United States Patent 9,567,581 (SELECTIVE REACTIVATION OF GENES ON THE INACTIVE X CHROMOSOME) - sequence listing, part 2

SEQ ID NO: 139 - DNA, 11576 bp, mus musculus
ggctgttgaggggcgtcttccaatctcgcacagctgcgttggctgtagaagagaacggacggcgatggcgacggtcgcagcaaatccagctgctgctgcggcggctgtggcggcggcagcggcggtgactgaggatagagagccacagcacgaggagctgccaggcctggacagccagtggcgccagatagaaaacggcgagagtgggcgagaacgtccactgcgggccggcgaaagctggtgaggctgggctgcggtggagcctcggcagagggaacggtgggggcattgacaaccgctggggattcggcggccgagggccgcgggaaagctgctgcggggtgcgggggcgggggagtggccggcgggacagcgggctaaaggggcggggaagtgcctttgaatgaatcgcaacgtctggaaaaggggcggggcctgtgtggtgcagtctgacgcctgagaacaaaatggggtttgttgtgatgagaccagtttcggtcctggaggtggggccgggcctgcgtagtgaaactgcgtaggaacctgggaagaaggtgggttctgctacataaggcgggggcgcggcctgcgctgcgtaatgcaacttttgggggcgaggagcggtttccgattgctccggggcggctgggaacgaggcgagctttgtgacgtcagcagaagagcgggatggagccgaacggtccgagggagggagcggggacctccgtgggggaggggggaggagcctggagcctgggaacgaggttaggttggtgacgtgagctgaggggcgtgctctgaggccgagggacgacagtggaggggaggtggtgcctatgaggcagaaaatggcgcctgcgaataagcaaagtttatgacgcgccgtggtttttgattctggcggaagccttcccgagtcgagagaacgtgcaggtgattagcaccggaggggccttccatgtttaattggttttctgtgttggtactgttttgtttttagaatcaagaaaaagtcgtttttttaaaaaatagaattttgataaatcggcttgttttactgatttcttgctaaacagtccttcttgaaatttactgcttctgagttcattttatttctcgccgagttgcatctcgttttttaattgtgaaatacgtaagacttaaaaagattatataaaacatttacgcagcccagattgacggacatcctgttaaaataaacggcctacactcttcaaaaatgtcaggatcatgaaagacaaaggctgaagaactgttccaaattgaaggaattaatgcaatttaacgagtcatgataactaaatgcaacatgtgatcctcgattggatcctggaacagaaaaaaaaattattttaaaaatcaattttttatcataagattatttttgtctcttttactgtaaaaggcaatggaaacgtcggtgaaattttattaaagtgggtagatactagtactactaataattgtgatcattgtggctgtgaaaaataatatccttgtttataggaaatactgaaaaatttagggataagaacgcatcgtgtaagcagtttattctcaaatgcctgaaaaattagcatatataaatttatatatggcgaggggaaataaaattggggagatgttggtcaaaggatacaacatttcagttagacaagaaaaataagttcagatctattgtacaactatagttaataaattcattgtatacttgaaaattactgagagaagattttacatgttctaccaccccccaaaaaataagtatgtgacgtaatggatgtgttaattgccttgacttagtcattccacaatgtatacataagtcaaaacttcatgctgtacactctaaatatatgcaatttttgtccattttaaaataaataaaaataccaaaaaatgcatgtaaagaaacaacgattgagcaaatgagtaaaatattagatttggagaatctggatgaaggacatatggggattctctgtattatttttgccatttttctcaatctatttcaaagtttaaaaattaaataataaataaaaacgtgtgaattcaccatccatgttaagattcagaacactgtcttaagaaatccttctgtgcccctcccagatggaaattcccctccttgctccatgggaaactgttatcctgaattttgagttaacagtctcttccttttctttaatgttttaccacagctgtatgcatccctaagcggtatgtattgtctaagctttcactttatacatatatggaatacatatatataaaattctactggatgcatactgtgagcccttatcttcgcatcgggtaatacatggtatccacatggcatcattggtgatgttaaccttgatcacttggttatggtagtgttggccagctttctcaactgtaaaggtaccattttcctctttacatatgcagtaattatttttaaaacatgtatcatgtccagccattcctcaaaatactcttaacagcttcccatctcttgcagcgtagatgctaaaatccttacaatgaattgcaagcctttatgaagctggtctcctgcttgcattctgatgtcttcccatatctctcctctgattacgcactccctccctgtctccatccaggccggccatattggactcttgctgttcctcaaacacatctaaccttagggctttttcgagtgaggtttactcactacagagttctttaataaccacaccagtgaaatgtgtatctctgttactggggagatgagttgagattttccaaatcgggaatacaaacccaagccgtgtttttctgccattacgtcacacttttccagcaagaaaaagcctcatttcatcctgagaataaacaaaataaccacagtgttttgtaactcatttgaagatgttcaaaagggccttgaggctttgatccttgcctcttcctacctttgtagccttgtgattgtgtcactggtaggacatgacatcctgtcatccttgataatacgctttaaaattaccccaccagtactgggttttcttttgggatgatgaaatattttggaactagggagaggttgtggttgtacaacattgtgaatgttctaaatgccgctgaattgttcactttaagatggttaatgttatgttatgtgaatttcacctcattaaaaaaattaccacaccagtgttggttcagtgttgaagccggtttgtctctgctgtcatgggtattatcatgaagcatttttgctaaactccactttgttaatgcttctctagtaagagcaaagcatctcaaggttctttattgctgtccattttccattttacaggggtttgcttaagtggccaggatatatgtgtttataaagcattttgaagtcatggactaaccccaaatcatatatcttgtatcagtattaatatttgcaccttctgtcttttgtcagctggcagatttgggtgagggtagttaattaatttggtcatcacaactgatttaatttctgggagaagcttgtattttaaggcaaattcaaatctgtaataatatagcctccttggaaattttcactttttccttttgtgggatgaaccatcttcaaacacaaatcagacacaagagaaaactagaagacagaaaataaagaattgtttagcaacttttttccataagcacatatttcatatcatttcaacaaatttgaggaagcacgaataaacctaagtgactttagcaagatcagttgtacctgtatatactggcagcaagaaactagaaaattaaaatttatgataccatttatgatagcatccaaaaaattgaatacccagctgtaaatataataatttgggtgttattgatacagaccatgacacctttgttgtgactgccacctggcctgacagagattgtgagacatcctgatttcagagatgttaacaatgatttttttaaagtgtctttgacttgaagcaatatggtaataattttctgtgaaaaattatgtaaaatgtcagtcctctatgaaatctatagaagttcagcctgtgaccaggtctggaagttttgcttaccactctacagcgtgattttaatgttattttttgttcaaaatctgctcttaaaaagaagttgagcagtgcctacctttgcattggaaggtactgttaactatagctttactgaacaaattaacttcatagactggctatggaggcaagtaaagccacaaagggtggatggtggtgtgtggggtgcagggttgggtctgagcattgagccaccggcacagaagggtttgtttccctggtgtgagtgatatggggcagggtctgtgggggtcagtgcagcaaaaaaacaaaaccaacaaaaaacccacagaaatgtttgcctatctaggtgacttgtgactattccaagatttgtctgtccctccatcctcccacctctctgatcctttcatgaacaagggaaagttgacattttaaagaatcacattgatgaggttaaattgggagaatcgcttgaacccggcaggcaaaggtcgcagtgagctgagattgtgccactgcactccagcctgggcgacagagcaagactctgtctcaaaaaatgataataataataatgaggttaaattgcttgaaaaccagccaatataatgttatgtgcatttcatcaaatttggttattttttaaaaagcatttatttgaggctgctcagtatttgggatagccttttatgtgtcagaaatgccacagcagaacaggtgtgtgtgtatgtgtgtgtgtgtgtgtgtgtgtgtgtgtgtgtgtgtgtgtttaggcaggaggaggtttatgtctgtgagcttttatgtccaagtcctgaagtccaagctgtcagaacaatgacagctaaaattcatttagcacttattatatgtcaagtattttccaaacttcaggatttctcacaaaggtagatttcaatatagttctaaatggttatccttgtagtacatataagtttcacctttaaaagagagctagttgaactgtatactgaaaaatgcttgatggtaagttttatgttacatgtttttatcacagtttttaagagaaccataagctcaggaatttactataaagccaaagtaaattctaaattaaaaaatgatgaacaatagcaatatgcagttcttttttttttttttttttttgagatggagtcactctgtcgcacaggctggagtgcagtgatgcagtctcggctcactgcaacctctgcctccagggttcaagtgattctcatgcctctgcctcccaagtagctgggattacaggcacgtgccagcacacctggctaatttgttgtattttttagtagagacggtttcaccatgtcagccaggctggtcttgaactcctgacctcaggtgatccacccgtcttgacctcccaaagtgctgggattactggcgtgagccactgtgcccggtcttttttttttttttttttttttttcagtatgcagtttttgaaggaaaaccttatgattctttttagcattttaaattctttgctccttttaaaagcagatttttcaccatttatcaaatctagttcttagctgaagaattatgcttccattgatagatcctttagaaacaaacacataatgaatggctaaagccttataaaattagctgcagatggcacatatcttgagcctaacttaactgggttatcccacagactaattcaaatgaatcatcttttattctataataaaacctcatgtttcctagcactataagtatggattttttgttggtttgtttgccattgttaaccacattttctgtttttaatcagatttcttttttaatactaagaagttatctaacatacaaatctgagtttcactgaataaattttgcttcgaatttatttttatatgatgctgaaacttttcatcttaaattataatgtgtcaatactttcagtctgttgggcatgggaagttgtatagctaaccctcagctacccatgtaacacccttgttacctgtctgggccccaggttccttgtggagaagcactggtataagcagtgggaggcatacgtgcagggaggggaccaggactccagcaccttccctggctgcatcaacaatgccacactctttcaaggtacaaggcctttgcctccttctcaccctagccctggagttcttgtcccttccgtccctacagatgatcataagcccattctgtgtgctaggtcactggtggggtggccagagtcattcgtcagtttcctttgttgattcttcctctgccacctccacccccgccccacagatgagataaactggcgcctcaaggagggactggtggaaggcgaggattatgtgctgctcccagcagctgcttggcattacctggtcagctggtatggtctagagcatggccagccacccattgaacgcaaggtataatggatggggagggtgcatggcggggagtgcgtagtaagaaagccttgtaggcccagcatgggtacagatccatgtatgctgggtaggtacacatatgtctgctctcttccccctcctagctcatcatacaggtatctttgtctgctgtgtgtgttcccctgtgtggctctctttacagaccattgtatatgtgtgtttgtatgctatgtttgtaaggcagagtgtgtgctcctctcatttgagaggtcacagcgctgtgtctgtgtgagtacacctgtgtctgcacccctctactcttacaggtcatagagctgcccaacatccagaaggtcgaagtgtacccagtagaactgctgcttgtccggcacaatgatttgggcaaatctcacactgttcagttcagccataccgattctattggtgagtctaagggtcacgcaatgggttggtgttcctagctactagtcccaactcagtgacttgaggttgcatagggttaagctgaagctgactgagaaggcactggtcagactttggaagacccagaaggcattggctaagttgggtggaggcactgaggggatctactagagccctgagggtatgtgagctacattctagtggcttacgtggtgtggcagaggatatttgctggagatctccagtctggagtgtgggccagtcatttggagactgattgaggacacaggtattggccaagcatgtgaggtccgtagggatgagtcaggtatgcccagatggattgatcattttgggtctcacaaagatcttgaatgtactccatcaccccgcacaggcctagtattgcgcacagctcgggagcggtttctggtggagccccaggaagacactcggctttgggccaagaactcagaaggctctttggataggttgtatgacacacacatcacggttctcgatgcggcccttgagactgggcaggtaagggtggggagggcttttctgttcaggtggactggcagatagactcacctggcagtactcgggggaaatgaaggctaggtacccataatgtcctccattaatacctttccttctttctctttctccaacccagttgatcatcatggagacccgcaagaaagatggcacttggcccagcgcacagctgcatgtcatgtgagcccttggggtatctggtccagagcgggggcgtcccacagtaggcaaaatgatttagcccatgagcacattgcacccccatgcagcaggccctcagctgacagtttctcatctaaccccaggaacaacaacatgtcggaagaggatgaggacttcaagggtcagccaggcatctgtggcctcaccaatctgggcaacacgtgcttcatgaactcggccctgcaggttgggccattatagttgtgtctggcacagccacgtggttgggcttcaagagctgaggattggggacagagctggggtcctgaggggactacagggcaaggggtcaggatgaaagctgaggccccacaagtctgaagtggcacgcccacgttcattcctgaactatcagcctcttctctcagcttgccctcattttccctcttctcttccctgttcccacgttcttccttctcgtgaaatcctaatgccttctctcccctactctcctgctcctctctctcctcccttccccttctctcttgttttcctctctctttcctcctggcttctttttgtgtatcctcactttgaaccttctgtctcccctctgcctcattcacctggtctctggcctctgcagtgcctcagcaatgtgccacagctcaccgagtacttcctcaacaactgctacctggaggagctcaacttccgcaacccactgggcatgaagggtgagatcgcagaggcctatgcagacctggtgaagcaggcgtggtctggccaccaccgctccattgtgccacatgtgttcaaggtgtgactcaaccctgggcacccccgaccccctacgtctcttggctctcctaactccctctctctctgatgaccctgcccatcttcttagaacaaggttggccattttgcatcccaatttctgggctaccagcagcatgactctcaggagctgctgtcattcctcctggacgggctgcatgaggaccttaatcgggtgaagaagaaggagtatgtggagctgtgcgatgctgctgggcgaccggatcaggtaggctgcccccgcatttgcagtccaattaacatcaccaaggcctctgcctcggggattttctggcctccctggggtatctaacacgccaccattttctgttaagtttctctacctgacctcaactccagccttactcttaaccttagttgcaataccatatctgcccccacagtcaacccagagtaaaccccagcgcagtctcctgccctaaatgacccccagtcttgaccgtgaacatagtctctgtgtatccctagctggagctctgcctctggactttagcagtggccttccgcttcaccccatttgaatgcaccccaagccatggtttcctcttaccctgggcaagccccaccacccaccatgacactatcaacaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttccactgcctatcagccacaagagggtcttggaggtcttctttatccccatggatccgcgccgcaagccagagcaggtgtggggcagtgggggcctggggagatgatgatggacacatagagtttgattagctgccatagctcaaggcttcttgcattaactcaccacaagcccttttggtcttttgtggataccgtttttcccttagcaccggctcgtggtccccaagaaaggcaagatctcggatctatgtgtggctctgtccaaacacacgggcatctcgccagagagggtgagactgcagaaggaggctggatgggattccagggcaaggaggcagaagggcctgggaggccgtgcagactaacagtcccctctccatatcccattcctagatgatggtggctgatgtcttcagtcaccgcttctataagctctatcagctagaggagcctctgagcagcatcttggaccgtgatgatatcttcgtgtgagtggggatggcagggaggtggtggttcctcaggaacttggtccacttccttttgtatggtcctgccttaaccaccttctctcttccctgcctctgcctcgttcactgggcacctgccctgcgcagagcttcagccacatgccttgggaggctgaggcaggagaatcacttgaacccgagaggttcaagtgagccaagatcacgccactgcactccagtctgggcgacagggcaaaactccatctcaaaaataaataaagccgggcgcggtggctcacgcctgtaatcccagcactttgggaggctgaagcaggcagatcacgaggtcaggagatggagaccatcctggctaacacggtgaaaccccgtctctactaaaaatacaaaaaattagccgggcgtggtggcaggtgcctgtagtcccagctactcgggaggctgaggcaggagaatggcatgaacccgggaggcggagcttgcagtgagccgagatcgtgccactgcactgcagcctgggcaacagagcgagactccgtctcaaaaataaataaataaataaataaaaataaaaatgccttcaggctgtgaggatgagtgggtggggcagccagggcagagtcagggagtctctgggggccctgatcaggtgtgcctgctgtccaccccccacagctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcgtaagtgtcctcttccccgggggtggggggcggaggggtctgaactccgacttgggtgtttagctgcttatttgacacctcccctgtaacaaacaaaagacagtccaaacttaacatggccatagaagaacttgtagggttttttctttctctagacctctggctttgctactgcctgtcttgggtgctagggatacagaggtgaacaagatgcacaaaacagacaacttcatcttgtcttcagttgtctctcctggagactgttgtccctcctgggagagtcttggtttttttgtctttttgctgacaaattttcattttgcctaaaatctagagtctttactgtggcacacaaagcattgtgttatcagaattctcccccctcattttgcattcaaaagtcattccccagaggctttccctgatgggaagttacagccggtatgtgtcttgtctagcagtggcttattagagtaaaagtccacgctccatacctttttttttttttttttttgagatggagtcttgctctgttgcccaggctggagtgtagtgacatgatcttggctcactgcaacctccatctcccggattcaagcgattctcctgcctcagcctcccaaatagctgcaattacagccgcgcgccaccacgcccagctaatcacactccacacctctgactgggacacaagttccttcattctcaggccactgctgacagccttggcctcttcatgcatttacgcgtcaccccttcagccctctcacacctcagattcagaacggtttacatgtggatctaccaatggcttcccattatcttaagtaaaatcccgggctctatccccactgtccttgtacccgtcttgggagtctcctctgctctgttgcagacgctacgtgaccaaacccaactcagatgatgaggacgatggggatgagaaaggtgag

SEQ ID NO: 140 - DNA, 292 bp, mus musculus
cccgcgggagccggggcccagaaacccgcccgggcagcggtaactggaacggagccctcaggcctgagccggctgggctgcgcgagcaggaagcggggtccctgggcccctttgtgtgaagggcgggggaggagtgccgggcagccccgggctgcgggctcctccgacgtccgcctcgccgcagggtcccctcgccgcagcccccaccctttccctcccgggggcacgcgcctcctcgccaccctcgccgggcttttcccaggctcgccctcctccccacgccccctgctcg

SEQ ID NO: 141 - DNA, 348 bp, mus musculus
ggggcccagggaccccgcttcctgctcgcgcagcccagccggctcaggcctgagggctccgttccagttaccgctgcccgggcgggtttctgggccccggctcccgcgggggtcgtccggcctgtgaaggggagaaggacgcacattacccggctgacccccgccccgaacctgcggcgccggccgccgcctcccccaactcccacccggatcaagctactgccgcttaccccgccgtccgcacccgcccggccgccggggaggctctgtcacgccaaggccatggccacccgctggctcctctgtctctccgctgccccagcgctgctgctcgccgcggggaaagaa

SEQ ID NO: 142 - DNA, 40544 bp, mus musculus
gggcgtggcggggcgggcagagggcggggcctgcttctcctcagcttcaggcggctgcgacgagccctcaggcgaacctctcggctttcccgcgcggcgccgcctcttgctgcgcctccgcctcctcctctgctccgccaccggcttcctcctcctgagcagtcagcccgcgcgccggccggctccgttatggcgacccgcagccctggcgtcgtggtgagcagctcggcctgccggccctggccggttcaggcccacgcggcaggtggcggccgggccctgaggcgcgggatccgcagtgcgggctcgggcggccgggcccagggaaccccgcaggcgggggcggccagtttcccgggttcggctttacgtcacgcgagggcggcagggaggacggaatggcggggtttggggtgggtccctcctcgggggagccctgggaaaagaggactgcgtgtgggaagagaaggtggaaatggcgttttggttgacatgtgccgcctgcgagcgtgctgcggggaggggccgagggcagattcgggaatgatggcgcggggtgggggcgtgggggctttctcgggagaggcccttccctggaagtttggggtgcgatggtgaggttctcggggcacctctggaggggcctcggcacggaaagcgaccacctgggagggcgtgtggggaccaggttttgcctttagttttgcacacactgtagttcatctttatggagatgctcatggcctcattgaagccccactacagctctggtagcggtaaccatgcgtatttgacacacgaaggaactagggaaaaggcattaggtcatttcaagccgaaattcacatgtgctagaatccagattccatgctgaccgatgccccaggatatagaaaatgagaatctggtccttaccttcaagaacattcttaaccgtaatcagcctctggtatcttagctccaccctcactggttttttcttgtttgttgaaccggccaagctgctggcctccctcctcaaccgttctgatcatgcttgctaaaatagtcaaaaccccggccagttaaatatgctttagcctgctttattatgattatttttgttgttttggcaatgacctggttacctgttgtttctcccactaaaactttttaagggcaggaatcaccgccgtaactctagcacttagcacagtacttggcttgtaagaggtcctcgatgatggtttgttgaatgaatacattaaataattaaccacttgaaccctaagaaagaagcgattctatttcatattaggcattgtaatgacttaaggtaaagagcagtgctattaacggagtctaactgggaatccagcttgtttgggctatttactagttgtgtggctgtgggcaacttacttcacctctctgggcttaagtcattttatgtatatctgaggtgctggctacctcttggagttattgagaggattataagacagtctatgtgaatcagcaacccttgcatggcccctggcggggaacagtaataatagccatcatcatgtttacttacatagtcctaattagtcttcaaaacagccctgtagcaatggtatgattattaccattttacagatgaggaacctttgaagcctcagagaggctaacagacataccctaggtcatacagttattaagagaaggagctctgtctcgaacctagctctctctctctcgagtaataccagttaaaaaataggctacaaataggtactcaaaaaaatggtagtggctgttgtttttattcagttgctgaggaaaaaatgttgatttttcatctctaaacatcaacttacttaattctgccaatttcttttttttgagacagggtctcactctgtcacctaggatggagtgcagtggcacaatcactgctcactgcagcctcgacttcccgggctcgggtgattctccccaggctcaggggattctcccacttcagcctcccaagtagctgggactacaggtgcgcaccaccatccctggctaatatttgtactttattttatttatttatttatttattttttgagatggagtttcgctcttgttgcccgggctggagtacagtggcatgatctcggctcagtgcaacctctgcctcccgggttcaagcgattctcctacctcatccccctgagtagctgggattacaggcgcctgccaccatgcctggctaattttttgtatttttaatagagacgaggtttcaccatgttggccaggctactctcgaactcctgatctcaggtgatccacccgccttggcctcccaaagtgctgggattacaggcgtgagccactgcgcccggcctaatatttgtattttttgtagagatggtgttttgccatgttgtccaggctggtcttgaactcctgagctcaagcgatctgcccgcctctgcttcccaaagtgctgggattacaggcatgagccaccgtgcctggcctaggtagacgcttttagctttggggtgtgatgcctgccccagtatatagtgaatttaattattgctagagctggctgtttgttagttttctttgaacataagatactcattgtttttagtttgcaaatccctcttcctttttaaaaaatttctttcccttaaattgtttgcatgttagcaataacaaatgcttaaatggtgctatgtgctagatactcttctaagccctgttatgtatattaactaattttttaaattacacaaatcagagaggttaagtaacttgcccaagattacccaacaatactaggatttgaacctaagtttgtctcaccccagattctgctcttaatctctaaacttttaagttagtagtgacaatagtaggtatttattgaatacttaactatgttttaggcgttgaagtaaatattttgcaggcattatctaatgtaaacaccctaaagttacataacaggtaccctttaggtaaataaacactagtatgaccttggaggcacagatagttgaagtaacttgcccaatatcacttacatgaaattggccctcaaatgtgtctgatacaacccatgctgcttgtaactatcgttttaaactgccagggtaaacttggacacacttgagctaagaaaaagcttttagatttttgcaaattaatgtgaaagatatgctttatgtggatataatatcttctaaatttcggggatggtagtcctagaaatgtaatcctgccctagccgagcttaccctgccaataattttttacagaattggtaaaacggagcaccttttttttgtccttggccacactgttatcaacagggtgtagattgacatcaatctgtaggtgtaaaccagaattactctttgtgaccaccaggaaatagagcagttcagttcaggggtttctttctgtgaatttagcactgtgacctgcatactacaagtctactttgttttctatccattgtttgtatctgggtattgcaaaaggtaggaaaaggaccaaccagatcagcagagaagagttgccttggagttttcttttagttttctgcagttcattagatagtaactaggccatgtcattttactcccttgtagtgaagatatgttgaagttgtactggtatactcttctacctttctgtaattttatattgtgtagacttgataaaatttatgtgtcaatcaccaccattaatatcaatattgagcctcaattcttatttttctgcccagtggctgccaaattactaacatttacaataattcactactactaagataatctactagttcgatcacatacttcaaattgttatggaactactgtcttcagcattgtgcttctgataactgataagtataattttttttttgtccagagtgaacatgtctattcttccactgtacacactaataaaaggaaaaattgtaatattgggtaaattcatgtccttacacatgtagtagttatgagcccatgtccctagaatgagtaataatttatccctcccttggttgaatagtcaagaatgctgattttaattcttctaacagctttatccctcagaagggaaggcaagcaagttatatatgtagtttatttgtaagactgatatgaaattggaagatgaatctactattagctttaattatttttacatttaggaatattgcatcagtaactcataattttggttttctgttatcctgagttaacacaaattatccaaggagatggcggatcatctgctttgaggtgtttttttttgagaattttaatgtatctgaatataaaaggtaaaaatatgccaactagcaatttctgcccattccagaagtttggaaatattactcattactaggaattaaataaaatatggtttatctattgttatacctcttttaattcacatagctcatttttatcttttatttttgtttgttttttttgagatggagtcttgctctgtcaccaggcaggagtgcagtgatgcaatctcggctcactctagccaccgactccctggttcaagcgattctcctgcctgagccttctgagtagctgggattacaggcaggcaccaccacgcccagctaatttttgtagagacaggatttcaccgtgttggccaggatggtctccatctcctgacctcatgatctgcctgcttcggcctcccaaagtgctgggattacaggtgggagccactacgcctggcccacatagctcatttttagactcacttccattaagtcttgtttggacccacgaacattgtctttttttttttaagatggagtttcacttttgttgcccagactgtagtgcaatggtgcaatctcagctcactgcaatctctgcctcctgggttctagcaattctcctgcctcagcctcccgagtagctggaattacaggcgcccgccaccacgcccagctaatttttgtgtttttagtagagacggggtttcaccatgttgggcaggccaggggtgatccgcccacctcagcctcccaaagtgctgggattacaggtgtgagccaccgcatctggccaacatgtcttttttttttttttcctttttaaccacaaagagacttaagcagtccttgtcacagatgatgaattgatgttgcaagtattgtcttagcttggattaattttcttgcttactgtaattttagataatatagctttgtaattagagattttatgtgtaaaccacaaaaatgtttacatgaaggccattattacagatgtgacgtgcataattattagtaatttgtatgtttacatgggtcagtctggcaaaaaattatgaagttttaaaaattaaaaaaaattataatgccagttttactggaaagtaaaattatttcagtaatcgattatagcaaaagtattgattttcattccagacaaaagtcagaatgaaaggtaatttctcaatactctttcagattaataaaagtacctgtagcgatttttatcattcacaagtatatcacaagtaagttagaatttgagaactgtgttctagatctctgaggagatgcagtcagatttctgaactgtctcagcaaatggtaagtaacttagagctagtaattaataacctgtcctttgatttctgattcagccaagaatggccatatttgggaaaggcagatctggagagtaaccacgttttcattcatttaccacttctaggcccctccagagctctcagatattttggggttgagcccttccccaaagccatacaggaccttttttttgtgatctgttctagccatttttatgttgggtgcttgttatggactgagcatttatgtcctcccacaccccccccataccttttttgaagtcctaacccccagtgtgatggtatttggagacagggcctttggaaggtaattacagttagaagaagtcgggagggttgggcccaggtctgattggattagtgcccttatatgaaaagacaccaggacgggcgcagtggctcacacctgtaatcccagcactttgggaggccaaggtgggtggatcacgaggtcaggagtttgagaccagcctggccaatgtagtgaaacaccatctctactaaaaatacaaaaattagctgggtgtggtagcgggctcctgtcatccaagctactcgggagggtgaggcatgagaatcacttgaacccgggagttggaggttgcagtgagcccagattgtgccactgtactccagcctgggtgacagagtgagactctgtctcaaaaaagaaaaaaaaaaaaaaagagacaccagagagcttgttagaagaggtcatgtgagcacacagttagaagaccttcaagccaaagaagaggcctgagattgaaacctaccttgcaggtaccttaattttggacttcccagcctccaaaactgtgagaaataagtttctgttaagtcactcagtctgtggtattttgttatggcagcctgagcaggtagttgttctttcagaaggtgttgataataaccacatgcaacaccaagtcacaaataataaaacagatgtaacttatattcatacagaaagttgggcactgccattgccttgttggtttacacggctgtgctagttcagtagcagaaaggtgctggtctcctttactcagtttacaatctaggcagtagaatgtaatcactgctttaaacttgatactgcttagggagagaatcattggtgctgggtaactttgggttctaggtttactttttgtgtatatataactgtttttggtaaatcacaagtttctgggcttgtcgaattagattttgttacagattatgagctttattatgctatacagttagttgtatgtatatatgcctttcccactagattttaagctttttttttttttttttttttgtgacggagtcttgctcttgtcgcccaggctgaagtggagtgcagtggcacaatctcggctcactgcagcctccacctcctaggttcaagcgattctcctgcctcggcctcccaagtaactgggactacaggcacgtgccaccacacccggctaatttttgtattttttgtagagacagggtttcgccatgttggctaggctggtcttgaacttctggcctcaggtgatccacccgcctcagcctcccaaagtgctgggatttacaggcatgagccaccacgcccagctataagctctttaagggttgtaaatttataatcattcttttactctcctgcaaattctgttgcacactgccttaatcaaggtagatgctgaatgcatttttgtataattgaatatgttgcaatccccaactctctccaactgttcctgtcaaagcagccactggattgttaactaatccatattagatggggttaattaatatcagatgggacaagtaagggctaataagattataggccaccaagtagatttctgtctagctcttatagagattgagtttattggacctgtttgataggaagttttggtgtttgggatgattaaaactgaagttcctatttattgaattatacctatttatattatttcatatcagtggtccacatgcaagtgaggcttctgagacagagtttgagttctctcttcaactaccataacacttaacctgtatctttttttttttttttttttttagacggagtctcgctctgtcactcaggctggagtgtagtggtatgatctcggctcactgtaacctctgcctcctggattcaagcagttctccatgtctcagcctccctagtagctgggattacaggcctgtgccaccatgcctggctaattttttttttgtatttttagtagagacggggttttaccacgttggccaggctggtctcgaactcttgacctcgagcgatcaacttgccttggcctcccaaagtgctgggattacaggcatgagccacagcgcccagccgtctttttttttaaatagcaatttaacactgttcacagttactcatgtacatgtcatgccatctattacactgtaagttctgtgagggtagctgtatcaaatttatctaactctctctagtatgcatgacatagtaagtattcaataaatatttgcatattagtgataaggatacaggttctgaatagtgggtccttaccatttaagaattagtatttgatggccgggcggggtggctcacgcctgtaatcccagcactttgggaggctgaggcgggcggatcatgagatcaggagatcgagaccatcctggctaacatggtgaaatcccgtctttacaaaaaaaatacaaaagaattaaccaagtgtggtggtgggtgcctgtagtcccagctactgctttgtgaggctgaggcaggcagatcacctgaggtgggaaattcaagaccagcctgaccaacatggagaaaccccatctctactaaaaatacaaaattagccgggcgtggtggcgcatgtctgtaatcccagctactcgggaggctgaggcaggagaatggcgtgaacccgggaggcggagcttgcagtgagccaggatcgcgccactgcactccagcctgggcgacagagcgagactccgtctcaaaaaaaaaaaaaaaaaaaaaattagtatttgatatttgatcattaaatatgaattaagaggacttagactttttgttaaatgtcaagctgggaaaagttgtcatttaaatgaattgcctcttatttaatttcgtctgatgatacattttgtttttattttgtaaaaaattattttttttctttttggagacagggtcttgctctgttgcccaggctggtcacaaactcctgacctcaagcaatcctcctgccttagcctcccaaaatgctgggattacaggcgtgagccacctcgcccggccttgtattatgatacattttgaacaactacaagtagacttggtataatgaacctgcacgtacccattgccaagttctgacaactgtctgtctatagccaattatgcatttcttaaattagaacccccccaatatacccaaatatatatatatgtgtgcatatatatagtaagttgtaacaaagttgtgaattcatacctgaagtatctcaagtgatgcaagttttatgaatttttgtttatgccttttgggaagagttgtattgacaaattttttatgcttaaagtaaaccataaatcaaaaaaataaaatctaggatgcaataaaacaaaacaacttcttgacataagtatggtatgtaaatctgttttgattggaaatcaatttgttatattgccagaattcctgttttagaatacatctctgctgatctgtctgtattcttagactgcatatctgggatgaactctgggcagaattcacatgggcttcctttgaaataaacaagacttttcaaattcttagtcgatctgcagaacctgtagccaggcactgaaccattttgatagatgcagtaatcgttgcaagtgtatatttcaaggagttctggctgggtcctagtttatgcttgtggcagaagcagtgagtaactgggaggaagttggtgagtaagcttcaaggaagaagtcatttttagtactctggatcttcctgattttaaagcactacaaaatggtgcattttcattcttgtcaagtgataacagatatattctgatgagcctgaaatgaatatatattgtatcatttttataatatctagcaaggtttgtattttcctagaacttgaactaaatttcagttcataaaatttataaaatacttagttgttgtaaaatatttttggaatgttcacataggtgacacacaaatgtcccattttcattctttctatagtaaatatgttctgatatgtgaaggtttagcagatgcatcagcatttaatcctagaggatctggcataatcttttcccccaagaatagaaattttttctgcttatgaaagtagtacatgtttctttaaaaacaaatcaatattgacttctgcctgctgtatagcactatgcctccacctggccatgaccaggggcatgtcctggtccacctacctgaaaatgtttgcaaccagcctcctggccatgtgcacaggggctgaagttgtcccacaggtattacgggccaacctgacaatacatgaagttccaccaaagtctgagaactcagaactgagctttggggactgaaagacagcacaaacctcaaatttctcagcactggaaacctcaaaatataactgaattccataaataagattttaagtcttaaatatgtatttttaaatgtattaaaagtcaagctgcttgtatttaagcacctaatacaatgcttaggttgtaaaaggagatgctcaataggtactaactgatatattgagatttaattatggtttgaccaatatttattggaaaccgccaaagcttaaatcatcagcttcttgaatgtgatttgaaaggtaatttagtattgaatagcatgtgagctagagtatttcattctttctggtttatttcttcaaatagactttgaatataatggtgaatgggtattataaattaactaataaaaatgacattgaaaatgaaaaaatatatatattaaagtgtagaaagtgaccaggcgtggtggctcacacctgtaatccaagcaccttgggaggctgaggcaggaggatctcttgatcccaggagttcaagaccagcctgggcaacatagcgagacttcgtctctaaaaaaaaaaaagagagagaaaaaaattttttttatttaaaaaaagtgtagaaagtgtcaagaccccacttcttaccattatttggtatatttctctatacccacccacccttcctccttactccctccctcccttcccaatctttttatctttttgtattctgattttttgtttgtatattttgctttaatttaatgtatcctttaaaaatttcccatacattttatatgtatatataaaaacgcatgctgccaaagataatttataagaaagaccattgaatttttttaaaagtgatatatattcattgaaaaaaatttagaatatatagcaaagcaataaagaactaaataaaattgctgtaactcctctttcaaagataagtgcttttatgattttgttgtatttttttctgtatataggtacatatatagtatttataaagctgtactcatagtacattttcacatcacaggtaccatatcagtgttattaaatattttgtatgccaggggctagacataccaagacaaccaatatgtggttctacttaaataatattagagtatcttttatgatgacacttcatgagttgactataataatcttagacttctaagagtttgggttttcaaaagatcacttagcttttttgggtgatttttcccccttactgtgagatgagagaggctgtttggatttgggattggggtagcggggacagcaacttttcttttctttttcttttttattttgaggtagggtattgctgtgtcacccaggctggagtgcagtggtgtgatctcggctcactgcaacctccacctcccgggctcaggtgatcctcctgcttcagcctccccagtaactgggactacaggcgcgtgccacatgcctggctaattttgtatttttagtagagatggggtttcaccatgttggccaggctggtctctaactcctgacctcaggtgatacgcccacctgggcctcccaaaatactgggattacaggcatgagccgctgcatcagccagcagtttttcttgtggttttttttgtttgttttgttttgttttgtttttgagatagggtcttactctgttgtccacgctggagtgctgtggtatgatcgtagctcactgcagcctcaaactcctgggctcaagtgattccttctgcctccgcctcccgagtagctgggactacaggtatgcaccaccatacctggcaaatttttacaaagttttttgtagggacggggtcttgctacattccccatgtcggtcttgaactcctggcctcaagcaactctcctgtctcagcctcccaaagcactgggattacaagtgtgagccaccacaccatgccagtttttcctgttcagtgtgatattttatcttgttagactacagtgtgttaaaacttgttttactaaattttcaaacatactcaaaagtggagagaatagtataatgaatacccgtatgttcatcacccatgtttagaatattattaaatataaagattttgctgcgtttgtcttagctctttaaaatttttctttttctctttgtgacctaaaggaaattccatatcttatcactttacttctacattcttgactaagatgactaagacatatagttacatggttttttgttttgttttttgttttttaaagacgaaatctcgctcttgtcccccaggctggagtgcaatggtgccatctcagctcagtgcaacctctgccttctgggtacaagcgattctcctgcctcagcctcccaagtagctgggattacaggctcctgccaccacgcctggctaatttttgtatttttagtagagacggcggggggaggtttcaccatgttgacaaggctggtctggaactcctgacctcaggtgatccacccgcctcggcctcccaaagtgctgggattacaggcgtgagccaccgcgcccagcctgtttttttgtttgtttgttttgttttttttgagacagagtcttgctctgtttcccaggctggagtgaagtggcgcattcttggctcactgcaaccttcacctcccaggttcaagtgattctcctgcctcagcctcccaagtagctgggactacaggcatgtgtcaccacacccggctaatttttttgtatttttagtagagacgggatttcaccgtgttgcccaggctggtctcgaactcctgagctcaggcagtctgcctgcctcagcctcccaaagtgctgggattacacgtgtgaaccaacccgcccggcctgttgttttcttacataattcattatcatacctacaaagttaacagttactaatatcatcttacacctaaatttctctgatagactaaggttattttttaacatcttaatccaatcaaatgtttgtatcctgtaatgctctcattgaaacagctatatttctttttcagattagtgatgatgaaccaggttatgaccttgatttattttgcatacctaatcattatgctgaggatttggaaagggtgtttattcctcatggactaattatggacaggtaagtaagatcttaaaatgaggttttttactttttcttgtgttaatttcaaacatcagcagctgttctgagtacttgctatttgaacataaactaggccaacttattaaataactgatgctttctaaaatcttctttattaaaaataaaagaggagggccttactaattacttagtatcagttgtggtatagtgggactctgtagggaccagaacaaagtaaacattgaagggagatggaagaaggaactctagccagagtcttgcatttctcagtcctaaacagggtaatggactggggctgaatcacatgaaggcaaggtcagatttttattattatgcacatctagcttgaaaattttctgttaagtcaattacagtgaaaaaccttacctggtattgaatgcttgcattgtatgtctggctattctgtgtttttattttaaaattataatatcaaaatatttgtgttataaaatattctaactatggaggccataaacaagaagactaaagttctctcctttcagccttctgtacacatttcttctcaagcactggctatgcatgtatactatatgcaaaagtacatatatacatttatattttaacgtatgagtatagttttaaatgttattggacacttttaatattagtgtgtctagagctatctaatatattttaaaggttgcatagcattctgtcttatggagataccataactgatttaaccagtccactattgatagacactattttgttcttaccgactgtactagaagaaacattcttttacatgtttggtacttgttcagctttattcaagtggaatttctgggtcaaggggaaagagtttattgaatattttggtattgccaaattttcctctaagaagttgaatcattttatactcctgatgttatatgagagtacctttctcttcacaatttgtctcttttttttttttttttgagacaaggtctctgttgcccaggctggggtgcagtgcagcagaatgatcacagttcactgcagtctcaacctcctgggttcaagcgatccttccacctcagcctcctgagtagctgggactataggtgtgcgccaccactcccagctaatatttttattttgtagaaacagggttcgccatgttacccagcctcccaaagtgctgggattacaggcatgagccactggcccagtttctacagtctctcttaatattgtatattatccaagaaatttcatttaatcagaacctgccagtctgataggtgaaaatggtatcttgtttttatttgcatttaaaaaaaattatgatagtggtatgcttggtttttttgaaggtatcaaattttttaccttatgaaacatgagggcaaaggatgtgttacgtggaagatttaaaaaaaatttttaatgcatttttttgagacaaggtcttgctctattgtccaggctggagtgcagtggcacaatcacagttcactccagcctcaacatcctgcactaaagtgattttcccacctcacctctcaagtagctgggactacaggtacatgctaccatgcctggctaatttttttttttttgcaggcatggggtctcactgtattgcccaggttggtgtggaagtttaatgactaagaggtgtttgttataaagtttaatgtatgaaactttctattaaattcctgattttatttctgtaggactgaacgtcttgctcgagatgtgatgaaggagatgggaggccatcacattgtagccctctgtgtgctcaaggggggctataaattctttgctgacctgctggattacatcaaagcactgaatagaaatagtgatagatccattcctatgactgtagattttatcagactgaagagctattgtgtgagtatatttaatatatgattctttttagtggcaacagtaggttttcttatattttctttgaatctctgcaaaccatacttgctttcatttcacttggttacagtgagatttttctaacatattcactagtactttacatcaaagccaatactgtttttttaaaactagtcaccttggaggatatatacttattttacaggtgtgtgtggttttttaaataaactccttttaggaattgctgttgggacttgggatacttttttcactatacatactggtgacagataccctctcttgagctacatcggtttgtggggagtcaaaagtcctttggagctaggtttgacaaataaggtgggttaacacttgtttcctagaaagcacatggagagctagagtattggcgaattgaagaaatccccctttttttttaacacacttaagaaaggggactgcaggtatactcaagagagtaagtcgcaccagaaaccacttttgatccacagtctgcctgtgtcacacaattgaaatgcatcacaacattgacactgtggatgaaacaaaatcagtgtgaattttagtagtgaatttcattcataatttgatcgtgcaaacgtttgatttttattactttagactattgtttctgattttatgttgggttggtatttcctgtgagttactgttttcctttaaaataggaatttttcatactcttcaaagattagaacaaatgtccagtttttgctgtttcatgaatgagtcctgtccatctttgtagaaactcgccttatgttcacatttttattgagaataagaccacttatctacatttaactatcaacctcatcctctccattaatcatctattttagtgacccaagtttttgaccttttccatgtttacatcaatcctgtaggtgattgggcagccatttaagtattattatagacattttcactatcccattaaaaccctttatgcccatacatcataacactacttcctacccataagctccttttaacttgttaaagtcttgcttgaattaaagacttgtttaaacacaaaatttagacttttactcaacaaaagtgattgattgattgattgattgattgatggtttacagtaggacttcattctagtcattatagctgctggcagtataactggccagcctttaatacattgctgcttagagtcaaagcatgtacttagagttggtatgatttatctttttggtcttctatagcctccttccccatccccatcagtcttaatcagtcttgttacgttatgactaatctttggggatttgtgcagaatgttattttagataagcaaaaacgagcaaaataggggagtttaactttaatattttcttttaaaaagcatttcatgttataagatcaattctgagtggtagaaatgctttgacattttatttccattttctacttttagtttttttcctatttgtttaagatcttagaggattattaagctgaactcctcaactgataaaaagcatgacatcttaaacataagcaaagcatatttttaggttaattttcacatagaaaacagtttattttatgtgaaattctatgtagatatactatttttttggtatttattgatatgtttattttattttattttattttattttattttattttattttatttatttatttttttttttgagacagagtctcactctgttgcccaggctggagtgcagtggcatgatcgtagctcactgcaacctccacctcccgggttcaagcaattcttctgtctcagcctcccgagtagctgggactacaggtgcctgccactatgcccggctaatttttgtgtttttagtagagatggggtttcaccttgttggtcaggctggtctcgaacccctgacctcaggtgatccacccacctcagcctcccaaagtgctgggattataggcatgagccaccgtgcccggccgacatgttaattttttaaaaaaggctttactggggtatattttatataatataataatcacatgttttaactatacaattccaagctttttagtatatttatagggctatgcaaggaagatatactgttaaacagtagaaattgagaaagctcttctgataatatctcttgatttgatgatggctcatgcctgtaatctcagtgctttggaaggccaagacagcagaatcacttgaggccaggggttcgagaccagcctgggcaacacagcaataccctatctttacaaataataaaaatatctgttgatttgaagtaaagtttttttttaaagacaaggtctcattctgtcacccaggctggaatgcagtagcaagatcacagctcactgtggccttgaccttctgggctcaagtgattctcccacttcggcctcccgagtagctgggactaacaggtgtgcaccaccatggctggctaatttttttttatgtttgtagagattgggtcttactgtgttgcccaggctgatcccgaactcctgggctcaagcagtcttcctgcctcagcctctaaaattgctgggattacaggcttgagtcaccatgcccagcctgaagtagcatttctaccctgtttaataattcagcagcttgtcatgtaagatattcatatatgcatataaaacattaggcagcttaatttggtaaaactgtaaaatggaaattttaaattgtttgcagcatcaataacattgatgtcagtatgatttttacatgctgatcttgaccaatttgaaacagtgagttaaaatctggctgatccgtactaatcctaaagaaatattctatgaactattaaatgtttccagaatatataaagaaacattatgatgtcaacacacccatctatttttttttggaaataaaaactccatttttcttattaaagaaaacatgcttattagaaaacatacggctgggtgcagtggcacacatgtaattccagtgctttgggagatcgaggtgggagaatcacttgaggccaggagtttgagaccagcctagacaacataatgagaccccctctctacacaaaaagaattagttgtgcatggtggcgtgcacctgtagtcccagctacttgggaggcagaggcaggagcatcccttgagcctaggagtttgagactgcaggagttcgagactgagtggaatgcagtggaactgcattccagcctgagtgacagagggagaccctgtcttaaaaaaataagaaagaaaacacaactgcagaaaattataaaggatttaagtcattccaaatatcactgccactttttatttagaatattctaaagaattctctctctgtgtacacacacacatatgcgtactcttaatccaagtagcttggtaggattttatttacctagtgcctagatgggaaattgcctggggattccaaatacctatttcattaaattaaagatgtcactgattttaagacttaacactatttttcatactgccaagaaagaaaacactaccagttataaatgtaaattgccatcaattgtaatacatcaattttagagctattattaataaaatgtgaatgtgcatcttagagcaatgaaatatagtactatatatttgatgaccttttctgccctgtgatattcagaaagtgaaagttaaatatgggctgagcatggtggctcacacctgtaatcccagtactttgggaagtcaagacgggaggctggcttgaacccaggagttcaagaccagcctaggcaatgtagcgagacgccatctcaaaatattaaaaataagtaaataagtaaataaaaagaaggttaagtatacaaatgtatttcctttgttgtgaatttatttcaattttatagtgattttttttttttgagacgaagtctcactcttgtcccccaggctggagtgcgatggcgtgatctcagctcactgcaacctctgcctcccaggttcaagctatactcctgccttggccccccgagtagctgggattacaggcgcctgctaccatgcctggctaatttttgtatttttagttgagatggggtttcaccatgttggccaggctggtctagaactcttgacctctggtgatccacccgcctcggactcccaaaatgctgggattacaggcgtgagccaccgtgcctggccagtggttttttgttgttgttgttgttgttgttttgtttttgtttttgtttttgttttgagacaggatcttgctctgtcacccaggctggagtgcagtggtgccatcttggttcactgcaacctctgcgtgggctcaagcaatcctcccacctccctttccagagtagcggggaccacaggtgtgtgccaccacacctgactaatttttgcatttttttttgtagaaacagggttttgccatgttgcccaggttggtctgaaactcctgagctcaaacaatccaactgccttggcttccctaagtgaaattacaggcatgggccactgtacccagtctagtgatttttttatttttatttttattttattttattttatttttttaccaaaaaaacaacaaagcctcaggaggaaaagttgatacacaagtaaattttattggaaatgtttttgtgtggaccttaagcagagggaaaattagtctgcattatggtgtatccagactaaatgactgatattaaaatgaaattattcttaggatttgcaatcttagagaaaactttttcatttttatttttttgagttacaaattatcttcatttacatttgagaacagtgagtcacagagggattaagtaacttactcaagatcatacaagtctttgatttgaacccaatcttttaactctgcagaactcagagtcactcttatttggaaaaactttttaactgatgtggatcctctaatatgggcttcctattattcattctctattagtcagaagttttgcaagcagacagaattcattttgccaattacgggattttccctcagttgcagtcaaggttcataaaactataactctttatctttaattagaaatgtttttttttttgagacaaggtcttgctctgttgcccagactggaatgcagtggcatagtggcccattgcagctttgaactcctgggctcaagggatcctctgcctcagcctcccaagtatctgagactacaagtgcgtgccatcacccatggctattttaaaaaaaaaaaaaattgtagagatagggtcttgctgtgttgcccaggctggtctcaaactcctggtctcaagcaatccttctgccttggtctcccaaagtgctgagattacaggtgtcagccgttgcacctggccaaaacgataacttaaaatacacacacacacacacacacacaaacacatatgtgtatttgtgtgtgtgtgtgtgtgtgtgtgtctcaaaaggtatcaaaagagaatagctataactttagtgttgatcttgatagtgacttgattaggctctgtttaacatcaaagatgcaaattaatactttctttgaacatattaaaaatgcagaaaatattggagtattttattttaaataaattgtattctgtatatttaaggtatacaacatgatgttatgggatacatataggtggttaaaagattactgcagtgaagcaaattaacgtatccctcaactcacatagttacccattttttttttgttttggtggcaagaggagcttaaaatctcatttagtgtgaatcccaaatacagcacaattttattacctatatacttcatgttgtacattatatttctagacttgttcatcctacatatctgctactttgtatcctctgagctacatctccccattttctcacttgccccccaagtagtttcttaaagtgtctcatgtaagagggcagtagctttcagcttaaactttttctctgtatgtagtcgatttctttgaggtatacttttctctccagaatagttagatgtaggtataccactttgatgttgacactagtttacctagaacttatcttctgtaaatctgtctctatttccatctctgtctccatctttgtctctatctctatctgtctatctctatctatctatctatctatctatctatctatctatctatctatctatctatctaaagcaaattcatgcccttctcctatttattgaatcgagaccatagacaggggtgagagaaagaatttggcaggaatggggatgtgtattatctgtggcataaggaaactttacagaactaggttcaaaagtatactttctagttctttcccatggcttttcactttgatgtagtccttatcaggtaactgaggttttatataagtcccctgattcttagaacatgaaggtgtagtagtcaaggttggtcccttgaaaccacaaattttgtgaaaaaaaattaagaaaattgaataatttcctcagcaaatacatattgatcatctgttatacagccatgagaagtggttctgttgcacacgtttattttatcagatcctaatcccaaaccaggcataaaatggaaaccatgaagataggatgaaataacttctgaatgtttgaatgtttgaaaatagtgtacttaaaaataccaggtggtttttgtttgttttttgtttttttctttttttgagacagggtctcactctgtcacccaggctggagtgtagtggtgcaatctcatctcattgcagtcttgacctcccaggctcaggttatctcccacctcagcctcccaagtagctgggactacaggcacatgccaccacgcccagctaattttttgtattttttgtagagacggggtttcaccctgttgcccaggctggtctagaactcctgggcttaagcgatcctcccacctcagcctcccaaagtgctaggattacaggcatgagccaccatgcctggcagaaaataccaggtttttaagtatcagcacttactcttcaatcttttctattactatgttgtgctaaatggtattttttatttaattagagcaatgctgttcaatagaactttctttgaggatggaaatcttttatgtttctgctatgtggtacagagccactagtgacatgtggcttttgagcgcttgacacatcttgtgcaacacaggaactgaatttttaagtaatttatattgccacatgtggctaccgtatgggacagtgtagtactagatgatctgtaagggctgtgcttcatcagtgtcgttttttaactgacaaaaacctttagttttttttttagtaatgtgtttatttaaaagaattcataaaatacaagtaaacaaattaacttgttacctgagcatatgtcctttcatacttattttttctgcatacatattttggaaaatggaatatctgccctttttttttatctgagatacagtctacctctaaaaatacatgattctaacattctcacttttgttggcatttgatcagggtatagaaaaacagttaaaaggacagagaatggttgagagattatgatatgaagagaaaatgtgattgagtgtggtagacttggggcctgcttgaatgttgagagaatgactgttttccgataaaaaaaaaaagtccattctaggatcctaaaagaagggtctgaagttcactgcagaaagcaagctacatagtactaagccactaaggggacatggagcccttagtaattcctaccttagtaatagtctcatcatgccctcttgggaacccagccttgttgattagcctctctgctttctctccttatagttcaacctccctgtttgttccaagcagttcttttcctgcccatttattatgcatttctatacagctttcctcctctttttctataccatgctgcagttcttattgctacctagaggttttcaaaattcctaggggcggataagtaggcataaacaaagttcttccctattatccttcctattttttcacctagactgaagaggtagacaaaatagaaataaagacattaagggtatgtgtttgtagtcccaaagagcttctctggcaattttatgtagttgacagtgacgctctgagttcaggacagattggactccttggctgagaggagtgaggagataggacggtagaggagagggtagagcaactctggaggaagctttcccctcacctttgccagtcctgttatcctagacttaaccataattaaagatgagggaggcactcagtaaagggatctagtgggaagcttgttccagacagccaaggagggaggttcgcgcagttcctttggccacccaggtggggtaattgatccatgtatgccattcatgtacaatgtaggcacttatacctgtattccaatgtagtgaactataccattactcttaaattaatattctttattagcttccatggtggctataggccaggcaagagagttaagaaaaaataaatagccaggtatggtgactcaagcctgtaatctcggcactttaggaggccgaggcaggaggatcgcttgagtccaggagttcaagaccagcctgagcaaaatagtgagatcctgtctctattttttaaaaaagccttggggcaaacaggagtatggaggtttggatgctaatagaacagcagtgtcttactgcttggagttctcttgtttcttgtcctatcaccgtagcctttggatcacagcaatttttccatgactccatacttttcagttcttgaatattttttcctttattcctcttgtctctgtaaagacatcaactggagttggactgtaataccaggtatctccagaagatggcactatttaacagattttataaataatttgatgtgagtcactgtcatctgaagcttgttgccttttctttctttcttctttcttttttttccccatcaattctgtatgtttgaaatgctgggttttaagttagttagaataagggatgtctgtaatttccctaaattgagaagtaatatgcaaaggttgatatcagaagtcatatgctcaccttgcaacaccaaataatactggcccatttgtgatttttgaaagtaacactccataataaatggatgtatatatagaagcataacaaaaatagaagcacataaaagtgaaaagtctcataaacgccattgtcactactcatgtaattgctgttacaaatttgtttaaatgttgaataaaaatggtgtcataggcaacacagtgttccactacttggtgtttttaatagcattattctgtctcagtgtgctttggattatcaggtgctttttaatagttgcatggtattacattgtgtagatgaacttgattaatttaaatggttccctgttaatggacatgttggtttgtttttgtgaacaactgatacagtgaacatttattttttaaataaaaaaaagagagacagggtcttgctgtgtttctcgggctggccttgaactcctggggtcaagcgatcgtcttgcctctgcctccctgggattacaggcatgaagccaccgcacccggcccagtgaacactcttgaatgtatctttgtatacttgtcagtgtttttgtagcattgattcccagaagtgggattactggattaagtgacatgcatgtttgcaattttaacaggtattgctatgtcattttcaaaagaagctatgccaattaatactctcaccaacaagagtgcttatttcccctcagcatattatcaggcttaagttttgccagtatgggtgggagaacagtagaatcacattgttttagtgtttgtttctcagatagatataattttacaccttataaccttctcttctataaattgtctatttgtgttcattctccattttcctatgggttcttattgttggagcccaatatataaaagggggtatttgttacagaacctcttcagttttggttcatgtcatgcctgggtttttaccctttctacggatgttaaaaaaaattctctattttcttccagtccacttatggctttattttttacatttagattttaatccgtctggaatttatttttgtgtatgctgtgaggtagggaccatacttttattttttcccaaatgggttactagttggccaaacatcatttattgaataattcatcttttccctactgactcgaaataccatctttattgtatactaaatcctcatatagttctgggtctgtttctgggctctactttgttcatttactgtgctggtactgcaccgttgtaattgctgtggctttgtggtatggtatggcttgctctctgctagggcaagtcgaagctcttttgttcacctgctctttcacccaaattttctgtcctgaatccagcacagccaaattatggtcattgtcaccaccaactacagtgggtgttgagcatttcccattgaatctcctgtaagggttttattggattctgtgatagcagtaaaatgggagcctaagaggtattccttaaaggactactaatcagacctggtttcccagatgatgctgaagatgacggggcctgggctagacttttgagggacatatccttggggttgggtgtgatatagaccagcccttacaatttgcttgactcatgggaatcgtacagggccagaaccagacacctgtcatgctaataacttccctcacaattcagaaatcactgtgattgaagatgggtggctgttataatactacccacttaaaaatggatgtaacccattttttaggactcttaaaaacatcaaatcagtaatggccgattaggactttttaatttttactaatctctacttgaaagttttctagtcattcatttcaggaaacctaattcttataattcatatcatttagaatatcataatgctatggatattagctagctaacttctcaaatcttctagttctcatttaatttgaagtttgtgtgtgtacataaggatatacatatacatatgtgtgtgtagatatatatatatatagttttttttttttttaactagaatgaccagtcaacaggggacataaaagtaattggtggagatgatctctcaactttaactggaaaggtatgtatcttgaaagggaagaaaaaaaagcacttcataccgagtcaattagtaacagtgtgctttcaatcaatcactaagagataatttacatagtataactaaatgggttatttaacccttggaagcagtctaggttaattatcgttccctaggtcatgtagtaaaaagacagtagaatccaacattaaccttaaatgtccatattgtcaagtactgctgtctgcctctgtgggactctaatttgggatccttcaaaaaacattgatgggggaaaagatagcctttaaaaaaaaaaaaaaaacaaacctatgtgagtctatgtgaggtagactcacatagtttcctaaaagatagcaaagcagtattatgtagtggctgaaagtgtgagttccggagcctgacaactgattcaaagcatggcttagtacttcctaactctgaccttgggcaagttacttaacctctctgtgtcccatatgtgattagggtgaggttgataatagcagccatagagttaagaggattaagtgctataatgcaagtagagctcttacaacagtttctggtaaatcactcaataaattcagacatactattattttaagaaatctcaaagagttttcttgtaccttaaaattctcctagtgtgaaccattggttttggtatattgtgcttccatgtagtttaatatcaagatgtttttagatttcccttttaatttatttgttgacccattggttgttcaggagcatgctgtttacctgaaaataatggagatattaaggtatttgaatatttatcttctagtacattgaaaaactttttgagagtaaccaataataaatgatggaatgctactgctttttttttttgaagctgccagttattgtttacttacactatgccaaatataaaggcattaatctcataaaagtttcacaacaatcctgtgagggagacgatatccccattttacaaatcaggaaattaagacttaataaggttaaaagacttgcccaaagtcacagaaccagtaagtggtagagcttgaatttgaatacagacctgactctaaagctcttttctttctttagattttagtgttcattgcttacttgaatgagtatctataagaaaactttaacatgtaaaacttctgtgaaattatcttgtcccatatcagggtcatgtcaaactaatgtcctcctcagcatctttggaaaacttcagaggagaaatgagctttgcccctcctgttcatttcatataccactgttagacctgtccttccctttcagcatgctttgtccatatttagaagctgttgaagccattacttgtctggtcagtttttagtgctggaatggacctagccttttaggccttctgagatttagtttgatctcgtctttcccacctaatggctctgttctactacatagatttgatctgaaacagttctctgtttctaaaataactttcttttcatgatagtcacagtaaagtacatttattatggaaaaatcaataagtataacgagtgaaagttatttcttggtggtaagattatgggattatttgaactttctgtttcattgtattttatttatttatttatttttgtgatggagtctcactctgctgcccaggctggagtgcagtagtacgatcttggctcactgcaacctccccttcccagttcaagtgattctcctgcctcagactcccaagtagctgggattacaggcgcacgccaccatgcctggctaatttttttatctttagtagagacagggtttcaccatgttgaccaggctgatctccaactcctgatctcaggtatccacctgcctcagcctcccaaagtaccgggattacgggtgtgagccaccctgcctggcctcattttgtcttttgggggtatttttgtgtgcagatatatatgtatataaatatttttccctcttttccccagttagtatttgagcagatgaactttggacccgaatacctgtattcaagtctctaataccacttcttggctattttcattttatcaaatggcctcttatcctcgtttttctcatttattaagtagagatgtaactacttgatataattcaaaaactcaataatggcattcttttgttttttagactctagtgtctgtactcgttgtaccatgctgggattcatttgaacaattgcatggcttttttagtgtattattaaatttgcagtttacttagaatttactgggacctcatacaaatgggaaaaaaacataactgtgttactcatttgctgtgtgcctttggattgaccctattttttgtattcattttctccccatgtcctgagttccactttgaataaaaagtaatttttttcctgcctgtaaaataggctaccaataggctgcagttgtctatagtagctgcttcactgaggagagctcagcatgagagaaatagtatgaattgcttgccacaagttatgggctagccttacttcattctgtacttggacctgtttaggcttctaagagatcttacctccaacaataaactgctttgagacatgaaaaggtggaagctttacttggttataactttacttttaatacctagaacagtgagtcttcaaacttgtatttgcatgcccaatttataaaaagtttcctgagcatttacccctaatatatgcattttaaattatatatgatttatggtaataataatatatatgttacaaaatacatacaaaaatatagattaaacaaggtgaggtaaaaaatttaaaagttctaatctttcttgcaaaccagtggatcttttgtgccttactctggtaaacactgtcttagaagaatatatagaacattaaaatcttaatgctatagttatatgacagagtatgatgagagctacagataaacaacacatcatgaatcttcttgtggcagtgtttataaccattatgtgaaatgctgcctcattcttataactagcataagaacagataggactttctcgattttgaggggtaattattagatggtattttctgttaaggactcttccagctataaaattcttaaatgtagaaagcgaagtgagggtttatggtgagaggaagcattggtatcatgttttagtgtagtccaagaatatggacacatccagaaaatgcagatcaagtttagcctaatgagaaaatatattttggagtccatatggtaaattaaattatgtgatttttgagttattgtacaaatataattcttagaatgttagagtcaggagactataagagaccaactgcttcaagtttcatttaacacatgggaaactaaggccagagaaatttcaagacttgcccaagattagacctcttgttaagtaatgaaagtgttttaaaaacaggtgggtcaaattctgtttttaaaatttccattatgatgaaaatttcagtattacaggcttccaaatcccagcagatgggccacttgtttaaaggagagtttgatataataaagcatctaaaaacaagagtttggataattccttagggttgttatgatgtgatttgacttataattggaaataccgttttattcattgtactgattttcatttctctttttcttctagaatgtcttgattgtggaagtaagttcacatttacttttaatataacatttatgacttttctaacttagtatgcaccatcctaaaggtaagccagggagagaaattcctctgcatcagttttaatggtgggcttgtgttctaaaggagtgagattggttttttgtaaagactacttagtaatttgtttttaccaataatggaatggtatacttcctacctctctttttttagtttgaagtattttctttctaaacataactctctctctctatttatctatatataatatatacatatatatcttatattttatgtatatatatatatatcttgcttagattttgtcttatgtaatatttggtacataaaaaataatatttataatttatagactattttccatgtgttattatgtgctaaagtattttgtatcttagcaccgagaggctaagcagtttcctagggttaccagctagtaaactaagggaaacctttacttcctttagctcagtggttctcaaaatgtggttccctagaccaaaagtattaatatcagacaagaacctaccgaatcaaaatatctgtgatgaggcccagcaagctatgctttaacaagtttccgagtgattctgatgcatgctaaggtttaggatcccttgtttttactcataagtcactttctcattaaggccttccctggccatcctatataaaatctcatgttttcacaccgtcaacttcgtattcctcctcaatacttttattttcctgatcacttatcactaacagcctctctctctctctctctctctctctatgtatatatatatatatatcacttatcactgtctaacagcctctctttatatatatataatctatagattatatatatatgcagcattgtgcaatcattatcacgctcaattttaaaacattttcattgccccacaaagaaacccaatccccttagccatcactccccatttccccttcccccagcacctagcaaactgatcatctacctacttgctgtctataagatttgcctattctggacattttgtataaatagaatcatacaatatgtggccttttgtatctggcttctctcacttaatgttttcaaggttcattcatgttgtggagtatatctgcactcatttcctttttattgccaaattgtatggatagacaggtgttcctcaactgtgtcctgataaacccatctgaagttgaaaatatcataagttgaaaatggatttactactttgataaatctatcctaaagtcagaaaaatctcatgttgaaccatcgtaagttggataccatctgaattacatttttgttatccattcactggttgacagacgttaggttgtttccactgtttgctccttatttctcgtacctgaaatgtccttattccctcccttcttatcccatgtttaagtcatttaagacccagctcaaacgtcacctccacaaaaccttccttgatacccctttcctcttcaattcacttggaccttttgcatttaattttaatttttattttttttaagacagagtctcactctgtcaccaggctggagtgcagtggtatgatctcagctcactaactactctgcctcccaggttcaagcaattctcatgtctcagcctcccaagtagctgggactacaggtgtgcgccaccatgcctggctaattgtgtgtgtgtgtgtgtgtatgtatgtatgtatatatgtgtgtgtgtgtatatatatatatacacacacatatataaatatatatacatatatatatatacacacatatataaatatatatacatatatatatatacacacacacacacatatatatatatatagttttttttttttttaagtagagatggggttttgccatgttggccaggctggtctggcctcaagccatcctcccacctcggcctcgcaaagtgctggtattataggcatgagccactgtgcctggcctgcatttcattttaattataaaatattttgaactcagaaaaaagggtatgctgaatacctacgtacccacaaaagtattaacattttgccatatttgcttctgatcttattttttttgagaaattaaagatcataatacaactaaagccccatttctttcccttcattcccagaagtatgacaattatccttaaagttgatatatatcattcccatgcatgttttttatacttccctagtacaagttagctgtatcctctgctcaggggctcatcaagctgaatcaagggactcatgatcctcttcaaagttccttcaggttgttggcagaatttagttccttgtgattgtaggactgagggcccgttttctcactggctgctggccaggggttgctcccagatatttaaaggctcatgccctagcccatgacagtctcacaacatggcagctgacttcttcaaaaccagcaggagaatcttgctctagtctaccacataacctaatcacaggagcggctatcccgttattttcacagatcctggtcacattcaaggggagggaacccttctgtgtgtgtacaccaggaggcaggaattttttttttctttttcttttttgttaaaaagtcttaaagtcttttatccctaaaggaggcaggaattttgagagccatcagaattctgcctaccacagcccagaaatctgcatttttcacaagtctccagccatgatgtttctgatggctcacactgctttattccatttttaaagagtatttttattgaaaagcattagggttatggtttaaaaaatattttccctaacaaagatgggtttgtttagagtcctacttttgactaaatagctgagattcacttttatgtaaagtcattttatagcgttattaatttgggtgcctttaaaaatagtataaagcatgtttctcgagtgtagtctgttagccacctatattggagagttgggaggagagagtctctatcttgaatttatgggaaaaattctaaaatactttttataatgaaggacaacatcataactccctaataaaatgtgcatgtatatattcaaatttgctgtcattgatcctgcacctacaaaatccagtcctgggggctggcattcttactgcttgctgagggccagatgatatagattccagaatatctccatgtagattttggtgagaattactgtgctgaaaagaatgacagtattgcagttatacatgggggttttggtactttatattgtgactctgaatttaaagctatgcaatgtcttcttttttgaaaggatataattgacactggcaaaacaatgcagactttgctttccttggtcaggcagtataatccaaagatggtcaaggtcgcaaggtatgtatgacattttgacacagaatattttcctcatttgaagggggattaagtgattgcttctttttaaggataaatgttttcaactgtcattttatcttcgaaaagtaatgtaatctcatataagacttaagatataatccttttaaataattttgtcatgtgttaataaagctcataattacagtcacttccttgcctaatattaacatttggtttttcagcatgctaattatatcagtttgtcctgaatagcatggcagaggattttgggcccccttgcaaaattaagaataaggattccaaagcgggtgaggaagtgataggaaggggtgggccctgaagatctggacctcctggaattgagtgatgaatgctgcatcttctttgtgtctgtagtgaaattttataatgcctgcttccttttttattaagtcggcctcacctcctcaccttacctatgctgttttacttttgcttttatagttctacctgtgtttatttctcattttcgtttcatctctcaacaactctggggtggcattattattcccacttttcagataaggttactgaggcatagggaattgtccaaaggtacagagctagtccgctatagagatgagatttgaacccagggaacctggctcacagtttatgcttttgctaccttaagtttttaatagagtgacatcaaacaaacatttaagaatatgtttttcttttccttttataatttcattaaaaacattaagtctctgatcagtctgcagtttttatgtaggggtcaggtaatgttctaacttctgctttttcctaagtgattaacaggtttttataagcccttttgaaaaaatcacggtatctgtcgagcatctttgaatcagagtaagccttctagtgagtcatatgtcagcagtttgactgtatgggcttttctaatatccagttcaagtgtttatcagtgagtttttcttttaaatagatttgggacaggtactatgagagtatataagtgatacgttataggacactaactagtatcctatgaaatggcaaaaactgcaatcacttttgcaccaaccaaatagaaactaatcagtgcacttgcttatttttctacatgctctttagggttttaaatgtcaacctactgtggcatagactttaatcctctgggtattcttttgttgttctttcctggtatatgctgtggaattgagatagactggttcgtgagcgagagattttgtgttgccacaggtaggacatgctcaaacaatacttgggtcatttcttgacccaagtcatctattcaccatagttttgtagcaccgatcttgcatacatttcatgtatcttctttgaaccccacgtcagtgctgcttatatgatactcagaaattaaacactaaggaataagattttcaggtaggattgagttttggagggtcacaaatcttgtaatgtctaatatttccactctccctgctgagaattagttttggcttccttggaggtgatatcgcctctgttgagtataagtggcctactgtgatcacaccactgcactccagcctgggtgacagagtgagaccctgtctcagaaaaaaaaaaaaaaaaaaagaatgcatggcctagatgacttctaaggtttttcccacccagttccagttttcatgttctaggcagagcagtaaagtgagaaacacatggacttgggagtttagtctcgcatttcactgccacttaatctgagcgactattccatatttaatctctctgaatgtatttactcatctttaaaggggaatgattattaacatctttttctcagggaaactatatgagtcaaggagataatatatttgaaaatctttttaactgcaaagcgctgtttcactgttggttataatgtgattgatctcattgtagtgagcagctgcttaattgcgttttagaatgtagggaagatagtaatatttttcacattatatatgtagctggttctggaactgtaaacatactccttttttatggagatctgagtcacgtaccataaaattcactcttttaaagttgtacaatccagtggtttttgatatattcagagttgtgcatctgctaccactatttcattttggaacccaaagaaaccttgtacccattagcagtcattctcccttctcccagcccctggcaactactaatctactttctacagaaagtccgtacagatttgtgtattatggacattccatataaatggactcatgcaatatcctgtcttctttcacttagcatagtgttttcaaggttcatctaggttggggcatgtatcagtacttcatcccttgttttggctgaataatatttcattgtacaaatatatcacattttgcttatccatctgttggtgaacatttgagtttctacctgttggcttttatgaataatgttgatttgaatgtttgtgtacaagtatgaatacctgttttcaggtctcttgagtatatagttgctaggtcatatagtaactctgtgtttaacattttgaggaattgcccgactatttaacaaggtatatgtactgttttacaccagtaacatatgagggttccaatatctccacatccttgacaacacttgttactgtcctttttattgtagccatcctagtggctatgatgtggtatctcattgtggttttgatttgtgtttctctgatgctgatgatgttgaacatgttttcatctgcttattggccatttacatatatcttcttaagaacggttacccatttacagtatggaaaatgcttcagatgcaactctagtcatgccttagagatggagctttattaaacattcagatctctaggcatatgaagtgctgagttctcttgaactcctaatacagattgcactgagtttagtgataccttttctggagcattcctgagttcaggtagggagaagggtttttgctgtgattggcttgttatgttctttctaaatggaaatagaattgaagtgtctcctctctccatttattggaagagtcatgagggacataattagatgatcccttggagtctccggcttaggtcagtggttatctacttaggctgcacattggaatcacctgagagttaaaaaaccaggataacctctgcctgtgtctcatctccagcaattctgatgtaattggtcagggctgtggcccgagtaggtgagttctggttttttaaagctcccaggtgattctgatgtgcaatccaggttgagatcactttgggccctttccagctctttaaacatatatatttatctaggaaggtatgaaagcataagttttcttgagactgcctttaacatctgtaaaggctttcaaagcagcttctgtagttttttttaaatggctgaatatttttcaacaggcagcatttgggttataaaattagcttttggtagagttgacttataccacctccagcttttgttccaaaaataaatactggttcttttggcacactagttgttttaccctaaagttcctctttgtaagccagttattaaaagttgtgatgcagccagggcgaagtggtacacatctgtagtcccagctactcggaaggctgaggggggaggatcgctagagcccaagaagtcaaggctgcagtgaactgtgattacaccactgcactgcagcctgggccacagagcgagactcatctctttaaaaaaaagaatgttgtgaggccgggcgcagtggctcacgcctgtgatcccagcactttgggaggccgaggtggacggatcacctgaggttgggagttcgagaccagcctgaccaacatggagaaaccctgtctctactaaaaaaaatacaaaattagccgggcgtggtggcacatgcctgtagtcccagctactcggcaggctgaggcaggagaatcgcttgaacctgggaggcagaggttgtggtgagttgggcgagccattgcactccagcctgggcaacaagagcaaaactccatctcaaaaaaaagaaaagaaaagaaaagaatgttgtggccaggcgcggtggcttacgcctgtaatttcagcactttgggagaccgaggtgggcggatcacgaggtcaggagatcaagaccatcctggctaacacagtaaaaccccatctctactaaatacaaaaaaaaattagccgggagtgctggcgggtgcctgtagtcccagctactcaggaggctgaggcgggagaatggcgtgaacccaggaggcagagcttgcagtgagcggagatcgcgccactgcactccagcctgggcaacagagcgagattccgtctaaaaaaaaaaaaaaagaatgttgtgataaaaggtgatgctcacctctcccacacccttttatagtttagggattgtatttccaaggtttctagactgagagcccttttcatctttgctcattgacactctgtacccattaatcctccttattagctccccttcaatggacacatgggtagtcagggtgcaggtctcagaactgtccttcaggttccaggtgatcaaccaagtgccttgtctgtagtgtcaactcattgctgccccttcctagtaatccccataatttagctctccatttcatagtctttccttgggtgtgttaaaagtgaccatggtacactcagcacggatgaaatgaaacagtgtttagaaacgtcagtcttctcttttgtaatgccctgtagtctctctgtatgttatatgtcacattttgtaattaacagcttgctggtgaaaaggaccccacgaagtgttggatataagccagactgtaagtgaattactttttttgtcaatcatttaaccatctttaacctaaaagagttttatgtgaaatggcttataattgcttagagaatatttgtagagaggcacatttgccagtattagatttaaaagtgatgttttctttatctaaatgatgaattatgattctttttagttgttggatttgaaattccagacaagtttgttgtaggatatgcccttgactataatgaatacttcagggatttgaatgtaagtaattgcttctttttctcactcatttttcaaaacacgcataaaaatttaggaaagagaattgttttctccttccagcacctcataatttgaacagactgatggttcccattagtcacataaagctgtagtctagtacagacgtccttagaactggaacctggccaggctagggtgacacttcttgttggctgaaatagttgaacagctttaatatacaataattgttgcattattatttcagatgataaatgtggtcataagtaagaaataaatgatcgagtttagtcttttaattcactgtcctttgaatacctgcctcttactctggaggcagaagtcccatggatgtgtttatgaacatggttgaggaagatttaggaagactgcaacagtacactacctaaagcaggttttttactccatctttttttgccacgtacactggcctcccactttgatatgcttgaaattatctccttgatttgtctttcaaaactacatattgaggctggttgcggtggctcacacctgtaatcctagcactttgggaggccaagccggacagatcacttgaggtcaggagttcgagaccagcctggcaaacatgatgaaaccccacctttactaaaaatacaaaaattagccaggcgtagtggtgtgtgcctgtaacccagctacctgggaggctgaggcaggagaatcactggaacccgggaggcagaggctacagtgagccaacatcacgccactgcactccagcctgggtgacagagcaagactctgtctcaaaacaaaacaaaaaacaaaaaactacgtattaagacaagaaacagactgggcgcggtggctcacgcctgtaatcccagcactttgggaggctgaggcgggcggatcacaaggtcaggagatcgagaccatcctggctaacacggtgaaaccccgtctctactaaaaaatagaaaaaattagctggggtggtggcgggcgcctatagtctcagctactcgggaggctgaggcaggagaatggcgtgaacccgggaggcagagcttgcagtgagcagagatcgtgccactgcactccagtctgggtgacagagcaagactccgtctcaaaaaaaaaaacaaaaacaagaaacaaattaaactaatgtgatagactactgctttgttttcaaaagatacactccccaaaagttactgatctaaaatacagtagtactatctctgtttagtaagaaccctgacaactaatagtgttcttatatgtaaaatgctattcttgcctttcatttcagaatatactttttaaatgtgaatttctggatttttttttatagcatgtttgtgtcattagtgaaactggaaaagcaaaatacaaagcctaagatgagagttcaagttgagtttggaaacatctggagtcctattgacatcgccagtaaaattatcaatgttctagttctgtggccatctgcttagtagagctttttgcatgtatcttctaagaattttatctgttttgtactttagaaatgtcagttgctgcattcctaaactgtttatttgcactatgagcctatagactatcagttccctttgggcggattgttgtttaacttgtaaatgaaaaaattctcttaaaccacagcactattgagtgaaacattgaactcatatctgtaagaaataaagagaagatatattagttttttaattggtattttaatttttatatatgcaggaaagaatagaagtgattgaatattgttaattataccaccgtgtgttagaaaagtaagaagcagtcaattttcacatcaaagacagcatctaagaagttttgttctgtcctggaattattttagtagtgtttcagtaatgttgactgtattttccaacttgttcaaattattaccagtgaatctttgtcagcagttcccttttaaatgcaaatcaataaattcccaaaaattt

SEQ ID NO: 143 - DNA, 513 bp, mus musculus
gggcggggcctgcttctcctcagcttcaggcggctgcgacgagccctcaggcgaacctctcggctttcccgcgcggcgccgcctcttgctgcgcctccgcctcctcctctgctccgccaccggcttcctcctcctgagcagtcagcccgcgcgccggccggctccgttatggcgacccgcagccctggcgtcgtggtgagcagctcggcctgccggccctggccggttcaggcccacgcggcaggtggcggccgggccctgaggcgcgggatccgcagtgcgggctcgggcggccgggcccagggaaccccgcaggcgggggcggccagtttcccgggttcggctttacgtcacgcgagggcggcagggaggacggaatggcggggtttggggtgggtccctcctcgggggagccctgggaaaagaggactgcgtgtgggaagagaaggtggaaatggcgttttggttgacatgtgccgcctgcgagcgtgctgcggggaggggccgagggca

SEQ ID NO: 144 - DNA, 96 bp, mus musculus
cttcattgactccgaggggatacagcagcaattcatgttttgaagtgttctaaatggttcaaaacgtgaggcgctgctataccccctcgtggggaa

SEQ ID NO: 145 - DNA, 2035 bp, mus musculus
gccggctgcgccgctcgcctccaagggagcgttccgtgctggcccctcgctcggctccgctccgcctccgccacgccgctctccgagcttcggcagcagccagcgccccctccacgctgcgaccccggctctcggctctccgtccctgtagctccgtgcccagcacctcgcgccccgcaacctcgccgtctcccaagtcccgggccccgcttctgtcgctgtccgtcgctgtccgtgtgtcgctcgctcggtctgtctctccgcctccccagcccttccttcctccctgtctccctcgctggcttgcacgttcgctcgctctcggacgcggcgaaacagcttcgcaggcaaatcccagaaacctttgcaaaaagcttgcaatgaaatttaagaagttcttcgatttcggcgccattttcgagtggagccagaggtgacatgcgattttttaaaaagggacttggtggctggcgtctttcccgactgtaacgtgggttacggcaggcagaaaaacatctggtgataattctgaaaaaagtgctgtggcgtttgggggggttgtaaagcacgttttgcgggcgggatgggggcaaatctgacatttaaagtgtttaacaaatgagtgcggccgggaaattctcaggaaacggactgggaaaaaaaaaacaacaactaacatggaggggcggggagagaaaactgagtaaggggcagtgaccgactgtcagcctcgctagggtcgggagcgactggttttgacagaatgtaaatgaacttttcctcttatttgcaagaagttagttatgtcttggaaagaaatgtgtgattaatttcacattgtctctcccgaattaaaactttaaaggttgtttagttttccccgtagggacttgacattgtggaagtttggctagaatgcgccgagagaaggtacatcgtgtgtttggggtgtgggggacgaaggcatatgcaaaattaaaagacaaaacgttgtagagtatgaacagaggaagaggcgtattctttggctcttaaatcatttagccaaacacattgcagttcagaagggggtggggctatggcaactcgaaagtatcgattctttgtctattgtatcagtgaatgaccctctcctgaagtgacaagacgcccctttgtaatctcttttcgtaagtaaatttcagtctaaggggaaatatgtaaactaggggatcgaggtggctttttaggggtgtaactcgttgtactatcactgggagagatgaaaggggttagggtgaaaggtataaatgaatttgattccaagagcaatctggaagggaccttcgcctttgacaccgatgctgtttcgaatgaacttttgtttttctaagtagtcaactaaggaaatgttaaattaggcatgactttaacttctgacatgatggctcgtatatttgtgtggaacaaaatgttgggagaaagttgtggagttttacatgataattgtacatttgctaaacatgttttttttttctttttaagggcagtcaacgacatttttctccattaatcccaaagtcagtgtaaaagttgtttgtaaatatcattgccaaaacaagatggaatgtagagatacttgattgtcgcaatttagggaatggggttattgttactaatgactttttttttttaccatgacatagtgtatttgttaccactggatctcagtctggatgttataaattcgatacttaatcttattaaatactctgcacattttattaactaataaataggacacttaacattcattgtactggttttgaaaaaccgacttaatttgtaagtgtaacaagatacttacagttggataatttaaatgtctattacttgtgctgaaatgtatttaactttcaaaaccattacagttagtgctgattttgttgttttaacttttaggtttgtgattgaggatttcagagtgggttttttttttaatgcttaattgaatattgtattcaaacaaaaagagggcatgcatgtgacttgttgc

SEQ ID NO: 146 - DNA, 2035 bp, mus musculus; identical to SEQ ID NO: 145

SEQ ID NO: 147 - DNA, 1301 bp, mus musculus
cgccccccgagccggctttttctagggcggctccgggagcctctccgccggctgcgccgctcgcctccaagggagcgttccgtgctggcccctcgctcggctccgctccgcctccgccacgccgctctccgagcttcggcagcagccagcgccccctccacgctgcgaccccggctctcggctctccgtccctgtagctccgtgcccagcacctcgcgccccgcaacctcgccgtctcccaagtcccgggccccgcttctgtcgctgtccgtcgctgtccgtgtgtcgctcgctcggtctgtctctccgcctccccagcccttccttcctccctgtctccctcgctggcttgcacgttcgctcgctctcggacgcggcgaaacagcttcgcaggcaaatcccagaaacctttgcaaaaagcttgcaatgaaatttaagaagttcttcgatttcggcgccattttcgagtggagccagaggtgacatgcgattttttaaaaagggacttggtggctggcgtctttcccgactgtaacgtgggttacggcaggcagaaaaacatctggtgataattctgaaaaaagtgctgtggcgtttgggggggttgtaaagcacgttttgcgggcgggatgggggcaaatctgacatttaaagtgtttaacaaatgagtgcggccgggaaattctcaggaaacggactgggaaaaaaaaaacaacaactaacatggaggggcggggagagaaaactgagtaaggggcagtgaccgactgtcagcctcgctagggtcgggagcgactggttttgacagaatgtaaatgaacttttcctcttatttgcaagaagttagttatgtcttggaaagaaatgtgtgattaatttcacattgtctctcccgaattaaaactttaaaggttgtttagttttccccgtagggacttgacattgtggaagtttggctagaatgcgccgagagaaggtacatcgtgtgtttggggtgtgggggacgaaggcatatgcaaaattaaaagacaaaacgttgtagagtatgaacagaggaagaggcgtattctttggctcttaaatcatttagccaaacacattgcagttcagaagggggtggggctatggcaactcgaaagtatcgattctttgtctattgtatcagtgaatgaccctctcctgaagtgacaagacgcccctttgtaatctcttttcgtaagtaaatttcagtctaaggggaaatatgtaaactaggggatcgaggtggctttttaggggtgtaactcgttgtactatcactg

SEQ ID NO: 148 - DNA, 1301 bp, mus musculus; identical to SEQ ID NO: 147

SEQ ID NO: 149 - DNA, 867 bp, mus musculus
gccggctgcgccgctcgcctccaagggagcgttccgtgctggcccctcgctcggctccgctccgcctccgccacgccgctctccgagcttcggcagcagccagcgccccctccacgctgcgaccccggctctcggctctccgtccctgtagctccgtgcccagcacctcgcgccccgcaacctcgccgtctcccaagtcccgggccccgcttctgtcgctgtccgtcgctgtccgtgtgtcgctcgctcggtctgtctctccgcctccccagcccttccttcctccctgtctccctcgctggcttgcacgttcgctcgctctcggacgcggcgaaacagcttcgcaggcaaatcccagaaacctttgcaaaaagcttgcaatgaaatttaagaagttcttcgatttcggcgccattttcgagtggagccagaggtgacatgcgattttttaaaaagggacttggtggctggcgtctttcccgactgtaacgtgggttacggcaggcagaaaaacatctggtgataattctgaaaaaagtgctgtggcgtttgggggggttgtaaagcacgttttgcgggcgggatgggggcaaatctgacatttaaagtgtttaacaaatgagtgcggccgggaaattctcaggaaacggactgggaaaaaaaaaacaacaactaacatggaggggcggggagagaaaactgagtaaggggcagtgaccgactgtcagcctcgctagggtcgggagcgactggttttgacagaatgtaaatgaacttttcctcttatttgcaagaagttagttatgtcttggaaagaaatgtgtgattaatttcacattgtctctcccgaattaaaactttaaaggt

SEQ ID NO: 150 - DNA, 867 bp, mus musculus; identical to SEQ ID NO: 149

SEQ ID NO: 151 - DNA, 867 bp, mus musculus; identical to SEQ ID NO: 149

SEQ ID NO: 152 - DNA, 867 bp, mus musculus; identical to SEQ ID NO: 149

SEQ ID NO: 153 - DNA, 19187 bp, mus musculus
gggcttggtggagggcgggaaggctgaagggcggtgacaggtcgcactgcctcgcgagggccagaacgcccatttctgcagaggtgcactcagtggcgtgggaaatcaaatgcatccggttatcccagttcggcctctctgggattccgcgggagggggtgtctggtctggtttggtttggtttggtttggtttggtttggtccggttcaaagtagcgcagtctgactgagcgggaggtggagtggaaggcgagaataggggtgaaggattagacagaagaagactttgaactaggaacagtggcaaccagggtgacccaggcttttgtgacccgtagaggcagaaggtgaggcgtctacgccctctctcaccagattttgggcggccctgtggagacaccctgtgccctttaagggacatggattgagtcgggatctcaaaatgtgagcctttcctcagacccagctttgacccacgtactcgcctttcctcaactcattttcatactttcacttgactatatattttttaaaaattgtgttaagcacttgaggttcatttctgcccctactgtatgtgcaccctgtgccagagggtggggtgaacacgtgtgtagcagtcatgcgtcctgtccacaggggccgatgcacctccttgcaaccctttacattccactgtgaaacaaacctcaactttttcttattcctgtttttacaccgtgcttatagctgccttaatccatgttcccttcgggatgctggtatccaactgagaagttgacggagcatctatcgtgtgccagacactgtgctaagtgctaacgagaaatcggtgagcaaaacagaaaagaaaaaaaaagaagaaacgactgccagcattgaacttagtacctagcaaagtaggtggacataaatcaaattgtcagacaagtaaatgagtagttgcagctgtgataaggggtatgaagaataggcgcttccatgatggcggaacatgacctagtctggggtggagaaggggagatgattccagctggaatatggcaggtgagagttaactaatagcactgagttggcagaggcaggatgacctgccccaggcaggtgccccagaatgagaggatgttgctgctggtggaactccagctttaaagcggtggatctagggccacattcctcaaggccatagcaaacaggaaagaccttttggactagggtctttggagtagtcacatgaggccaagaacccaatagggctgaaagagaatctcatcataggctgaatgggagcagagcattagctgcaactccaatgtattatagtaaaaggggacacattgattagaatgattatacccctccaagtgtaagctgttgttcaatttacccagggcttaaaaatatgtcaactcttcacaaccatttttactacaagccacactcaacctgtgttgttccctgaacctgtgatgcactttcatccgttcatgtctctacacatccttcctgggccccatagaggccctgcaccttaaggttttcagctggattcctattagctagttattttatctcaggtacagagagttaactttgctcctcaattttcagcacattgtcatatcagtccctacagggtccttgtttacattattttatagtgtttatattattttttcctcatctttctcgatccccactctcattcttctagacacaagctgcaatatgttcgatagagatccttgataatttaacacagataatgttttgtttatgcctcttgcatttacagagatggtattggactgtaaatctctatttcccactgttttactcaacagtctgtttttgagctatacccacattgctgtgtgtacacctagtttgctaccgagtatgccagaaattttattcatacatatccctactgatcgggcatctaggttactgccaactccctgaagtcatactgtggtgaaaacccttgtgaatgtctttacaaacctttgccagaacttattttgtgctcttgtagaactttgtgcataccctctgcttcctcattacactgcttggcatatagcagagactcaacaaatgttgaatacctctactatgatggttagtgtactagaataatttatttatatttctgttttccttattggattattagtaccttccagacagggcaaatgtcttttctatctttgtgtccctggcacattaaaagtggttgatttcaaggtatgttcaatgaatgaataaatacttatcttcactgccagtacatactgcaacttagtcttccccacttgactctgagtctcagccttactctgatctctagcttttgatatttcccctttcaagatagcttacctgaattcagacactgagctcaggcctgatcatgagcctgctcttccaaagtcctctctctctctctctctttctctcctgtctctcgttacaggcagctcctgccttccagttcgttgctcaagcctaaaactgagacattttgaccctctttcacacatcagatccatcagcaaatcattgtagaatccagactctgtttctgatcatttgctcagctaaaaccatagtccaagcttccattctcttacctgcattatggcagcaacttcttcgctggtatccctgcagtcactgtccactgttgtaccctctctgacagttctcagcacagaagacagaatgaccctgttgaggtgtcaatcaagtcactctgccactcacaatcccccagtgactccctacatctctcagagtaaaagccagagtcattatttattctggcttcagtgccctatatactctgacttctgttatctccgctatctcaccttctactttcccccttcacttcattccagtgcatgaaatctatctagttcacctagattttctcctatgttatctttcagaagttttacagttttgtgttttgcatttaggtctatgatccattttgagtaaatttttttcaaaagatataaggtctgtatctagattattttttgcatatgaatgtccagttattccagcactgtttattgaaaaggccattgtttctcattccagccataatgttttctttgttgtttcttgaaaatagcagacaggttctgtctctctcccctcactagagtgtaagctcagtgagaacaaagatttccatttgttttattcactgcttgtccccagtgcctaccacagtgtctggaacatagtgaatgtttactaaatattacatgaatgaacgaatatgtgttgaggacccggccgaggttgagtcagctctcatgcctatatttatctgatattggaatgatgcttcagtgtttctagccctgccttggcccttggtttccattaaattgctgcctgttgtctttgcattgatttattctgtgctatttcctgctccttcgcaatttgagccctctgagtcttttccatggctcaaacccagctgaaatgccttctgccctttccgactctcaaatcttatgtacccttcaggacccagctaaagtcacacttctttcttgacactttctctgacaatttcctttaaccatgacctctcattcaaatgagatattagaaaaagaataattaattggctttattttttagaacagttttacatttatggaaaaattaagcagatagtggagagagtttctatgtacttcctaatctccctcctcccctacagttcctcctgttattaacatcttgcattcgcattgtacatttattacaactgatgcattattactaactaaagtctatagtttacattaagattcactctttgtgttgcatagctctgtgggttttgaaaaaagcataacatatccaccattacagtgtcagcagaacaattacactgcattaaaaaattccttgtgttccacctattcatctggtctacctgcaaccaacccttggcaatcactgatgtttttactttctgcagaattttgccttttccgtaatgtcatagagttggaatcatatagtatgtagtcttttcatactgcttttttttttttacttagcaatatacatttaacattcctctgtgtcttttcatggcttgatagtttattttcttttattgtgcacagtattccactgtatgtatataccatggtttgtttatccatttatttattgaaagacatcttggttgctttcagtcttttaaaattatgaataaggctcctgtaaactttcttgtacagatttttgtatggacataagttttcaactcatttaggtaaataccaaggagcatgattgctggatcatatggtaagactatgttttgctttatcaaaaattaccagatgatcttccaaagtggctgtaacagtttgcattttcaccagcaatgagtgagacttcctgttactccacatccttgccaacatttggtgttgccagtattttgaattttgggtattttaataggtgcatagtagaatcttattgttttagtttgcaatttcctaatgacatatggcattgggcatcttatgcttgtttgtcacgtatgtatcttctttgataaggtgtctgctcagatctgttacccattgggttttttttattgatgatttttcagtgttctttatatattttagatatcagccctttatcagattatgtattttgcagatattttctcccagacagtggcttgtcttttcattcatttaacaatgtctttcattgagcagacatttgtaatgaaaaaatttcgactgttcagtttttttcagggatcgtgcttttagcattgtacccaaaaagtcatcaccaaacacaagttcacctagattttctcctatgttatcttccagaagttttacagttttgtgttttgcatttaggtctatgatccattttgagtaaatttttgtgaaagatataaggtctgtgtctagattgttttttgcatatgaatgtccagttattccagcaccgtttgttgaaaagaccattgtttctccattgaattatttgctcctttgtcaatgatcagttgactgtatttgtatggatctaattctggcatctttattttgttccatttatctacagttggccctctgtatccatgggttctgcatcaacagattcaaccaatgacagatcaaaaatattctttaaaaatcccctaaaaatggccaggaggggtggctcatgcctgtaattttggtactttgggaggccaaggtggggggattatcaggtcaggagttcgagaccggcctggccaacatagtgaagccccgtctctactaaaaatacaaaaaattagctgagcatggtggcgggcacctgtaatccaagctgctcaggaaggtgaggcaggagaatcacttgaacccaggaggcagaggttgcactgagccaagaccgcaccactgcactccagccctgacgacagtgcaagactcagtctcaaaaagaaaatcccctaaaaataacaatataacaataaaaataatacaaataaaaaatcaataaagtataactgttacatagcatttacattgtgttaggtattatatataatctagagatgatttaaagtatacaggaggaggatgtgcataggttatatgcaaacactacgtcgtattatataagaaacttgagaatccacaggttttggtatcctcagacatcctgcaaccagttccccccatgatactgaggaacaacagtatttctcttttctttcatcaataccctactgtcttgactactgtaactttgtaataagctttgaagtaagatagtgtctgtcttccaactttgttcttcctcaatattatactgcctattctggatcttctgtctttccatatagactttacagtcagtttgtcaatattcacaaaataacttgctaggattttgattcagacagcattgaatctatagatcaagtagggaagaagtgacagtttaacaacattagtcttgctatttatgaacatgggatatttctcaatttatttagatttttcatttctttcataaggtgttgaactagattctgtacatattttattagatttatacctaaatattttgtttttcagtgctggtttgaatggtatgtttttaatttcaaattccaattgttcattgctgatatataaatttccctctcatcactgcttttgctgcatcccataaattttaaaaagtttattttttcatttagttcaaaatatttttaatatctcttgaaacatcttctttgatccatatattatttagaagtgtgttgtttaatctccaaatatttgagggcattgcctagcatatttctaggtttctaaaaatatctagtttaattttattgtaatctgtgaaaatatcttgtttgatttctgtttttttaatttttaaggtgaattttatgaaacagaatgtggtctatcttgattaatgttccatgtgaacatgaaagaaatgtgtattctgtctctgttggatcaaatagtctataaatatcaggccaggcacagtggctgatgcctgtaatcccagtactttgcaaggctaaggtgggaggatcacttgaggccagaagttcgagaccagcctggccaacatagtgaaatgccgactctactaaaaatgcaaaaaattagctgggtgtggtggtgcatgcctgtaatcccagctactcaggaggctgaggcatgatgagagtcacttgaagctgggaggcagaggttgcagtgagcagagattgcccactgcactccaagcctgagtgacagagtgagactgacacacacatacacacacacacacacacacacacacaataaagtctatagatgttgattagatcaagttgatcgataaggatgttcagcatcaactatatccttactgatgtttttggctatatctgtaaattactgacagagaggtgttgaagtctccaaatatgacagtgcatttgtctgtttctctttgcagctctgtctgcttttgcctcatatgttttgacactgttgctagatggatatacaataaggaattttatgttttcttgcagaattaacacctttatcggtatgtaatgcccctctttattcctgataatgtccttgccctgaagtttgctttgtctgaaattaatatagctacttcagctttcttttgattagtgttagcatggtatatctttttctatccctttacttttaatctaggtatatctttatgtttaaattgggcttcttgcagacaatacataattgggtcttttaaaataattcattctgacattattcattttttaatttatgtatttagaccattcacatttaaattgattatgataataatatagttagattcatatataccatgttttaactgttttccatttatttcacttgttcttggtttcttttttaacttttcctcttttactgccttctctggttttaattgagcattttatattattctctaataaaagagatcttagatattgattatacttttaaaaatgtagtagtttccctagaatttgcagtatatatttatatctaattaagtccactttcaaataacactatagtgcttcatgggtagtacaggtaccttattacagagtattcccaattcctccgttatgtcccttaaaattttgctattattcacttcacttatccgtatactataatcacccaaaacataattattttgaaaaaatagttatatttattagatcaattaaggttaaggaacattaaagagtttattttatgctcatttattccttcttgaaagctcttttctttatgtagatttcagtttttgacctatgtcatttcatttctgtccgaaaaatttcttttaacatttatttcaaggcaggtctactggtgacagattcagcctttgtctgagaaagcatttcttctttgcttttgaaggataatttcactgtatccagaattctagttttatcctttcaacactttaaacatttcacgctaccttcttctttcttgcatggttgccaatgagatttctgatgtaattcttatctttgtccctccttaggtaaatttctcctcttctgtagcttctttcatgttttctggttgttttagttttctgtgatttgaacataatatgactaggtgtggacttttttttttttaaattttatcctgcttggtgtcttttaagcctcctggatgtgtggtttggtgtctgtcactgattttggaaaattatcagcctttattatttcatatatttcttctgcttctttctctcctacttctagtattctcatataagcatattatacctttagtaattgtctacagttcctggatattttgtttctttttttatatctaatttttgcatttcagtttgggaaatgttaaaagaaaaacttcatgcaaattaaatttaaaggagtttaattgagcaatgaacgattggtgaatcgggcagctcccaaaatcacagcaaattcacagagactccagtgcagccatgtgatggaagaagatttatagacaaaaaaaggaaatgacatacagaaatcagaagtcaagtacagaaacaactggattggttacagcttggtgttagctttatttaaacagggttcaaacagttggctacatttgattagtcaaaattcagtcattggcacaggtgcgggctatggttggtttatacctccacttgttatagttcaagatgtgcagaaaaacctttaggccgaacttaaatatgtaaggaggcaactttaggataaacttgattaacagaagtttctattaacatatcttcaatctcattggttctttccgctgattcttcccgcagctgtttccagtctactggtgagcccatcaaaggtatttgtgtttccgtaacagttgtttttttaaaaatttctatcatttttacaattctttcttggagattttctttctctctctctgcttacattacccatttgttcttacatgttgtctactttttccattagtgctctaaacatattaattataattattttaaatttactttctgataattctaaaatcactgttatatttaagtctggttcctttgctcgctttatctttacagactgtgttttttcttgcctttctgcattccttgcaattttttgttgaaagtcaggtataatgtattgggtaataggaactgaggtaattaggttttagtttgactttttatgttaatcagttaggagttggggtgtttaatgtttgctgtagctgtaggtgccagatgctttagttcagtatctttgtttttgtctcctttgctgtctttgcgtttccctatcaacttcttcttaaatggtctgggtttctcagctctcccattgtaatctattgctattatactggagcactgttgatgcagtggcatggtgttagggaagggaaatgttctataattttatgattaaatttcagatttttagttgagttcctgggctgtaatcttcagaattatttcttagctttttttctccctttagatgagataagaaggctaaaaaggactagcactggctaataatcccttcctaggtcaggaatggttctggaaaggtagtttccctcgtagggcaagcatttgttacaaagaatatactgaatatatttcaaagtggttgcttcctgctcctccttcaggaaacaggaagcagaaattctctgatatatactgtcagaaactggtggggttcctgaaggcaaaagccatgaaagtgtagcctttgcctccgatttgtcccctaggaattttcaactttcaaactagcccacacccagcctcaagcaattcaccaaaaccaccacttaagttttcctacctaattggctccagtggctgctgcttcaggaaatctaagttctgctctgattctctgtattcacctatcgctccaaatttggtgctggcaggttgccctggggccttaaatctcttggtctaagataagtcattgcttttctgtttgttcaatgttttgttgttgttgaaaggagtgccagtttccaagctctgtacatgtcagagctcaatattagacatttgcgttggaatttctttcttggcttggagtcgagtgtcaggactgatattcatagcccaaacatcaccaagaagccggtacaagtagaagtattgaccctcaaggtcattttagtattgatttcattatgagataatcacattattttctctttatccattgagaataaatagcatgcaatctgtcacagtcactggtttggctaacttgacttccatgcccagccttattttctcttgcctgcctctaacctagagagtggaaaacctaaatatgcaagtttccagccaaccctgaaaccatagtggccacgtgactatttttgtttttttgcaaatgtgatctaaacataagtttacagggaagtttctagaaaagcttttgcttttttgagaaaaggggacaaatttggctgatgttttatcttcttttgtaatgcctgccttggttatggatgtgacacctaaagttagggaaaccttgaggctgcggttaagagaatcgcaagctatcctcccacctcagcctcttgagtagctgggactacaggtgttcgtcaccacacccaactaattttgtatttttctgtagagccggggtttcaccatgttgcccaagctggtctcgaactcctgagctcaagcgatccactcgccttggcctcccaaagtgctgggattacaggcatgagccactgtgtccagccaccaccagacttatgtgagaaaaataaacctctgtttgattaggtgttgctaaagtggcttttcaataacttgcagccatatgcatttctgatagagcacctaacctatatggaatctgaggtacaaaaccaaacaaccagactaatagataacaactatgaggagcaggagtcaacttggctacaatgagtcatgttgaggcccacccattcaaagaactaaagcaaagatcagtctcaacattgttgaaattccaagtactaaagttttgctggttgccatttgttatgcacatatgtcacatgaaatgtggaggggatgttgtctctgtaaactcaaagtgccagtttcattcctgtaatcccagtgggaggccaagttgagaagattgcttgaggccaggagtttgagccaagcctggacaacatagtgagacttcccccccgcaccccccaccactctacaagaaagtaagaaaattagcctggcatggtggtgcatgcctatagtctcagttacttaggaggctgaggttggaggatcacttctggccaggagtttgaggctacagtgagctacgatcaggccactgcaccccagcttgggcaacaaaataagactccgtctctaaaaaaagtttaagaaaggaaaaaaaaaaaaggaaaaagcattaaaccaaggcgtcagtgaccagtagcatgagaaaatggcaatttttaaggaggtgggagccttagtagtttccctgagctgcacagatggatctgagaaataaaagtaaaattctaagccttcatctgaatgaacagagcccctcttggccaggggaactgcagagaaaccttgaaagctgaattcatggccatgacaggatgagagattggacacgcctcattatactccctccctcgctaacagtcataggttttattccctaagggctaaacagaaaccagccctttcaaaagactactagattattgtcccaggtacagaacaaagacaaaatgagattaatcatttatttacctctccccaagaaatttgctttctccattccctttttcttcaaatgttcaccttgttttatgtaagtgtggatttactggccactaaagtctcacaaatatataattatttgtctcactaccacccctcatttttaaggaaaatgtgtaaatactaaacctcctgttcacctctttgggaaaaaaacagccacagatgcttctgtgactcacatttttcctggtgcaccctcaagctggctcaataaaccttgatgttttgagacttacagcacaatcactcattttggttatcagatccaaacaaaggatagatttctaaggtttttatgaattaggaatgaggctcttctttaaccagtcttcttgggcaagttacttgatctctctatgcttcagtttccttatccataaaatggggataataaaagcatgcatctcattggaggtgtgggcatcaaatgagataatctatgtaaataactcaaccagtgtctgcacacattaaatgtcttttcaacgatgttaaaactgaattgtggacctagccctttgcatgtattgccctcatcatccacaaacccacacagaattttgcctctgaggagcagcactcatgactagtttgttctcatatcaaggagtgctttaagagagctcttaatattgaagcagagaaatatttctaagctgcaatggaccttggcttgtgcattaatttgggctcaatgagctgccaaagttaagtgaacttttacttgaagggcagtaaacaatgtctttcagaagtgtgactctgtttagagagaatagtgtttagaatttttccaggagttgattaagctgggaggtctgtatgtttcttttgaaatattgaaatgtggaatattgtctgtctctaatctcctgacatctttctcagagattatttaaggtagttactaactgtcactgtctactgcacttactgggtcagtacatgtcacaagtgtggctctgtttattgatctggttacatttgactatatatcacttaaatctgaaaaatattgacttaaacaagtaaagggtttattttattttatttcattttttctttttatgtaacaagaagtctggagacaggcagtcaggatgtagtctggtggcgccttcttcttcccactaatcctccttgaaattcccatgctgggaagttgactgctccttctctagaccatgagtttacattttatgcaggaaaaagggtttaagaacatagtgcaaaaggcacatgccagctgctcctttaaaaaataataatcaggaaaatacttgctctccctgcattgagaaatctacattcagtagatttctgcttacatctcattggctaggaccatgttacctgaccacacatagctacaaggaagcctgaggattgtagccagacaccttgctgtcctaaacagaactgcatttcttttggaagaagaggatgatggtgttgggcgtgcagcttgctgtgagtgctgcacccttcatcccattactcaaaatggcaaactagttgatggagcagaggatatggcttaagtgtagagatgtttgctccaagcctgtatgaaaaagttgcctgttttaaataagtaaaggaaaatccaacctcagtagcataatccatgattatattatgaggcaacattttagatttttcttgctcctctctgttgacaaatatgcctttttagaattattgggaaataacatttttcataaattgtagtaccttggcagagaaggcctcagatccttcctgtcaaactgacataaaaatatcctaaccatagcctgggccacatggggagacatcatctgtaccaaaaaaaaaaaaaaaaattgccaggcatagtggtatgtgcctttagtcccagctactcaggaggctgaggtgggaggatcacctgagaccgggaggcagaggttccagtgagccaagattgtaccactgtactcccacctgagcaacagagcaagaccctgtctccaaaaaaaaaaaaaaaaaaaaaattccaatcatttaaaaattaaagtgagaagactgagaaatgtcaatagaccaaaggagactaaaaagacatattgagaaaacacaatgtggtatcctggattagatcctggaagagaaaaaggaaggtagtgaaaaaatgagcaaaatctgaaaaaagtctgcagtttagttaatagtaacatacagatgttgctttcttagttgtgacaagtgtaacatgctaatgagaggtgacaacgtgctagcagccctcatttgctctcggagcctcctcggcctccgcgtctgctctggccgcactcgaggagcccttcagcccgccgctgtgctgtgggggcctctctctggggctggccgaggccggagttgactccctctgctcatggggaggtgtggagggagaggtgctggcgggagcccgggcttcacgcgcgctcgtgggccagtgcgggttccgggtgggtgcgggctcagcggccccacactgggtgcagctggctggcgcctgttgggcttgatcggaggctgggtcccgtgcgtggacttccgttacctctttgccggctcattggccaccatggcgggtctccgtctctttgtcgtttcccgttttttcctctaggttgtctgggaggagctccatctgggctgccagagtgcctgggctaggtactccaaagtcccctggcgagtgccagtaagaggtaaagcctgctgggcttctgggacaggtggggacttggagaacttttctaactaaaggtttttaaatgcaccaatcagtactctgtgtctagctaaaggtttgtaaatgcaccaatcagcgctctgtgtctagctaatcggctggggatttggagaacttttgtgtctagctaaaggattgtaaatgcaccaatcagcactctgtgtctaactaaaggtttgtaaacgtgccaatcagcagtctatcaaaacggaccaatcagctctctgtaaaacggaccaatcagctctcagtaaaatggaccaatcagcaggatgtgggtggggccagataagggaattaaaagcaggccaccccagccagcagcggtaacccactcccattcccttcaatgttgtaggagctttgttcttttgttcttcgaaagaaatcttgctgctagtctctctttgggtctgtgctgtctttatgagctgtaacactcaccatgaaggtctgcagcttctttcctgaaaccaccgagaccacaaacccaccaggaggaactaacaactccggactcaccgccctttagagctgtaatgctcactgcgagggtctgcggcttcactcctgaagtcggcgagaccacgaacccaccagaaggaaaaaactccggacacgtccgaatatcagaaggaacaaaccccggacacaccatctttaagaactgtaacactcaccgcgagggtcggcagcttcattcttgaagtcagggagaccaagaacccaccaattccagacacactaatataaagtgttaacattaggggaaactgggtgaggggtgaagcttatatgagaactctgtatcagttttgtaccttttttgtaaattgaaaaatattctaaaataaaaaggaaaataatttttcttccaacatttcctcattataaaaattaagggcagctgagcacaatgactcacacctacaatgccagcactatgggaggccaaggcagatggattgcttgagcctaggagcttgagacgagcctgggcaacatgatgagacccccatctgtacaacaaaatacaaaaattagccaggtgtggtggtgtgtgactgtagtcccagctacttgggaggctgaagtgggaggatcgattgagttggggaggtggaggttgccatgagtggagatcccaccactgcactccagcctgagtgatagaaccagactctgtctcaaacaaataaaaaacagaaaaaaattaagggaatgctggaggaaaaattattacatgacaaaataagtatttacatagaaaaaacagcaactgtaatttgaatgaatgagatccaaatgtactagtatgagcctaaggtattttcacagctggaattttggcatgtccgcaaaattgctggtagaatgatctgcaataagtctattttttcatgaggaatgggaggcctattaagaaagaatgtatagagagatcaagcaaatgtggttcaagaacagtggcctgcatggacaggaggactgatactaaatatattatcagtttttcagaatgcatcctggctccagaacccatggcctcctgctggagttctccatgtaaaagaaccagtaaaagcattcataaagctggcacactgaggaggcaaggaatcgattgcactgggacaagatctttattattttattattattattatctatttgtagagatggggtcctggtatgttgcccaagctggtctcaaactcctggcctcaagctatcctcctgcctcaacctcctgaattggtaagctacattttaaacacactattattattcatggaaactgaccaactaattattcagaagaaattaattcttcaacattagcatttggagctgggatgttttcaataagcccagatagttactgaatattttttcccaaggccacaagtcttgggaaaagaatagtttgtttgcttttcttttattttctttttcttagacttaaaatcttggcttgaggctgtggtatctgagctggcaaatggaaaatttggactgtctaataaaagttgggaaagtgcagattgtaaaagatgcgaggggttgttaagtggacagtattattggacaggagggaaatctatagtattaacagttcagtagtagttctggcattgggcacacaggacaggagtaaactgagcaaggcataggagatcccgtgcctccctatcactgtcaggtcacaatgagctcctcctgcatgaacagccagaaccaaccacaatgaaggatgccatgagtcaggtaggcaaaggaaatcagaaagacctgtggaagaaaagctgcactgcctagcttcagagctcaaagagtctgactgcaggcacaaggaaaacatagaattagaaaaaaaccttttcagaaagcaactctgcggagacaggcttgactgagccctgcccccaagttaaattgctgctgaaaacaggtgctgattggacatgcaaactgagaactgctagtattaccagccagaagaaaatagttcatctgaagcagttaaattcctgaagaatatattactggcatcggtcccacccaagtctgagtaggaatttcaacttctagttgacctcttatggttctgacaaaaccatacaccattcttgaggattttatgaactctattcactagattatttggaaggaacagactttgtgccttatcactgtgttgatcatgaggtaaccacagagtgcaaaatggagtaattttggatttttttgtccttttcattgaagtgtaatttacataaagtacaatttacagccttcgatatatggttctatgaattttgataaatcatcacagttgtacaatcacagtctctccctctcatacccagcccctggcaaaaacttacctgttttctttccctatccttttacctttcccagaaagtcacattaatggaatcatatgtaatgtattccctttggagtctgaatttgtgcacttagaaaaatgctttggaactttgtccatgttgtttcatgtgtcagtagtttgttactttgtattgctgagtagtagtgcattatgtgcatatatggacatgtaccacagtttaatcattgtttagaagacactgggttgttttcccttttaggagattatgaataagcctggcataaaaatttgcatagaaatatgtgtgtgaatacaagttttttattctctcaggtgaatgtacagaagcaggattgctggattgtatggtaattgtgtgcttactattatgagaaactgctagctgatttttgaaagtggctattctgcattgccaccagcaatatatgttgctgaacatttttgccagcactgggcattgtcattaaaaaaaatcgccagcctgatatgtgtgaagtgataccacatacgggttttaatttgtattttcccaacagcagcatgttaaattcatgtgtttatcttctatagtaaactgcccaaaaattttttgcccatttttaaaaggttgtttgtttatcttaatattctgttttgatgtagtaaaatttattctttatacattgggctttatgtgttctacctaatagagtctttacttaccccaagatggtaaaggtctctttcctatattatattctagaagttttatagatttgattttagatataggtttatcatccatttcaatttaaaaaattttaaatctattttttcttttcttttcttttttttttttttttgagtcagtgtctggctctgccacccaggctggagtgcagtggtgcgatctcggctcacagcaacctctgcctcctgtgctcaagagatcctctcacctcagcctcctatgtatctaagactacaggtcacaccaccatacctggctaatttttgtgtttttttttttggttttttttttttttttttgtagacacagggttttaccatgttgcctaggctggtcttgaacttctgagctcaaatgatctgcccaccttggcctcccaaagtgctaggattacaggcgtgatccaccatgcttggcctcatccatttcagtttaacttttgtataaattgatggtatgggttaagcttcgatttttttcaaataggtatccaattgttcctgcaccaaatatagaggtaggctgaaagatgggaggtaaggagagataaaggcctttttaaaggataaggagacgaaggtagggggaggtgaaagtgtactaaatgttttatcttcctggcattggaaaaaaatggggaagaaatagaacattttgatagaggccacatttgatatgctattttaagtaaatagtaaagaaatatgtgtattagaagaaaggaaaaatagcaaacagcaatacaaaataaatagtaaatataaagcaagctgtaaaacaaaataaaacgtgatactttatattatatttgaatggactgatctctctcgttaaattacaga

SEQ ID NO: 154 - DNA, 18760 bp, mus musculus
gtttcagtgtttacacccgcagcgggccgggggttcggcctcagtcaggcgctcagctccgtttcggtttcacttccggtggagggccgcctctgagcgggcggcgggccgacggcgagcgcgggcggcggcggtgacggaggcgccgctgccagggggcgtgcggcagcgcggcggcggcggcggcggcggcggcggcggaggcggcggcggcggcggcggcggcggcggctgggcctcgagcgcccgcagcccacctctcgggggcgggctcccggcgctagcagggctgaagagaagatggaggagctggtggtggaagtgcggggctccaatggcgctttctacaaggtacttggctctagggcaggccccatcttcgcccttccttccctcccttttcttcttggtgtcggcgggaggcaggcccggggccctcttcccgagcaccgcgcctgggtgccagggcacgctcggcgggatgttgttgggagggaaggactggacttggggcctgttggaagcccctctccgactccgagaggccctagcgcctatcgaaatgagagaccagcgaggagagggttctctttcggcgccgagccccgccggggtgagctggggatgggcgagggccggcggcaggtactagagccgggcgggaagggccgaaatcggcgctaagtgacggcgatggcttattccccctttcctaaacatcatctcccagcgggatccgggcctgtcgtgtgggtagttgtggaggagcggggggcgcttcagccgggccgcctcctgcagcgccaagagggcttcaggtctcctttggcttctcttttccggtctagcattgggacttcggagagctccactgttctgggcgagggctgtgaagaaagagtagtaagaagcggtagtcggcaccaaatcacaatggcaactgatttttagtggcttctctttgtggatttcggaggagattttagatccaaaagtttcaggaagaccctaacatggcccagcagtgcattgaagaagttgatcatcgtgaatattcgcgtccccctttttgttaaacggggtaaattcaggaatgcacatgcttcagcgtctaaaaccattagcagcgctgctacttaaaaattgtgtgtgtgtgtttaagtttccaaagacctaaatatatgccatgaaacttcaggtaattaactgagagtatattattactagggcattttttttttaactgagcgaaaatatttttgtgcccctaagaacttgaccacatttcctttgaatttgtggtgttgcagtggactgaattgttgaggctttatataggcattcatgggtttactgtgctttttaaagttacaccattgcagatcaactaacacctttcagttttaaaaggaagatttacaaatttgatgtagcagtagtgcgtttgttggtatgtaggtgctgtataaattcatctataaattctcatttccttttgaatgtctataacctctttcaataatatcccaccttactacagtattttggcaatagaaggtgcgtgtggaaggaaggctggaaaatagctattagcagtgtccaacacaattcttaaatgtattgtagaatggcttgaatgtttcagacaggacacgtttggctataggaaaataaacaattgactttattctgtgtttaccaattttatgaagacatttggagatcagtatatttcataaatgagtaaagtatgtaaactgttccatactttgagcacaaagataaagccttttgctgtaaaaggaggcaaaaggtaaccccgcgtttatgttcttaacagtctcatgaatatgaaattgtttcagttgactctgcagtcaaaattttaatttcattgattttattgatccataatttcttctggtgagtttgcgtagaatcgttcacggtcctagattagtggttttggtcactagatttctggcactaataactataatacatatacatatatatgtgtgagtaacggctaatggttaggcaagattttgattgacctgtgatataaacttagattggatgccactaaagtttgcttatcacagagggcaagtagcacattatggccttgaagtacttattgttctcttccagcaacttatgatttgctccagtgattttgcttgcacactgactggaatataagaaatgccttctatttttgctattaattccctccttttttgttttgttttgtaacgaagttgtttaacttgaaggtgaatgaagaataggttggttgccccttagttccctgaggagaaatgttaatacttgaacaagtgtgtgtcagacaaattgctgttatgtttatttaattaagtttgatttctaagaaaatctcaaatggtctgcactgatggaagaacagtttctgtaacaaaaaagcttgaaatttttatatgacttataatactgctgtgagttttaaaagtaaagcaaaagtaaactgagttgcttgtccagtgggatggacaggaaagatgtgaaataaaaaccaatgaaaaatgaactgctgtggagaagtgttacatttatggaaaaagaaataggaaccttgttcatcaaattgatagaaaagcttttaaaactaaacaaatcaaacaacttgagtataatggaattcagactttgatttgcctaacataaccaccatatttgcaaggacagctctctatcttctggtgtttattcttaaaaacttaaaagttagatttagcgatcaccagagccactacttttatgcttaggtatttgtttgacttagaaaaaattggtcacgtgtaccactttatagtgccctgcaggtgttaagatatgaaggcactttgacttacacctcataaaatctttacaaagtattttctaaatgaataatgatgaaataaagtctttattctaggtgcatctgccccacataatttgttttctttggactagaagttttgatgtgttgagaatggtaatgaattaactccattttaaatgtagaatgcgtatcactccaatatgaatgccctaatgaatcctaagatttgtaggttttgtgtactagtatgaaaattactaaagatggaaaaatcacatgttggagacataagatacaaacctttttgttttctgaaaatacaacctctgatttctgattccttgttgtaatatggtgtaattatactagattgtaattttgttgttagattatacttttttaagttcagtgtttgaggacagactttcatttggttagtagtattatggcagctagcagctaaatatgataaagtgtacaatcaaaaggatatttttaatgaagatattagtggtctaacatgtcatttcagatacatagctgaaatgtagtaaaatcagttttactacaaataaacttgcataaggtttataaatttataagtttataaatcaacttgggtaaagtgtaaataaacttgcactcgtggtttctctgaagtctcctgagctaactttgcataaaggtgttattctgtacttcgaggaagtgaattattggggtcaaccacattttttttccttcctacagtctgattgccctttttagtttttaggatctttgtggctgcatcatttttccccttttgaactgtgcattttctaaccccatacttaaatattctcataacctccaaattattaattagatgcaacattcagtggtatattactggagtttctgatttctgcccactataggaatgtgcttcctgagaagattgggatcgtgattataataatagttaacaggggatgagtactttctaggtgccaggcactgttctctctgatactttatttgatgtattgttgttattcccattctttaaatgatgcacagagaggttaggtaagtgacttactaccaagtgtcagggccattaagggtcaggattctgaattcctgaaatgatgaaatttagcttgaagaaattggtttgatttcctgcttagttttcaatttcatggtggtctttgattgtattttgtgctataacactgccttagcatcctataactatagttacagtgttatattaccattttttattgttaatacaaagccatcatgaaataattcagtttatgtgccagctttttttgttactaattcttgaaccttggcgctgtacttcttcatgtggatgcctgttaaggaaagataaagttagaaatctttgaccctgctaggaaatttgtctttgttatattgggagctcataaaactgaagtattcaaaagttagaatacatacacacaagaaaaattagtaactaatttaataatgttttctttgcacatgtctctgttgtcttttggtcagagtgaagctaaatgtgtttttcacataatttgtagcctatatgaagtcctggacatgtggtatggttggaaggactgttgatgaggtttattgtctctctttattcttttatgttgttagtgtccccatacaacggggcggggggagtggggacaaaatgataacttgctttatatatgaagccttgggtttgaatcatactgttatcacatttcctatgtccctatcctgtctcctgcaggttttctttcttggttttcttttttggttttctttcttcctttcttcctttcttttcctttctttcctttcttccttttttctttccttttcttttttcctttctttccttcatttctctcctttgctcctttagtttgtttctttgtttctttggtttgtttctttgtttctttggtttgtttctttgtttctttagtttgtttctttgtttctttgtttctttcaacaggtctcactgtcgcccaggttggagtgcagtggtgggatctcagctcactgcaacctccacctctcgggttcaagccagtctcatgcttcagccttccgggtagctgagattacaggcatgtgccaccattcctggctattttttgcatttttagtagagatgaggtttcgccatgttggccaggctgatctcaagttatctgcctgcctcagccctccaaagtgctggaattacaggcatgagacaccgggtccagcttccagcaggttttctttaggagggatattttacaatgctgtaagtttttcctaacgagaattatcatagcactacatgttctgtcttcagtaagtgatacaagcttactgatgatgttgtagttatgttcattggtggtcgggtgtacattgaaactttaacacataatagcctctcctgtgagcagtggttcctgttggtaagatactttactaagggaaggaatgtgaggtgtcgctggggagagtttacccaaataaggatggactttctgtctttgtttcatcagtcctggtaatagaatgtttgaatagatagctctaggcattacatactttcataaatatgattattgtaattacctctttggcccagttgctagtaaattagggaccccttaatgatttatttcctgtttattcaccctgatgaagaacttgtatctcttttaaactgtactttatcgcctttctcaaattccaagattctcatcacattttttttcttcccaaactctaaataaccttttaatattaagtatctttgtggaaacattgttttctttttctatcccaatttttaaagcttttttaaaaaaaagagtgcttttgttgggatgtacattttccaaatgcaaaaacatttatgattctgtgtctcttataaaatatgacactctctacttttctctcatttatttagtgccacctatgtgtgtaatttcattacccacagcagtcttaggaggctggtcgagttccttatttgcagatgaggaatctgaggtccagagatcacttcttggtgagagtctcacagctattaagtattagagccaagattttgaacgtaggtctgattcacagcaaaaccgttaaccactaagtacactgactccagtaagagccctagtcctcacccaatacactttaattcccctgtgcattcattcaaattcattgaatttgctgcctttggaaacctctcaggaacctcctcaacctctcttctctacagacatcagctttgcctgataggtagggatcatagcaaaacacagttttccaaggtggtgataggtggagtgatagtgctctggagatggccaaagaaggaaggtatgagtgtatctgtgggtgggtgagtggtggataaggggaaggacagagccaaaagcgacggctattggaaaaactatgatgagaaacaggaagatggaaccttgttggaattagtgaaagaccttagaattcacaggaggtatttgtccttcacgcgagtgtagaccaaacgtaacctatgagtttcttttattccacttattaaagcagcaaccaaaggtattatataccttctgtattcacttaaaatgactgattttgaaaaagtcatgcaaacatccatttacagataagcctcattaactcaaaggcagtggccctgttgggctctgatgattactcaaaccatttctgacactctgacactacatccggaaatcatccggaaatgcattcagagcctgcaaaagctttttttttttttttttttttttttgaatagctacagcacttgcagatcttcctcctttgagagaatatttgattttaggaaataagcaaatgtagataagtatgattcaactgggcaataacttttaggcaaagagaaaaaaacaaaatatagcaatgtagtaataaggctgatattatagtgcttttatgatgagtctgaaaacagtctccaacatttgtaaatgttttaaatcgggtctgtctactacagtagcccttaagccatatgtagctattgagcacttgacatgttgcaagagtgaattggagactgattttaattttatttaattttaatgtaagtagtcgcacatgacccgtggctactatggtagatggcatagttttagacaagggcagtagtcttgggtagatacttgatttacttagaacatttctttacctagctgtaacaaggttctaatagctgattaaaggacaacatttttagcatgtaatatacagtaaggaactaatgttaattactgccaagatgtataaacattatgaaaccttaaacaaggatgaacacagaagcagtggcccttctttgtaaataaggggtcagttacttcctaataggtgtcttagttttagttaataatctaatagcacccccaaaaagcaaactgttaatttgttattagccatcctgtaaagacaagggagaaatcggggccaggagagtcctctttcccattctccataatttttacgacctatagaaataagagcctaagagtgaccagttcctgcaacctaactcaaaattaggcctctctgttgaagtaatagtgaggcaaacaatcccttgaagcactggggcatgcacccttatgaaatctaataattctaaaatatcattggcagtattaagctagagttctcaaaatatgctgtagaaaatattggtcatttaaatatagctgagtaaaaataagcaagatcaaaatgataagaaaatgttgatttctccccttttgaaccagtaactaactataagggtatatacccatgcttaacttaaaaataattatttagccaccttgggtatagcacaacatatggatgccattatagtccaccttgatcttacaaggaagctttcttttagcgtagctttacttttatttaagcattattgaagaagcttggtatctctgtttaagttgcttctgtatcagtgttttccagggccctgtctcagcttccatagttttccttaagagcagctaattaatgcttcactccatatgctttaatttgatattttgggaagtttcattttttaaaataatctttttatatcataggcctttgaagacatatttgtttacaaagacatctgcattgaaccatttgtttttaaaaacatgtatcgggcatgtcctatataccagaaactatgccatttactgaggacaccgaagttagagaatggtcttaatccgaactagttattgtctcactatccaatatggatatcaaacattcagcgtcatgaggatttactactgtgttttctcccaagagttttataattttagctcttatatttaggtctttgatgcatattcattgatttttttttgtatgcagtatgaggtaaaggttgaaacgtattctttttgcatgtgggtgtccacttgtcccagcttcattttttgaaaacactatactttccccattgaattgtcttggcttctttgttgacaaaggatttattatttctgccacaacccagctgtttctcactgtctaaacctttatgcctgctgccccgtaggcttagtggaatgcctctccatcctccactctcttttgtttagctagtacttccttatcctttaaggggtcagtaggaacctcaccttcttcagtatgttttcctttgtcttatcaacctaccaccatcacccacacacataccttttccctaaggctgggataggaacctcttaggcaatgatctatttgataagtactcactgagttcatactagacactctgcagtatatccgtaaatgaagtaaaacctgacaccaccctcagaaaacttactgttagtgagaaaatgggctataataatagagtggggtaagtttattgtagggataagcataggatgctatgagaatgcagaggacaggaatttaacctagacttctcagttctcccgttgaagttgacatctgaactgaaatctggaagaccagtaagagatagctatgtaaaaagaggggaaggacaataggaaagaaggaatggagagaggcccagaaactacagagtatggcacaagtagtttagcattgttgggtcacaaattctaaggatatgaaagataaagttgaagaagtggtggggctggggaggacagctcctgtagagccttttacagcgggagaaggagtttggctatggtcctgcaggcagggagaaaccactgaaggggagaaacatacagaataaatttgagtaagaagcttaaatctccccaagcccttttaaaataaattaagatataaagcctttgggtttctttatgctttgtcctattcttctaattgtccaaaacaaaacaaaaaccttccttttctgtacctattaaaaggttaattttataaagttacagacagcatgctgattaaagaattcttgataattagctattttgtctgtctttgtgtagattactaacaattgtgtcatcagatttaaaagatctaaacctctggactttatatattttttctacaagtactgtgagattgagaacttaattcaactctagtaactggactttttagtgttgtttgcagcatatgattgttaaagaaagtttagtatatttgtgtgtgcgtatatatatatatatagatagatagatagatttgaggttatatttaatcattgactattggtattctaagattttaaggagagaaaggtaggttacaatatatggctgatatatggttctggaacaattttcttagttttcagtaattctacctaaaatgtacgtccagctttgcactcactaccacattgtaatttccagtatacttgtctatttttcgagatgttgaaatctgtggagaattttttctcatgtttagtgttttagctatgtttatctctagggtatagcacatacaaggtggcaatatagatgtgcttaatgaataaaatgatcttcaaaaactgaccttcatttgaagttctattttattcataaacacataaaacgtttggtatcactgtaaaatttaactaaaaacaaaaactatctttaagctcacaagttaatttaacgttttttcttacacaggcatttgtaaaggatgttcatgaagattcaataacagttgcatttgaaaacaagtaagtgtctcgttatataattttaatgatgaggttctttaatattttatgctaattctattcttcattttttaaaaattcaagtccagtttgagtgcttttcaggaatggatcttcatgttactgactgagaagtttctgaacaactcagtattaaactaatggaatgactgtttctgctaatgtcctggaggtcccttattgtatggtattgatccttacgtcttaattcccttgaatgtgaagaaagaaaccagagagtcttgtgtattagtaactggaagttcgcataggagtatttgtaaattttaaaaagatagtaatgaaaagattcatgggtattgctaaaaagttgtatgtgagttctttaacattaaatctaaaactgatggttttagttgtctagtatattttatggaaacagtcatgtttacctattatctgattttttttaatgtttcatatgttcagcaatagcagtagctgatcttttctgttctcttttgctagatgaagaaataaaaacagtcataggcctaggaatattaactgtatgaaagcatcaatagtatagatgttaacattttattggagaacacaagtctcttgactaaatgttttgaatgctaataaaggctattttcagggtagctgttggtaagattgtaaagtacatataaactccttagtcaaagtgtagatgtggctatgatcttaggattttactaaactctgatggatggttaacagttatcatttttttggctcttatataccaagaaaattaataatatatcaaaagcaggctgcaaatctatagagacagaaagtagattagtgattgcttgtgctggggctggtggggagaacatagctaaagagtacaggatttttgtgtgtgtggcaatgaaaatgttgtaaaattgactggtaattattgcacataactgtaaaccttctataaaccattgaattgtacatttaaattgatgaattataatgatatgtggattatgtctgctaaaatgtagtatgtgacccaggcatactgagcaataaatacacacatcttgcttctaaagtttaaaaccaggcctgtgtttcagtgtctagaaaatatatttcataattgaacttagcagattcttttggctagcaacaggacaaagtagtatccttagatgcctgaaacacgtgtagggggacagagataaaaggattaaaagcatctaaccctatttctggctctggactaataatcgcagaccaaaatacaagtttgaatagtagaatacctttccctgaatacataaagccaaaagttttagtatttgtctcttcgctgtttcatatatccatggctatgcaatagacaacagcatcacaccaacagaggaatctttgataacttggagggtatttttttcttacaattatacactttatctacttacttacatcactaggtaaatgctgtttcccataaagggagagttgtctttatttgctactcttttagtttttcctgtagtctataatctaaagtgttaagcaaacactcatttcctctatgcatttaagaatttgtctagtttatacattgatttattagatcacttctttttaattttcaatcagatttctaccataaacttaaaattatttcatctttggaccttccaattatttatctcctgtaccatatctgcatgaaagtttctcttcaagctctttgtcatcctgggagtttgaaatagatcattgattttcccttgtgttcatggagtatgtttgcaatacaacactgggtttgagcacatcaataggatttaataggtctccaccaaagtaatctctttgcccttccttgtgtgtttcctttttggttttctgttagaaacaaaacgaaaacagtgttttgtaaaacaccagattgtatttaccctttctttcctttcaatcaggaagaagctcctgttactgatagcagattgttttaggtgctttgtttttaggtgcttcctaaaccttccataaagcataaaggtgttttcatatttcacattttttaataaggaatttgaatttttatctgtatacacttaaaatcattattttttccttggaaccattgagttatatattattatatgctttaaaatcaaatttagcaatgaatgtataacatctattaggtgtgtataataactcagaggagggttcagttaatttaggccctaatcagatttccacaaattctgacttaatatttgcccgcttatataacagctcttctttaacaaaaacaagtacttttctcaatagaattttactaagaaagctctttagtaaaacatcgacattatacatacaacatatctcagtatctgctgatgaagaacaccaaaaagaacccagatgtgactgctccggaagttgaatcctcagtatttttgcaaagtttgtctttcagtattttatttgtgtgtgtgtgtgtgtgtgtgtgtgtgtgtgtctatatatatatatatttttttttttttaaagacaggatctcactctgtcacctaggctggagtgcagtggcatgatcatggctcactgtaaccttgaactcctgagcttgagctatcctcccacctcagcctcccgagtagctgggactataggcacataccactgcacctaatttttttttttttttaataatttgttgtaaagatcaggtcttaccttgttgcccaggctgctcttgaagtcctggcctgaagcagtgctcccacctcagcctcccaaagctctgggattataggcttgagccaccgcatcctaatattttatatttttatggatataaaaaataatttggtatctttcagagttgtttaatatcattttaaatttaaaaacataggcaacttaaactcctataggctgtctccatcgggtttctgtggtttaggagaccccaccatcccagtgcatgctgataacgtcatactgatcagcatccagctacccacagcaagaattgaccacctcgtgggatctaaaatttaaagggggaaaagtgagttgtgaattgctaatgtgctgatagccccattttgcttgggaattagagggcagtttttgtggtccttggaatgtggttaaaattcttctgcaagtggaagcatatttatattactaacaattactggtactaatattcaaatattgaaggaaatttctgttgtggacttatgtttaaagctcttagaagttgaaattattggaaagaagacttgttttgaaaatcataatgttgctgtattgtgtttagagaaatattccaaacgggagtaggctgctgtgctgcatgcagactttgctgaaatgttactatattgccgttatgtcccactcagcaaaaactgatgattttaaagcttttgcttcttgaaactagaaaaagaggggtcagccttaaccaaaagttgatggcagagtggtcattatttcagttaaacatgaaaagcatgttaaataattgtatgtttgcttatttacagctggcagcctgataggcagattccatttcatgatgtcagattcccacctcctgtaggttataataaagatataaatgaaagtgatgaagttgaggtgagttttccctgccataaagtcatttagcactgaaagagtggggttaatttatctgtgtttttttttaatactttgtctttaacactgtttaaattactttgagaattacagctggaatggacacgtgcttttgactaactcatcttattaataattcaaaatgatacatgatgcttacatttggctatttgagcagtactcagagcatgtatttgaaagtcactgccgcaagttcctttgcccactagtaattcttttctccttctctcaatttctgaatctttgaatagtatgttgtttgtttacaactgtgtccccattgtaagcaaaatggattatgaaaattaattttacacaggaaagaaatcatgctttattacaaaatagtatactagaatttctttaagtagcagtgaatcttcttggtatatttttaaaaacctacaagctttagtttatacatattggtaaaatctctttttcacaggttataccgtgaactacctgcttatctcccgttgagctctttgaccaaaatgtgctatggagatctaacatgtgaacagaaatgttgtgtttgtgatttctttctccattagaaattggttttgtatttaaggcgcttacagtgcctcatatagtttgtgtggtatcttctctcctttgtatcctttcacatactccattttgagctgcttctcttctttttctacaataataagcataatgccttactattagttaataatagttgccgttccatgaatatttgtagtatgaaggatgtcgctaagtagacatttgtgcaggtgaggcagagtggttctaggtcctgtccttcagttctttatttatttatttatttattttttgagatggagtctcactcttgtcatccaggagtgcaatggcgcgatcttggctccctgcaacctccgcctcccgggttctagcgattcttctgcctcagcctcctgagtagctgggattacagtcgcccaccaccacgcccagataatttttatatttttagtagagacggggtttcaccatgttggtcaggctagtctcgaactcctgacctcaggtgatccactcgcctcggcctcccaaagtgctgggattacagatgtgagccaccatgcccagctggtccttgaattcttatttgctgcactaggtagtaaaggtgtagcaaaaacaggacagaatcttctgcctttgatgaaatcacattccagtaaggatagctaatatgacagatgtgagtcttaaagaaaaaaaaagggagaggatgaaaggtgatttagggacaggattgctgtttcagagagtagtcagggaagatctctcaatgtccaggcctgtgtttttctctctacagttttaaagtggacataggatatagtgttatttattttccaaaaatgtaaccaatctctactaggtgtaagcagctgggcttggttttgcaagggatcttaatagggaacagaaacactgtgtatgcttagctgtccacttccccagaagactgtaagctctctgaaggcaagacccaggtctttggtctgtattaggagtacccagaatagtgtttgatggagggatgaaagggactttttctccccagcttggtcacttgacagatcgggaccaatgagataccattgctaggatgacctcactgtcttacacaccgattcgttgaggtaatttctctggctagagtagttgagaaagatggaagcaagagggaaaggtatgttaagttgtattcagtcactgtattgtgtgatcattaactttggttgtaaaagggagacaagttcgagcttttactctacttgtcagccctagactttgtacctctcttggcctcatgtctttatcccccttgtctttcttatttctcttttctgcttctgagtatccctgtctctctgtccatatatactctgttgtctcttttcctattaaccttgatttgctagggtcttcatgaaaggttccatgctgtacatcttaagtgaactttgaagtggtcatcaaagagatcagttagaagaactgatctgcagtgtgtgacagaccaggaaagtgatatccagaggattgccaccatgaagttgtcatttttagtggagaggaagcaggagaccagaaagtgaccaaggatctgtccatttagttccaggagatatgactgccagagtggtatccttagtgggctgaatgttcagtggtcttactttagtgaccaagcaacaagacagtagggcatggtcagtaactttcagtcaatttttgcttactaggataaagcaaaaataagcttatacatttttagatacattttttgtaacttgctgagtacccaaggaaagtgtgcttgtatttatgggcgtctattttcagagcactaattattgctgaattagaacagaaatataggaaaactgatttttacaaggagcttcaaagcaatctcaggtagtttctgattatgtatctctgcctacctcggggtacatagacagggttacaatttggttgaggatatatgacatgtggtttttaaagacacctaggggcattttaagaaaatttcctcgatatctgaaaatctgtagatttcaaaattatgttaatcatgaaatattctgtgttgtaatttttgtgtaggtgtattccagagcaaatgaaaaagagccttgctgttggtggttagctaaagtgaggatgataaagggtgaggtaggaaaatgcctatttaaatttttttcttatattgtttcctttttttaaacccaggttgtacattcccgtgtggatttctattttgaagtaatatctaattttgagtaatttaattaaaatgttttcactatgtgttcagtatgtttctgttggtcataaattttttcacatagattatttattttaaaataactgaatagggagaacttcttattcttactttaaaaattgtgattagaagtgacttttatttatttctcagttttatgtgatagaatatgcagcatgtgatgcaacttacaatgaaattgtcacaattgaacgtctaagatctgttaatcccaacaaacctgccacaaaagatactttccataagatcaagctggatgtgccagaagacttacggcaaatgtaagttgatacacaagaaatgctgagaacttggaagtgatatgcaattagtttagaagaatttctagtagtttaaaattttttaaactactagaaattgattttaaatttggtggactttggcaaaaatggtttggtttgcaagagcaatggagaaaaaacttatttaacttttcctacttatagaatcaaggcagccttgcgcttgtttaaacttacttggctatacacgtgtctgatgtacataatgtacatttgttttctaaactaactttgttcattctaagatttaaaaactgatcaaacaaatgtgataattctgtcataagtcacaaactataaacgatttctccgtttttttctcttttacctaaaatgttttcagataaatgtgtaataagtagagccaaagaagctttaaaaagtcatctcatcttacaatccttgatctggaataatgcttaaagactatagaagagacgcatttttattttttacagattttattaagtgaatacagtacgtttgatttggacatgttgttgaacattaaattgcagttcagaatacatagaaatcctcccttttctagagattgtgtatgtgtgtaaatttttgtgccttctggttcatgtacgtttccttctctccctcaaatcgtttagcagtttcttaccccattctccgtgatgtgcttatttcatattgcatgcctgtatcaaaacatctcatatgccccataaatatatatacctactatgtacccacaaaactaaaaattaaaaaaaaaggaaaaaaaaaggcctgcaacaagagaagaagaaagaaatcagataccctgtaggtagctatctcccaaaagttttcaatagttgacttaagaaaactactgacttgtatgtaactgaaatcaggaaacctgtagtgtagagtggttcccctgaatatgtctcttttggtaatctaagctgtatttcagaaatgtacagaaaaggagctaagcttctaaatggatatagcatattttgcataaatcaaatttaatatgaatccatgattcttgtatgtgtaaatctgcctgcatttatttatgtcagtagttggtaattattcatcttaatttttttttttaaatttctaggtgtgccaaagaggcggcacataaggattttaaaaaggcagttggtgccttttctgtaacttatgatccagaaaattatcagcttgtcattttggtgagcatttttgagttgtttatttttagtttaattcatctggggcaattgccttgataataatgttgttaatttaaatcatttagtccatcaatgaagtcacctcaaagcgagcacatatgctgattgacatgcactttcggagtctgcgcactaagttgtctctgataatgagaaatgaagaagctagtaagcagctggaggtatgtcactttccctagcactgcttgtaagggtacctaggaacgattaactgtatcattccacaacttgaatatggggagcttgtcatttatttactgcttcttaacaattccttaggttctatagttggaaaattgtacaaagcataatcatactaaagtttccatgcctgaggtttcaaaattaaacagcagcttatgtatattaagggacttctggtactttcacttttactagaagtttatcaaagttgctaataaaatgcggcaatgcttcttccatataacatgttgtcattaaaaatactagagaatatttaaatatctaatcatattcctctcattatgtatgtttatctttgtttaaaagggtatagaacttcttcattctaat

SEQ ID NO: 155 - DNA, 38798 bp, mus musculus
gtttcagtgtttacacccgcagcgggccgggggttcggcctcagtcaggcgctcagctccgtttcggtttcacttccggtggagggccgcctctgagcgggcggcgggccgacggcgagcgcgggcggcggcggtgacggaggcgccgctgccagggggcgtgcggcagcgcggcggcggcggcggcggcggcggcggcggaggcggcggcggcggcggcggcggcggcggctgggcctcgagcgcccgcagcccacctctcgggggcgggctcccggcgctagcagggctgaagagaagatggaggagctggtggtggaagtgcggggctccaatggcgctttctacaaggtacttggctctagggcaggccccatcttcgcccttccttccctcccttttcttcttggtgtcggcgggaggcaggcccggggccctcttcccgagcaccgcgcctgggtgccagggcacgctcggcgggatgttgttgggagggaaggactggacttggggcctgttggaagcccctctccgactccgagaggccctagcgcctatcgaaatgagagaccagcgaggagagggttctctttcggcgccgagccccgccggggtgagctggggatgggcgagggccggcggcaggtactagagccgggcgggaagggccgaaatcggcgctaagtgacggcgatggcttattccccctttcctaaacatcatctcccagcgggatccgggcctgtcgtgtgggtagttgtggaggagcggggggcgcttcagccgggccgcctcctgcagcgccaagagggcttcaggtctcctttggcttctcttttccggtctagcattgggacttcggagagctccactgttctgggcgagggctgtgaagaaagagtagtaagaagcggtagtcggcaccaaatcacaatggcaactgatttttagtggcttctctttgtggatttcggaggagattttagatccaaaagtttcaggaagaccctaacatggcccagcagtgcattgaagaagttgatcatcgtgaatattcgcgtccccctttttgttaaacggggtaaattcaggaatgcacatgcttcagcgtctaaaaccattagcagcgctgctacttaaaaattgtgtgtgtgtgtttaagtttccaaagacctaaatatatgccatgaaacttcaggtaattaactgagagtatattattactagggcattttttttttaactgagcgaaaatatttttgtgcccctaagaacttgaccacatttcctttgaatttgtggtgttgcagtggactgaattgttgaggctttatataggcattcatgggtttactgtgctttttaaagttacaccattgcagatcaactaacacctttcagttttaaaaggaagatttacaaatttgatgtagcagtagtgcgtttgttggtatgtaggtgctgtataaattcatctataaattctcatttccttttgaatgtctataacctctttcaataatatcccaccttactacagtattttggcaatagaaggtgcgtgtggaaggaaggctggaaaatagctattagcagtgtccaacacaattcttaaatgtattgtagaatggcttgaatgtttcagacaggacacgtttggctataggaaaataaacaattgactttattctgtgtttaccaattttatgaagacatttggagatcagtatatttcataaatgagtaaagtatgtaaactgttccatactttgagcacaaagataaagccttttgctgtaaaaggaggcaaaaggtaaccccgcgtttatgttcttaacagtctcatgaatatgaaattgtttcagttgactctgcagtcaaaattttaatttcattgattttattgatccataatttcttctggtgagtttgcgtagaatcgttcacggtcctagattagtggttttggtcactagatttctggcactaataactataatacatatacatatatatgtgtgagtaacggctaatggttaggcaagattttgattgacctgtgatataaacttagattggatgccactaaagtttgcttatcacagagggcaagtagcacattatggccttgaagtacttattgttctcttccagcaacttatgatttgctccagtgattttgcttgcacactgactggaatataagaaatgccttctatttttgctattaattccctccttttttgttttgttttgtaacgaagttgtttaacttgaaggtgaatgaagaataggttggttgccccttagttccctgaggagaaatgttaatacttgaacaagtgtgtgtcagacaaattgctgttatgtttatttaattaagtttgatttctaagaaaatctcaaatggtctgcactgatggaagaacagtttctgtaacaaaaaagcttgaaatttttatatgacttataatactgctgtgagttttaaaagtaaagcaaaagtaaactgagttgcttgtccagtgggatggacaggaaagatgtgaaataaaaaccaatgaaaaatgaactgctgtggagaagtgttacatttatggaaaaagaaataggaaccttgttcatcaaattgatagaaaagcttttaaaactaaacaaatcaaacaacttgagtataatggaattcagactttgatttgcctaacataaccaccatatttgcaaggacagctctctatcttctggtgtttattcttaaaaacttaaaagttagatttagcgatcaccagagccactacttttatgcttaggtatttgtttgacttagaaaaaattggtcacgtgtaccactttatagtgccctgcaggtgttaagatatgaaggcactttgacttacacctcataaaatctttacaaagtattttctaaatgaataatgatgaaataaagtctttattctaggtgcatctgccccacataatttgttttctttggactagaagttttgatgtgttgagaatggtaatgaattaactccattttaaatgtagaatgcgtatcactccaatatgaatgccctaatgaatcctaagatttgtaggttttgtgtactagtatgaaaattactaaagatggaaaaatcacatgttggagacataagatacaaacctttttgttttctgaaaatacaacctctgatttctgattccttgttgtaatatggtgtaattatactagattgtaattttgttgttagattatacttttttaagttcagtgtttgaggacagactttcatttggttagtagtattatggcagctagcagctaaatatgataaagtgtacaatcaaaaggatatttttaatgaagatattagtggtctaacatgtcatttcagatacatagctgaaatgtagtaaaatcagttttactacaaataaacttgcataaggtttataaatttataagtttataaatcaacttgggtaaagtgtaaataaacttgcactcgtggtttctctgaagtctcctgagctaactttgcataaaggtgttattctgtacttcgaggaagtgaattattggggtcaaccacattttttttccttcctacagtctgattgccctttttagtttttaggatctttgtggctgcatcatttttccccttttgaactgtgcattttctaaccccatacttaaatattctcataacctccaaattattaattagatgcaacattcagtggtatattactggagtttctgatttctgcccactataggaatgtgcttcctgagaagattgggatcgtgattataataatagttaacaggggatgagtactttctaggtgccaggcactgttctctctgatactttatttgatgtattgttgttattcccattctttaaatgatgcacagagaggttaggtaagtgacttactaccaagtgtcagggccattaagggtcaggattctgaattcctgaaatgatgaaatttagcttgaagaaattggtttgatttcctgcttagttttcaatttcatggtggtctttgattgtattttgtgctataacactgccttagcatcctataactatagttacagtgttatattaccattttttattgttaatacaaagccatcatgaaataattcagtttatgtgccagctttttttgttactaattcttgaaccttggcgctgtacttcttcatgtggatgcctgttaaggaaagataaagttagaaatctttgaccctgctaggaaatttgtctttgttatattgggagctcataaaactgaagtattcaaaagttagaatacatacacacaagaaaaattagtaactaatttaataatgttttctttgcacatgtctctgttgtcttttggtcagagtgaagctaaatgtgtttttcacataatttgtagcctatatgaagtcctggacatgtggtatggttggaaggactgttgatgaggtttattgtctctctttattcttttatgttgttagtgtccccatacaacggggcggggggagtggggacaaaatgataacttgctttatatatgaagccttgggtttgaatcatactgttatcacatttcctatgtccctatcctgtctcctgcaggttttctttcttggttttcttttttggttttctttcttcctttcttcctttcttttcctttctttcctttcttccttttttctttccttttcttttttcctttctttccttcatttctctcctttgctcctttagtttgtttctttgtttctttggtttgtttctttgtttctttggtttgtttctttgtttctttagtttgtttctttgtttctttgtttctttcaacaggtctcactgtcgcccaggttggagtgcagtggtgggatctcagctcactgcaacctccacctctcgggttcaagccagtctcatgcttcagccttccgggtagctgagattacaggcatgtgccaccattcctggctattttttgcatttttagtagagatgaggtttcgccatgttggccaggctgatctcaagttatctgcctgcctcagccctccaaagtgctggaattacaggcatgagacaccgggtccagcttccagcaggttttctttaggagggatattttacaatgctgtaagtttttcctaacgagaattatcatagcactacatgttctgtcttcagtaagtgatacaagcttactgatgatgttgtagttatgttcattggtggtcgggtgtacattgaaactttaacacataatagcctctcctgtgagcagtggttcctgttggtaagatactttactaagggaaggaatgtgaggtgtcgctggggagagtttacccaaataaggatggactttctgtctttgtttcatcagtcctggtaatagaatgtttgaatagatagctctaggcattacatactttcataaatatgattattgtaattacctctttggcccagttgctagtaaattagggaccccttaatgatttatttcctgtttattcaccctgatgaagaacttgtatctcttttaaactgtactttatcgcctttctcaaattccaagattctcatcacattttttttcttcccaaactctaaataaccttttaatattaagtatctttgtggaaacattgttttctttttctatcccaatttttaaagcttttttaaaaaaaagagtgcttttgttgggatgtacattttccaaatgcaaaaacatttatgattctgtgtctcttataaaatatgacactctctacttttctctcatttatttagtgccacctatgtgtgtaatttcattacccacagcagtcttaggaggctggtcgagttccttatttgcagatgaggaatctgaggtccagagatcacttcttggtgagagtctcacagctattaagtattagagccaagattttgaacgtaggtctgattcacagcaaaaccgttaaccactaagtacactgactccagtaagagccctagtcctcacccaatacactttaattcccctgtgcattcattcaaattcattgaatttgctgcctttggaaacctctcaggaacctcctcaacctctcttctctacagacatcagctttgcctgataggtagggatcatagcaaaacacagttttccaaggtggtgataggtggagtgatagtgctctggagatggccaaagaaggaaggtatgagtgtatctgtgggtgggtgagtggtggataaggggaaggacagagccaaaagcgacggctattggaaaaactatgatgagaaacaggaagatggaaccttgttggaattagtgaaagaccttagaattcacaggaggtatttgtccttcacgcgagtgtagaccaaacgtaacctatgagtttcttttattccacttattaaagcagcaaccaaaggtattatataccttctgtattcacttaaaatgactgattttgaaaaagtcatgcaaacatccatttacagataagcctcattaactcaaaggcagtggccctgttgggctctgatgattactcaaaccatttctgacactctgacactacatccggaaatcatccggaaatgcattcagagcctgcaaaagctttttttttttttttttttttttttgaatagctacagcacttgcagatcttcctcctttgagagaatatttgattttaggaaataagcaaatgtagataagtatgattcaactgggcaataacttttaggcaaagagaaaaaaacaaaatatagcaatgtagtaataaggctgatattatagtgcttttatgatgagtctgaaaacagtctccaacatttgtaaatgttttaaatcgggtctgtctactacagtagcccttaagccatatgtagctattgagcacttgacatgttgcaagagtgaattggagactgattttaattttatttaattttaatgtaagtagtcgcacatgacccgtggctactatggtagatggcatagttttagacaagggcagtagtcttgggtagatacttgatttacttagaacatttctttacctagctgtaacaaggttctaatagctgattaaaggacaacatttttagcatgtaatatacagtaaggaactaatgttaattactgccaagatgtataaacattatgaaaccttaaacaaggatgaacacagaagcagtggcccttctttgtaaataaggggtcagttacttcctaataggtgtcttagttttagttaataatctaatagcacccccaaaaagcaaactgttaatttgttattagccatcctgtaaagacaagggagaaatcggggccaggagagtcctctttcccattctccataatttttacgacctatagaaataagagcctaagagtgaccagttcctgcaacctaactcaaaattaggcctctctgttgaagtaatagtgaggcaaacaatcccttgaagcactggggcatgcacccttatgaaatctaataattctaaaatatcattggcagtattaagctagagttctcaaaatatgctgtagaaaatattggtcatttaaatatagctgagtaaaaataagcaagatcaaaatgataagaaaatgttgatttctccccttttgaaccagtaactaactataagggtatatacccatgcttaacttaaaaataattatttagccaccttgggtatagcacaacatatggatgccattatagtccaccttgatcttacaaggaagctttcttttagcgtagctttacttttatttaagcattattgaagaagcttggtatctctgtttaagttgcttctgtatcagtgttttccagggccctgtctcagcttccatagttttccttaagagcagctaattaatgcttcactccatatgctttaatttgatattttgggaagtttcattttttaaaataatctttttatatcataggcctttgaagacatatttgtttacaaagacatctgcattgaaccatttgtttttaaaaacatgtatcgggcatgtcctatataccagaaactatgccatttactgaggacaccgaagttagagaatggtcttaatccgaactagttattgtctcactatccaatatggatatcaaacattcagcgtcatgaggatttactactgtgttttctcccaagagttttataattttagctcttatatttaggtctttgatgcatattcattgatttttttttgtatgcagtatgaggtaaaggttgaaacgtattctttttgcatgtgggtgtccacttgtcccagcttcattttttgaaaacactatactttccccattgaattgtcttggcttctttgttgacaaaggatttattatttctgccacaacccagctgtttctcactgtctaaacctttatgcctgctgccccgtaggcttagtggaatgcctctccatcctccactctcttttgtttagctagtacttccttatcctttaaggggtcagtaggaacctcaccttcttcagtatgttttcctttgtcttatcaacctaccaccatcacccacacacataccttttccctaaggctgggataggaacctcttaggcaatgatctatttgataagtactcactgagttcatactagacactctgcagtatatccgtaaatgaagtaaaacctgacaccaccctcagaaaacttactgttagtgagaaaatgggctataataatagagtggggtaagtttattgtagggataagcataggatgctatgagaatgcagaggacaggaatttaacctagacttctcagttctcccgttgaagttgacatctgaactgaaatctggaagaccagtaagagatagctatgtaaaaagaggggaaggacaataggaaagaaggaatggagagaggcccagaaactacagagtatggcacaagtagtttagcattgttgggtcacaaattctaaggatatgaaagataaagttgaagaagtggtggggctggggaggacagctcctgtagagccttttacagcgggagaaggagtttggctatggtcctgcaggcagggagaaaccactgaaggggagaaacatacagaataaatttgagtaagaagcttaaatctccccaagcccttttaaaataaattaagatataaagcctttgggtttctttatgctttgtcctattcttctaattgtccaaaacaaaacaaaaaccttccttttctgtacctattaaaaggttaattttataaagttacagacagcatgctgattaaagaattcttgataattagctattttgtctgtctttgtgtagattactaacaattgtgtcatcagatttaaaagatctaaacctctggactttatatattttttctacaagtactgtgagattgagaacttaattcaactctagtaactggactttttagtgttgtttgcagcatatgattgttaaagaaagtttagtatatttgtgtgtgcgtatatatatatatatagatagatagatagatttgaggttatatttaatcattgactattggtattctaagattttaaggagagaaaggtaggttacaatatatggctgatatatggttctggaacaattttcttagttttcagtaattctacctaaaatgtacgtccagctttgcactcactaccacattgtaatttccagtatacttgtctatttttcgagatgttgaaatctgtggagaattttttctcatgtttagtgttttagctatgtttatctctagggtatagcacatacaaggtggcaatatagatgtgcttaatgaataaaatgatcttcaaaaactgaccttcatttgaagttctattttattcataaacacataaaacgtttggtatcactgtaaaatttaactaaaaacaaaaactatctttaagctcacaagttaatttaacgttttttcttacacaggcatttgtaaaggatgttcatgaagattcaataacagttgcatttgaaaacaagtaagtgtctcgttatataattttaatgatgaggttctttaatattttatgctaattctattcttcattttttaaaaattcaagtccagtttgagtgcttttcaggaatggatcttcatgttactgactgagaagtttctgaacaactcagtattaaactaatggaatgactgtttctgctaatgtcctggaggtcccttattgtatggtattgatccttacgtcttaattcccttgaatgtgaagaaagaaaccagagagtcttgtgtattagtaactggaagttcgcataggagtatttgtaaattttaaaaagatagtaatgaaaagattcatgggtattgctaaaaagttgtatgtgagttctttaacattaaatctaaaactgatggttttagttgtctagtatattttatggaaacagtcatgtttacctattatctgattttttttaatgtttcatatgttcagcaatagcagtagctgatcttttctgttctcttttgctagatgaagaaataaaaacagtcataggcctaggaatattaactgtatgaaagcatcaatagtatagatgttaacattttattggagaacacaagtctcttgactaaatgttttgaatgctaataaaggctattttcagggtagctgttggtaagattgtaaagtacatataaactccttagtcaaagtgtagatgtggctatgatcttaggattttactaaactctgatggatggttaacagttatcatttttttggctcttatataccaagaaaattaataatatatcaaaagcaggctgcaaatctatagagacagaaagtagattagtgattgcttgtgctggggctggtggggagaacatagctaaagagtacaggatttttgtgtgtgtggcaatgaaaatgttgtaaaattgactggtaattattgcacataactgtaaaccttctataaaccattgaattgtacatttaaattgatgaattataatgatatgtggattatgtctgctaaaatgtagtatgtgacccaggcatactgagcaataaatacacacatcttgcttctaaagtttaaaaccaggcctgtgtttcagtgtctagaaaatatatttcataattgaacttagcagattcttttggctagcaacaggacaaagtagtatccttagatgcctgaaacacgtgtagggggacagagataaaaggattaaaagcatctaaccctatttctggctctggactaataatcgcagaccaaaatacaagtttgaatagtagaatacctttccctgaatacataaagccaaaagttttagtatttgtctcttcgctgtttcatatatccatggctatgcaatagacaacagcatcacaccaacagaggaatctttgataacttggagggtatttttttcttacaattatacactttatctacttacttacatcactaggtaaatgctgtttcccataaagggagagttgtctttatttgctactcttttagtttttcctgtagtctataatctaaagtgttaagcaaacactcatttcctctatgcatttaagaatttgtctagtttatacattgatttattagatcacttctttttaattttcaatcagatttctaccataaacttaaaattatttcatctttggaccttccaattatttatctcctgtaccatatctgcatgaaagtttctcttcaagctctttgtcatcctgggagtttgaaatagatcattgattttcccttgtgttcatggagtatgtttgcaatacaacactgggtttgagcacatcaataggatttaataggtctccaccaaagtaatctctttgcccttccttgtgtgtttcctttttggttttctgttagaaacaaaacgaaaacagtgttttgtaaaacaccagattgtatttaccctttctttcctttcaatcaggaagaagctcctgttactgatagcagattgttttaggtgctttgtttttaggtgcttcctaaaccttccataaagcataaaggtgttttcatatttcacattttttaataaggaatttgaatttttatctgtatacacttaaaatcattattttttccttggaaccattgagttatatattattatatgctttaaaatcaaatttagcaatgaatgtataacatctattaggtgtgtataataactcagaggagggttcagttaatttaggccctaatcagatttccacaaattctgacttaatatttgcccgcttatataacagctcttctttaacaaaaacaagtacttttctcaatagaattttactaagaaagctctttagtaaaacatcgacattatacatacaacatatctcagtatctgctgatgaagaacaccaaaaagaacccagatgtgactgctccggaagttgaatcctcagtatttttgcaaagtttgtctttcagtattttatttgtgtgtgtgtgtgtgtgtgtgtgtgtgtgtgtctatatatatatatatttttttttttttaaagacaggatctcactctgtcacctaggctggagtgcagtggcatgatcatggctcactgtaaccttgaactcctgagcttgagctatcctcccacctcagcctcccgagtagctgggactataggcacataccactgcacctaatttttttttttttttaataatttgttgtaaagatcaggtcttaccttgttgcccaggctgctcttgaagtcctggcctgaagcagtgctcccacctcagcctcccaaagctctgggattataggcttgagccaccgcatcctaatattttatatttttatggatataaaaaataatttggtatctttcagagttgtttaatatcattttaaatttaaaaacataggcaacttaaactcctataggctgtctccatcgggtttctgtggtttaggagaccccaccatcccagtgcatgctgataacgtcatactgatcagcatccagctacccacagcaagaattgaccacctcgtgggatctaaaatttaaagggggaaaagtgagttgtgaattgctaatgtgctgatagccccattttgcttgggaattagagggcagtttttgtggtccttggaatgtggttaaaattcttctgcaagtggaagcatatttatattactaacaattactggtactaatattcaaatattgaaggaaatttctgttgtggacttatgtttaaagctcttagaagttgaaattattggaaagaagacttgttttgaaaatcataatgttgctgtattgtgtttagagaaatattccaaacgggagtaggctgctgtgctgcatgcagactttgctgaaatgttactatattgccgttatgtcccactcagcaaaaactgatgattttaaagcttttgcttcttgaaactagaaaaagaggggtcagccttaaccaaaagttgatggcagagtggtcattatttcagttaaacatgaaaagcatgttaaataattgtatgtttgcttatttacagctggcagcctgataggcagattccatttcatgatgtcagattcccacctcctgtaggttataataaagatataaatgaaagtgatgaagttgaggtgagttttccctgccataaagtcatttagcactgaaagagtggggttaatttatctgtgtttttttttaatactttgtctttaacactgtttaaattactttgagaattacagctggaatggacacgtgcttttgactaactcatcttattaataattcaaaatgatacatgatgcttacatttggctatttgagcagtactcagagcatgtatttgaaagtcactgccgcaagttcctttgcccactagtaattcttttctccttctctcaatttctgaatctttgaatagtatgttgtttgtttacaactgtgtccccattgtaagcaaaatggattatgaaaattaattttacacaggaaagaaatcatgctttattacaaaatagtatactagaatttctttaagtagcagtgaatcttcttggtatatttttaaaaacctacaagctttagtttatacatattggtaaaatctctttttcacaggttataccgtgaactacctgcttatctcccgttgagctctttgaccaaaatgtgctatggagatctaacatgtgaacagaaatgttgtgtttgtgatttctttctccattagaaattggttttgtatttaaggcgcttacagtgcctcatatagtttgtgtggtatcttctctcctttgtatcctttcacatactccattttgagctgcttctcttctttttctacaataataagcataatgccttactattagttaataatagttgccgttccatgaatatttgtagtatgaaggatgtcgctaagtagacatttgtgcaggtgaggcagagtggttctaggtcctgtccttcagttctttatttatttatttatttattttttgagatggagtctcactcttgtcatccaggagtgcaatggcgcgatcttggctccctgcaacctccgcctcccgggttctagcgattcttctgcctcagcctcctgagtagctgggattacagtcgcccaccaccacgcccagataatttttatatttttagtagagacggggtttcaccatgttggtcaggctagtctcgaactcctgacctcaggtgatccactcgcctcggcctcccaaagtgctgggattacagatgtgagccaccatgcccagctggtccttgaattcttatttgctgcactaggtagtaaaggtgtagcaaaaacaggacagaatcttctgcctttgatgaaatcacattccagtaaggatagctaatatgacagatgtgagtcttaaagaaaaaaaaagggagaggatgaaaggtgatttagggacaggattgctgtttcagagagtagtcagggaagatctctcaatgtccaggcctgtgtttttctctctacagttttaaagtggacataggatatagtgttatttattttccaaaaatgtaaccaatctctactaggtgtaagcagctgggcttggttttgcaagggatcttaatagggaacagaaacactgtgtatgcttagctgtccacttccccagaagactgtaagctctctgaaggcaagacccaggtctttggtctgtattaggagtacccagaatagtgtttgatggagggatgaaagggactttttctccccagcttggtcacttgacagatcgggaccaatgagataccattgctaggatgacctcactgtcttacacaccgattcgttgaggtaatttctctggctagagtagttgagaaagatggaagcaagagggaaaggtatgttaagttgtattcagtcactgtattgtgtgatcattaactttggttgtaaaagggagacaagttcgagcttttactctacttgtcagccctagactttgtacctctcttggcctcatgtctttatcccccttgtctttcttatttctcttttctgcttctgagtatccctgtctctctgtccatatatactctgttgtctcttttcctattaaccttgatttgctagggtcttcatgaaaggttccatgctgtacatcttaagtgaactttgaagtggtcatcaaagagatcagttagaagaactgatctgcagtgtgtgacagaccaggaaagtgatatccagaggattgccaccatgaagttgtcatttttagtggagaggaagcaggagaccagaaagtgaccaaggatctgtccatttagttccaggagatatgactgccagagtggtatccttagtgggctgaatgttcagtggtcttactttagtgaccaagcaacaagacagtagggcatggtcagtaactttcagtcaatttttgcttactaggataaagcaaaaataagcttatacatttttagatacattttttgtaacttgctgagtacccaaggaaagtgtgcttgtatttatgggcgtctattttcagagcactaattattgctgaattagaacagaaatataggaaaactgatttttacaaggagcttcaaagcaatctcaggtagtttctgattatgtatctctgcctacctcggggtacatagacagggttacaatttggttgaggatatatgacatgtggtttttaaagacacctaggggcattttaagaaaatttcctcgatatctgaaaatctgtagatttcaaaattatgttaatcatgaaatattctgtgttgtaatttttgtgtaggtgtattccagagcaaatgaaaaagagccttgctgttggtggttagctaaagtgaggatgataaagggtgaggtaggaaaatgcctatttaaatttttttcttatattgtttcctttttttaaacccaggttgtacattcccgtgtggatttctattttgaagtaatatctaattttgagtaatttaattaaaatgttttcactatgtgttcagtatgtttctgttggtcataaattttttcacatagattatttattttaaaataactgaatagggagaacttcttattcttactttaaaaattgtgattagaagtgacttttatttatttctcagttttatgtgatagaatatgcagcatgtgatgcaacttacaatgaaattgtcacaattgaacgtctaagatctgttaatcccaacaaacctgccacaaaagatactttccataagatcaagctggatgtgccagaagacttacggcaaatgtaagttgatacacaagaaatgctgagaacttggaagtgatatgcaattagtttagaagaatttctagtagtttaaaattttttaaactactagaaattgattttaaatttggtggactttggcaaaaatggtttggtttgcaagagcaatggagaaaaaacttatttaacttttcctacttatagaatcaaggcagccttgcgcttgtttaaacttacttggctatacacgtgtctgatgtacataatgtacatttgttttctaaactaactttgttcattctaagatttaaaaactgatcaaacaaatgtgataattctgtcataagtcacaaactataaacgatttctccgtttttttctcttttacctaaaatgttttcagataaatgtgtaataagtagagccaaagaagctttaaaaagtcatctcatcttacaatccttgatctggaataatgcttaaagactatagaagagacgcatttttattttttacagattttattaagtgaatacagtacgtttgatttggacatgttgttgaacattaaattgcagttcagaatacatagaaatcctcccttttctagagattgtgtatgtgtgtaaatttttgtgccttctggttcatgtacgtttccttctctccctcaaatcgtttagcagtttcttaccccattctccgtgatgtgcttatttcatattgcatgcctgtatcaaaacatctcatatgccccataaatatatatacctactatgtacccacaaaactaaaaattaaaaaaaaaggaaaaaaaaaggcctgcaacaagagaagaagaaagaaatcagataccctgtaggtagctatctcccaaaagttttcaatagttgacttaagaaaactactgacttgtatgtaactgaaatcaggaaacctgtagtgtagagtggttcccctgaatatgtctcttttggtaatctaagctgtatttcagaaatgtacagaaaaggagctaagcttctaaatggatatagcatattttgcataaatcaaatttaatatgaatccatgattcttgtatgtgtaaatctgcctgcatttatttatgtcagtagttggtaattattcatcttaatttttttttttaaatttctaggtgtgccaaagaggcggcacataaggattttaaaaaggcagttggtgccttttctgtaacttatgatccagaaaattatcagcttgtcattttggtgagcatttttgagttgtttatttttagtttaattcatctggggcaattgccttgataataatgttgttaatttaaatcatttagtccatcaatgaagtcacctcaaagcgagcacatatgctgattgacatgcactttcggagtctgcgcactaagttgtctctgataatgagaaatgaagaagctagtaagcagctggaggtatgtcactttccctagcactgcttgtaagggtacctaggaacgattaactgtatcattccacaacttgaatatggggagcttgtcatttatttactgcttcttaacaattccttaggttctatagttggaaaattgtacaaagcataatcatactaaagtttccatgcctgaggtttcaaaattaaacagcagcttatgtatattaagggacttctggtactttcacttttactagaagtttatcaaagttgctaataaaatgcggcaatgcttcttccatataacatgttgtcattaaaaatactagagaatatttaaatatctaatcatattcctctcattatgtatgtttatctttgtttaaaagggtatagaacttcttcattctaattggttgtcattctttaaaactcctgtcttcagattcccgccagaggctatttccctaacttactattttgtctcttaaggtgcattttatctacttttattaatcctccaataattttcatcaccatatatttgttttcattgataactatcaagtacgtccatccattactatagaaactaagtggatcttagatgaatgtgccagctctactatattcctgtcaaattccagagttcgtcatcattattcattagaaggaaaacaccacacatttgaaatagtaaagaaaaaaaggagttccaaactgcattttaggagaaaaggtagtcaagactgtgttcttataaaaaccctgtgaaatttgccacctgtcaacttgatgtatgatgctgaactcttagcagaaggggaaaagtttaatctccttttgccactttgttttttcttaaggccatggaggtctgtttaattggtctttgctctcattctttcttgatgtccctgtgttcatgattttgtggttccttcagtgattctctcataacttttagcccagagctgcctccttactttgattgtgagtattatgaaaatatactcatatgcctcttaaacatcgaattattcttaaatgatctatcatacttttggctaaccatttatcagtgaattatcaatgaaaaagaacgaaccagattaatgaaccaggactcaaaaaacatgacttcttgaaaagtcctagaattattttatagattttattactctagtctaaaaaaaatgggtattgcacttttaaattatttatgctagttgtattcattcattcaaattatcaggtctgttgaacaatgagaaactagtatgcatgcctatctttcttcactactaatattaaagagatttacatgttcctataagaaattcccatttttcaacatgagccactaatacgtttggttttcattaatggcatgctagaactgaacactaaattttgataatggtatttaaagacagtggttatccacaagtttgggatgtcagtgtaacttagtttcgtcatcactggatatttacaagtgctcatcataattgtggatccagatcacaaggtcttacggactctggtctcatgttagctttcagatgcttactaagtttttaatttttgacattttttgattattcagtttaactactgtaccaacaatttttgattccttaggttttgagggaggtgtcattttaatgtcatttcaacagaggaatgtttagaccacagtacctaatgatgttataaaaaatggcactgtttccagaaaatatatactgataccttttaataaaaatgaagcgaataaaattttctataaagatgatatttaaacatttttttacctaaataagtaacattgagtttgtcagaccgagtgagctggtttttactggggaacatttgacctgcttcttagttattatattgctgatgtcattggttaactaaggcagccttgtgataagttttcagcagttaccttggaaaatgtcaacaagttctttcctattaacaaaaacatataaaatgtcatagacctttagtaacctaaaaagtacttaggctgtgagaggtattttctaaaacctgttagttttaacctaaaactattaataatttatggacccctcatatacagggtcaagataatttacatggctggcctaaatacagttgtcgtaatagttgataaagtgtattcatcagacgtccatttctcttcagagttcaaggcagcttgcctcgagatttcatgaacagtttatcgtaagagaagatctgatgggtctagctattggtactcatggtgctaatattcagcaagctagaaaagtacctggggtcactgctattgatctagatgaagatacctgcacatttcatatttatggagaggtaaatattttactgcatagtttttttttccccaaacaagtatttcagctggctaatcttttgtcttaaaatgtttccccttttattaggatcaggatgcagtgaaaaaagctagaagctttctcgaatttgctgaagatgtaatacaagttccaaggaacttagtaggtaagtcagaagtatctgttgacatatagtacaacaactaagtttaggtaaacagtttatttatagtgatagaattccattttttcttactggagggtatcatttaattgaaacatagtctttgaaatatgatctgttctttttttttattatttaagttttagggtacatgtgcacaatgtgcaggttagttacatatgtatacacgtgacatgctggtgcgctgcacccactaacttgtcatctagcattaggtatatctcccaacgctatccctcccccctccccccaccccacaacagtccccagagtgtgatgttccccttcctgtgtccatgtgttctcattgttcaatcgatctgttcttacagcatacaaaaaaatatttgttaagtatgatgctcaaaggttacattttcagaaggtattcaaaagagattgcttttctagttcaaacctactaatacctgaaaggataaatcttgcccagccctcctgactgtataccttttatatcttaaaattaaataatttttcaaaatgaatgatatttggggactttatgatttgaaatagatttgtatttgatctttcttatgggactataaaatgatagcattcattttaattatctcagggttgaagatctgaacataggttacttaaatctaaaaagtcccaaagctagaagaaacttcagatgtctctgggactttctgcaaagtcaatagtaattctccattttgacttgagtagtgttttatcaccatcaccatcgtgagtatcagcaaatatttaggagctcttcaccaatactcctaaatgctgcagatatctttagtagaacatatcaaaaccaggtgcagttttatcaagaaagctacatatgtttttaatttgtaaataaaattgggacatactgcctatatgttttttatcttttaaacttgagatcatggccattttatataaagtaatacatgttctttggaaactttaaagaagaaagcaaggacttctcatacattctgtttacgtagtttcaatgctaatttagcctgcttttttgtcagcatagactcataaacatcttccttgtcattaacaaacactagaaatgataaatgtatctcccaaagaaaattagcttgaagataaagtgcaaatagtaggaaaataatgcagaagtgttagctcaactgtgtactacagacaactggagaaatgtgtttgtaatgttactaaggtaacttgcataccaattgtatgtgtacagaatgtatgcatagcgcaagataaagtgctaatctcaagacagttgggtgatgaataatatttattttcttctttacagcttgtcaagcaattgcataccttttgtagttagaaaggttattgtaaatttaggaattcttatggaaaaagagctggtagttgttttgttttttttttttaatagcaaatgagtagagaattatgtgtcagattcattaaagttggttttgaagatggcatgatggtagtggggaaagtgcttgggcattggagttggatctggatttcagtcctactttattctttggtggcaatgtgagcgtgggtcactgtcttagcccccctgagaattatttttcttacctatcaaatgtgataataggatccacctcatagagttgatgtgataattaaattggaagatatagtaggggacaattctggacacagtaggggactctgttcttcaccttattcaaaacaactccatttcagtagaacagaatcacagtaaattgctctttgggatttggaaataagtgtaatgtagaattggattatttgctattaaatattaaaagtagattctacctgtggttacctggaaagaagaggatctcagaaataaccagaaagactgctaaaagtaaatcagccttgtttttgttttgttgtttctagttagtaaaatgagataattctgttttagagatggtccactgcaacactgggaacgttggaacttttcagaaagcatttttgtgtaagattctgcaaggcagatctttagagaggtgtcataatcagttttgcatgtgttttgtttgagtcaaccaacgttatttgtgatctctatttttcacaaactctctttggtatgtgcactaatttatcttttcattaaaattggattcttcactcactaagaatgaattggtatgactattcagtcagctatagttaacacacagtacttaggataattaagatattatcttaataaaaacatccccaaatctcatttttcattttgttaactcacttagatctttattaaagtcaacattaattcatgaaaatgtaagtgttgcagtttaaaatcaaactgtgtgaagactccaagtagcttctctcacctcacctttccccttttcgttatagaagaacagaaataattgacagaaggacctagaccaagaatcctgatttaatggtgtcagatctgttctatgaccagtcaaagagtttctaggggtgaatgaggcagccacacacagcaagaatgtcaaagctatgctctgattacaagagccacaagaattttttgtgagaaggcttttcactgagttcttatctagcattggctcaaagcaaatttttgcttccatcttttcccccaactttgccttgagctttgcctttaaaggcgaaaaggaaaaaatggaagatgagatggtgagggcaagcacatggtggatgtggccaatgtaagggtacttaggtaccttgggtgagccctcagaatcagatgtagttcacatgtacatttccagaattagtaattcttaagtttgtaatgtcttgctttaccactcgtgtcatgatgcaaatgaaagcagtcattttccagtaatgtatatgattgtaaaataaataaggaaatgatcaagtacctattttttactggtacttgaaatcccaagttttaatagatgttactgaaaaatacttaaattggtttaaagctttttcattgtggttttgagttatcttaaagtgggttttcttaatcttttactctgtgactaatcccttcactttttaatacattgctaaagtttgtaagtaatgcacaggagtgatactctgttaacacattgaccttgaagaatttgtattccttttggatgtatgtatagctgcttaagccactttcagacttagattatcttttataaatgtgccttccatacagaattctgaaaatatttaccatggacaaagaagcagatttaaatcaggtacagacaagaattgaaagtgttgaataagtgaatatatttcccattctctctacttttttcttaattcttatagaactttgcagaaagaatgatacataccacagtaccagcaagtttaaagcgtacccttttgtgcaaaaataagaggttatctttgaactgccttaaaaatccaaaattaccctatcagtttgcaagtattaatcaactctggtacctgaccaaaggagtttaaacaatgatgtcctaattaaacagaaaaccagattaaccatcttgttgaaaagagtctctactttggttttgaaatcttacaattcaatacatacacatacacataaaaatatctatctatatgaatgtaatagtttacagtagggctgtgcttactgctttgaggtatgtgtttttaaaaccaaacttgatttatttatttcttaggcaaagtaataggaaaaaatggaaagctgattcaggagattgtggacaagtcaggagttgtgagggtgaggattgaggctgaaaatgagaaaaatgttccacaagaagaggtatgttacagtgcgaatattttgtggcacatataataaaagtaaaagttttttatgtgatatgttgaggacctctaatatgtgcataaagtgaatgcaaatattctgattatcaagcatgcctgctgtaattaatgttataattgtagataatggcccttctctgtcctctaatgcagtgagtttggattagtcactttattgaattcttttttcctgatctttaaaatgggtagttataaatttttaaatatgagacatacatcactgggtcgagtgttaatggcaatttaataaaataatatatatgtaaatgcttcgtaaagcactttgtaaatgttaatgttgctgacaaaagcaaaattggaacacaggttttctggctttcatcttttcacttttttagtgtggggattgtgtagtatgtgtgtttattctgtgtgctttaaatttatttctgtgcttaatatctcttccccatcctccttacctttaaattctgtaacccttttatcttcataaatatatgctttttgtagcagcttttaaagtatttgcatggggtagagaggtgaggatgcacctttctgtgcaatagtactcttaagatactgtctcatcaaagagccgtaattttcacatattgtctagctttctttttgaaagattcttttagctaaagttaaatcttttttttctgcgtacaatttgtattcggtaattttataaaccaaaactgtttataataacttacattttttaaaaatatgatgattgataacactaatagagctaaataaagtcttaaattggtcctttttttctcttttgtgttttctgttttttaccaaggaaattatgccaccaaattcccttccttccaataattcaagggttggacctaatgccccagaagaaaaaaaacatttagatataaaggaaaacagcacccatttttctcaacctaacagtacaaaagtccagagggtaagaattacttgtcactttgaattacaatacaagtaatttgtctcagatgtcacaattggtattttggatgttttctctggttagacttgtaggctacttatgttctattttttttccaaatgtaattgccagcttatgagatactacaaattagtgtgatacatacttttcaatttattcacagtaacaactcttatgccataaacacaaaataatggggttgcatttagtggtcacatttttcttttgacagtggactctcttttttccatgccttctctctttaaattttgcaggtatcgtagctcaaaatacaccttctgttagttgcattagttactacttgaaccatattttagaaactaattttctctgtttgaactaatctgtttagaaatgggtttaaaagtcctgcagtgaaagtcctgcgttcaggcttctgtgtatcgtttgttatagttaatgacatcccttgcattccttatactgctttaggtgttagtggcttcatcagttgtagcaggggaatcccagaaacctgaactcaaggcttggcaggtaggaaaacattccttgagaaatacactttcagtttatattttaatgtttattccccttgttaacaaagattacaaatgatcctcaggattagggactggagggaggagtgtttgtgggtatgtggatccattgccctggagttaaagcttaaacaccttcatgccgcttgtaaggcttttcctaattacttgtctagttatcatctttaaattatcttctcccttgcactctagagaaccttaagccatactgaagtactttgagttctctgaacattctcgtgcttattttgcttctagacatatgtacaggtttactctgcctggaatgctttttctcctccacatgtcacctcattttgaccttattccttacaaagctttccttgtgtacttgccgaagatccccacccccttgactggttcaagagccttccccttctgttttgcaatgtgctcacccctagcatagcacttaaacatagatgtttatttgttgatctcctcaaccacattgtaagttctttgagggcagggagagctggtgagaactgtttatggaaaaaaatgttgtggactcatggattaaaagcaaaggtgccattttacaaagaggactataacggcaagtggattggatatgtctcattgccgggcagcccattattccagaacacagagtaacttttttctggggtccgtactaaaggccatcattccattcttgcctttcttcattttaatttactattcaggtctactcgtgaagtgcttaaattagagtggcccttggggtactccagcagtttagacatgttgcaagaaaagatattcgtaaataatttgctccgaagtcaatctaactaaatctgttacataggattttaaagctattttggtgatatttgacccagagggaagggtgtagcattcattccatcacatggtattttgggaaataatacagttaaaggcttttgtaacaaataaagcttgttggagaaaaacccaacatgcagaaatgaattgccagttattaatttgcacaattgtttctaggtttccctataacttgtgacaagaagtagttgttttttttttccctcttaatatatatatatatgggctaggagtacagacatttagcatatgccttttaaaaatctgttcttatgttaagtagtgtccatagagagaagttcaaactttccttgtgattcagccttttaaaattttcagagtacattattgaaatgtgtatgggcttgataaaacttaatgcttgtcaatgtacctatttttttgtctcacagattattcagtgcatttttatcctgatgtttttgtttgtattttgtgtgtactctatttacttggttagcagaaatgatttactttttacttttgtacccttggtatttcattttgattttttttttaagaatttgatcggccaggcgcgatggctcatgcctgtagtcccgacactttgggaggccaaggcaggcagatcgcctgagcccaggaattcgagaccagcctgggcaatgtggcgaaaccccgtctctacagaaagtacaaaaatttagctgggtatgatggcatgcacgtgttgtcccagctatccaggaggctgaggtgggaggaacacctagggcctggggaggtcgaggctacagcgagccattatcatgccactgcactccagcctggataacagaataaaaagaccctgtctcaaaaaaaaaaaaaaaaaaagaggcggaggcgggcggatcacgaggtcaggagatcgagaccatcccagctaaaacagtgaaaccctgtctctactaaaaaaacaaaacattagccgggcgtagtggcgggtgcctgtagtcccagctacttgggaggctgaggcaggagaatggcgtgaacccgggaggtggagcttgcagtgagccgagatcccgccactgcactccagcctgggcgacagagcgagactccgtctcaaaaaaaaaaaaaaaaaaacaaaaaagaaaaaaaaaaaagaaaaaattttgatcaggataaagcctttcataaatgaattagagcatcttatactactcattttgtttatacatctcatggtaaagcttgtataattttgaattatacattttgtgattttgctgatactgaatactagtctttataataatctgatacgtttaaaaggttgctattgatctattcgtattcacagtagatgtgtaaagtagtatatcaactacttttgttttcatatattgatttatatttacagcaaacatttgtatacctgctgttcaccagatcctgtgctagggaattagtcgttatttgcatttttcagattaatctatcattacttttataggatcattgttgcaatttctttttcagggtatggtaccatttgtttttgtgggaacaaaggacagcatcgctaatgccactgttcttttggattatcacctgaactatttaaaggtgagaacagaaagaactttaacttctaatccttttgtactaaaatatacaaactttatagtagatctttcagcagttaggactcattctagcctgtgcaaaacactgtatgacttgtcaaaggtaatagagaaaatacgttgtttggcttataatttttttaaaaatggaagtctttataaatttaagtaccaatataccagttttcaataaaattttatacttccctttattcttctcttaaacccttacactcagtttaggcaatcctgtacatagcctgttaatccatttgatcctttctagcattttggttttttccagacaaaaatctgtgtctataactcttgcctttattgttccttttatgtcatttatcaaggaaatctaagcatttcatgaagttctttgtttaaatgtttaccctatttttctctttactgttattcaaaatacaaactatttgtgtcttctcataaatgttcagtttagttagtgtgatgcggttatgcctccttaaaatttcaaactggaagataggaacgaggaggctacaaggtgtagtggagcaagcactggatgggcaatgcagcaatttacttataagacttcagcaaatgaactagctgtgtgactttaggcaagtcacttccctacactagatgcttcttgaaattccttttggccaaaatgttctatactttaatgaaatggaaactgatctacttcattttcataatgttttatttgtatccatacatatcaaaattataatgtagctggtattaaatgtttttaaaaagcatttcaactctatttatggcattaagaatttttttgctgatttcttgaaagaaataaaaagtacatgatttctgcttgtgtgtaaataagaatgaaaggaagaaaaagtgtaatactgggcatgccattcattcttatggtggccagttaattaaaagtggaaaggtttcatccagcaaggtttacatgggtaggatacctctttgatttttttttaagtatgtttatgtgtaatctctctgtgtgtgtgtctctctcgtaattagcttaaatcatcatgaaggcctggagagttaggattgcattgtatcaaatcccttgttcttttgactaatgttctttcttagatcctttgatttattctcaagaatatcttctttggttatcagcagctgccctgttgccattctttccatcaccagaacttccctcgtttgggcctggcatctctcaccaaaaggtgactgctttgccccagtgggataacctggactactcttctgttttgcaagatattcctattccatgagctattactatacctttggaggaagtcactcactcagctgcagtctctcctttgctcaaattctatgtaaaacagattctggtgtaactatgtaaattgctaatgatggcagagcacagatgaaacggaccaaatccttacctgacctttcttttccagaagctgccacaaccaagattttagaaacttagctttacaggagcttctccaatgactgttcatgtagacagtctctatgataacctctgcttcactgagacgcctactactactatagttatgaatctgattccccgtagccagtaaatgagatgtttatgagtggattggaaggacagtggttagaaatgaggtttcatctggttttaacagaacccaacatactggaagtgctttttgtaagggtctgtcattggaccccaggtgtatatttctatcaactaaatgtatactgtttctcgtacttgttgtagcagagttgtagtctttaggaagttttcaaggcatgatgtaagacctagctgtctggtcagctattaaatagttttgttttcccctcatgaggaatagtcagcattttcagttgatgaaaaaatcattgttccttaaccatagtatatgttcttttaaaacaaaagatggcccaaactcaatgctttgtaaattaagatattaactggcaaatctattttaatcaagattatttacaatgtgtgattttttaaggttagctggttataccttgaatgtcatttatctatattcatacattttagcatgttttatttaatatcctatcatgaagaagtccccaaaatagcatatctgtgccttagcagtagaataattggataatagtgccaaattagacaactttaaattttattcagtataattttactgctgagtgtttttgttatatctctaattcttgacatcaataatctgttatctgtagtaattttctttttaaggagatcattcaatttcctgataattctgtgtaacagtgtttactgtaaatttagaactgaaattgaaatattccagtatatttttatctgatgaaaaggagaaaggttttattaagtaaaatgtcaaattatttttactgttatcttgtatattttaaataggaagtagaccagttgcgtttggagagattacaaattgatgagcagttgcgacagattggagctagttctagaccaccaccaaatcgtacagataaggaaaaaagctatgtgactgatgatggtcaaggaatgggtcgaggtagtagaccttacagaaatagggggcacggcagacgcggtcctggatatacttcaggtacaaactaagcattttactcagtaactttatctgttcctagacttatagctgctaatctctaatattcattagaaccccattataacaatttgccgctacatggtttccaattcacagtgggttaaattgtgttacaggagacatagagtaaaaacctgatgataaacacgtagagttcacagggccggtgcaagttctgttcatgctctgattgggggtaaatctgcaaagcccttgtgtgttgatgattttcttaaggcctctcctgattttataactgtatagtcaaaacttttttcatttgtgtactgtggctcatttttattttgtcaggtatgtgctggtcatacttgctggatggactgtgtaaatcaggggtctgcctcttgtggctcataaggtgattttgagtgacatggccaaagtcagccctaggcacagtcaagaagtaggcgaagtttctctttgccttcccagcttttctgtccgtgcttctttcttctctcccagtacctttcagtgaacctgatccccacctgccagtgcctactgtctttcttgctcaacagtgtatctcctttgtaacttgctaatgatggtataaggtataatccatttcacgcatatttgcatttcaaaaaggaactctttaagatggaaaagccttcaagatccacaggaatgaagctataatggtgaagctataattggtcattagctccaacagaggaagagagaggtagtagagctgatattctggagttggggagagttacctactcctaaggccaaccttgaacctaacccctaacccctctcccaacagtctgttctttttactcatgaatttctgcctcaccgtggagctctttttctccgctcctgtcctctaagtcgttaaccccttcaggcataatgaatttattatagtaattctttattaatgatcaattattgtaatgggagtgggagggcaggttgtggaccaaacatcaggcaagcatgtatctgccttcagctagatccaatccatgacccacaagagacccttccctgaagcagttgccatggtggcctcctttgccaccctctcagaaatgaccaaaatatatacattcccctctgtcctgggccaaatcttgctaaaaggagctctctttttagaggttttgtttatcagggtatcacacttaactgtcgtggataatcttttcctccagagagtatagatgtttaaaggaacacagctatttaatgatatggcacatcaaggtttgaacttaggtggctaataacatacctttttaaaaatgagaatgaaacatgtttataaccaaaattaacctcaaatattgcaaagcccttcattttgagtttaaaattttgttttatgaaatggaaagtgataatactcttggtgggcttataaattgggaagagttttggattacccctgaaacgtctctggaagcttctgttaaccctcttttttttttttttaaagtcagacaatggtatataacttttaactctcgataggaactaattctgaagcatcaaatgcttctgaaacagaatctgaccacagagacgaactcagtgattggtcattagctccaacagaggaagagagggagagcttcctgcgcagaggagacggacggcggcgtggagggggaggaagaggacaaggaggaagaggacgtggaggaggcttcaaaggtatggagatcttcattaagaaatcaaagtgaattgtaacagctgtcttgaagttccatgagaaatcctattgatgcaatgaactgttaccaagatcccatctctcccgttttgtgctgataccataggaaaggatcagccttccacttgtgtagaaagaaagaatattaggcagccttccttatggttcatacagatatatgaataaatgctgataactaattcagcatcttggtgggtctaaacagcatcccttcattaactcacattgacctgtagatgcagaattataataactgtgaaatattttctgttacttagcagcaggctagattattagccattgtgtaactggaatcactggggtattgattacatttcagattctgtggttggtttaaatagagggtgtgggaataaagaacttccagtaagcatttcagaatcagtaactgttgaaccttttgaaaatattctcataggaaacgacgatcactcccgaacagataatcgtccacgtaatccaagagaggctaaaggaagaacaacagatggatcccttcaggtaaaacctgtctgcctcttttcatcttaattgtttgaatatggtagtttgagatttatgagtttattttactttattaaaaacatgttcaaagattacaaatccagtttatgtgaaatattttaccttcaacattacaattgtagtcaatcttagttctttgtgacaagtatacaaataagaggatttctctagagaatatgcagtctgagtatttgtgaagaccttgacagccacactatgattttattatttattatttatttttatttttttgagacgggagtttcgcttttgttgcccaggctggagtgcaatggcgcaatctcggctcagagcaacctctgcctcccgggttcaagtgattctcctgcctcagcctcctgagtagctggaattacaggcatccactaccatgcccagctaatttttgtatttttagtagagacggggtttcaccatgttggtcaggctggtcttgaactcccaacctcaggtgatctgcccaccttggcctcccagtgtgctgggattacaggcgtgagcactgtgcccagccacactatgattttaataccacattggtagacctgcaatcccccagagaaggaacatcctgggatgtacttagagacctcagtaaaccttatgtgtctttgctcccccaaattaacagggatagggtattctctttgaatagaaaataaggaaaagaaggtgtctgtcttacaactaataatcatgatagacagagctgatgatattcagctagtctccatgcttggtcagtcatctgcttatttacagccaggacctagtccgaggatctcttctcaattggctgtcaccagtgctaaaccaattgttaaataattttaaaattatctcctgagcacatccaggcacctttgctaagtgctttgtgtatgttttatctcatttaatcttacagcaacccactgaggtagttttattattccactttataggtgagtgcactgtagcttcagtcctttgcccacagtcacatagctagcatatgtccaaatgatagtcaaaccttagtgtctgattctctgaatctatgttgtcgtctactttttctgtaacttttaattattaagtagttagggttccttcctgactatggattcatttgggaccatcacccaagattagtgagagatactttttaagacaaagtttatgatggaatatttcttggaattcatagcagctcaaagtaagtgttaactattggtgggttcttaaggaccagcatgtccaagggatagatagattggtaaattactgtatgtacctgtcttttacaaagctataagatatttaagtacccgttttgtaattttccacttaaactgatatgtttgatgaacttggcagtctaactgcattggttaaaaggatgcacatttatatttctaaatgaaatggaatactgaatttaaaaggtgatgttttctctattaagtatgaaaatagatacaaatctggccaggcgcggtgctcacgcctgtagtcccagcgctttgggaggccaaggtggtcagatcacctgaggtcaggagttcgagaccagcctggctaacatggtgaaaccccatttctactaaaaatacaaaaaattagccagacgtgttggcgggcacctgtaatctcagctactcgggaggctgaggcaggagaatcgcttgaacccaggtggcagaggttgcagtgagccaagatcttgccattgcactccagcctgagcaacaagagcaaaacaccatctcaaaaaaaaaaaaaaagggccaggcacggtggcgcacgcctgtaatcccagcactttgggaggccaaggcgggtggatcacaaggtcaggagatcgagaccatcctggctaacatggtgaaaccccatctctactaaaaatacaaaaaattagccgggcatggtggcgggcacctatagtcccagctactcaggaggctgaggcaggaggatggcgtgaacctgggaggcggagcttgcagtgagccaagatcgcgccactgcactccagcctgggcgacagagcgagactgtctgggaaaaaaaaaaaaaaagatacaaatcaaagtactgaatccttggtaacgagacatttaaaacacatgcacatacccactacttaaacatactttgaaattacaaccatttggggatgtttttagcatttgtgcttgaagtagatcaatatttgtagttgttttagttccatttgtcactgttaactttcatttgtacctctggaattagcagtgctgtattcagcattggcacttaaaatattttatagctcttagaacactattttttaaattacattgatctttatactctcctaggattccagtccttccacaaattattatatgcagttttctttatactgttccattcttcagacagagttcaggttgtaggatcatctgaattttcttagtgaaatacaagccagtagaaaccaaagctcgtgtttttctactgtatgactatgggagctctcagtatagagaaacttgatcatacctgtgatagatataaagatgtaaattaaagtctagttagtgagttatttgagggtaaagccagaataggaaaacattttgtttctcttttcctgggcttcacaatctttggagaataactaattttattttaactctagtgttagaggcatgtatgtcttctggtaatcagtaatagtaattcattttacctgtttgtttctcactgttttattctacttagaagaagacatgataggattgtgagtttttctctaactttggatgcagtgagatgaccagtgtgttccagttaaagaagaagagtgttttaaaatcataaaccaaataaagaatcctaccttacattaatttcttgcacttcttctgttctcatctccatttctctttttaacatgtggaatttacacttcaggtttaaatttcttgtcaggccaattacagattacagtaggatatggtctgtgtatataacaactataacttgttttagatcagagttgactgcaataatgaaaggagtgtccacactaaaacattacagaatacctccagtgaaggtagtcggctgcgcacgggtaaagatcgtaaccagaagaaagagaagccagacagcgtggatggtcagcaaccactcgtgaatggagtaccctaaactgcataattctgaagttatatttcctataccatttccgtaattcttattccatattagaaaactttgttaggccaaagacaaatagtaggcaagatggcacagggcatgaaatgaacacaaattatgctaagaattttttattttttggtattggccataagcaacaattttcagatttgcacaaaaagataccttaaaatttgaaacattgcttttaaaactacttagcacttcagggcagattttagttttattttctaaagtactgagcagtgatattctttgttaatttggaccattttcctgcattgggtgatcattcaccagtacattctcagtttttcttaatatatagcatttatggtaatcatattagacttctgttttcaatctcgtatagaagtcttcatgaaatgctatgtcatttcatgtcctgtgtcagtttatgttttggtccacttttccagtattttagtggaccctgaaatgtgtgtgatgtgacatttgtcattttcattagcaaaaaaagttgtatgatctgtgccttttttatatcttggcaggtaggaatattatatttggatgcagagttcagggaagataagttggaaacactaaatgttaaagatgtagcaaaccctgtcaaacattagtactttatagaagaatgcatgctttccatatttttttccttacataaacatcaggttaggcagtataaagaataggacttgtttttgtttttgttttgttgcactgaagtttgataaatagtgttattgagagagatgtgtaatttttctgtatagacaggagaagaaagaactatcttcatctgagagaggctaaaatgttttcagctaggaacaaatcttcctggtcgaaagttagtaggatatgcctgctctttggcctgatgaccaattttaacttagagctttttttttttaattttgtctgccccaagttttgtgaaatttttcatattttaatttcaagcttattttggagagataggaaggtcatttccatgtatgcataataatcctgcaaagtacaggtactttgtctaagaaacattggaagcaggttaaatgttttgtaaactttgaaatatatggtctaatgtttaagcagaattggaaaagactaagatcggttaacaaataacaacttttttttctttttttcttttgttttttgaagtgttggggtttggttttgttttttgagtcttttttttttaagtgaaatttattgaggaaaaatatgtgaaggaccttcactctaagatgttatatttttcttaaaaagtaactcctagtaggggtaccactgaatctgtacagagccgtaaaaactgaagttctgcctctgatgtattttgtgagtttgtttctttgaattttcattttacagttacttttccttgcatacaaacaagcatataaaatggcaacaaactgcacatgatttcacaaatattaaaaagtcttttaaaaagtattgccaaacattaatgttgatttctagttatttattctgggaatgtatagtatttgaaaacagaaattggtaccttgcacacatcatctgtaagctgtttggttttaaaatactgtagataattaaccaaggtagaatgaccttgtaatgtaactgctcttgggcaatattctctgtacatattagcgacaacagattggattttatgttgacatttgtttggttatagtgcaatatattttgtatgcaagcagtttcaataaagtttgatcttcctctgctaaattgatgttgatgcaatccttacaaatgattgctttta

SEQ ID NO: 156 - DNA, 38798 bp, mus musculus; identical to SEQ ID NO: 155

SEQ ID NO: 157 - DNA, 4327 bp, mus musculus
aggcggaggcgaaggtggaggggaaggcggaggcggcggggaaggcggaggcggcggggaaggtggacgccaccgagaaggtggagacggcggggaaggtggacgccgctgggaaggtggagacggcggagggtccgggccgccgggctgagctcaagctggagcccgaacccgagccggtccgggaggcggagcaggagccgaagcaggagctggaggatgagaacccagcgcggagcggcggtggcggcaacagcgacgaggttcctccccccacccttccctccgatccaccgcggccccccgatccctctccgcgtcgcagtcgtgcgccgcgccgccgaccccggccccggccccagacccggctccgtaccccgccgcagcctaggccccggcccccgccccggccccggccccggcgcggccctgggggcggatgcctggatgtggattttgccgtggggccaccaggctgttctcacgtgaacagctttaaggtgggagagaactggaggcaggaactgcgggttatctaccagtgcttcgtgtggtgtggaaccccagagaccaggaaaagcaaggcaaagtcctgcatctgccatgtgtgtggcacccatctgaacagactccactcttgcctttcctgtgtcttctttggctgcttcacggagaaacacattcacgagcacgcagagacgaaacaacacaacttagcagtagacctgtattacggaggtatatactgctttatgtgtaaggactatgtatatgacaaagacattgagcaaattgccaaagaagagcaaggagaagctttgaaattacaagcctccacctcaacagaggtttctcaccagcagtgttcagtgccaggccttggtgagaaattcccaacctgggaaacaaccaaaccagaattagaactgctggggcacaacccgaggagaagaagaatcacctccagctttacgatcggtttaagaggactcatcaatcttggcaacacgtgctttatgaactgcattgtccaggccctcacccacacgccgatactgagagatttctttctctctgacaggcaccgatgtgagatgccgagtcccgagttgtgtctggtctgtgagatgtcgtcgctgtttcgggagttgtattctggaaacccgtctcctcatgtgccctataagttactgcacctggtgtggatacatgcccgccatttagcagggtacaggcaacaggatgcccacgagttcctcattgcagcgttagatgtcctgcacaggcactgcaaaggtgatgatgtcgggaaggcggccaacaatcccaaccactgtaactgcatcatagaccaaatcttcacaggtggcctgcagtctgatgtcacctgtcaagcctgccatggcgtctccaccacgatagacccatgctgggacattagtttggacttgcctggctcttgcacctccttctggcccatgagcccagggagggagagcagtgtgaacggggaaagccacataccaggaatcaccaccctcacggactgcttgcggaggtttacgaggccagagcacttaggaagcagtgccaaaatcaaatgtggtagttgccaaagctaccaggaatctaccaaacagctcacaatgaataaattacctgtcgttgcctgttttcatttcaaacggtttgaacattcagcgaaacagaggcgcaagatcactacatacatttcctttcctctggagctggatatgacgccgtttatggcctcaagtaaagagagcagaatgaatggacaattgcagctgccaaccaatagtggaaacaacgaaaataagtattccttgtttgctgtggttaatcaccaaggaaccttggagagtggccactataccagcttcatccggcaccacaaggaccagtggttcaagtgtgatgatgccgtcatcactaaggccagtattaaggacgtactggacagtgaagggtatttactgttctatcacaaacaggtgctagaacatgagtcagaaaaagtgaaagaaatgaacacacaagcctactgaagtgacacacagacctacctgcaatggaagatgacgacaccaatactacaactggcatcgagatctaaaggacctacttgaccatggcccatgggcctgacagagtaagaattgaacagtacccagtgtccaaaaggtcctgattggaagagaaatagaaggggagggagaagaggctctagtctaagcagttgatgaaagggaaattaaatggtagaaacactctgggtgaggaaggcaggagcaggaaaatgctgacactggtacatatcctatattcctccaaaagattgtgtgggaaagtgtgggggggaggggggtggtggggggggagtgtgcccttgtaaccgtaaaacatctttctccatgggtgtttcagcttcaattgaccaatcacataacagttatatgtttggggggaaaaagaaaagtttctaaaaaatgtagcccattacatatatgggtatgaaagcagaaaagtggaggaggcagggatatcattgacaaacacctttgccagtttctttgtattcgtgattttttgtgctattaaatgcagtattaaaacaagaaaagcccacctgggctagtgaaaggagaggaaataagggggcttgtaaaaggggagccgtcgctccaaaagtagagaagacaagaaatgctgtaagataagcaaccaacgcagacaggcctcagctaagagtatagtgtgtgtgtgttaaaaaaaaaaaaaaaaaaaagaaaaaaaaaagctgtatgatatacttgagcaaatcaatgaacctctttgcgattgttttatcatctgtaaaatgcagataattcctaccttaaagggttattgttaaagataaaatgatataaaaatgtgtcaaagtataaagtaaaaggcttggaactttgtagggactcagtaaacgtttgttggatccaaacctgaaacttctttggaccaggcccagaatgcatcagaggtgggggtcagtcctgcctgagacccctggacagaagggacacacatcatgtcacatacagtcacacacacattctccacaactccctccccaatgctgtctatttagagtaccaaggcaatgaactccacttttgtcccttgtgtgcagggcatcacagtgggtgccacctgggattgggggtggaaaggaccacagctgtcccataaggtcattattctgtccttttggaggacagtcatgttgctttcatgattcagatcccagtgatgggactctcatggccagtaggctgccaggcttgcacacgagggaatttggtggtcttcgtcttctaaaaacattatgggttcggttgctatgtttactcacaggcacagatcagtagaaagactgttttccaaagttcactggcccatcagcccagggatattgatagagtggcttgttggccccttccctgatactgtcagagggcagagcagcctgcagagagctaagccaaaacagatgggatgaacccaggatggggtaagcactatgagtccttctctcatcagcatcaggtacaaaagtaattgttacctagataatcctggagggaaattgaatgcgtatcacatccatggggcttggatccactggctctggtaaaaggctgggctccccattgcttcccaagtctacttcatggtcaactcatttggaaatatatgtttatttacgtggctgtgggtgcatcacaactagcttataggcttttttaggacaggagttgtgtctcctcttgtaccttgggatgcattctcattcccttagctcctgtcacatggtaagtaggtattcaaaacatttactgaatgaatgaatggatggatgagttaatgaaccaatacaccttcctttcataaccgagatttcattaacacctagggctcataattttcaggagaaaatgtaaaaagttgttatttttggtgtcttgtaggatgggggagctcaagagatgggtgactttggatggcacttggcaacttcgtgcagggtgtctgactaccttttgggatgggtctggtatccctacctggaagaacacagccatgtcctcattcttcatctctgccaggggaagagtccaggcaggcctgtgccaccagatcctgactgcttgcacagaaactgacctttaaaaattttaaacatttttatttggaaatcatttcaagtttacagaaaagttataaaaaatagtataaagagcatctgtatgctctataccagatt

SEQ ID NO: 158 - DNA, 2202 bp, mus musculus
gtggcggcgcgggggccacgcagacctggggtgtcccccgcccggcctgagggagcgcggtggctgtggcagctggacccaaaagggactttcactgaaggaggcggcggcggaagcaggcgacgcccccgggaatcctcccgccgaagccccctagtggaggctgcttctgcagccaggccccgtttcctttaattcagtattttccaaacttgcttgttcacgagaatcacgtggggagcgtgttaaaattacagattccttggctccacccgcaggcctactgaatcagaatctcgaagggaggtactccggaacctgtatctctaactagggccccagaggctgcttatgatcaggcaagtttgggaaacacagctctaattcattgaggctggcgggaaggggggcggggaccgcgcagtctctttaaggcgcttccagctctcggctccaatcgctgctctgacccccttcatcgtctcctcccctctcctcgtccttcccctcgtctatgcaggcttccctcggccactgcggggctgggggccgagcgggtgccaagtccagaaatgtttctgaggctgtgaaatgtcccctctgaggggggtcctagggagcgcaggcagaagccgtgacaggccatcatttcggcggccgagcctgcctctagcctcgtccctgtctcccttcccacgccaggtcctgcgcttcccgaaaaggatgaagctccagctgcagttctggggaggcctggaccccagctccgggggggccgggctaccaaggccgctgggcctggagaggcgcgtccctggcccatcttatcagcgctctgcagggtctgggcctgctgctcgcgtcctcctgggctcccaaggccacgggtgggttaatggcttgacagccggcctcctggcccagcagacgctgagcagcccgatggcacaatccacctcttctctccaaggccagctggagggacgaggcacgacaaggccatccctacagctggcacttcccctacagctgagagggggcctaaactacaggacacactcccaagacccttaagccctggcagcatcccgggggaggggggcagcaggtggaagtggaaagaagcctgtggagctgccagcagggagagggagtcggacatgaggctgagaggcctctgggaacccctgtgccaaggggctgctggcactgggcagcagcaccccagagcccacgaggagtgtgcccagagcaagtggctcagacctgggtcatggctcgagggtgtcgggctgtagctgctggtcccagagagtgcagcccagggcaggcatcaggacaggagtaggaggagaaagagtgttctaggaagagtctagtcccctaatcctggtggtggctggctgtagcctagtgcacgctgtctggcttgtgtggctgtgctgcctgagtatacataccctagcaacattctccttgctcagcactggacatcagctctccacctggccccttcctctagggaggggatggggaggcctcctagggttagcagcaggagttgggcctcaggaatcaggagcccttgaaaggaggatgcgtggttcccataaaactgagggttgccctgggccctacccttcctgagtcagctcttgcttcaattccttgaagcaccccagcatcctttcaataaatgcctgccctttgtggcctgcaaccagaggaactgcaactagcacactcactgaaggaatcctgctgctgctgctgctgctaaaaacaaccgaggtcatggatgagggggtggaggatactctcatcccacctccagactgacaacaaaaagacctaaagatctctgtgtacctgggactgtctaccattgaagattagccatggtaacttgttgacttagtgatcaacttcctgcagaagcccataggtccacctggactctgcccaggccagcgtgttctgaaaatggagggctctgtcaccattcactcaacaaatgtttattctgcactgaccgagggccagatgtaccaagagctgtggacacagcactccaacttactccagggctactgaaatcagggatggcttccccaaaaggcacactaaggaaagtctatgtcactagcagagaagaggcaccaaagacaaaaaatcaaaaaagaaaaaataccagaaacagtt

SEQ ID NO: 159 - DNA, 2865 bp, mus musculus
agccccgccccggcccgcccctcggagttgtaactccacgtccgaaggcagtttccaaggtggaagctgggtccggctgccaggaagcggccggtgcgcgggctgcgcgggctgcgcggggctcggcttccacgtgcgagcctgcaccgccgccccgccctctcctggcggccaggcctggggactctctgccgcgggacggcgcctcgcgttccgccgtggcagtggccgtggccagaacgtccacgcgcggtcgtccaccgccggatctcgctccaggtctctttccttttgttctctcctaggggtagggggagatgggggaccgggggccagaccacctctgagaggactcgctgaggcccagcacctcggcgcctcctctgttcccctggcccacctggccctgggggagatctaggcctcgaacggcactcctcgcacgcacacccccagccagagtcggaagctcgaacttggggagcgttcgcgagaagaccgagacaggagcagaaagggggtatggagggaggcggctgcgacctcagggtaccccaagatgagcctcgaaggggcggttagccgctcagccctcttctcgaggacccttccccgggccgagctgctgcctggggggtttcttggggcgccttgttgggagtcctcatggtgggggaccctgggctcccgccttcaggacgcggggccggcttcaagtctgagccccctcggccctccggtagctcacaccgcgccttctctctcttcgcagcgcccgtggtccagcgtgtagggagccgatcgcccatggagggtctgggccgctcgtgcctgtggctgcgtcgggagctgtcgcccccgcggccgcggctcctgctcctggactgccgcagccgcgagctgtacgagtcggcgcgcatcggtggggcgctgagcgtggccctgccggcgctcctgctgcgccgcctgcggaggggcagcctgtcggtgcgcgcgctcctgcctgggccgccgctgcagccgcccccgcctgcccccgtgctcctgtacgaccagggcgggggccggcgccggcgcggggaggccgaggccgaggccgaggagtgggaggccgagtcggtgctgggcaccctgctgcagaagctgcgagaggaaggctacctggcctactacctccagggtaggtgccgcggggccctccttccagggggttcgggattcatttgaccttaggccagccccacttctttttttctaaagcgagttgaggcccccctcccctgatgacctgccaggctgctttgagaggagggaagcctgagtgtgaccgtggggaagttcttcaccctcggcagcccagtctctgagcctggaaaatggggagaattagcctgacctgagctagttctcaggatgctcaagaacgaattacaaagtgcgggctccccagggtctcggcaagggtatccccacctccccaacctgctcaggaatgagcaagggaggcaggggtcagacagcactggtgcaatcacggctcactgaagcctcctgggctcaagcgatcctcctgccttagcctcccgaacagcatataaagtgttcaggtgtccagcccggggaaatagtatctgtaaatagagatgctggcttcttgagccatattctcccccaagttcccccacatcttggggtcccacttcatccctgagagtcaggagatgcccaggcagagagctgacatctgagttcctccttttctttagctgatggccgcagtcctccctaaggctggcagtgcatctcggctctgttgagccctcacacctgcctcagcttgaccctaggggtgtaagatcctttccggtggctcagcgtgagcccagcttcttgcagcccgagctgactgagggtggctagggccccacgtgggtaccaggacacaccaagctgctgggttttgtgttccctttgggaacatttgcaaaccctccaagttgtccagggtcatctccccagccccagacagaggcacttggctgcccagaaggccaggtcagcaggccccatgccctctccccaacaggaggcttcagcagattccaggccgagtgccctcacctgtgtgagaccagccttgctggccgtgccggctccagcatggcgccggtgcccggtccagtgcccgtggtggggttgggcagcctgtgcctgggctccgactgctctgatgcggaatccgaggctgaccgcgactccatgagctgtggcctggattcggagggtgccacacccccaccagtggggctgcgggcatccttccctgtccagatcctgcccaacctctatctgggcagtgcccgggattccgccaatttggagagcctggccaaactgggcatccgctacatcctcaatgtcacccccaacctcccaaacttcttcgagaagaatggtgactttcactacaagcagatccccatctccgaccactggagccagaacctgtcgcggttctttccggaggccattgagttcattggtgagtccaccccacccacccttccctcctgtcctccccaaggcctgctctggcctcccccttgtgagtactcctcccaagccccgctgccattcccagagccaaaagcctaggtgacagttctaggggacaggcagagctagggcggcccccagaggccactagagaaacctgcaggtcgtggccatctggcccagggggcagggcggggcctttgagggcccttcggaaggcctcggcctcacacacgcctgccctccgggtctcccgggccctttcctgccccatctagatgaggccttgtcccagaactgcggggtgct

SEQ ID NO: 160 - DNA, 2865 bp, mus musculus; identical to SEQ ID NO: 159

SEQ ID NO: 161 - DNA, 960 bp, mus musculus
ggccggggacggggaagagagggatagtcggagcgaggtggcgagtcgctgagcccgccgcggccccgagagcggctgcagccgccgccgccgggaaggagagggcgaggcgcgcccgagccgccgccgccgccgccaccgccgccgccgccaccaccgccaccggagtcgcgggccagccgggcagcctccgcgggccccggccggggcggggggcgcgggccacaggcccctgctccggccgccgcttgcagaccgcgggcgccgatgtcgcccgcgccccgctaggctgagcctcgggtcgggcgaggagccgccgcagccgccgccgcccgagccgcgggcaggagcctcgggagccgccgccgccgccgccgccgcccggccgggccccgccgccgcccgcgcgcccccgggcccccgacacacatgagattcttcaggctcactttcaagtgcttcgtggactgcttctgactgcgccgcccgcgccccgcaccccgccgcccgcccgccgccccgtcccccggcccggccgccccccggcccccggccggcccgcgccctcggggccctccccggtgccgccggtgccccccgcctgaccgccgccccccgtgaggcgccgcgaccccggcccggccgtgcggcccgccgaggccatggcgaagaagagcgccgagaacggcatctatagcgtgtccggcgacgagaagaagggccccctcatcgcgcccgggcccgacggggccccggccaagggcgacggccccgtgggcctggggacacccggcggccgcctggccgtgccgccgcgcgagacctggacgcgccagatggacttcatcatgtcgtgcgtgggcttcgccgtgggcttgggcaacgtgtggcgcttcccctacctgtgctacaagaacggcggaggtgagttcccccgcccgccgcggcctcctcccccag

SEQ ID NO: 162 - DNA, 28526 bp, mus musculus
agccggaggcggcagcggcagcggcgggccccgcgggcggggaggcgcgcggcccacggcccctgacggcccctggcggcccggcgcgcccccgcgctccctggggggccgtagcctggcaacgcccggcgcgcccgcccatcccccgctgccctttttctcctggccgggtgcgagggagcatgcccgcgcctggcctcggccagcgaagagttaacctgaggggcgagccgctgcccccacctcgggggcgtgcccccctcccccgctaggcggcccgccccccgcgccagggtatggcccctggccccggcccgggacccgaggtcccgcgcccgggtcagtgaaaggcgtcttcccgttcccgccctccgcctcctctcgccggccagcaacatgggatgtaatatgtgcgtggtccagaaaccggaggagcagtacaaagtgatgctgcaggtagggccgccggcgctgcggcgggggcgcggccctccgcggggaggagcgggccagtggggaggcccggagcggcgggcgtgggagagcgggagggctcgaggaggacaaggtagggagccgtccgcaccctcccatcctggggctgttgggtgttggcgctccgtgggaaccagccacgggtggggtgggaagttggggttggcccgggtggggcgcgcttccgtcccgggaggcgcggtgcggcgggcgcgggatggaggttgcatagcaacgagcgcagttccccgcacacgctctccccgcaggacccagggcgggggagggagccaggctcccgccgtgcggggggcgccgaatctagatcccggcgggcctggagcgtgggagtgcgtgggcgtccccgggcgcggtccaagtccgtccgggggctgggtgcccaccccgacacccactcccgcctggccctgcccgaacgatgggctcccgggccttaggcgtctcgggtgagtgggcgccgccgggatcagcgggttgggctctctgcgggtggcagtgcctggccgggctttgcggggcgtggaccagcagggccccgcggggagggaaggagacgcggggcccggagctcggacctggagcccagccccgcggcccggaacggggcttcttgcctgtgcgtggcgtgactacgtgagtgcgttcctgtgccccgtctctgtgtgcgcggaggctcccccggccccgcatttgtgtactttctgtgtgcaccctgcagactgtctagagaaatgtcccggatgctgtgggctgagacctcctagggctaagtggagggaggtcaaggtcaaggcacccaggagcagacagggctcagacaggtatgcgtttagtggcctggattcaactcccgggtttattggtctggactgggaaggaatcaagtgctttgcaggaggggtgttggcttgggagaacgtgggggaacccgtgcagggatcggcgagaactccggggcgggggcgggggcgggggaaggaggggctgggcacgggggagaattcccaggaatccggggactgacttcacgctgtgagccgagctcctctggccacctggtgcgggagccgaggggcagggcggggacgcaaatcttgccccaccctggcggagctcctggtcctctctccccggcccttctccgggggtgcgcggggccctcggcttctcccgttcgctgtcctccgccttcttccctctcagttcccggctgccactcctcgtctcttgttcccgctgtttggaaaccttgtgtggccattgccagccccctagcgggataggaatgcgaccgagagggcgtcctgtggaatccgtgttggattccagggctgggatggttggttgacggggactctggatcccatcctcctgcttccttttcgggagtcattccatcaaacggcaagcgatttctccaagcgattcctccggggccgttttgactttcctggagaaggattggtgtcgcacttcatttaaggccaacctcgtggggacgtgtggataggggagagcgacccgagctgcaccccaggcctgaaatgagccatgggacgacaccggtagcccttggggctccccacagccctccgggaaggcctcggcaggtcgggctgggcctgccttcagggaggtgaacttgggtgggccctccctgctctgcgccctaagctctccttcatggaagggacttgcccaccccaaggagacccgccaggaggagggccactgccgcatgcgccctctgtgcgctttcctgctgggctccctttgaaaccgtgggagtttggctgcaaactttcactttctacattcctccttggcccaatcaaagccgggattttacgaggagaaccatccttcacaactaagggaaaacaagaggactgaaaaaagtagatacggaaagcagtgcaagccatgagctgtcccaggggactgcgcttctgggggtggacgcatcaccaggtcccagcctcttcagaggagaaggagcttttgttccaaaagacaggtcagcttctgggaccccgtgcctgcctcccggcctccttaaacacgggtgctcccccatctttagggggcacttctccctgtcccccctgagtaacctcgtccgcaccttgtcagggtgaggcacttcatgggcctgattttcagaaagaagcacatgtgcatctgcagcgccttccatctacaatccacagaggcctgggatccccaggccaggaacccccaagtctctagcctagccttgtgttccaagccattttctgccaatgactcacaacacttccaaaattacagctgtattgagctatcattctcctactgcacaacttaccctttcaaagtgtacaagtcagtggtttttagtatactcacaaggttgtgcagcccacaccagtaattccagaacgttttcatcaccccaaaagaaaccctgcactccttagcaatcacatccccatttctccctcaaacttcctagcccctggcacccaccaatctacttcctgtctctatggatttgtttattctaaacatttcatagaaactgaccttttgtgtctggctttcattaatcataatgttttcaaggttcatccatgtatcaatagtcaatttctttttattgccaaataatatttcattttgtgatatacaacatatttatccattcgtcagttgatgagcatttggggtgcttccacccttgggctgttgtgaatagcgctgctgtgaacactggtctacttgtatctgtttgagtccttgcttttaattctttggagtgtgtgcctgtagccattgaactgttttccacagtggctggaaccagtttacattcccaccagcaacatataagggttccaatttctctatatctttgccaacagttgttattttctgggtttttgttatggccgtcctgctgggtgtgaagtggtatctcattgtgattttgatttgcacttcctgttagctaaatgatgagcaccttttcttgtgcttgttggccatttgtggatcttctttagaaaaatgtctgttcttaagccagcgccacactgctttcattactgcagctttgtagtaagttttgaagtaaggaaatgagagtcctccaactttgtacgtctttttcaagactgttttgtctattctaagtccctcaagtttccatattaatttcaggatcaggttgttaatttctggaaagaagccagttggcattttgatagagattgcatcaaatttgtggatcaatttgggtagtattgttcatgagcatggggtgcgttttccatttatttaggtctttaatttctttacatgatgttttgcacttttgtttaagtttattcatgagtattttctttatgatgctatcataaatggaatcgttttcttaattttactttcagccttctcattgctactgtatagaaatacaattgattggctgagcgtgttggctcacacctgtaatcccagcactttgggaggccaaggcgggtggctcacctgtgcttaggagttcaagaccagcctggccaacatagtggaaccccgtctctactaaaaatacaaaaaaaattaacggggcatggtgatgtgtgcctgtaatcccagctactcaggagactgaggcaagagaatcgcatgaaccccagaggcagaggttgcagtgagctgagattgcaccgctgcactccagcctgggtgacagggcaggactctgtctcaaaaaaaaaattgatttttatacattgatcctatatcttgcgaccttactaaaattgtttattaagtataatttgtttagtagattcctcaggattatctacatattaggatcatgtcattggcaaatagaaatcgtttttcttcttcctttccaatctggatggctttgatttcttttcttttctttctttctttttttttttttttttgagacacagtctcactttgtcacccagactggagtgcagtggtgcaatctcggctcactgcagcctccgcctcccgggttcaagtgattctcctgcctcagcttcccatgtagctaggattacaggcacacactaccacacccagctaatttttgtatttttagcagagacgagcttttgccatgttggccaggctagtcttgaactcctggcctcaagcaatcctgcccgcctcggcctcccaaagtgctgggattaccggtgtaaaccaccgttcctggcccttcgatttctttttcttgttaatttgctctggctggagtctctagtacaatgttgaatagaagtgcctgtgaatgtctttcccttgttcctcatcttaaaggtaaagaagcttccagtctttcactagggggtataaagttagctgtggctttttcatagctgtcctttatcagggtaaggaagttcccattctattcctagtgtgtttttatcatgagaggcattggattgtgcagtgctgcttctgtggctagtgagatgaccacatggttcctttattccacggatgtgggttgtcacaggcactttcgtgtgtcatgtcggaacctcagccccattcctatattccaatcatgtcctcctagtttggaaaatctgggacctcccctgaaaatggaggattactgcgtgttgagttaggaaaaggaagcaggctggttgcccagaatggaaggcaggaaacagcatgtccccagctccggagccttttctgcagcccatgtccctccactgccaccaggcccccttgtcatatatctcatcgtggtccacactctgctgaacttgtcttggccttggcaccccctctctgacaccatgatgtgcttgctagcatccgagcacgccggagatggtcaggggataaacccctggtacttaggactggtctcccgcccatcctactcaggctttacagggggagtgggtcaggaccgcctgtcatctcccctctgtccacatcgagggaggccaaaggacagctggccagcccttctggtgatctcccaggcattcttgcctaaagcacctgcatgtgagcccccatggtgctggcagccatcctgggtgcgtggcattcagcagggagacactgcagacagggccttgcccctcccccagactccccttttgttgttgttgttgttgttgtttgagacagagtttcgctcttgttgcccaggctggagtgcaatggtacgatctgggctcaccaaaacctccgcctccagggttcaagcgattctcctgcctcagcctcccgagtagctgggattacaggcatgcgccaccatgcctggctaattttgtatttttagtagagatggggtttctccatgttggtcaggctggtcttgaactcccgacctcaggtgatccacccacaccggcctcccaaagtgctgggattacaggagtgagccaccacgcctggccccaggctcccctttttgtaagggggagaccatcgccaacatgtaggcaactgcgggggagagaaagtactgcttgagtgcgggagcgtggctggcagccagtgtcccctcttcagcgacgtcttcctccaaactgctctcccacccaccaagccaggtggcttctctggctccctcctgcttgcatgggggcttcctgtgagcagggatttgggtctggcatgggcactctgcctccccgcctcaccagcaccagatgctgccagcacatccacgctggcctccacccttccaggggaaagctggactctcagtcaactcagtggttctgccgcagaagctgactggggaagaagcaggctctgagaaagtccttgtggagtggaagaacagagggctggacactgaattctgactgccatcttctggaccaggtcatcctgttttgtgtcattgtcccaagattgtagaatgccctttcccctctcatctcggggttcctgaggactgtccagtctgctgaaatgaaattcgatagtgccagagagcagattcgtggttgcagggatgggcagaggggcatgaggacacttttggggaagatagaaatggccactgtcctgacggtggtgatggttccccaggttcatgtatgacatatgaacacctgccctttgcacactgaagatgtgcaggttaccacccagcaacagacctcaccaaagctttagaacaggaactccatggccacatgcacgcatcctggggagaaaggtgtcctttccttccttctacttcaggggccctgccagagaaggcagtgcagtgtggagataggaatggaggcagccaccaactgacagctgtgtggccaggggcaagtcgctgcatggcccactggctcagtgactcagtttcctcaactgtgaaatggcagtgaagagtgcttgcgtccgagggccattgtgacaaggaaaacagatggtgtgtcccccgggatctcactgggtggaggagggagttgctgccctcgggccattcagttggtcattaagaagtggaaattggctgggtgcggtggctcacgcctgtaatcccagcactttgggaggccgaggcgggtggatcatgaggtcaggagttcgagaccagcctggccagcatggtgaaaccccatctatactaaaaatacaaaaaattgaccaggcgtggtggctcacgcctgtaatcccagcactttgggaggctgaggtgggcggatcacctcaggtcaggagttcgagaccagcctgaccaacatagagaaaccccatctctactaaaaatacaaaattagccgggcatggtgacacatgcctgtaatcccaggtacgcgggaggctgaggcaggagaattgcttgaacccgggaggtggaggttgtggtgagctgagatcacgccattgcactccagcttgggctcgaaactccatctcaaaaaaaaatatatatatatatattagctgggcatcatgcacctgtagtcccagctactcgggaggctgaggcaggagaactgcttgaactcagcaggtggaggttgcatgagccaagatcaagccactgcactccagcctaggtgacagaacgagaccctgtctcaaataaataaattaattaaataaaaaataatgaaaaaggaaattatatggagaaggccttacatctgggtatgtcacagttaatgcccagtgacagaagaatgtccaatattattctgagaatttctctcaggaaagggacctccaagttttgaagaagtgtgatgtagtacaatattagttaggacagcctgggcaacatattgagaccttgtctctacaaaaataaaaaattgctcaggcgtagtggcatgcgcctctagtcccagcttctggggaggctgagtgggaggattgcttgaacccaggagttggaggcttctgtgagccgtgattgtaccactgcactctagcctgggcaatggagccagactgtgtctggaaaaaaaagaaagaaagacagagagaaagagagagagagagagggagggagggagagagagagagagagagaaagaaaaaacagatggacagggaacaaagcggaggcatatgtggtcattttgcacaggagttgggccggaggaggcgaggctgagcagcctggggctggacaagatgtcctccctttcagtgcattctgcctgtcctcatggctgcttggagcattgagaatgaaaaacgctgcagagggaatattgctttgattgtaaaacgctgcagagggaatattgctttgattgttgctagatgtgaactgtgcccttagccagtcaggttagcctgaggtgggtgggaggatgggtttagttgctgggccacgtgcctggaaagctgtgaatatgtacccgaaggttgatcttgagaatggcttcaggaagtggttggcttttcctgtgcaaggtgtgggacacccctcttttcctgtgtgttttttttttttttttttttgagacagagtcttgctctgtcacccaggctagagtgcagtgttgtgatctcggctcattgcagcctccgcctcctgggttcaagcaattctgcctcagcctcccgagtagctgggattacaggcacctgccaccacgcctggctaatttttgtatttttagtaaagacagggtttcatcatgttggccagtctggtctcaaactcctgacctctagtgatccgcctgcctcggcctcccaaaatgctgggattacaggcgtgagccaccgcgcccggcctcctttctgcttctgagccaggactatggaggtgtctgagaggccgccgctctcccggaaaggtgggggccaggtggattgatgagacttcagcagaccctgggcttcggggagggaaggagaagtgaggggaaagaaagatgccctcatgcagaaggccttcgttgaggtctgccctggttcctccagggcgcgctctgagtcagtacagcgccaccctccacccgaagtccttgttaaggtgcactttctgactgagccactagcatggggcctgggattctgcacttctcacaagctcccaggtgatgtggatcccactggctgtgagtagccagggccttgggtagggaccgggagtagatctatggtagccccaaaccacattaacatgggtggtgaagtgaggtgttgttttttttgtttgtttgttttgttttttttttttacaaatagagggtaaaaattgtttacaaatagagggtaaaaaaacacacatagagggtaaatcagaacatccaggagtcgttgcctacgtgagggctttacaggacataacttgttcttccctgccatgtgcagctaactgacccccttccctgtcaccggcacccctaccggtatacatgtctctcatggacgcccagacacccctcccccgactaagtgctcaaaggcctttgagatgaagccctcccatgtttctgtctctcctgcccccaggcagaaagggtgggcacagagttatggaagcgggtggtgtggcttgcccaggaggccacagttgggggcgtgggcagccatgctacttgccgggcctgtcacctctttgtccctgctagaattctaacatgttggtggagacattttgcagccaccaatgcagtaattaattcaggcaaaaatcatcactggatgccaaaaccattagatgtaaggtcgttggggacagaatattcacaaagtctccaaatattaccccaaattacctgtgaatcaggaagggaaactgcgtctttacagaggagagatctggcagctgccacctggaccatgtgatcaaacagcctccccaacagtggggcagcctgaccctgccagccgccagatgcagggctggggaggagacatacagcatctcctgcaaggtgctcttgtcaaaacgctcagcctgaatctcaccgcgggaatgaatcaggcaaattcagactctggcgcattctataaggactggtctcttccaagaagtcattcccattaaagtaaaaaatatatatatttttttctagattagagaggagacataataactagagacctaacaaccgaatgtaatatgtgtgcttcttgattgaatcctagattttttgtttgtttgttttgtttttgagatggagtctctctgtgtcacccaggctggagtgtgatggtgtgatctcagctcacttcaacctctgcttcctgggttcaatcaattctcctgcctcagcctcccaagtagctgggaccataggctgcaccaccacgcctcgctttttttttttttttttttttttttgagatggagtcttgctctgtcgcccaggctggagtgcagtggcacgatctcggctcactgcaacctcctccgccacccgggttcaagtgattctcctgcctcagcctccctagtagctggaactacaggtgcaagccaccacgcccggctaatttttgtatttttagtagagacggggtttcaccatattggccatgctggtctcgaactcctgaccttgtgatctgcccgcctcagcctcccaaagtgctgggattacaggcatgagccattgtgcccagcctcaaatcctagatttttaaaaaaagctataagggtgttagcgggacagctggggagatgtgaggctggcccattgtatgagtgcggaattccgtgctaagggtgttgtggttccacggagaatgggactgatggcatcttgctttcaaatgcttctgcacatgtgtgtgtagaaaccccgagagcaggtgtggggaatctgcagatgttcccacatgcttgtgggcggacaattttcaaaatcccgagctggggaaacatgaatggggactttgctgggtcactgagtgggtgaatgtagtgagcctgcggcttctcctttctcctctgatgctctactcgttgggagatcccccgatgcctgacttggcctggaagctacagtcacaactgcttccaaggtgtcctggatactccagacggcagagctgagagccagcaggcaggtcagagctcggccccgggcagaggataacttcctgtctctgtccttccccagcttgtttcctactctacagcagtggggtaaggggagtccgaaggtggcagcccccccacctccgtggcagccacgggggcccctggaagtgatgtggcttcacctcccatcccgcgcgttgccagtgagagtgaaaggggtcgcaggcgccgtgtgacaagcacttgggattgcgagtctcccaggccacaactgttttcttagcctctccggcctctcttctcggcttcccagagattcctgatcagcaagagggcgtcgcgccccacccggctgtgcgcctgccaccgctgggtgcaggagggtgcctggggcagagcctggaaacagagctcagcctccgacggggttggcggggcgggcgggcaggagtcctgccaatacagccaccagcgtggcggcgccgggacgagtgtggtccgccctgctcccgcagccgcagccaccccgccgccgtcgcggcgcgctctttgtctgcggctccgggctcagggggcggggcgagcgcgcctggggctccgccctctccgcctagggcgccccgcttcccgcgtcccctaaggcccgccagtcccttgcccagcgggagatcgccgccccacagcgactgcccgtggggccgacttcgcgtcatgcctgcctcgcctgcccggtgttgccccctcccctgtccctgtgtcccccctcccttgcccgcatgtccccctcatgcggggaaagcggtgccagcactttccctggccttgcgaattgctcttccatcggtattcagccgcccctctgatgttcctgaaaacccaacctgctccttctctgcaaaaagctccggaaggctgtgtcgatgcaggtcgagcttccccacccggccccctcccaccttttagcaaatccagaggccccaccttcgccctcccctcccgggctccgacccagtgcattgagcagctcctcggcttccctcccgggactttctagtctctctccccaaccggctcagtgtcagggtgccccaggactctccttgggcctctcctgttcttgactacattcactccctaggtgagctcctccatctcatgcttttgctttttaaatttttatttatttatttttaaatttttattatttttgagacagggtctcagtccgttgctcaggctggagtggagtggcacaatcacggctcactgcagccttgacctcccaatgctcaggtgatcctcttgcctcagccctaccgcctgccccctacctcctccaccacttggggctacaggagcgagacaccacgcccagcttcatctcatgattctttttttgtttgagacggagtcttgctctgttgcccaggctggagtacagtggtgtgatctgggctcactgcaacctccacctcctgggttccagtggttctcctgcctcagcctcccaagtagttgggattacaggtgcctgccaccacgccctgctaatttttgtatttttcgtagagatagggtttcgccatgttggccaagctggtctcgaactcctgacctcaagtgatccgtctgtctcggcctcccaaagtgctgggactacaggcttgagccaccgtgcctggccgtcatcttatgattttaaataaagaaaaattcctagtttaattgaacagcaatggtcacatgccacccagttagctgacttgggcttgggccagacatttggagtggggcactggagatgtccacatgcctcgggaagttcaagctagagataaaaaccttccatttcctgccctgggcctaatccctgagtccttccttcctcggtcttcctcactgctgtgaggatacccctggtccttgtggtcctgtgtggcaattttatgttttcttgtggtaagatacgcataacataacatttaccactagtgacttttagtctattctcaatgttgtgcagccgtggccactgtctagttccagaacaggttcatcgccccaaaagggacctcatatccctcagcagtgactccccaggccccccttcctccaggtcctggcaaccattcgtctgctttctgtctgcctctttgccttggctagactgtgctcatgcagtcgtgtgtgccggtcgttcattctttttatgtcgggatgggtgtaccatgttgtgctcgctcatccattcatccactggtggacacgggttgcctccgagtcttggttactatggatactctgctgtgagcatttgagtataagttttctttgcatgcctgttctcaactatggatactctgctgtgagcatttgagtgtaagttttctttgcacgcctgttctcagttctttggggattgctgggtcatgtacataagctacacctaaccttgtgaggagccaccagactgcttccctggctgcactattttacatgcccagcagcaaggcgtgaggctccagggtccccgcgtcctctccaatactcgtgcttcctttcactgattccagcctcctcgtggtgtgcggcggtatctcactgtggtttgggtgtgtgtttcctctgtgcgtactggccggtgctgacgcgtcttttcctgcgcttattcgatgtcttcttcaagccctcactgtcccttgcccccagcccaacagcaggtcctggcagcctacctctaaaacccaagctgactctgaccacatcccaccacctctactgccacccctggggtcatgccaccatcatctgtggtctggaccactgccgttgcctgctggtctggcccttacagtctgttctcctgggagctcccttcgctacaaggaaggaagcatggctggtttcttgtcatcatttaggtctcagctcaagtgtcaccgacccagagaggctgtcctgaccactctacccacccaggcagctttgtctctgtcccctcccaccttccaaccaagccccttggggagcggaacgggatggggggtgtgttctggatccaccgtctctcccttcagctccttggcactcctttcctatggggcaccctgtccagggcaggtggggcaggattcccccctcttccctcatctcccgtgcttcccgggcccaccccccagcatctccagcctgcccgggagtcacatgtcctcggcccacagaatccccagcacacgccccacccacaggcctagccccagccctggggtccctggcaccccacctgccagggcccctcccctgccttgctcaccccccaacacacctgattgttggaaaggtcttcccatgcccaccacgaccccctcccactcatctgtgggcgggagagcttggtccctgccgcacgttgcccccctagcatccaggcccaccaccgagcccccgacaggcctgggagccccactggtgggtggggacccaccagctgggggtcttgctcacaccgaggggctgggggtggcggtggctttctcagggcaccctgccttgggctgcaggccgctgggtgggcaccggctccctcggaaggcagcgcaacccgggatcctgccggccctggcccccaccctgccgaccgggcctggggcgatcagtgccccagctcctgtcctcttctgctcagatgctgggttgggagatcaggggccacagctcggccactcagagccctttccgcaagtcttagagggaccagctgcggggtgtgtgcagaggggctgcgctgtggggagggcgcatggctcagtcctcctggcctgaggcccgcctagcctaagtggcctccaggacccatggccaggcccttctgcagccttccagaaagaaccagcttcccagggttccctggggaaggcctggggccacctcctctggaggggtggggcctgtgcttcattcctccttccccaggtccccttccaggccgccaggtcccctccccgacctggagcccacagccttgtaattaaattgtaaacgtccttgtaattaaattcatgtaatatccattattattattactgttttagactaaattacttagagcacattgactggatcaaaggctaccatgaacgttttcaagggtttttatagttattgacaaattcttctccagaaatttgaccactttacactctggggtaagattcagactaagtgtgtctagaaagggtgatggggtcggctgggaggaggaactgggcttgcaggggacctggggcagtgagtgctctcagtgtgcaaaggggaactgggctgtcccaagcaggatgtgagggccacttgggccacattcaggcagaggggccctgctaaggcttgagtcccctgttcagagcagggaccatggtggaaattaaggacgttcatgtcaactgtggttgagattggagctgcagtcctagagtcagccctcttgggcccatcttggcagcaaatcaggaaggaagtagatctgtgtgctgaagagtcgccatggggcacgtcaagcccctggctgagccgtggtgtgctcacaggctgctgcactccccggggcagcggagtgccagggacttgtattttcatctttgtgctcctccgcctcctcagtgtggcgctctgagcacttcgattatttgaaaggaaatgcgaaaatttgtacaaaatctattgtgctagcacgtgatggaggaggggtctttgtgaacaggctttgagggtttgcttggctcacagctcactacccagtcaacagggttgactgccacggggtgacctcgctaaggtgaagcatgatgcccagcacgtggtcaggatggcacgggagcactggagaagatgagagtcgctgggaacctgggcgaggggggacaaggggcatttgagtgggcttcaggtacgtgaagtgttgcaagataaagtgggtttcttctggattgttccaaaggagggaggttgctctcaatgaaggaaacattcaatagtgagagttttccgataatgagctcagtcaacaatccccactctccccatactagagaagcaaagtggatttcttctggattgttccaaaggagagaagtttgcacttgatgaaggagacttttttttggggggggggtggggggtggatggagtctgactctgttgcccaggctggagtgcagtggtgcaatctcagctcactgcagcctccacctcccaggttcaagtgattctcctgcctcagcctctcaagtagctgagattacaggcgtgcaccaccatgcccggctaagttttgtatttttagttgagacggggtttcactgtgttggccaggctggtctcgaactcctgacctcaggtgatctgcctgccttggcctcccaaagtgctgggattacaggcgtgagcctccgtgctgggcaatttttgtatttttagtagagtccgggtacatcagactcaggggctgggtcatgcctgtaatctcaacacttttggggggactaagcagatggcttgagcccaggagttcgagactagcctgggcaacatggtgaaaccccatctcttattattattattttttaaaaggtagatcagataaattacaggtccttaatatatattcaacaaattacagaaatatataaaattttaattcagccaagaaacatattaaagttttatcttcagcaaactgttaggagttgggatggaagtagaactcagggtgaagccctcttggggtttgttgtctaatgaaagggaggtaattagacaatcacacataaaaggctgagctccagcctgggtatcttgaggcctcctggacttgctgtagcatctggagaagtatggggcatcatctcgcatcacttagcaccagcactgccacccagccttgatgtgggtcctgttggcctgagcgtttttccttgaagaaggtattaaaagcagattgaagccgcctgtgcccacccatcccctacgcacttcatctgctcgcctctctgccgtgttttccaccaagtacatactacgaatgagcctccattatgtgcgcctccattaactgcacatgcggaataccaggaattgtttgttcgactgctggcagacctttgggctgtccctggtgtttggccactgtggccttcatgcccacatcctcctggtcctcctggtggtggttctgaagggcatctcctctcatctcatggctccaagtgcttgctagtgggtcccctttgccctgagcacctgttgatatcctttgcccatgttcttcttgagttgtttgtgtctgtgttttcttgttgttttgtaggaattctttgcatattctggaaaacccattatgaggtccatgcattgtaaggctctcctctgagcccgcctttttactgtgtttagggtgtcttttgtcgtctagaagttttacatctcttccattattgcttccccatttgaaatattgagaatttcgtctctatcccacaccataaagatattgttctcttgttttgctttgtccctgtaggtctttgatccaattggaattgcttggccagggcttggactaggtcttctgtcttggtggggcgagctcccagggtgtggaaacgtttgcaggtggggcaggagggagagtctggtgggaagcaagcctggggttggccatgttgagtgtttgtgccttttagagactggagtggtcgagtaggcaatccgagggttggggcattacaggggtggctttaccagtgtgctacctcaggatggttgggggtggggcggggaggcaaggctctgagcaggactggaagagctgctgtcatcagaagggccacagtgtggctccttaccatgtgcctggccctatacctctttgctcatggccccatattttcccaccttgttggtagcccttagcccttccccagaggggagctcatttcttccttgggggtccagcatgaccgatgaggaggagagagagagagagcgagaaggcttcaggagcccgtggcttccacccaaatacctgcctggctgtcacaggcgatcactctggttgctgctgatccgaggtgctgaggctgtgcccacgcccatccccctcttgacatcccagcctccgccagcccgcccagcaagcgctcctcagtttccatagcaacactgctgctcggtaatgattccgggtagaaaggcattcgtgcgttctctgtcatctctgtcacctgagcatcccactgcctgcttgctgtcctgccccgggagttcaggaagaaaccctgaggacagctccgagcccttctgcttgtgtgttggcttctcctcaagggcagtggtaaggtggtaaatgttcccagacaaaaagccctgatttggagcatttgccgatttccctggtgtaaatgctgccactatagccgatttcaagccaccactgcgatgtcactgaacttggagttgggggaatgcacacatagtatttccatctcccataccagatgtgaataaccccaaaagcacagatgacagaaaagtgtagtaagataattagacagtgatgtgttccgaggatttattgcctttgttgttaatatcattcagttacctgtacatttctacggttaaaataccaataatcgctgtgtttgacaactggcttccaaatttcccagcttcagttggctctagccactgctgctgagagtgtcgaggccattccatcatgtccctttgtctacagccttcctgaacccacactctgctgccgcccaccctcttccatcctgcctttctaactgtagcctctccaccaagcacagcatgccctgtcctgactgacattcttacggtcttccaacaaataccttcttggctgaaagctgtttcctttatagtatttgatccagaaattccacctcaagaaattttctccaccttgacaaccactggttacacaaagatttaagtatgaaaaatgtataaaatggaccccagaatgtgtctttgccacattctttataataaaaaatcaaagccacccttactgatgtgatgatgaacatgatggtccactggtgtgttggtgtggatggaccttaaggggcctgcagctgcaaaatggcacacatagaaaacagactggaaggaaacaggccgcatggccaggtgcggtggctcatgcctataatcccagcactttgggaggctgaggcaggaggattacttgaggtcaggagtttgagaccatcctggccaacatagtgaaaccccatctctactaaaaatacaaaaattatccaggcgtggtggtgggtgcctgtaatcctagctattggggaggctgaggcaggagaatcacttgaacccaggaggcagaggttgcagtgagccaagattatgccactgcacttcagcctggatgacagagcaagactctgtctaaaaaaaaaaaaacaacagctgggtgtggtggcacacacctgtagtcccagctacttgggaggctgaggcaggagaattgcttgagcccaggaggtggaggttgcagtgagccaagatcgtgccactgcaccccagcctgggcaacagagcaagactccatctcaacaaaaaaaagcccccaaaaaacaaaaaaatgaactgtgtttcttttataatcggacaaaactgattttgacaaaaagctcttttcagaatatgaaaattttggggagaagggagacatagaaaacttcaatgattatctacaaggacatagtcaaatagaaaaaaagtaatgcaggagccgctgctgaggccacaggggttccgaggacaagctgggctctcctcagatagctgtcttcccgaaaagactcgtacagcggtggttctactgtatcgcgggcactaagacaagattttgccgtcagaattgacatctctgtgagaaacccggggtgggaggtgccgccgtgagaatgcaggacagagagttcttctaaacttgctaatattcgcacaactcggaaaagcagagggctccgtgcaggcgcagccacctgcgcccatgcccagggcccttctgccctctcatctggcacaagctcccagcctgctccatccctaggcggactctgggtctcctcgccctgccctctctgtgctgactgggggctttgcttccaactgcaaaccagcctccctgggtcttttcttggccctgttccctttgcctgatggaggccaggtgtcccctgctccagaagccttccccgcctcccaccgaggcgtgcatggccagccgtgtgctcccttagctgtgggtaaggtctgtccccacgctcacctgcggggcatagccatttgggcataatgctagtgtgtagcctccccaggcccagaacagcccttccataagccgctgagcccatgaggagaccctgcacgcctgcctcgagctgcctcctcctagaagtgcttcctgctgacccttgctggccccatggcacgtgccctgaattctggtggagtctgttcagtccttcttggtccttagtcattcgtcccttctctacttgcctcccttccccaaggaggacttgaaggtcgcagcatactgtcccagggtgctgcggaagcagccttcgaccttgtgggcactgcttgccccaccacctgcgctgtgcgtaatgggcttccttctgctacccttcattgtccttccttcacccctacagcatcccgcagagctgcttaggtcctacttccgccttgggccctggcccgcgatggcctcctcctccctgacccctccttctggccaccgggcagcctgtcctggctcatgaccttgactcagtgccacaaccttgctgagcttgctgacatggtttcctcatctgcaataatggcatctccctcaaggttgttgggggttaggattttgtggagacccacatcaggggtctttcccagaatgtagcacatggcacgtgcccaaaaaacagtagtggcatttttttttctttgagacggagtctcgctctgtcgcccaagctggagtacagtggtgcgatctcggctcactgcaagctccgcctcctgggttcatgccattttcctgcctcagcctcccgaggagctgggactacaggcgcccaccaccacgcccggctaattttttgtatttttagtagagatggggtttcactgtgtttagccaggatggtctcgatctcctgacctcgtgatctgcccgcctaggcctcccaaagtgctgggattacaggcgtgagccaccgcacccggcctagtggtggctttataaggaccactttcttggcacctcttttaggctactttgcagttccagggggcttcttgtacatcaaggccttttctcttgggcaagtcagttgtcactgtgaggacacaacactgtatctttaggcatcttcctacttgtcccccaacctgaccctggccctccctagtgagtagacatttgttgagagactcggctcatctgaagagtcaaggtcatcctcttgcttgatgctgaatgagcacaacacagatgctcactgagtgttggctgttatggtccagtcattgccaaggaactcaatgggatcttcatgctagctctggcctcagtgccgccctagaaagaagtgggtccggatggggagaggccaggagagctcaagcagtgtctggaggacgttgtagggcggtatcacagcctccagacccagtgcacagaggctgggtcccccagtccttggtgtgacttggtgatccccagctggccttcagtgggatgaaggctgagcagtggggcttgcctgggaacaggggcaccaaaggtagccagggctgcagacagcagattccttgcttgagtggcttggggtgctggttgtcagcccaggtcctgccagctagggcctctgccttgacctcagaggggaggagcaagcctttgagggttcttacggaggcgtgtctctgccgcaggtgaacgggaaggagctctccaagctgtctcaggagcaaactctgcaggccctgcgctcctccaaggagcccctggtgatccaggtgctgagacgcagcccccgcctccggggggacagctcctgtcacgacctgcagctggtggacagtggcactcagaccgacatcaccttcgagcatatcatggcgctgggcaagctgcgtccgcccaccccgcccatggtcatcctggagccgtacgtcctctctgagctgtgagtcgccctcaggagggccccgggccctgcctccagagaggacaggccacctggagcggccatccgcacgccaccctctcgggcaggaagcaggcccctcggcctccagaactgaccgtggtacccaagggctccaaaacctccaggcctctagccttgggccgggctccagcaggcgccccgttgtatctacccccagggccgagggaggaccctcctgtccgggacgtcgctgccggaagtgccagggttgagggcctcagctcctcctcctccatcctctctcctctgccgcctcacaagcatcactccttgaatcttcttgcatcccttgtctgtctcattcctctacctgctctgaatttcctccatctcttcagcttctttctttggcccgaccggaagaagggcctttcatccaggcctggtggctcatgaccgcgtgagcgctgcctcattctgctaatcttagcccgggctgcggggaggtaggccacagggccatgagcagccaaccttagttttggggccaggagggcagcccctggaggtagggtgggcccccctctgctctgcagaagtcctccagggcctggataactcctgggggcgttgcatgagtggggccagtgctgggcgggcgggtgggcacccggagattggagaagttggtccctgccagctggcgtggttggaggagttctggtctgggggacgggaacgctagaggcatgcgcaggtcctctgcgtggacgctgcacactcaggtgcgagaagtgcccccggtctttgcatggctgcatgttgcccaggaaggggctctgcaggaggcaactgggccacccacccttgagagcacaagcagagcaggcctccgtgccaggcacgctgggatcggcctgcctgggagctggggctgaggtgtgagaggatggccagctggtctgacccccaccttctcctgggcagccccccaatcagccatgagtattatgacccggcggagtttatggagggcggcccgcaggaggcagaccgcttggatgagctggagtatgaggtgagccgggtggccaggccagggcccgcagccagctgcgggagccgccccgacgcctgtgtgccttcctgcccaggcccaaccccgtggccctcctggcacgcatctggctgagtcagggagggtgcgggtgaggttacgtgttccgtccatgtcggtgagtccacgtcccatgcacgtctgtcttctgtgtcctgtgcctgtgtgtgcctcgtgcatttcctgggagggagaccactgagtacgtgcgccacgtgggatggtaagagagaccctcaaagcggggcctggaaactgagctcagggggctccagaggaagctgaggggctgcgggctgaggggttgcgggctgaggggctgggctgtgctgcctgctccctcactcacgcatttctggggctttctacctctgcttcctcccggacccctcgtggcaggaggtggagctgtataaaagcagccaccgggacaagctgggcctgatggtttgctaccgcacggacgacgaggaggacctgggcatttatgtcggagaggtatgcagacgggtatgccccagccccgaggcccatccacatggcctgcctgtggctcagaggctgcccttaaggtcccagctaccagaaacagggcatcacagctagggtgctgcgtggtgaggcgatgatggtcgacggcttcagccactgtccagtgaggtagtcatctgcagaaagaggcctgtgcctgggtgggacagcagatgggcctgagaactagcaacagggttgctgtctagccttctcccgaacccatcttgggcagatgtcttgtgtatccccaggagggggatggcccctcgctcccctccctactagtagcatcccactaaagccacccttccagatggacaatgtcctacttcccaccaatgcccggggctgaccaaaagcacaggcttccgtgcagaagagcctaggagtgcagggcaggggcggggagaggtgactactccacagcctctgcctctgcttcctggggctcagagctggaaggggagccagagagccttcagcttgctttgggggcccctgaggtgagcctgcccccttctaccgaaagggcatgttaggcaccaagtccccaagatgcgtgtgtcctgcaggtaaatcccaacagcattgcagccaaagacggccggatccgtgagggagaccgcatcatccaggtgagcacttgcaggctgcaggcctggcccaaggccccgctgtgcccgtcggcccagccacctctctttagccagtccctagctctctcccactaagagctaaccctgaggcccagcagcctgccgtgtcctaaacccgggctgagtctcatctctctcctgcccactcaccccagtggctcccgtgtgcctatgggatctgctggcatccagggcccctgctgctctgaaacctcctggcccctctccctctgccccactccatgctctcctgagcacacatttgctcttgcaagagtcaggccgccctctccctggtaccttccacttagttacatcctcccagagctcaagccccagcctagcccagccgagcccagagtgcttgggctccctgcacccgcccagggtccgccccagggccagccctagcatgcttgttgattgtatcctgcctgcctcagattaacggtgtagacgtccagaaccgggaagaggcggtggccatcctgagccaggaagagaacaccaacatctccctgctggtggcccgacctgagagtcaggtgtgtatgcctggcagggcgacccggggccacgacatcaggctttctgtcttggaagctgctggccgtgactagggcacagatgtgccaacgacctggagttgatggagggcgggtgggcaggggtctctcagggcccgtttcccctcctggcctctgaaggctgagggggctgggacgctgcccccaggttgctgagcttcaccgaaacaagccaagtgcggggtccagagcagacaagaagggtatatggggaggtccttgaagctgtggggacaccagggcctgtctccacagctggcgaaaaggtggaaggacagcgaccgggatgacttcctggatgactttggctctgagaatgagggggagctgcgtgctcgtaaactgaaatcaccccctgcccagcaggtgaggaaggaaaagggcgctggtggggagggcgaggaggagagaactgggtggaaggcgctgaggctgtgcagggtctcccaatgcttggcagggaaatgaaccaggcctgaagccccttccgatcctcctgtgacatcccgtgacatccctgtccgtgggacctaactgagcggtacttacctttctgctctagcccggaaacgaagaggagaagggggctcccgatgccggcccaggcctgagcaacagccaggagctggacagcggggtgggccggactgacgagagcacccggaacgaagagagctctgagcacgacctgctgggggacgaacccccgagctccaccaacaccccgggaagcctgcgcaagtttggcctgcaaggggacgccctgcagagccgggacttccatttcagcatggactctctgctggccgagggggcggggctgggagggggcgacgtcccgggcctcacggatgaggagtatgagcgctaccgtgagctcctggagatcaagtgccacctggagaacggcaaccagctgggcctcctctttccccgggcctccggaggcaacagcgccctggacgtcaaccgcaacgagagcctgggccacgagatggccatgctggaggaggagctaaggcacctggaattcaagtgccgcaacatactgcgggcgcagaagatgcagcagctgcgtgagcgctgcatgaaggcctggctgctggaggaggagagcctctacgacctggcggccagcgagcccaagaagcacgagctgtccgacatctccgagctgcccgagaagtcggacaaggacagcaccagcgcctacaacactggggagagctgccgcagcaccccgctgcttgtggagcccctgcccgagagccccctgcggcgggccatggccggcaactccaacttgaaccggacccctcccggccccgctgttgccacccccgccaaggcagctcctccaccggggagccccgccaagttccggtccctctcccgggatcctgaggccggccggaggcagcacgcggaggagcgcggccgccgcaaccccaagacggggttgaccctggagcgtgtgggccctgaaagcagcccttacctctcgcggcgccaccgcggccagggccaggagggcgagcactaccacagctgcgtgcagctggccccgacgcgaggcctggaggagctgggccacggccccctgagcttggccggtggccctcgggtgggcggggtggcggccgcggccactgaagcaccgcgcatggagtggaaagtgaaggtgcgcagcgacggaacccgctacgtggccaagcggcccgtgcgagatcggctgctgaaagcccgtgccctgaagatccgggaggagcgcagcggtatgacgaccgacgacgacgcggtgagcgagatgaagatgggccgctactggagcaaggaggagcggaagcagcacctgatccgggcccgtgagcagcggaagcggcgcgagttcatgatgcagagccggctggagtgcctgcgggagcagcagaatggcgacagcaagcccgagctcaacatcattgccctgagccaccgcaaaaccatgaagaagcggaacaagaagatcctggacaactggatcaccatccaggagatgctggcccacggcgcgcgctccgccgatggcaagcgggtctacaaccctcttctctcagtcaccaccgtgtgagctgcccgggcgggtacacggcccaggcccagggaaccccctggggccccggccctcactctcctatagagattgtgtgtgtgtgtgtgtgcgcgcgcgcgtgctcgctgtgcgcacgcacacatctcctcgtctgggtgtgcgcacagggctttgttagcagagagaagcccctgaggagaagggacgcttttcttccttctgcccaagtaaagtgaccatgccagtggccagcactgggggcacacctgtgatgggcaccccttcagctgtgcgtgtgcattccccatcccccatgctcttgcgtgtgcttgcacgtgcacgcacacacacacccagtgctctctccacccgacccgtgtacttgcagacagggaagctgagctgaaaggagcacaagagagtgtccggcttcgctgctgagcgcggcctctccccgccgctgcgcactgcagttatttgtagacaaaggcacccctgatttttgtggtttttctccctttctgtgcttgccaatagttgttttgttttgtggacctgccctgggggctggcagctccttcaggcagcctggcagaagtggaactcccctctccactgatggctgggaagggagttggggaggaagagtgggagggagggctggggatggatgggagggaaggggagggaaaggtgggaggaatgggaagcagctgttctggtggcttccactctgaggtgtgggaacggggagcctctggggggcacctgtttccccagtgactcagagagagcaagactgcaggaacggaggggtcctgcagggtgtccaccaagaagtcacagagcccgttctgcgccccacaccatctggagcaggggcttctcttctgagtgaactgaggaaggtgcttagatggtgagggctctagaaaccaagccccatgagcagcagtggaagacctcgggccatgcggcctggggaggacttggtggcgatccgcaacctggaccccagtgagaggcggtgggctgactgggaaggagaggcccccaacctcctcaggatttgcacgtgtgaactaggctgcctgtggggtgccccttaggcttggagagccccagattggaggcagacagactgcaccaccccttccccccctgcatctcaagaataaagcaagctgcctttgtacttggtt

SEQ ID NO: 163 - DNA, 195 bp, mus musculus
ttcacacaagatggcggctcccagggaggaggcatgagcgccctgccgttaccgcttcttctgccgtacagttgccgcttcggggcctaactctagctctttgaagcggctcctgtgggaaggagtcataaggcgggaagtgaggatcggacaccgccttgagtttggtgtgcagtggaagaactgacctaggag

SEQ ID NO: 164 - DNA, 415 bp, mus musculus
gctcgcggccccagcctcccagctctcagggcacggccggtctgtgccggctgctcccgcggttaggtcccgccccgcgcagcgcgcgcagcctgcggagccagcggccgtgacgcgacaacgattcggctgtgacgcgacaacgattcggctgtgacgcgagcgcggccgctcccgatgcgctcgtgccgcccccgccgtgctcctcggcagccgttgctcggccggttttggtaggcccgggccgccgccaggcctccgcctgagcccgcacccgccatggacaactacgcagatctttcggataccgagctgaccaccttgctgcgccggtacaacatcccgcacgggcctgtagtaggtacgcggcggcgggcgggaccccttccgggccccctcctcgtgctccgcctcg

SEQ ID NO: 165 - DNA, 2070 bp, mus musculus
agtcttctgtccctgttgttgggttctgagtcccagtgtggctgcacacttctgagttaggggtgtttgatgcaagcgctctggagacccaaagagagggacagtccacacatgatctggccacagtcgtgaagtcaagggaggactgaggatctgccccagagaggaggagacccagggagctggcagtccaacgtcctgggggtcctgcagtaatgctgttgggacaaatgaggtgctcggacagggtctgtgagcaggaggtggggctgaatccactcagcttctcatgggatggctgtagctaatggattcgacgtggtaatagaaggctggacaaattttaaaaaatcaataaattatgggctgggcgtggtggctcatgcctgtaatcccagcactttgggaggctgaggcgggtggatacgaggtcaggcgttcaagaccagcctggccaacataatgaaacccgtttctactaaaaatacaaaaaattagcccggcgtggtggtgggcgcctgtaatcccagctactcaggaggctgaggcaggagaattgcttgagcctggaaggcggagcttgcagtgagccgagatcacaccactgcactcgcactccagcccgggcgacagtgcgagactccatctcaaaaaaaaaaatcaataaattatggtttaaaaataaaaaacaggccaggtaggatgactcacactttgggaggagaggcaggcagatcacctgaggccgggagttcgagaccagcttgaccaacatgaagaaacccagcctctactaaaaatacaaaaattagccaggtgtggtggcttgcgcctgtaatcccagctactcaggaggctgagacagaagaatcgcttgaacctgggaggcagaggttgcaatgagctgagatctcgtcactgcactccagcctgggcaacagagcaagactctgtctcaaaaataaaaataaataaaaataaaaataaaaaactgccgggtgcggcggcccatgcctgtaatcctagcactttgggaggctgaggtgggtggactgcctgagctcaggagttcgagaccaacctgggcaacatggtgaaaccccatctctactaaaatacaaaaaaaaaaaaaaattagccgggcgtggcgacctgcgcctgtagtcccagctactcaggaggctgaggcaggagaatagcttgaacccgggaggcggaggttgcagtgagccgagattgtgccactgcactccagtctggcgacagagcgagactcctaaaaaaataataataaataaataaatataaaataaaaataaaaaactggctgcttaatgcatagggggctttctttccgggtcatgaatatgtttcagaactagaggtagtagctgacattgtgactgtatcagatggtataaaatactgtttcttgtattacatatgatacacaatatgtttgtatatattgctgtatatattgtatattttgccatacagtagattatacattgctacatacacatagtatcatgtagtactgtaactatgtcaaattgtatatgtggctgggcggggtggctcacggctgtcatcccaacactttgggaggccgaggcgggtggatcagagtgtgatggcgggcgcctgtggtcccagctactcgggaggctgaggcaggagaatcgcttgagtctgggagatcgaggctgcagtgagccatgatcccatcactgcactccagcctgggtctggctggaccctgtgtcaaacaaaaaacagaaacactagagagacaaaaggcgagcgcaggaggctgccaggaagcgggagccccacggggtgacggccacttcccgccgccccggggctggcctcgctgccgtcaagcggcccgtgcgcgctttgcgacagtcggtcgggctgggcaccggcgcaggttcgctttccggcggttgcaccgggccggggtgccagcgcccgccttcccgtttcctcccgttccgcagcgcgcccacggcctgtgaccccggcgaccgctccccagtgacgagagagcggggccgggcg

SEQ ID NO: 166 - DNA, 2151 bp, mus musculus
agtcttctgtccctgttgttgggttctgagtcccagtgtggctgcacacttctgagttaggggtgtttgatgcaagcgctctggagacccaaagagagggacagtccacacatgatctggccacagtcgtgaagtcaagggaggactgaggatctgccccagagaggaggagacccagggagctggcagtccaacgtcctgggggtcctgcagtaatgctgttgggacaaatgaggtgctcggacagggtctgtgagcaggaggtggggctgaatccactcagcttctcatgggatggctgtagctaatggattcgacgtggtaatagaaggctggacaaattttaaaaaatcaataaattatgggctgggcgtggtggctcatgcctgtaatcccagcactttgggaggctgaggcgggtggatacgaggtcaggcgttcaagaccagcctggccaacataatgaaacccgtttctactaaaaatacaaaaaattagcccggcgtggtggtgggcgcctgtaatcccagctactcaggaggctgaggcaggagaattgcttgagcctggaaggcggagcttgcagtgagccgagatcacaccactgcactcgcactccagcccgggcgacagtgcgagactccatctcaaaaaaaaaaatcaataaattatggtttaaaaataaaaaacaggccaggtaggatgactcacactttgggaggagaggcaggcagatcacctgaggccgggagttcgagaccagcttgaccaacatgaagaaacccagcctctactaaaaatacaaaaattagccaggtgtggtggcttgcgcctgtaatcccagctactcaggaggctgagacagaagaatcgcttgaacctgggaggcagaggttgcaatgagctgagatctcgtcactgcactccagcctgggcaacagagcaagactctgtctcaaaaataaaaataaataaaaataaaaataaaaaactgccgggtgcggcggcccatgcctgtaatcctagcactttgggaggctgaggtgggtggactgcctgagctcaggagttcgagaccaacctgggcaacatggtgaaaccccatctctactaaaatacaaaaaaaaaaaaaaattagccgggcgtggcgacctgcgcctgtagtcccagctactcaggaggctgaggcaggagaatagcttgaacccgggaggcggaggttgcagtgagccgagattgtgccactgcactccagtctggcgacagagcgagactcctaaaaaaataataataaataaataaatataaaataaaaataaaaaactggctgcttaatgcatagggggctttctttccgggtcatgaatatgtttcagaactagaggtagtagctgacattgtgactgtatcagatggtataaaatactgtttcttgtattacatatgatacacaatatgtttgtatatattgctgtatatattgtatattttgccatacagtagattatacattgctacatacacatagtatcatgtagtactgtaactatgtcaaattgtatatgtggctgggcggggtggctcacggctgtcatcccaacactttgggaggccgaggcgggtggatcagagtgtgatggcgggcgcctgtggtcccagctactcgggaggctgaggcaggagaatcgcttgagtctgggagatcgaggctgcagtgagccatgatcccatcactgcactccagcctgggtctggctggaccctgtgtcaaacaaaaaacagaaacactagagagacaaaaggcgagcgcaggaggctgccaggaagcgggagccccacggggtgacggccacttcccgccgccccggggctggcctcgctgccgtcaagcggcccgtgcgcgctttgcgacagtcggtcgggctgggcaccggcgcaggttcgctttccggcggttgcaccgggccggggtgccagcgcccgccttcccgtttcctcccgttccgcagcgcgcccacggcctgtgaccccggcgaccgctccccagtgacgagagagcggggccgggcgctgctccggcctgacctgcgaagggacctcggtccagtcccctgttgcgccgcgccccctgtccgtccgtgcgcgggccag

SEQ ID NO: 167 - DNA, 10295 bp, mus musculus
ggtgacggccacttcccgccgccccggggctggcctcgctgccgtcaagcggcccgtgcgcgctttgcgacagtcggtcgggctgggcaccggcgcaggttcgctttccggcggttgcaccgggccggggtgccagcgcccgccttcccgtttcctcccgttccgcagcgcgcccacggcctgtgaccccggcgaccgctccccagtgacgagagagcggggccgggcgctgctccggcctgacctgcgaagggacctcggtccagtcccctgttgcgccgcgccccctgtccgtccgtgcgcgggccagtcaggggccagtgtctcgagcggtcgaggtcgcagacctagaggcgccccacaggccggcccggggcgctgggagcgccggccgcgggccgggtggggatgcctctgcacgtgaagtggccgttccccgcggtgccgccgctcacctggaccctggccagcagcgtcgtcatgggcttggtgggcacctacagctgcttctggaccagtgagtgggcccaggccgaggcaggcccgcccgggtacccatgcccggccggaggtgggacttagggtgggggacgccgcggccccgacctagcgggcgagcccggagcgcctgacctctccttccccgccagagtacatgaaccacctgaccgtgcacaacagggaggtgctgtacgagctcatcgagaagcgaggcccggccacgcccctcatcaccgtgtccaatcaccagtcctgcatggacgaccctcatctctggggtacccgggccagtgtgctgggcagggggaggaaaggcgaggattcgggacgggcccagcctcgtcagaacaaaccccttctcgctgccttttcatggagccctggcactccggtttccgggcgttctgccccagggctgagacttggatttgtggctcctgcagcatccctgagggagcatgatttggagagggccttgggcatggagcaggaccaaggaacggccacagggcatatcttacagctcctttaacgtcaggcctccagaaccctctgttctctaaaccatccagggccccacagtcttgggaaaaatttgggggttggacataggatatcctgtgaggaagttctgggccagggactggaagcccagtgtcctggcttcaggtttgcccctggctgggcgtgtaccgttcagccctatttgggagcctggttgccacacctagaggttcctgctctgctgacttcacaggaagttgcttggctctggtaaccagatggccgggtggaggggtgcctggggcttccactcctgaacagagagcttaactgtcctagagttcatggggagccacctagccacactggagcccttcagagctcaccctggctgctgggtggagaaaggcctatagatgtcacaggtggatcctgggaggccaggaaggaggacttggagccatccactagcctagactgggctggttgcagtgacagtacagggagaagtatagaagaatgggcattgtccaagtatgttggggaggtaggcagtccaggtgcagtgattagtaagatgtggagggtgggggagagggaggagccagggagaactgaatgatctggcctaagggtctgaaagatgccactttgggctgtagggaaatggtagtgctgctgtccctcattccctgagatggggtgaaggaagggcactccctggggatatgggaagttggggcatgaagcctttcctgtcctctagggatcctgaaactccgccacatctggaacctgaagttgatgcgttggtgaggaggaatgggcccctcgaagtgggccgggccggccccacctgcctctgcccagatttgccctcctcctgctctgcccaggaggtggcgtccagcagtccaggcagggcatggggtggggccccgcaggccctcccctgtgcctcccttctgcatgctgatgctgggggcagggtggtggagcggggtgcagggggcaggactaattgcatctgtccctgcttaggacccctgcagctgcagacatctgcttcaccaaggagctacactcccacttcttcagcttgggcaagtgtgtgcctgtgtgccgaggtgagctgctcctccagcgagtgcagggaggcacttctggggcaggaaagctggtggccagtgtctctgttttggagggacctatgggggtaggcatcccgggagccaacatgaggcccagctccatcacatgccagcagaggggacagaggctgtgggaggagggatgggtccttggaaagtcctcaactctctgcaactgcccagggatcctgtggacctggagccttggcattagaattcaaggaggcattatccataaccccttctctcagggatgtcactaagagactcattgagaacagtgcgttgtcattggtccatggtggcagtagcatgtacctgcaggccagagggttttgcttctaggagaacaaacaggcttgtggggtgagaaccccaggggataggggccattttgatccctattctccagacagggaggatcacagagattaagctgctggcccaaggtcatggggtaggaggtggcaaagccaggatttgaatccagattgctccttcctctgcaggagcagaatttttccaagcagagaatgaggggaaaggtgttctagacacaggcaggcacatgccaggtgctggaaaaagaagagagaaaggtaagccaggcatagcggttcacacttgtcatcccagcactttgtgaggtcgaggtgagaggatcactcaagcccaggagtttgagaccagcctgggcaacatagtaagaccctgtctctttaaaaataaaaatattttaaacaaaagaaaggtagaaaatatgagttgtatgtagaatatgaaggttctagaataatcctattaagaattttggattctggctgggcgcggtggctcacgcctgtaatcccagcactttgggaggctgaggccagcggatcacgaggtcaggagatcgagaccatcctggctaacacggtgaaaccccgtctctactaaaaatacaaaaaattagctgggcatggtagtgggcgcctgtagtcccagctactcgggaggctgaggcaggagaatggcgtgaacccggaaggtggagcttgcagtgagccaagatcacgccactgcactccagcctgggtgacagagtgagactccgtctcaaaaaaaaaaaaaaaaagtgccggccatggtggctcatgcctgtaatcccagcactctgggaggccgaggcgggcggatcacgaggtcaggaattcgagaccagcctaaccaacatggtgaaaccccgtctctactaaaaatacaaaaattagccgggcgtggtggtgtgtgcctgtaatctcagctacttgggagactgagacgggagcattgcttgaacccgggaggtggaggttgtggtgagctgagatcctgccattgcactccagcctgggcaataagagcgaaactccgtctgaaaaaaaaaaaaaaaaaaaagaattttgaattagctggctgcattggtgcatgcctacagtcccagctcctcaggaggctgaggtgggaggatcacttgagccctcgattttctttttccttgagacaatgtctgtttctgttgtccaggctggagtgccgtggcgtgatgatggctcactgcagcttctgtttcctgggttcaagggatcctgtcacctcagcctcctgagcagctgggactaaggagtgtgcccagctaattcttttttttttttggtagagttggggtcttactacattgccagggctggtcttgaactcctagactcaagcgatcctcccgcctcagcctctcaagtgctgggatcacaggcatgagccattgtgcccaacccagcccaggaatttgaggccagcctgagcaatatagtgagaccccaggtatagatagataggtagatagataggtaggtaggtaggtagatagatagatacgtaggtgggtaggtaggtgggtagataggtaggtaggtacgtaggtagatagatagatagatacatacatacatagatagataagatagatagattgattagatagattagatagccaggtggggtggctcacgcctgtaatcccagtgctttgggaggctgaggtgggtggatcacctgaggtcaggagtttgagaccagcctggctaatgtggcgaaaccctgtctactaaaaatacaaaaattagctggatgtggtggcgcacgcctgtaatctcagctactcgggaggctggggtgggagaatcgcttgaacccaggaggtggaggttgcagtgagctgagatcatgccactgcactccagcctgggccacagagggagacctggtctcaaaaaaaaaaaaaaaaaaaaaaaaaagatttttgtatttgactgtgctctctcatccaggtggtgacatgcttgtatctgtggttaagaggtagtatctgccgggcgcggtggctcatgcctgtaatcccagtactttgcgaggccgaggcgggtggttcacctgaggtcaggagtttgagaccagcctgaccaacatggcgaaaccccgtctctactaaaaatataaaaattagccgaggctgggcgcggtggctcacgcctgtaatcccagcactttgggaggccgaggcgggtggatcacgaggtcaggagatcgagaccatcctggctaacaggatgaaaccccgtctctactaaaaacacaaaattagctgggcatggtggcaggtgcctgtagtcccagctactcgggaggctgaggcaggagaatggcacaaacccgggaggcggagcttgaggcaggagaatggcgtgaacccgggaggcagagcttgctatgagcagagatcgcgccactgcactccagcctgggtgacagagcgagactccgtctcaaaaaaaaaaaaaagagagagataccattccagttgcaatgtggctgcagcagggctaggtggacatgaggagcccagttcagggctgtcacagtagctccagcagcagatgattgtggctgggcctcccaagtgtcacgttggagaaccggagaaggggacttctttgggatgtactctggacttgttgatagattaagtgtaggtggggtgaggaagagaactcaaagatgacaccaggtgttggagctgagccacggggagaagggtgcaaagggaaagcagtgcgggggctgggaggggagagggtcagtcctgttttgcttgtgctgcatctgaggagcccctcacctgtggaaggagagcagtcccagaggcagtggggtgtgcagttctggaacttagaagaatgatcagggggctgggtgcagtggctcacgcctgtaatcccagcactttgggaggccgaggcgggcggatcaagaggtcaggagattgagaccatcctggctaacatggtgaaaccccatctctactaaaaatataaaaaattagcagcgcatggtggcaggcacctgtagtcccagctattcaggaggctgaggcaggagagtggcgtgaacccgggagacggagcttgcagtgagctgagattgcgccactgcactccagcctgggcgacagagcgagactccgtctcaaaaaaaaaaaaaacaaaaaattatcaggaataaagatactgggaattcaaccacaaaaaccacaaagtcacgaatgcagagtgagagtcttcagagagagggcagaggcccaggatggcacagagggagagagaagccaccaagatggcagggagccatggccagagagaaaagcaaaccaggcgcctgtggcaccatggaagcagcaggtgatgctggagaagcgtttccatgcagtgacagctgccagagccagattattatggcctgagggctggtggtgctgcagttgggggggaatggagaccgcagcgggggaatggagaccgcaggggcggcaactcctcccagaggttcagtttggaggaaaaagagacagaaggaagggtaaccaaaggatattagaggtcaaggaggggtttattatttctagctggtcaaagtagaatgtggtaaaacccaataaagtaacagcaaataacaaagaggggcttttaatggaaagctgcagtgcctgcccctcacctccctagccccactcctcagaagcagccccctggagcggtttctctttctgctgcttttggaggctacttctgtctctgtaaaggaacttctgtctctgtaaaggaacaagcagaggccacagtgtcttggcaaatgaccgtggcattgtttatcccaacctgctctgagagatggggactctgctgattcacccctcgtccctgcctctttagttccttcagcaaagaactaataatatgtcattaaggcaaaggcagtatttggcacacttggcttctgtgttccaaaaaattccctttttctccaagcgtagattttaatatggtatttaagtatcaaagtgatttgacacaagtgacacaagtgagcagtagtagcatttgcaaaagctacaaatgatgaagtcttgctccaaaagcatattattattattttttaaattccagtttcaagctcaatggataggttgcgtcagtgggttttagtagagaaggggccagtacctatgaagactcccctgtactattacacatgctgcgtcccaagtagggaaactccagtgggtcatcaccccctccctctagcccaagtgggctgctgggtcagggcactgtttgggttgggttgagattcctggatccctaactagcaccttccaaagaatcggccttgcagagaacaaagttcattgccaaaggtattcccaatgtctgtctctcgctctgtgatagggcttctttactccccactttataagatgaggatatctgctataccccattccttcaacctctccacctctttcctcttttgtctgccatgtgattacttttccatcaccaaggttgatgagatccttactgtgtacttactgtctccaagcatccccaggcttccagccagcacgcagcagccaacattggcttcagaaggaaggaggtttgcatttccttctcttgggtccagtgccatggtctcagggttatctccaatgtggaaagttgctagaccaggagcagtttgactccactgtttttcagtctagcaagtttgagtttttcccaagctcttgatgtgtgttcaaatgaatgttctccctttcccaagagacctccctataagggagggtctagtttcccggggtgccctgagaagaaggggtcagcaggggggaggaatggtggaggctgaggcctcaggcaggtgccctgtgaggagtggctgtgacaagcggctgagatcccagcaaagggttgttgcccagaatctggggcctaagcgaggttggaaatcacaaatgcacttggtttctctagcagctggcacatagtaggatcagcccaggagtggcaccttcaaagagaaaggaacgcatgaggctccgagagcggtcggctggcagccagggcctggctggggagggagggcaggtggtgcgctgacctggggatctttgagagtgtgcaggagtatgtggctgaagcggcccagctggtgagccactgaagatgggggtcataggtagatggaggaattgccaggtcagaatctcggtaggagatgacttgagctgatgctgcctggcacataggggtttagaagatattaggaaggaagccccacagcgtgcccaagtgccatgcaggccctggagacggtcattggagggcgtctgtggatggcgcagtgggggatgggaagtccctaatctgctggggctttcccagcaagcagggactgagggggatagtccccaacacatgggccccagggagaagggcctgtttcattgaggtttggagagtgttgagggtaagctaacctgtcaccccacgcccccgagaatggttactgatagggagaggccttttccttgcaggagatggcgtctaccagaaggggatggacttcattttggagaagctcaaccatggggactgggtgcatatcttcccagaaggtcagcagggctgactgggtcgagcccccccagtatgagcgggatgggctcccaagcctcgcctctgtgctctctcaccagggaaagtgaacatgagttccgaattcctgcgtttcaagtggggtaagggctgctggtctctggccacagccatcctcccggcccagagatggccctgtgggcccctggctcccgccccctcgggctggcttgtatgggggtagatgggcgtgtttgtagcgccaggaaggggacaggtgctgagactaggcctgcctctcgcaggggcttgcccaagggagctgaattgaactggaggatgtcgggggtggcagtggccagaggctggcacagaagcttggctcagggcccagcttatgctaacatttctacctcccccctgggcaggaatcgggcgcctgattgctgagtgtcatctcaaccccatcatcctgcccctgtggcatgtcggtgagcctggggacggggacagagagatggcatctggggtggggggcctgggactccctctggtcccaggctgccctgctccaccccacgtctggccttctgtccactgtgctgcaggaatgaatgacgtccttcctaacagtccgccctacttcccccgctttggacaggtgggtggggactgctgaccttcggctgtctgcctgtctgctgtctgctccgtgtctcccactcagcactatggaggccagctgcaggaggagctgagcatgaggctacagcaggggacagagtggaacatagacagggacttcctggcaccgagacattaaaatgagagcagaggaagtcaggctggggcagaggtgggctgtggggtcaggacaggacaggtcatctacagcacaggacccaggaccaggaccttgttttagaggaagagtggcccctggggagtgtgtggcacagcagggccggggcttagcttctggctcccgggttgcttgggctggggctgtgggcactcctactgctcctcatcactcttggcggccaccccacagaaaatcactgtgctgatcgggaagcccttcagtgccctgcctgtactcgagcggctccgggcggagaacaagtcggctgtgagtttcctcctgggtcccccgtagctgtccccggaccccctgctgctggcttccagcagggtgcctccaccctctccatcccgtcaccctcccagggcaccctcccagggcaccttggccaagcttcccgaggggtgcaggccatccctggtcctttccctcaggtggagatgcggaaagccctgacggacttcattcaagaggaattccagcatctgaagactcaggcagagcagctccacaaccacctccagcctgggagataggccttgcttgctgccttctggattcttggcccgcacagagctggggctgagggatggactgatgcttttagctcaaacgtggcttttagacagatttgttcatagaccctctcaagtgccctctccgagctggtaggcattccagctcctccgtgcttcctcagttacacaaaggacctcagctgcttctcccacttggccaagcagggaggaagaagcttaggcagggctctctttccttcttgccttcagatgttctctcccaggggctggcttcaggagggagcatagaaggcaggtgagcaaccagttggctaggggagcagggggcccaccagagctgtggagaggggaccctaagactcctcggcctggctcctacccaccgcccttgccgaaccaggagctgctcactacctcctcagggatggccgttggccacgtcttccttctgcctgagcttccccccgaccacaggccctttcctcaggcaaggtctggcctcaggtgggccgcaggcgggaaaagcagcccttggccagaagtcaagcccagccacgtggagcctagagtgagggcctgaggtctggctgcttgcccccatgctggcgccaacaacttctccatcctttctgcctctcaacatcacttgaatcctagggcctgggttttcatgtttttgaaacagaaccataaagcatatgtgttggcttgttgtaaaatg

SEQ ID NO: 168 - DNA, 3675 bp, mus musculus
gcggggcggggcggggcgcggcgggtggggcggggcgcgcgcggctcccgcgcacggattcttcctgggccgcagcaccggccgccggcccgccccgcccgccccgccccgcgcctctctagactctcggcgagcagcgtcgcccgcggagccgcgctggtgctgtggcccgggccctggcagccctcccgggaggcgagccggggaggcggtggcccctgccggttgcggcggggcgcgggaagaggcgggactctttgacgcggcggaggggtcgggcgacggccgacgcgccgccatctttggtccagtgcggtggcggcggcggcggtggcggcggcgactgctgcggtgaaggaggaggaggagccgagcgggcgctggcaccgaggcctgaccatggacgaggaatacgatgtgatcgtgctggggaccggtctcaccgtaagtgcggccccggcgcccctggccctgcgtcgtgccctcgccatcccccgcgatgatgcggccgccggcccatcctctggtcactgccatcttctgcgctccgctccccgaaaagccggcgccgtgcccaccccgctgctcccccagcgacgtcgcctctgctcgttgccatgaccccatctccccgaagaggcccccttcctggccgcctcctgggctacccgggtccgacccccggcgccctcccatcttccctacccctgcccgctggaccggaaaacgcacccccactcggcccgatgcccacgaccccgcccacccatcgcccccacccatcacggcatccacccgtcgcccgcacccattgcccgcctagcgttgcctctcagcgtcccttcccatcttgcgctaatcccggtggggatgaagtagaaggacctggggtcagggggcctcgccagagtgggccctcagcccgcctcctcatcgtcttctggggccaggggatccagggaatgttccagaaggaacagcagtgggggcagtaagcacattcccgcaaccccacctcggttgcccatggagacctcaggctgggtagcatctgcagcctttgtccttgggctagtgacagtgactggtgagggtgtttatcttccccctttccccgaaaaccccgttggcctactcccctcagagactcttcttcctcggtccaggcccagatgcccctcctcagcggcaggggctcctgctatttgaagaaagagcagtccagggtggggcctacaatttcaaggactgtgctaagcctttcttttcctccctttcgagtgtcctttgcagtccagctgggtcttctctgtgccttattgtgttttatccgcctttttgtgcggctctgcgtaggtagatgcctctcggcgtgttggtactggaaggccatcctgtgtctgctggatgccctgcctccctcaaagcctccgttatttcactctccgccttgtgagggggacgggactcctttgcccagcaaggttgcaatggagagtgtggtcggatgaagccatcaccccaattttaggcgaggcaactagccagtggggatggtgggtggaaggagctgtccactgaggcaggtttgggtggggaacaaatcaggtctgctggtaggagcggaggcaggtgggagtgcagcggatggtgtcaccctcccccaggaatgcatcctgtcgggcatcatgtctgtgaacgggaagaaggtgctgcacatggaccggaacccctactacgggggcgagagctcctccatcacacccctggaggaggtgaggctgcccaggcccaagcctatccctgttaacctcccacatagcggcacagggtggaagtagctccccaggtgcctggagcaggaggaggtggtccctgaggtgtctctctctctcccttctgcttacagctgtataagcgttttcagttgctggaggggccccctgagtcgatgggccgaggccgagactggaatgttgacctgattcccaaattcctcatggctaacggtgagggacaggaaggaggtattgcaggtcgggggtgatagggaagacccgaggacggtcaggctccagaggaggcacggccagaccagctagagcctctggagagagccgtgctgatgttgcccttgtgcacccccacagggcagctggtaaagatgctactgtatacagaggtgactcgctacctggacttcaaggtggtggagggcagctttgtctacaaggggggcaagatctacaaagtgccgtccactgagactgaggccttggcttccagtgagtgtgggccccctgagccagagaaatcatggggtggcagggaagccaactgtctttgggatgggtggctgtccagaataaggcacccccttgtccaaagtcacatttcccgtgaaggaccagagaggcccttcactctgtattccctctgccccatgtcatgctgcacggctggctgccaggagggaggtcctcacacagcagggatgtgatgtggaggggaacggggctccttttgaaagacttgagcctggccaggtgcggtggctcacgcctgtaatcccagcactttgggaggcctaggcgggtggatcacgaggtcaggagttcaagaccagcctggccaacatggtgaaacaccgtctcatctcaaaatacgaaaaattagctgggtgtggtggcatgcacctgtaatcccagctactcgggaggctgaggcaagagaatggtttgcgcccgggaggcggaggttgtggtgagccgagatcacaccactgcactccagcctgggcgatagagggagactccatctcaaaaaaaaaaaacaaaaacttgagcctttggcagggcctccactgaatccccgagacatcgccaagtgtctgagccaggaaggcccttagagcccatccaggccaatcccctcttcatccaggtggggaaactgaggctaaaaagggtgaagaggttaacctaagatcacaggacagctgggctgtgagtgggggtgcctgccctgctgggatggagagttttgtgctgcattgatgcagaacctcctcccgccgcgttccttagatctgatgggcatgtttgagaaacggcgcttccgcaagttcctggtgtttgtggcaaacttcgatgagaatgaccccaagacctttgagggcgttgacccccagactaccagcatgcgtgacgtctaccggaagtttgatctgggccaggatgtcatcgatttcactggccatgccctggcgctctaccgcactgatgagtgaggggaagctgggtggtggcagccccctcgcccggcccgcccccacccttcccacacctgcctgctgtccccctgccccgcatgtctcttgtactcagccacaggctcacctatcaccctttccatttcccccttgcatttgatcctcatcttccccaggccattcagggtggtgggaagactggcctggtacctgggtgggggtaaatcaggggtgctgctattcccccagctacctggaccagccctgccttgagaccgtcaaccgcatcaagttgtacagtgagtccctggcccggtatggcaagagcccatatttatacccgctctacggcttgggcgagctgccccagggttttgcaaggtgaggacatgggttttttcagt

SEQ ID NO: 169 - DNA, 6612 bp, mus musculus
gcggggcggggcggggcgcggcgggtggggcggggcgcgcgcggctcccgcgcacggattcttcctgggccgcagcaccggccgccggcccgccccgcccgccccgccccgcgcctctctagactctcggcgagcagcgtcgcccgcggagccgcgctggtgctgtggcccgggccctggcagccctcccgggaggcgagccggggaggcggtggcccctgccggttgcggcggggcgcgggaagaggcgggactctttgacgcggcggaggggtcgggcgacggccgacgcgccgccatctttggtccagtgcggtggcggcggcggcggtggcggcggcgactgctgcggtgaaggaggaggaggagccgagcgggcgctggcaccgaggcctgaccatggacgaggaatacgatgtgatcgtgctggggaccggtctcaccgtaagtgcggccccggcgcccctggccctgcgtcgtgccctcgccatcccccgcgatgatgcggccgccggcccatcctctggtcactgccatcttctgcgctccgctccccgaaaagccggcgccgtgcccaccccgctgctcccccagcgacgtcgcctctgctcgttgccatgaccccatctccccgaagaggcccccttcctggccgcctcctgggctacccgggtccgacccccggcgccctcccatcttccctacccctgcccgctggaccggaaaacgcacccccactcggcccgatgcccacgaccccgcccacccatcgcccccacccatcacggcatccacccgtcgcccgcacccattgcccgcctagcgttgcctctcagcgtcccttcccatcttgcgctaatcccggtggggatgaagtagaaggacctggggtcagggggcctcgccagagtgggccctcagcccgcctcctcatcgtcttctggggccaggggatccagggaatgttccagaaggaacagcagtgggggcagtaagcacattcccgcaaccccacctcggttgcccatggagacctcaggctgggtagcatctgcagcctttgtccttgggctagtgacagtgactggtgagggtgtttatcttccccctttccccgaaaaccccgttggcctactcccctcagagactcttcttcctcggtccaggcccagatgcccctcctcagcggcaggggctcctgctatttgaagaaagagcagtccagggtggggcctacaatttcaaggactgtgctaagcctttcttttcctccctttcgagtgtcctttgcagtccagctgggtcttctctgtgccttattgtgttttatccgcctttttgtgcggctctgcgtaggtagatgcctctcggcgtgttggtactggaaggccatcctgtgtctgctggatgccctgcctccctcaaagcctccgttatttcactctccgccttgtgagggggacgggactcctttgcccagcaaggttgcaatggagagtgtggtcggatgaagccatcaccccaattttaggcgaggcaactagccagtggggatggtgggtggaaggagctgtccactgaggcaggtttgggtggggaacaaatcaggtctgctggtaggagcggaggcaggtgggagtgcagcggatggtgtcaccctcccccaggaatgcatcctgtcgggcatcatgtctgtgaacgggaagaaggtgctgcacatggaccggaacccctactacgggggcgagagctcctccatcacacccctggaggaggtgaggctgcccaggcccaagcctatccctgttaacctcccacatagcggcacagggtggaagtagctccccaggtgcctggagcaggaggaggtggtccctgaggtgtctctctctctcccttctgcttacagctgtataagcgttttcagttgctggaggggccccctgagtcgatgggccgaggccgagactggaatgttgacctgattcccaaattcctcatggctaacggtgagggacaggaaggaggtattgcaggtcgggggtgatagggaagacccgaggacggtcaggctccagaggaggcacggccagaccagctagagcctctggagagagccgtgctgatgttgcccttgtgcacccccacagggcagctggtaaagatgctactgtatacagaggtgactcgctacctggacttcaaggtggtggagggcagctttgtctacaaggggggcaagatctacaaagtgccgtccactgagactgaggccttggcttccagtgagtgtgggccccctgagccagagaaatcatggggtggcagggaagccaactgtctttgggatgggtggctgtccagaataaggcacccccttgtccaaagtcacatttcccgtgaaggaccagagaggcccttcactctgtattccctctgccccatgtcatgctgcacggctggctgccaggagggaggtcctcacacagcagggatgtgatgtggaggggaacggggctccttttgaaagacttgagcctggccaggtgcggtggctcacgcctgtaatcccagcactttgggaggcctaggcgggtggatcacgaggtcaggagttcaagaccagcctggccaacatggtgaaacaccgtctcatctcaaaatacgaaaaattagctgggtgtggtggcatgcacctgtaatcccagctactcgggaggctgaggcaagagaatggtttgcgcccgggaggcggaggttgtggtgagccgagatcacaccactgcactccagcctgggcgatagagggagactccatctcaaaaaaaaaaaacaaaaacttgagcctttggcagggcctccactgaatccccgagacatcgccaagtgtctgagccaggaaggcccttagagcccatccaggccaatcccctcttcatccaggtggggaaactgaggctaaaaagggtgaagaggttaacctaagatcacaggacagctgggctgtgagtgggggtgcctgccctgctgggatggagagttttgtgctgcattgatgcagaacctcctcccgccgcgttccttagatctgatgggcatgtttgagaaacggcgcttccgcaagttcctggtgtttgtggcaaacttcgatgagaatgaccccaagacctttgagggcgttgacccccagactaccagcatgcgtgacgtctaccggaagtttgatctgggccaggatgtcatcgatttcactggccatgccctggcgctctaccgcactgatgagtgaggggaagctgggtggtggcagccccctcgcccggcccgcccccacccttcccacacctgcctgctgtccccctgccccgcatgtctcttgtactcagccacaggctcacctatcaccctttccatttcccccttgcatttgatcctcatcttccccaggccattcagggtggtgggaagactggcctggtacctgggtgggggtaaatcaggggtgctgctattcccccagctacctggaccagccctgccttgagaccgtcaaccgcatcaagttgtacagtgagtccctggcccggtatggcaagagcccatatttatacccgctctacggcttgggcgagctgccccagggttttgcaaggtgaggacatgggttttttcagttggcatagctgagtaggactagggccaggagtggagatggccgccttgagcattttcttggtagtatttcctcctttccaattcgtgctcttcatttacttcactccatccttgggtgatgagggcacaaccccagtgcactgaagtacagaagtctccacacttgaaaaaacgagtctccacaaatgtgacttgctcagttcccggcagcaccaggactgggcccagggtcccagaaccttgagtcagggcttagctgggagctgacctatctccagagagtccattctggtccctcaggctgtcttggtgcggagcactgatccctcatgccccctcccgctggcccttggcagtgtattctgagcagaagctccagagaggaaagagcccgcggagatggggccagcgttcacggcagtgacagagctgggatgaatcccggcgtctcctacctgctgcctgcctggggcagccttctttgcactttggtggaggaagggtgcagtggaattggtccccgtttctcctgggaggggccttcaccggagctgctctcaccacagattgagtgccatctatggggggacatatatgctgaacaaacctgtggatgacatcatcatggagaacggcaaggtggtgggcgtgaagtctgagggagaggtgagcccttcccgtgcatgcagtgcagtcccatggttgaggcggggcttggtcactttctctgtgctgtcgagtctcctgctgcacagccccaagggtcttggagctgggaactgggggtccagaagtcttcagagtcatgactgtgggtgagaggtctctttcagaggccacatgccatgtctgtggtgcagaaagtgttcttgatcacagtgcctctggggggcgggggggcgggcacccagcccgtgcgtcaaggcccacctatctgagcggcagggtagggccatgcattcaggaggggcagtagtgatggctccgaggaacgtcttgtctgccagagctgcctgcccttgctgtgagcgcagccccacgtctacctaagggagggatgtgacaggggcgaggacttctggtgccttctcaggtggcccgctgcaagcagctgatctgtgaccccagctacatcccggaccgtgtgcggaaggctggccaggttatccgcatcatctgtatccttagccaccccatcaagaacaccaacgacgccaactcctgccaaataatcatcccccagaaccaggtcaacaggaagtcaggtaggccgggcgctggtacagcttcctctagggtgttctctttggggttactctttttctccccatcagtgtgggagctccctgccttacctctctggaaaaaaatttgagccacattgtagccaccacaacttggagccctagggtttgggtggcctggactctttccctctgggagggtggcggcttggatgctacctgctctgcggggctggggaggggcagtcgggccagacttgtgtccagccactggaacccctctctgcgtatggccagcgcctctggcctgagttgacggagctcttcctgtggccagacatctacgtgtgcatgatctcctatgcacacaacgtggcggcccagggcaagtacatagctattgccagcactactgtggagaccacggaccctgaaaaggaggtggagccggctctggagctgttggagcccattgaccagaagtgagggactgggctgagcccaagggggagagggagggagcccagcagctgggcttagggaccaggaagggcatggcccattgtgaggcctgtcccctcccctctgtctgcccctcaggtttgtggctatcagtgacttgtatgagcccattgatgatggttgtgagagccaggtaagcagctcgtcccagccctgggctcctggctgcccgcccaggatacctgtctgactcaccctgggcgctgggctctggctgtttccaggtgttctgttcctgctcctacgatgccaccacacactttgagacaacctgcaacgacatcaaagacatctacaaacgcatggctggcacggcctttgactttgagaacatgaagcgcaaacagaacgacgtctttggagaagctgagcagtgattgtggccgcccccagcccctgctgccccagcctgtgtctgttctcctcgagggctccagcatcctctgcttcccccaccacgttcccatcacccacctcattgatccactgaccaaatccttaaccctagcgatggcttgggagatggggggttggatagcatcctctttcttggcccttccttatcctaggaaaagagggttcctctccttgtgtgtgtctcttccccccacccctaattcttctgctctgtttgggaagacgtggaggaaaaggtgacttctgcccccaccgctcttacccccactgtagtggcctttggagatgcccccacctcccccccaccaactctcgcgtgttggagagaaggggccctcccagcacaaagttgcattcctcccccctaatttattctaatttattaactttgacccaccctttctgagcctgcagccttcccgtgtggcctgagggctgtcgagtgagctgccccagcccctcccagcccttgcccagcctgggggagtggggaaggcttgggcatggccccgttggaggttgatttgctgttttgtttcttgtctttgtgttctgtggtacttgctgagagaaaagaaaagtgagccaagcagaaggaggtgggaaaacggacccaaaccccagtgtgccctgccccatgcctttcctttagtggtgggaaacccttatcttgcaaagtgaatgtgtccccttccccaccctctagtgtatttcacagaaaacaaaacctcccaataaaacggttgaaacctga

SEQ ID NO: 170 - DNA, 3634 bp, mus musculus
ggctcccgcgcacggattcttcctgggccgcagcaccggccgccggcccgccccgcccgccccgccccgcgcctctctagactctcggcgagcagcgtcgcccgcggagccgcgctggtgctgtggcccgggccctggcagccctcccgggaggcgagccggggaggcggtggcccctgccggttgcggcggggcgcgggaagaggcgggactctttgacgcggcggaggggtcgggcgacggccgacgcgccgccatctttggtccagtgcggtggcggcggcggcggtggcggcggcgactgctgcggtgaaggaggaggaggagccgagcgggcgctggcaccgaggcctgaccatggacgaggaatacgatgtgatcgtgctggggaccggtctcaccgtaagtgcggccccggcgcccctggccctgcgtcgtgccctcgccatcccccgcgatgatgcggccgccggcccatcctctggtcactgccatcttctgcgctccgctccccgaaaagccggcgccgtgcccaccccgctgctcccccagcgacgtcgcctctgctcgttgccatgaccccatctccccgaagaggcccccttcctggccgcctcctgggctacccgggtccgacccccggcgccctcccatcttccctacccctgcccgctggaccggaaaacgcacccccactcggcccgatgcccacgaccccgcccacccatcgcccccacccatcacggcatccacccgtcgcccgcacccattgcccgcctagcgttgcctctcagcgtcccttcccatcttgcgctaatcccggtggggatgaagtagaaggacctggggtcagggggcctcgccagagtgggccctcagcccgcctcctcatcgtcttctggggccaggggatccagggaatgttccagaaggaacagcagtgggggcagtaagcacattcccgcaaccccacctcggttgcccatggagacctcaggctgggtagcatctgcagcctttgtccttgggctagtgacagtgactggtgagggtgtttatcttccccctttccccgaaaaccccgttggcctactcccctcagagactcttcttcctcggtccaggcccagatgcccctcctcagcggcaggggctcctgctatttgaagaaagagcagtccagggtggggcctacaatttcaaggactgtgctaagcctttcttttcctccctttcgagtgtcctttgcagtccagctgggtcttctctgtgccttattgtgttttatccgcctttttgtgcggctctgcgtaggtagatgcctctcggcgtgttggtactggaaggccatcctgtgtctgctggatgccctgcctccctcaaagcctccgttatttcactctccgccttgtgagggggacgggactcctttgcccagcaaggttgcaatggagagtgtggtcggatgaagccatcaccccaattttaggcgaggcaactagccagtggggatggtgggtggaaggagctgtccactgaggcaggtttgggtggggaacaaatcaggtctgctggtaggagcggaggcaggtgggagtgcagcggatggtgtcaccctcccccaggaatgcatcctgtcgggcatcatgtctgtgaacgggaagaaggtgctgcacatggaccggaacccctactacgggggcgagagctcctccatcacacccctggaggaggtgaggctgcccaggcccaagcctatccctgttaacctcccacatagcggcacagggtggaagtagctccccaggtgcctggagcaggaggaggtggtccctgaggtgtctctctctctcccttctgcttacagctgtataagcgttttcagttgctggaggggccccctgagtcgatgggccgaggccgagactggaatgttgacctgattcccaaattcctcatggctaacggtgagggacaggaaggaggtattgcaggtcgggggtgatagggaagacccgaggacggtcaggctccagaggaggcacggccagaccagctagagcctctggagagagccgtgctgatgttgcccttgtgcacccccacagggcagctggtaaagatgctactgtatacagaggtgactcgctacctggacttcaaggtggtggagggcagctttgtctacaaggggggcaagatctacaaagtgccgtccactgagactgaggccttggcttccagtgagtgtgggccccctgagccagagaaatcatggggtggcagggaagccaactgtctttgggatgggtggctgtccagaataaggcacccccttgtccaaagtcacatttcccgtgaaggaccagagaggcccttcactctgtattccctctgccccatgtcatgctgcacggctggctgccaggagggaggtcctcacacagcagggatgtgatgtggaggggaacggggctccttttgaaagacttgagcctggccaggtgcggtggctcacgcctgtaatcccagcactttgggaggcctaggcgggtggatcacgaggtcaggagttcaagaccagcctggccaacatggtgaaacaccgtctcatctcaaaatacgaaaaattagctgggtgtggtggcatgcacctgtaatcccagctactcgggaggctgaggcaagagaatggtttgcgcccgggaggcggaggttgtggtgagccgagatcacaccactgcactccagcctgggcgatagagggagactccatctcaaaaaaaaaaaacaaaaacttgagcctttggcagggcctccactgaatccccgagacatcgccaagtgtctgagccaggaaggcccttagagcccatccaggccaatcccctcttcatccaggtggggaaactgaggctaaaaagggtgaagaggttaacctaagatcacaggacagctgggctgtgagtgggggtgcctgccctgctgggatggagagttttgtgctgcattgatgcagaacctcctcccgccgcgttccttagatctgatgggcatgtttgagaaacggcgcttccgcaagttcctggtgtttgtggcaaacttcgatgagaatgaccccaagacctttgagggcgttgacccccagactaccagcatgcgtgacgtctaccggaagtttgatctgggccaggatgtcatcgatttcactggccatgccctggcgctctaccgcactgatgagtgaggggaagctgggtggtggcagccccctcgcccggcccgcccccacccttcccacacctgcctgctgtccccctgccccgcatgtctcttgtactcagccacaggctcacctatcaccctttccatttcccccttgcatttgatcctcatcttccccaggccattcagggtggtgggaagactggcctggtacctgggtgggggtaaatcaggggtgctgctattcccccagctacctggaccagccctgccttgagaccgtcaaccgcatcaagttgtacagtgagtccctggcccggtatggcaagagcccatatttatacccgctctacggcttgggcgagctgccccagggttttgcaaggtgaggacatgggttttttcagtt

SEQ ID NO: 171 - DNA, 15586 bp, mus musculus
ccggcggcccccgggccagcccagtgtgtgggcggcggcggcggcggctgcgcgcttggggcccggggcgcggggcgaggccgtggggacgtgcgagcggggccgcggtggggctcgggggcgcgtccacgtggccagagggcggccacccggagccagcggagggacaggtaggtggccgtcatcgtcgccgtccgtgcggggccaaacagctcggggcccggggctccggcagcccgggggtccggctcggcctgtgggggtcaggccctatccctgcccgtcggcgccggcctgcccgactccttgtgccccgcatggtggggacgccaacccaagaccaacaccctgcccaaagaggaccctttgtcgcaggggagcggcccctcggaggatcaacgctgtacttccctcccgctaagggctccgcgagtccgccgaggggtgccctgatggggcccgggcaaaccggaccagcagcacggtggggggtgtggggggcggccgctggacccccgtctctgcgtggggctgccccttcctcaggctctctgctggcccagctgtacctgtgatgcccgaggttgccacttacaggtgggggctgggcctgaaactgcctccccaggtctccctcccgacctgtccccagcctgttcctaggcttgtgttcccggggtgtagaggaggtgaagacaggatgtggcctctcttttctttggccttcctttcttctccggctgttgcatgaggggtccagctgacaaaagagccctggagaggtgatcaatctgagctgaaactttgcagtttcaagctgggcccgctgcttgttcctggcaaatgccttatttttcctttctctctcctgtgcctccttggtttggttccctgcaccaccccccgctccccccccgcctcccgccctcaagctgggtacctcctatctcccccgggagctctggcactgagagggtagcgctgagccctgccctgttggctgccacgacactgctctgctgtcttagcagcctggggctgactgggtgtggcctggggactaagtgccagtcccagcactgtccctgtggctcctgccctgtctctccaaggccttgactgtatttggggacattgctcctcctcttgtaaggctcctgggactccaaagggcaggtagggccccctgtacattcccttctccagtgaacccctgggtctggagggggagccatgcaggctgtggctgagcagagcttgactgatgtgtgtctgggtgcgtggctgaggggcaggcgcgacttggctttgtgttgcatcggggaggccagacagcgggctcctggatggccagctgaggcccttgtcggggaggcagctggggcccctgcaggggacatggtggtgctggatcctgcatcaggcctccattccccagacctctgtcccagggctcctggtggcagtgccactccaggtggtgttcctggccctgcccctctcccccagcttgcgattattctgtgcctgcctccctctcccctcagctcaggcgttgggggcagcccagaggcctggggcttgctgttctttgctgttggttgccccgggctctgagatgtggcatctggggtcccagttccagcatctgctctgctacccccttgggtgtggcccagctgaggcgaggcctcctggctcctttccagcatgggggctgagggacgattgatggcccccaagcctgccctcgctggctgctcactcatgcgccctggcggaggcccctcctctctccctgtcacggtggccatctggggctttggcggggtggtgggtgaatggcccagccctctgtggctcgaggcctctgactcccacacaccgtctctccctaggcctgtccccaggcgcggctgccggccatgccctctgtctgcctcctcctgctgctcttccttgccgtggggggggccctgggcaacaggcccttccgtgccttcgtggtgacagacaccacgcttacccacctggctgtgcaccgggtgactggggaggtgttcgtgggcgcagtgaaccgagtctttaagctggcccccaacctgactgagctgcgggcccatgtcacggggcccgtcgaggacaacgctcgctgctacccgccccccagcatgcgcgtgtgtgcccaccgcctggcccccgtggacaacatcaacaagctgctgctcatagactatgcggcccgccgcctggtggcctgcggcagcatctggcagggcatctgccagttcctgcgtctggacgacctcttcaagctgggtgagccgcaccaccgcaaggagcactacctgtcgggggcccaggagcccgactccatggctggtgtcattgtggagcagggccaggggcccagcaagctgtttgtgggcactgctgtcgacggcaagtcggagtacttccccaccttgagctcccgcaagctcatcagtgatgaagacagcgcggacatgttcagtctcgtgcgtgagccttccttctcttcttcctccacccagtcctggctctgcctcccagaagagccctgttctttctgagaggggactttcggctcctcagtgtctgggatgcagacaggttgcggagggtgggatgacagcctgaacccaggttgcgggggtcccctgtgtgcagggaggctggtcaccctgccctctgcagcctttctggcctgggcctctgtgatcatccaggcgggagggggatgcagagggaagctggcggtggcccgtgatgttggcacagggcctcaccggatgctgtctcctccccctgctccccaggtgtaccaggatgagtttgtgtcctcccagatcaagatcccctcagacacgctgtccttgtaccctgcctttgacatctactacatctacggcttcgtcagcgcctccttcgtgtacttcctgacgctgcagctggacacccagcagacgctgttggacacagcgggcgagaaatttttcacgtccaagatcgtgcgcatgtgcgcgggagactcagagttctactcatacgtggaattccccatcggctgctcctggcgcggcgtggagtaccgcttggtgcagagcgcccacctggccaagcctggcctgctgctggcccaggccctgggcgtgccggctgatgaggacgtcctcttcaccatcttctctcagggccagaagaaccgggccagcccaccccggcagaccatcctctgcctcttcaccctcagcaacatcaatgcccacatccggcgccgcatccagtcctgctatcgtggggagggcactctggctctgccctggctgctgaacaaggagctgccctgcatcaacaccgtgagcccctcatcaccccacactggtcctctgccctgtcccaggtctaccatgcccagcgtgggctcacggccagtcatcctgtcccaggctttgccatggccctgggagtggcacctttgccctcccacctgtttctccctcccaggggtccctgccctctccttgcctctctctgggctgcccagtgccccacttctgcttccttccgttcccagctcgttcctccttgctccgtctcccggttgccccttgtcttgagccaacaagagtcttgtgggcccaggcttcgctcctcgctccctgctgtccctcctctgtctccctccgcagccaccaatttcctggagcaccctagggcgagcagtcagtcctggctggaggggaccgggttctagatcccgctctcttctgggactcaggaactgccggcctccatcttgcgcctgggagctttgactctcacgggttcctcctctgtttcaccagcccatgcagatcaacggcaacttctgtgggctggtgttgaaccagcctctgggaggcctgcatgtgatcgaggggctgcccctgctggccgacagcaccgacggcatggccagcgtggccgcctacacctaccgccagcactctgtggtcttcattggcacgcgcagcggcagcttgaagaaggtggcccccagagccctgggcatgtgggggtggggacagtctcagatatgggacaaggctggtggtgggaacacacgggagagctctgaggacaggacaggagaggacacggctggtgcagggagggagatttccctggctgggtcccaggcgcctggccctgctcctcgggtcgccccttggccgcccaccctcaccattgccagttcccactgtggactgaattgccagcttcgtatggctctggggacagagaacagacctattgtggagtctccctgccacgagagcaggcctggggctgagccagcattgctgggtcctctgttgaatgaacaagggagcaaatgccttgcccctcaagcctccctatgcctgggacagacccacttgcccctgccctctccttggctcactacttcccatccttcccctcctacccatgggcccgggggctgaagctgcttccattggggatctgggggtagcttggcatgaagggggagatgaacttctgggcactcaggtacgtgttgaataggtaggagtcgggggactgcagtgctctcatcctgcttgcctcgtagatgcagtgccatcccccaggagggcaagtgttggtctgggggcgcagggaagggtttgtggagaaggatgatgaactctcctggcccacctgctctgttcctgggaccctcttttcctttgtagcagctttgttgaacgcgtactatccaattcacccattttaaagtgcacagttcagtgggtttctgtggatctgcagagtggcacaaccatcgccactacctcattctcctaatcaatgccatcttctagctcttcccctcccctgcatcccctgaccttgggcaacacgaatcactccgtccttctgtttgctgagggcattttctggcgtctgcaccctcctttttttggcctccgggctgtgggtgtgagtgctgaaccccaccaggtcctgacgtcagctcagccacaacctccaaagtctttggctggagaagacagtgtcccaggtgcaggaggctgtggtggcatcaggctggtcttgtggctcaggtgcgggtcgatggcttccaggatgcccacctgtatgagacagtccccgtggtggatggcagccccatcctccgagacctgctcttcagcccggaccaccggcacatctatctcctgagtgagaagcaggtgggcctgtggtgggtggcggtggctggtggggcgggggtgggctgggtgctgatgtggctgtccccaggtgagccagctcccggtggagacctgtgagcagtaccagagctgcgcagcctgcctgggctccggggacccgcactgtggttggtgtgtgctgcgacacaggtgagggcgggggcccctgctcggggagttggagggccccactggccagggggagccagccacacccagccgtgcccttgcggcctccccccgccctcctccactttctccagctaatgagtggaacctccaccccgagtgacgtccctcgggccccaggggacgcggccaaggctcgctgttgcctggcactgtgagctggacaggcctgggccctcccggggcagtggcgggaccggctctggcccgaccccgtgcaggtgctgccgcgaaggggcctgtctgggcgcctctgccccacacggctttgctgaggagctgagcaagtgtgtccaggtgcgggtccggcccaacaatgtgtcagtgacgtcacctggggtgcaggtgagcagcttgggggtgcccggctgggtgtgcacatgtgtgctgggagtccgccctgccctgagccctctgcttcccccagctgaccgtcaccctgcacaacgtgccagacctcagtgcgggcgtgagctgcgccttcgaggcggcggcggagaacgaggcggtcctgctgccctccggtgaactgctctgcccctcaccctccctccaggagctccgagctcttaccagggggcatggtcagtgggttggggctgcccaggatggggcagagtggggcctctccctacccccagcgagttcacggccaccccgggactgctgcaggggccacccgcactgtgcggctgcagcttctctccaaggagacaggcgtgaggtttgccggtgctgactttgtcttctacaactgcagcgtcctccagtcgtgagtacctggccagcacccgtccctacccctggggatagaggggacctctgggacaggcgacaccttcagggcagctgtttctggggcatcaggggctaactgtcaggccctgatagcccctgacatccccacatctctctgtcccctgatatggctgccttcttccttcagttcccgatgtgtcctattggggagcagtgaggggcagtgcagcctcctctgttatttctgaagccacttcccccccaggtgcatgtcctgtgttggcagcccttacccctgccactggtgtaagtaccgccacacgtgtaccagccgcccccacgagtgctccttccaggagggcagggtccacagccctgaggtgaggcgggcgccgcatgtgaggggctgggctctgtggtgcgggcggggccaccggcttctatgcgttctcggtttctttgagccttctccaggttgggcctggagaagggtggccctgtgtgcagctgacaggtgctttccccgcagggctgccctgagatcctgcccagtggggacctcctgatccccgttggggtcatgcagcctcttaccttgcgggctaagaacctacctcagccgcagtcgggccagaagaactatgagtgcgtggtgcgggtgcaggggcggcagcagcgggtgcctgccgtgcgcttcaacagcagcagtgtgcagtgccagaacgcctcggtgaggtcccacccgctgcctcccttcggggtctgggctgtggcgtggtgtggatcgttcttgtctatgcccagctctctggcagggaactgtctgagtctcctgctagggattcctgtacctggaggaggggggcagctggcaaaaatcttgggtaggggttctgcacatcttatctggggtcccatgggttcctttcctccagtactcctatgaaggtgatgagcatggtgacaccgagctggacttctccgtggtctgggatggagacttccccatagacaagcctcccagcttccgaggtgaaggcatgggccagggagcttccctcctaaggcaattggcactgctggggtcgggtctgggggccctagtgctccccactttccacttttctgccactgcctgctccgtcagcagtgccttctgtgcctgcagccctcctgtacaagtgctgggcgcagcggcccagctgtggcctctgcctcaaggctgatccccgcttcaactgtggctggtgcatctcagagcacaggtgccagctgcggacccactgcccggccccgaagaccaactggatgcacctgagccagaagggcacccggtgcagccacccccgcatcacgcaggtcagcctccctcaccgcccctgcccactgccaacagggcccctgggagtctgagccaactctctcactgcccatcctgctccacagatccaccctctcgtggggcccaaggaaggaggcacccgggtcaccatcgtgggtgacaacctgggcctcttgtcccgagaggtgggcctgcgggtggctggcgtgcgttgcaactccattccggccgagtacatcagtgctgagaggtgagtgcggctctgtgggtgcccgggccgtatgtggcctggccggccctgacgctctctgagccctaggatcgtgtgtgagatggaggagtcgctggtgcccagcccgccgccggggcccgtggagctgtgtgtgggtgactgttcagccgacttccgcacgcagtcggagcaggtctacagctttgtggtgcgtggctgccggccctaccccttcctgtcccttctctctcccgcaaggggcgtgtggagcagcccggcccggctcctcccctcagggcagcttctcccgcagaccccaacgtttgaccaagtgagtcccagccgtggcccggcgtccgggggcacacggcttaccatctcaggcagctctctggatgctggcagcagggtcacagtgactgtgagggacagcgagtgccagtttgtaaggtgggccggggccctgccagctttgggttgggcatcgtgtggggggccgtggggacgggtggctgagggccctgggccacccgctccaagcaccctgcttgccaatgtaggagagatgccaaggcgatcgtgtgcatctcacctctctccaccctgggccccagccaggcccccatcacacttgccattgaccgggctaacatctccagccccgggctcatctacacctacactcaggaccccaccgtcacccgccttgagcccacctggagcatcatcaagtaagaccctgggggactggggagcctggcagtgtccagagggctcagggactgggtggtctctgagctccggtggggcccctcctggagcctaggccctcattggtggagggggtggagctgtcctggctgcacagtacccggcacccactaggcgatccagggtcagggaaggcctgggctgccatggcagccttgatcgctctccagggctgggtgggtgcactggaggagggagcctgaggcccctgccctgtccctagtggaagcactgccatcactgtgagtgggacccacctgctgacggtccaggagccccgggtccgtgccaagtaccgcggcattgagaccaccaatgtgagtaccagctgccccgccccaccccgaccctgcagcccatggcttcacgtgcctggctgtccacctttgtccccacagacatgccaagtgatcaacgacactgccatgctgtgtaaggcccccggcatctttcttgggcggccccagcctcgggcgcaaggcgagcaccctgatgagtttggcttcctgctggaccacgtgcaaacggcccgctccctcaaccgctcctcctttacctactaccctgatcccagctttgagccgctggggccctctggcgtgctggacgtcaaaccgggctcccacgtggtgctgaaggtgcgggcggggtgggggcggggaggggcgggaaagtggagagtcctgggctgaagttgtcctccacccccagggcaagaacctgattcccgcggcagccggcagctcccgcctcaactacactgtgctgataggaggccagccgtgttcgctcactgtctcggacacacaactcctgtgcgactcacccagccagactggccggcagcctgtcatggtaggtggggatggggagaccccctgggcagcccagggtgggcgtggtggtcagctcacctcaggcctgtccccacaggtgctggtgggtggcctggagttctggctgggcaccctgcacatctcggcagagcgggcgctgaccctaccggccatgatggggctggcggcggggggtgggctcctgctgctggccatcacagccgtgctggtggcgtacaagcgcaagactcaggacgcggaccgtaccctcaagcgtctgcagctgcagatggacaacctggagtcccgtgtggccctggagtgcaaggaaggtgcctgaggcggggcgggatgtggtgtggaagctggggacctccctcctgcccactcattccctctctccaccccccagcttttgcagagctgcagacggacatcaatgagctgactaaccacatggacgaggtgcagatccccttcctggactaccggacttacgccgtgcgcgtgctcttcccgggcatcgaggcccacccggtgctcaaggagctggatgtgagcctctgcctggcctgccccccaccattcccttcagggccgcccccaccctctgagacctcctgctccccacagacgccacccaacgtggagaaggccctgcgcctcttcgggcagctgctgcacagccgcgcgttcgtgcttaccttcatccacacgctggaggcccagagcagcttctccatgcgcgaccgcggcaccgtggcctcgctcaccatggtggccctgcagagccggctcgactatgccacggggctgctcaagcaactgctggccgacctcatcgagaagaacctcgagagcaagaaccaccccaagctgctgctacgcaggtacctgcctcgctctatccaggccacacctttgtcctgcctgggcctgccccctgtccaagccccacccctgccaggcccgagcccccttctcttgccctaggacagagtcagtggctgagaagatgcttaccaactggttcacgttcctgctgcataagtttctgaaggtgcgccaggtgggtgggcggcagggaggtggtggcagaggaccggccagtggtcaggcaggcagccagctgtgcacctgtccctggctgcaggagtgtgctggggagcctctcttcctgctttactgtgccatcaagcagcagatggagaagggccccattgatgccatcacgggcgaggcacgatactccctgagcgaggacaagctcatccgtcagcagatcgactacaagacactggtgagcgcagggccaggcgggccagaggtaggggcgcagagagaggcctcgccccagactgacactggagtccgctttcccctcagacccttcactgcgtgtgtccggagaacgagggcagcgcccaggtcccagtgaaggttctcaactgtgacagcatcacccaggccaaagataagctgctggacactgtgtacaagggcattccgtactcccagcgtcccaaagctgaggacatggacctgggtgaggtccccaccctctcctcctggctcccactcataccctcctgtgccgtgtgacctccgtgggctctcccgctccccacctgaaccctgtttcctaagaggagtgggccaggcacttgggggctgccagcataatcttaagggctgtctgtggcccacagagtggcgccagggccgcatgactcgcatcatcctccaggatgaggatgtcaccaccaagatcgagtgtgactggaagaggctcaactcactggcccactaccaggtgaggggttggggcccattcctccccagggccacctgggagccaggaccctgccttgagctgcagcaggacacgggagcagtggccctggctcccctcgcccttctccctgggctcgtgggctcccctcctgggtgtgggtgggtgggggcgccttggcttctcagcttcctgcactgcccccctctgtctctggggcctccaggtgacagacggttccttggtggcattggtgcccaaacaagtgtctgcctataacatggccaactccttcaccttcacccgctccctcagccgctacggtaggtgtcctcagtgtggtggccatgtgcccttcgagggaacccccacttccaagtgccatcgattctgtagagtgtagacggagggtcggccagcgagggcagatgggtccccacatgctgctgagctcccgggagagtggggcaggggccaggtggtggcctaagggtcacatgcattctctgctccagagagcttgctccgcacggccagcagccctgatagcctccgctcacgggcacccatgattacgcctgaccaggagacaggcaccaaattgtggcacctggtgaaaaaccacgaccatgccgaccatcgcgagggggaccgtggcagcaagatggtctccgagatctacctgacacggctgctggccaccaaggtatgggcctgcctctcgccaccttggcctccgcccagaggttgtcccggccttacaggggaggggccatggatcatttgcttccagtgggcctttcttcgggtctttgctgtgggaactctgagccttagataaaggccatgtctgtctgagagaccactggccctgtagggaagcccctctctttgccaagcctttctgcctccatctgtcctgctctggggacatcccgacctggctccctcatagcctgtgacctctctgccccacacagggcacactgcagaagttcgtggatgacctctttgagacagtgttcagcacagcccaccggggctcggccctgcccctggccatcaagtacatgttcgacttcctggatgagcaggcggaccagcgccagatcagcgaccccgatgtgcgccacacctggaagagcaactggtatcaccccgtgctgggctgccagcagcctgtctggagactggtgggcggaagacgctggtggctctgctgagacccagggcctggagtagcatccaggcaggagggaatgaggcctggcctggggttgacactgacggtgccatcaagccaaggggcctgttgcgtccagttctggagctggactgcctgggtgggtgggatggtggtggtgaggcctttgccctctggggtcttgcaccaggtagagatgctggtggtcggtcgcaggtggtgagagcggtgacaggagaagctgcggagggggttgagccctattgagaacagaagttcagcagagacttagaggaaaggccgttcaccctaaatgtgttgctctcaccacctctggacaagatgtgagccggccggacaggaaagagatgtgcacatgggaggggccccttggggctaactagggagcctcaggcgcacgtccctctgttgtccacagcctgccgctgcgcttctgggtgaatgtgatcaagaacccgcagttcgtgttcgacatccacaagaacagcatcacggatgcctgcctgtcggtggtagcccagaccttcatggactcctgctctacatccgagcaccgcctggggaaggactcgccctccaacaaactgctctacgccaaggacatccccaactacaagagctgggtggagaggtgggctccgccctgctgtgggtggcagagggcaggacctgcccctccctgggctgcctgtgcgaggcaggccagctacaggcaggaagcccgggggctggctgggcagtgagggcaggggttctagtttttgtgatgtcgcctgagtgacatactcagggtcccaacaggtattatcgagacattgcaaagatggcatccatcagcgaccaggacatggatgcctacctggtggagcagtcccgcctccacgccagcgacttcagcgtcctgagtgcgctcaacgagctgtatttctatgtcaccaagtaccgccaggaggtgtgtgtcatccccacagactcccagttacttggtcctgaaggtgcagccagtgacaaaggcaggagggttggtgggggttggggattgttcacggtctctcccctgaccagggcctggggccggcacaggtgatgctctctgggatcacaggtagatgctggaatttgagggacccaggagataagccactggctgggtacaaagtggccactgggcaaaagttaaagggcctgagcactggaagggatgggtcaggctttgtgatgagaaatagccagaggcaggaggacatagaggtgtggactttaggatggagtctgggctggacacatttgcaagcctgtggatggcatttaaagccctgagcctggatgagctcacagggaagccacaagtgggtgtggagggagaagcggcccaaacactgagcccagggccccaggacacaaagaggggaggggaggggaggtgcagcagccagcggggaggatgcctgagagcgcctggtggggtctggcaacctgagccagtgaggacccctcacaggtcagggagtggcagtggccggctccatcttccagtgctgctgctggtgaaggatggtgacctgcagaacactcactgggtctggcgagggtcacggggtcctggcgcgagggaggcttgggctaggaggtaatgggagggggaatccagcacggcgagtccagagtccaggtcactctagggacaggccgcaccctagctgtggagaggaggaggagaaagtgctgtcgtcggaggggcatttggggctggggagagctggtgggtttgtacaggggctgcgggggaggacggagggatgaggcgtgtgggagggaggagcccagctgggaagtggggactttgcatggcaggagctgcgccccctacagagcccagctccaggggactcctctcccccagattctcacggctctggaccgagatgcctcttgtcggaagcataagttgcggcagaaactggaacagatcatcagcctcgtgtccagcgacagctaaggtggtggaatcggtgaggagggggcttctcagtcctgtgccgtcctcccatccaggggagtggctggctcaagcctgggtccccgggctgagccctggattgggtatcgtggggcaggtcaccctggccacgatgcccccggcacacccaggcccccttcattagtgccttgctttgggccctgcagggggaggggtgacagggcgagcccccaccccagcagcagcaatacccccaccctcctgccctgtgcccaggtgttgggacagtcccaccctccctgctatttatatccctctgcctatttattgaatcgaacttcgcctctgtctccatctgtaaatatgtgtccccccaccggatgtcgccaccctcactcacctgcctcttcttgagctgtcctgggccctgccacccgtctgggctcctttgtgtagcattatcagcctcggtctggcctctggcacctcacccttgccatggctgaccccacccattccaaggcggggtcacggtaccagcagcacttggggtgaggcctccaaagcttcctcagaattgtggctgtgccacgctggaccacagggtccccctcaagcatctcggggccctattctctctgagcacctggagggctggactcaggcttgtgccagggcctgacttgggcctgggggccctagaacactcctcctcctgagcctactgccaaacgtcctcagtgttgtctgcacctgctccgactccttcagccgccccattcagcgcccgctccgtccagtgcccgccctgtggggccaaggcggccgtgccttactactctgtgtcttctgcctcctctgaggaatctggccctgtctgacagtcccagaccccccgttctctcctctttagttgcatgagtttttctttgttcatggaatgttttttcctgattaaatgttggggaaatgccatccatgtggggctctgtccttggggcaggtcagtagacctgtggatgctgcatgagctggagccccattgtgggagaaaggaccactccttgcagggtcccagagggtttggggaggttcagggccatacccgacccatcagcaaaccccggtggctctaccttcaagacagattcaaggtagatagattctcctccct

SEQ ID NO: 172 - DNA, 19121 bp, mus musculus
ccggcggcccccgggccagcccagtgtgtgggcggcggcggcggcggctgcgcgcttggggcccggggcgcggggcgaggccgtggggacgtgcgagcggggccgcggtggggctcgggggcgcgtccacgtggccagagggcggccacccggagccagcggagggacaggtaggtggccgtcatcgtcgccgtccgtgcggggccaaacagctcggggcccggggctccggcagcccgggggtccggctcggcctgtgggggtcaggccctatccctgcccgtcggcgccggcctgcccgactccttgtgccccgcatggtggggacgccaacccaagaccaacaccctgcccaaagaggaccctttgtcgcaggggagcggcccctcggaggatcaacgctgtacttccctcccgctaagggctccgcgagtccgccgaggggtgccctgatggggcccgggcaaaccggaccagcagcacggtggggggtgtggggggcggccgctggacccccgtctctgcgtggggctgccccttcctcaggctctctgctggcccagctgtacctgtgatgcccgaggttgccacttacaggtgggggctgggcctgaaactgcctccccaggtctccctcccgacctgtccccagcctgttcctaggcttgtgttcccggggtgtagaggaggtgaagacaggatgtggcctctcttttctttggccttcctttcttctccggctgttgcatgaggggtccagctgacaaaagagccctggagaggtgatcaatctgagctgaaactttgcagtttcaagctgggcccgctgcttgttcctggcaaatgccttatttttcctttctctctcctgtgcctccttggtttggttccctgcaccaccccccgctccccccccgcctcccgccctcaagctgggtacctcctatctcccccgggagctctggcactgagagggtagcgctgagccctgccctgttggctgccacgacactgctctgctgtcttagcagcctggggctgactgggtgtggcctggggactaagtgccagtcccagcactgtccctgtggctcctgccctgtctctccaaggccttgactgtatttggggacattgctcctcctcttgtaaggctcctgggactccaaagggcaggtagggccccctgtacattcccttctccagtgaacccctgggtctggagggggagccatgcaggctgtggctgagcagagcttgactgatgtgtgtctgggtgcgtggctgaggggcaggcgcgacttggctttgtgttgcatcggggaggccagacagcgggctcctggatggccagctgaggcccttgtcggggaggcagctggggcccctgcaggggacatggtggtgctggatcctgcatcaggcctccattccccagacctctgtcccagggctcctggtggcagtgccactccaggtggtgttcctggccctgcccctctcccccagcttgcgattattctgtgcctgcctccctctcccctcagctcaggcgttgggggcagcccagaggcctggggcttgctgttctttgctgttggttgccccgggctctgagatgtggcatctggggtcccagttccagcatctgctctgctacccccttgggtgtggcccagctgaggcgaggcctcctggctcctttccagcatgggggctgagggacgattgatggcccccaagcctgccctcgctggctgctcactcatgcgccctggcggaggcccctcctctctccctgtcacggtggccatctggggctttggcggggtggtgggtgaatggcccagccctctgtggctcgaggcctctgactcccacacaccgtctctccctaggcctgtccccaggcgcggctgccggccatgccctctgtctgcctcctcctgctgctcttccttgccgtggggggggccctgggcaacaggcccttccgtgccttcgtggtgacagacaccacgcttacccacctggctgtgcaccgggtgactggggaggtgttcgtgggcgcagtgaaccgagtctttaagctggcccccaacctgactgagctgcgggcccatgtcacggggcccgtcgaggacaacgctcgctgctacccgccccccagcatgcgcgtgtgtgcccaccgcctggcccccgtggacaacatcaacaagctgctgctcatagactatgcggcccgccgcctggtggcctgcggcagcatctggcagggcatctgccagttcctgcgtctggacgacctcttcaagctgggtgagccgcaccaccgcaaggagcactacctgtcgggggcccaggagcccgactccatggctggtgtcattgtggagcagggccaggggcccagcaagctgtttgtgggcactgctgtcgacggcaagtcggagtacttccccaccttgagctcccgcaagctcatcagtgatgaagacagcgcggacatgttcagtctcgtgcgtgagccttccttctcttcttcctccacccagtcctggctctgcctcccagaagagccctgttctttctgagaggggactttcggctcctcagtgtctgggatgcagacaggttgcggagggtgggatgacagcctgaacccaggttgcgggggtcccctgtgtgcagggaggctggtcaccctgccctctgcagcctttctggcctgggcctctgtgatcatccaggcgggagggggatgcagagggaagctggcggtggcccgtgatgttggcacagggcctcaccggatgctgtctcctccccctgctccccaggtgtaccaggatgagtttgtgtcctcccagatcaagatcccctcagacacgctgtccttgtaccctgcctttgacatctactacatctacggcttcgtcagcgcctccttcgtgtacttcctgacgctgcagctggacacccagcagacgctgttggacacagcgggcgagaaatttttcacgtccaagatcgtgcgcatgtgcgcgggagactcagagttctactcatacgtggaattccccatcggctgctcctggcgcggcgtggagtaccgcttggtgcagagcgcccacctggccaagcctggcctgctgctggcccaggccctgggcgtgccggctgatgaggacgtcctcttcaccatcttctctcagggccagaagaaccgggccagcccaccccggcagaccatcctctgcctcttcaccctcagcaacatcaatgcccacatccggcgccgcatccagtcctgctatcgtggggagggcactctggctctgccctggctgctgaacaaggagctgccctgcatcaacaccgtgagcccctcatcaccccacactggtcctctgccctgtcccaggtctaccatgcccagcgtgggctcacggccagtcatcctgtcccaggctttgccatggccctgggagtggcacctttgccctcccacctgtttctccctcccaggggtccctgccctctccttgcctctctctgggctgcccagtgccccacttctgcttccttccgttcccagctcgttcctccttgctccgtctcccggttgccccttgtcttgagccaacaagagtcttgtgggcccaggcttcgctcctcgctccctgctgtccctcctctgtctccctccgcagccaccaatttcctggagcaccctagggcgagcagtcagtcctggctggaggggaccgggttctagatcccgctctcttctgggactcaggaactgccggcctccatcttgcgcctgggagctttgactctcacgggttcctcctctgtttcaccagcccatgcagatcaacggcaacttctgtgggctggtgttgaaccagcctctgggaggcctgcatgtgatcgaggggctgcccctgctggccgacagcaccgacggcatggccagcgtggccgcctacacctaccgccagcactctgtggtcttcattggcacgcgcagcggcagcttgaagaaggtggcccccagagccctgggcatgtgggggtggggacagtctcagatatgggacaaggctggtggtgggaacacacgggagagctctgaggacaggacaggagaggacacggctggtgcagggagggagatttccctggctgggtcccaggcgcctggccctgctcctcgggtcgccccttggccgcccaccctcaccattgccagttcccactgtggactgaattgccagcttcgtatggctctggggacagagaacagacctattgtggagtctccctgccacgagagcaggcctggggctgagccagcattgctgggtcctctgttgaatgaacaagggagcaaatgccttgcccctcaagcctccctatgcctgggacagacccacttgcccctgccctctccttggctcactacttcccatccttcccctcctacccatgggcccgggggctgaagctgcttccattggggatctgggggtagcttggcatgaagggggagatgaacttctgggcactcaggtacgtgttgaataggtaggagtcgggggactgcagtgctctcatcctgcttgcctcgtagatgcagtgccatcccccaggagggcaagtgttggtctgggggcgcagggaagggtttgtggagaaggatgatgaactctcctggcccacctgctctgttcctgggaccctcttttcctttgtagcagctttgttgaacgcgtactatccaattcacccattttaaagtgcacagttcagtgggtttctgtggatctgcagagtggcacaaccatcgccactacctcattctcctaatcaatgccatcttctagctcttcccctcccctgcatcccctgaccttgggcaacacgaatcactccgtccttctgtttgctgagggcattttctggcgtctgcaccctcctttttttggcctccgggctgtgggtgtgagtgctgaaccccaccaggtcctgacgtcagctcagccacaacctccaaagtctttggctggagaagacagtgtcccaggtgcaggaggctgtggtggcatcaggctggtcttgtggctcaggtgcgggtcgatggcttccaggatgcccacctgtatgagacagtccccgtggtggatggcagccccatcctccgagacctgctcttcagcccggaccaccggcacatctatctcctgagtgagaagcaggtgggcctgtggtgggtggcggtggctggtggggcgggggtgggctgggtgctgatgtggctgtccccaggtgagccagctcccggtggagacctgtgagcagtaccagagctgcgcagcctgcctgggctccggggacccgcactgtggttggtgtgtgctgcgacacaggtgagggcgggggcccctgctcggggagttggagggccccactggccagggggagccagccacacccagccgtgcccttgcggcctccccccgccctcctccactttctccagctaatgagtggaacctccaccccgagtgacgtccctcgggccccaggggacgcggccaaggctcgctgttgcctggcactgtgagctggacaggcctgggccctcccggggcagtggcgggaccggctctggcccgaccccgtgcaggtgctgccgcgaaggggcctgtctgggcgcctctgccccacacggctttgctgaggagctgagcaagtgtgtccaggtgcgggtccggcccaacaatgtgtcagtgacgtcacctggggtgcaggtgagcagcttgggggtgcccggctgggtgtgcacatgtgtgctgggagtccgccctgccctgagccctctgcttcccccagctgaccgtcaccctgcacaacgtgccagacctcagtgcgggcgtgagctgcgccttcgaggcggcggcggagaacgaggcggtcctgctgccctccggtgaactgctctgcccctcaccctccctccaggagctccgagctcttaccagggggcatggtcagtgggttggggctgcccaggatggggcagagtggggcctctccctacccccagcgagttcacggccaccccgggactgctgcaggggccacccgcactgtgcggctgcagcttctctccaaggagacaggcgtgaggtttgccggtgctgactttgtcttctacaactgcagcgtcctccagtcgtgagtacctggccagcacccgtccctacccctggggatagaggggacctctgggacaggcgacaccttcagggcagctgtttctggggcatcaggggctaactgtcaggccctgatagcccctgacatccccacatctctctgtcccctgatatggctgccttcttccttcagttcccgatgtgtcctattggggagcagtgaggggcagtgcagcctcctctgttatttctgaagccacttcccccccaggtgcatgtcctgtgttggcagcccttacccctgccactggtgtaagtaccgccacacgtgtaccagccgcccccacgagtgctccttccaggagggcagggtccacagccctgaggtgaggcgggcgccgcatgtgaggggctgggctctgtggtgcgggcggggccaccggcttctatgcgttctcggtttctttgagccttctccaggttgggcctggagaagggtggccctgtgtgcagctgacaggtgctttccccgcagggctgccctgagatcctgcccagtggggacctcctgatccccgttggggtcatgcagcctcttaccttgcgggctaagaacctacctcagccgcagtcgggccagaagaactatgagtgcgtggtgcgggtgcaggggcggcagcagcgggtgcctgccgtgcgcttcaacagcagcagtgtgcagtgccagaacgcctcggtgaggtcccacccgctgcctcccttcggggtctgggctgtggcgtggtgtggatcgttcttgtctatgcccagctctctggcagggaactgtctgagtctcctgctagggattcctgtacctggaggaggggggcagctggcaaaaatcttgggtaggggttctgcacatcttatctggggtcccatgggttcctttcctccagtactcctatgaaggtgatgagcatggtgacaccgagctggacttctccgtggtctgggatggagacttccccatagacaagcctcccagcttccgaggtgaaggcatgggccagggagcttccctcctaaggcaattggcactgctggggtcgggtctgggggccctagtgctccccactttccacttttctgccactgcctgctccgtcagcagtgccttctgtgcctgcagccctcctgtacaagtgctgggcgcagcggcccagctgtggcctctgcctcaaggctgatccccgcttcaactgtggctggtgcatctcagagcacaggtgccagctgcggacccactgcccggccccgaagaccaactggatgcacctgagccagaagggcacccggtgcagccacccccgcatcacgcaggtcagcctccctcaccgcccctgcccactgccaacagggcccctgggagtctgagccaactctctcactgcccatcctgctccacagatccaccctctcgtggggcccaaggaaggaggcacccgggtcaccatcgtgggtgacaacctgggcctcttgtcccgagaggtgggcctgcgggtggctggcgtgcgttgcaactccattccggccgagtacatcagtgctgagaggtgagtgcggctctgtgggtgcccgggccgtatgtggcctggccggccctgacgctctctgagccctaggatcgtgtgtgagatggaggagtcgctggtgcccagcccgccgccggggcccgtggagctgtgtgtgggtgactgttcagccgacttccgcacgcagtcggagcaggtctacagctttgtggtgcgtggctgccggccctaccccttcctgtcccttctctctcccgcaaggggcgtgtggagcagcccggcccggctcctcccctcagggcagcttctcccgcagaccccaacgtttgaccaagtgagtcccagccgtggcccggcgtccgggggcacacggcttaccatctcaggcagctctctggatgctggcagcagggtcacagtgactgtgagggacagcgagtgccagtttgtaaggtgggccggggccctgccagctttgggttgggcatcgtgtggggggccgtggggacgggtggctgagggccctgggccacccgctccaagcaccctgcttgccaatgtaggagagatgccaaggcgatcgtgtgcatctcacctctctccaccctgggccccagccaggcccccatcacacttgccattgaccgggctaacatctccagccccgggctcatctacacctacactcaggaccccaccgtcacccgccttgagcccacctggagcatcatcaagtaagaccctgggggactggggagcctggcagtgtccagagggctcagggactgggtggtctctgagctccggtggggcccctcctggagcctaggccctcattggtggagggggtggagctgtcctggctgcacagtacccggcacccactaggcgatccagggtcagggaaggcctgggctgccatggcagccttgatcgctctccagggctgggtgggtgcactggaggagggagcctgaggcccctgccctgtccctagtggaagcactgccatcactgtgagtgggacccacctgctgacggtccaggagccccgggtccgtgccaagtaccgcggcattgagaccaccaatgtgagtaccagctgccccgccccaccccgaccctgcagcccatggcttcacgtgcctggctgtccacctttgtccccacagacatgccaagtgatcaacgacactgccatgctgtgtaaggcccccggcatctttcttgggcggccccagcctcgggcgcaaggcgagcaccctgatgagtttggcttcctgctggaccacgtgcaaacggcccgctccctcaaccgctcctcctttacctactaccctgatcccagctttgagccgctggggccctctggcgtgctggacgtcaaaccgggctcccacgtggtgctgaaggtgcgggcggggtgggggcggggaggggcgggaaagtggagagtcctgggctgaagttgtcctccacccccagggcaagaacctgattcccgcggcagccggcagctcccgcctcaactacactgtgctgataggaggccagccgtgttcgctcactgtctcggacacacaactcctgtgcgactcacccagccagactggccggcagcctgtcatggtaggtggggatggggagaccccctgggcagcccagggtgggcgtggtggtcagctcacctcaggcctgtccccacaggtgctggtgggtggcctggagttctggctgggcaccctgcacatctcggcagagcgggcgctgaccctaccggccatgatggggctggcggcggggggtgggctcctgctgctggccatcacagccgtgctggtggcgtacaagcgcaagactcaggacgcggaccgtaccctcaagcgtctgcagctgcagatggacaacctggagtcccgtgtggccctggagtgcaaggaaggtgcctgaggcggggcgggatgtggtgtggaagctggggacctccctcctgcccactcattccctctctccaccccccagcttttgcagagctgcagacggacatcaatgagctgactaaccacatggacgaggtgcagatccccttcctggactaccggacttacgccgtgcgcgtgctcttcccgggcatcgaggcccacccggtgctcaaggagctggatgtgagcctctgcctggcctgccccccaccattcccttcagggccgcccccaccctctgagacctcctgctccccacagacgccacccaacgtggagaaggccctgcgcctcttcgggcagctgctgcacagccgcgcgttcgtgcttaccttcatccacacgctggaggcccagagcagcttctccatgcgcgaccgcggcaccgtggcctcgctcaccatggtggccctgcagagccggctcgactatgccacggggctgctcaagcaactgctggccgacctcatcgagaagaacctcgagagcaagaaccaccccaagctgctgctacgcaggtacctgcctcgctctatccaggccacacctttgtcctgcctgggcctgccccctgtccaagccccacccctgccaggcccgagcccccttctcttgccctaggacagagtcagtggctgagaagatgcttaccaactggttcacgttcctgctgcataagtttctgaaggtgcgccaggtgggtgggcggcagggaggtggtggcagaggaccggccagtggtcaggcaggcagccagctgtgcacctgtccctggctgcaggagtgtgctggggagcctctcttcctgctttactgtgccatcaagcagcagatggagaagggccccattgatgccatcacgggcgaggcacgatactccctgagcgaggacaagctcatccgtcagcagatcgactacaagacactggtgagcgcagggccaggcgggccagaggtaggggcgcagagagaggcctcgccccagactgacactggagtccgctttcccctcagacccttcactgcgtgtgtccggagaacgagggcagcgcccaggtcccagtgaaggttctcaactgtgacagcatcacccaggccaaagataagctgctggacactgtgtacaagggcattccgtactcccagcgtcccaaagctgaggacatggacctgggtgaggtccccaccctctcctcctggctcccactcataccctcctgtgccgtgtgacctccgtgggctctcccgctccccacctgaaccctgtttcctaagaggagtgggccaggcacttgggggctgccagcataatcttaagggctgtctgtggcccacagagtggcgccagggccgcatgactcgcatcatcctccaggatgaggatgtcaccaccaagatcgagtgtgactggaagaggctcaactcactggcccactaccaggtgaggggttggggcccattcctccccagggccacctgggagccaggaccctgccttgagctgcagcaggacacgggagcagtggccctggctcccctcgcccttctccctgggctcgtgggctcccctcctgggtgtgggtgggtgggggcgccttggcttctcagcttcctgcactgcccccctctgtctctggggcctccaggtgacagacggttccttggtggcattggtgcccaaacaagtgtctgcctataacatggccaactccttcaccttcacccgctccctcagccgctacggtaggtgtcctcagtgtggtggccatgtgcccttcgagggaacccccacttccaagtgccatcgattctgtagagtgtagacggagggtcggccagcgagggcagatgggtccccacatgctgctgagctcccgggagagtggggcaggggccaggtggtggcctaagggtcacatgcattctctgctccagagagcttgctccgcacggccagcagccctgatagcctccgctcacgggcacccatgattacgcctgaccaggagacaggcaccaaattgtggcacctggtgaaaaaccacgaccatgccgaccatcgcgagggggaccgtggcagcaagatggtctccgagatctacctgacacggctgctggccaccaaggtatgggcctgcctctcgccaccttggcctccgcccagaggttgtcccggccttacaggggaggggccatggatcatttgcttccagtgggcctttcttcgggtctttgctgtgggaactctgagccttagataaaggccatgtctgtctgagagaccactggccctgtagggaagcccctctctttgccaagcctttctgcctccatctgtcctgctctggggacatcccgacctggctccctcatagcctgtgacctctctgccccacacagggcacactgcagaagttcgtggatgacctctttgagacagtgttcagcacagcccaccggggctcggccctgcccctggccatcaagtacatgttcgacttcctggatgagcaggcggaccagcgccagatcagcgaccccgatgtgcgccacacctggaagagcaactggtatcaccccgtgctgggctgccagcagcctgtctggagactggtgggcggaagacgctggtggctctgctgagacccagggcctggagtagcatccaggcaggagggaatgaggcctggcctggggttgacactgacggtgccatcaagccaaggggcctgttgcgtccagttctggagctggactgcctgggtgggtgggatggtggtggtgaggcctttgccctctggggtcttgcaccaggtagagatgctggtggtcggtcgcaggtggtgagagcggtgacaggagaagctgcggagggggttgagccctattgagaacagaagttcagcagagacttagaggaaaggccgttcaccctaaatgtgttgctctcaccacctctggacaagatgtgagccggccggacaggaaagagatgtgcacatgggaggggccccttggggctaactagggagcctcaggcgcacgtccctctgttgtccacagcctgccgctgcgcttctgggtgaatgtgatcaagaacccgcagttcgtgttcgacatccacaagaacagcatcacggatgcctgcctgtcggtggtagcccagaccttcatggactcctgctctacatccgagcaccgcctggggaaggactcgccctccaacaaactgctctacgccaaggacatccccaactacaagagctgggtggagaggtgggctccgccctgctgtgggtggcagagggcaggacctgcccctccctgggctgcctgtgcgaggcaggccagctacaggcaggaagcccgggggctggctgggcagtgagggcaggggttctagtttttgtgatgtcgcctgagtgacatactcagggtcccaacaggtattatcgagacattgcaaagatggcatccatcagcgaccaggacatggatgcctacctggtggagcagtcccgcctccacgccagcgacttcagcgtcctgagtgcgctcaacgagctgtatttctatgtcaccaagtaccgccaggaggtgtgtgtcatccccacagactcccagttacttggtcctgaaggtgcagccagtgacaaaggcaggagggttggtgggggttggggattgttcacggtctctcccctgaccagggcctggggccggcacaggtgatgctctctgggatcacaggtagatgctggaatttgagggacccaggagataagccactggctgggtacaaagtggccactgggcaaaagttaaagggcctgagcactggaagggatgggtcaggctttgtgatgagaaatagccagaggcaggaggacatagaggtgtggactttaggatggagtctgggctggacacatttgcaagcctgtggatggcatttaaagccctgagcctggatgagctcacagggaagccacaagtgggtgtggagggagaagcggcccaaacactgagcccagggccccaggacacaaagaggggaggggaggggaggtgcagcagccagcggggaggatgcctgagagcgcctggtggggtctggcaacctgagccagtgaggacccctcacaggtcagggagtggcagtggccggctccatcttccagtgctgctgctggtgaaggatggtgacctgcagaacactcactgggtctggcgagggtcacggggtcctggcgcgagggaggcttgggctaggaggtaatgggagggggaatccagcacggcgagtccagagtccaggtcactctagggacaggccgcaccctagctgtggagaggaggaggagaaagtgctgtcgtcggaggggcatttggggctggggagagctggtgggtttgtacaggggctgcgggggaggacggagggatgaggcgtgtgggagggaggagcccagctgggaagtggggactttgcatggcaggagctgcgccccctacagagcccagctccaggggactcctctcccccagattctcacggctctggaccgagatgcctcttgtcggaagcataagttgcggcagaaactggaacagatcatcagcctcgtgtccagcgacagctaaggtggtggaatcggtgaggagggggcttctcagtcctgtgccgtcctcccatccaggggagtggctggctcaagcctgggtccccgggctgagccctggattgggtatcgtggggcaggtcaccctggccacgatgcccccggcacacccaggcccccttcattagtgccttgctttgggccctgcagggggaggggtgacagggcgagcccccaccccagcagcagcaatacccccaccctcctgccctgtgcccaggtgttgggacagtcccaccctccctgctatttatatccctctgcctatttattgaatcgaacttcgcctctgtctccatctgtaaatatgtgtccccccaccggatgtcgccaccctcactcacctgcctcttcttgagctgtcctgggccctgccacccgtctgggctcctttgtgtagcattatcagcctcggtctggcctctggcacctcacccttgccatggctgaccccacccattccaaggcggggtcacggtaccagcagcacttggggtgaggcctccaaagcttcctcagaattgtggctgtgccacgctggaccacagggtccccctcaagcatctcggggccctattctctctgagcacctggagggctggactcaggcttgtgccagggcctgacttgggcctgggggccctagaacactcctcctcctgagcctactgccaaacgtcctcagtgttgtctgcacctgctccgactccttcagccgccccattcagcgcccgctccgtccagtgcccgccctgtggggccaaggcggccgtgccttactactctgtgtcttctgcctcctctgaggaatctggccctgtctgacagtcccagaccccccgttctctcctctttagttgcatgagtttttctttgttcatggaatgttttttcctgattaaatgttggggaaatgccatccatgtggggctctgtccttggggcaggtcagtagacctgtggatgctgcatgagctggagccccattgtgggagaaaggaccactccttgcagggtcccagagggtttggggaggttcagggccatacccgacccatcagcaaaccccggtggctctaccttcaagacagattcaaggtagatagattctcctcccttccaccacccccacccagctctcctgtgccatcgtctatctctgcctggatgccagtctccctgcttctgccctggctctcttcagcctgttctcagcgtgggaggcagagagatcctgttatgatataaggtggatcatgttgcctcactgtttagaaccctccggcggtttcagctgcagccagctccttcaaaacctgacaattgcatactgtcgaggttgtggcacccatcatggtgcacctaccaaagtcttactcccaggcctgttaagtaatgcaggtggggagaaggtgacatgcaatttatttatttatttattttgagacagagtgtagctgtgttgcccaggctggagtgcagtggcaagatcacagctcagtgcagtctcaaactcctgggctcaagtgatcctcccacctcagcctcctgaatagctgggtgtattagtgcactctactatgccaggcttttttttttttttttttgagataggttgccgctatgttgttcaggctggtcttgaattcctggtctcaagtgatcctcacccctcagcctcccaaagtattgggattacaggcatgagccactgtgcccggccaggtgagatggaatcttatttttactttttatgtttttttttttttctttgacggagtgtcgctctgtcgcccaggctggagtgcagtggcatgatctcggctcactgcaagctccgcctcccaggttcacgccattctcctgcctcagcctcccgaatagctggaactacaggtgcccaccaccacgcccggctaattttttgtatttttagtagagacggggttttactgtgttagccaggatggtctcaatctcctgacctcgtgatccacctgcctcagcctcccaaagtgctgggattacaggcgtgagccaccatgcctgaccttttttttttttttttttttttttttttggagacgggatcttgccctgttgcccacgctggagtgcagtggcaaaatcaactcactgcagccttgatgtcctgggctcaagtgatcttcctgcctcagccttctgagtagctaggattacaagtgcttgccaccatacccagctgtttttttttttttttttttttctttagtagagatggagtcttgctggttttgaacctcctgggctcaagtgatcctcctgttttggcctcccaaaattctgggattacagttgtgagccactgtgcccagccaagtgagatgcaatttttttttttttttttttgagacagagtttcactcttgttgcccaggctggagtgcaatggtatgatcttggctcaccgcaacctccgcctcccgggttcaagtgattctcctgcctcagcctcctgagtagctgagattacaggcatgtgccaccacgcccagctaattttgtatttttagtagagacagggtttctccatgttggtcaggctggtctcgagctcccgacctcaggtgatccgcccgcctcagcctcccaaagtgctgggattacaggcatgagccactgttcctggcctttcttctttttttgtttttgtttttttttgagatgcaattttaaatagggtggcttggacagccacctgagttgggtttaaaagctgccagctccagccgtccagctgtggggccacggtgccagacagtggtggtggttataggaccgtaggtgtttaccaaaactagacaagtccacataacaaccaactgcacaaataaggagtaaaataataaagagaaggacgtgtgaggcaggactggattgtagcccaggataaagagaagttgcgggatgacagctgtgccgtcggcccagacagaaccatctggacagaggacagaggataagggagatggttgaaaatactaccatcatatgataatgacaactaagccacaggaaaacaaggcagttttaacctcaggggaaatccctcagaaatggatggaatctaccagaagcatcatgagaggaagaggaagggaaacagagctaaattggggccaggtgtggtggctcgcacttgtcatcccagcacttttggaggcccaggcgggaagatcactggagcccaggagttcaggaccagcctgggcaacaaagcgagatcccctctctacaaaaaataaaaaactagccaggcatggtggtgcatgcctgtggtcccagttactcaggaggctgaggtgctggggaacaaggctgcagtgagctgtgattgtgccagcctaggtgacagagccagaccctgtatcaaaaaaaataataataattaaaaaacaaaagatcggctgggcgcggtggctcatgcctgtaatcccagcactttgggaggctgaggtgggtggaccacctgaggtcgggagttcgagaccagcctcaccaacatggagaaaccctgtgtctactaaaaatacaaaattagctgggcgtggtggtgcatgcctgtaattctagctacttgggaggctgaggcaggagaattcgcttgaacccgggaagtggaggttgcggtgagccaagatcgcaccattgcactccagcctgggcaacaagagtgaaacactgtctcaaaaaaaaaaaaaaaaaagtgaaagatctaaattgtcaactattcgtcaataattaatgtctaaaaaatattaagaaaggaagaaaggaatgagagcaaaagagagggagagaggaaagtgtcatcttcataagctgaaggccagtgccaccgtcaccactggcagagctccccagattctacaaagggaaactgttcctccatatggagtaatagggactggatatgtcatgccaaatgaaagaacacgccaaaccagacaaaatatatggaatgcagagtattaaaaaactggctgtgggccagtgagggacagcgacgtgtgggagctgggaaacaaggtaagccatgcgactggcccagtgtcctgtgtggagtttcctggtggagcctggcagacacccggactttaggagttgaaactgattcagagcgtcccagcagctggagtttgcagggcggagaaccagagagaagagagctgcacagggaaagaaccctggatatccacagaggctcccgttccagtgtgcagcggactacgactactggtgagcacaggcgtgtgaggaagctacccaagaccagggaaggccatcaccccagcaggagaggatgaacggtaactccagtgtgcaagcaggacagggactagcagctgtccccacccaccaggatagagaagctcatgttcacctaggcagcactggccagggtgcccagaatggtgtttgttgcctccatagagggaaacaagcctacagttaagagctgctctggtcccacacagcacatcttcaaagcaagactcaaaaggatcaaaccatttccttgttttctgagaataaaagcagttgtacctcttccttttcactctcagaaaatctgatagaatctataaaagagccctaaggctggagaca

SEQ ID NO: 173 - DNA, 14394 bp, mus musculus
cagtgtgtgggcggcggcggcggcggctgcgcgcttggggcccggggcgcggggcgaggccgtggggacgtgcgagcggggccgcggtggggctcgggggcgcgtccacgtggccagagggcggccacccggagccagcggagggacaggtaggtggccgtcatcgtcgccgtccgtgcggggccaaacagctcggggcccggggctccggcagcccgggggtccggctcggcctgtgggggtcaggccctatccctgcccgtcggcgccggcctgcccgactccttgtgccccgcatggtggggacgccaacccaagaccaacaccctgcccaaagaggaccctttgtcgcaggggagcggcccctcggaggatcaacgctgtacttccctcccgctaagggctccgcgagtccgccgaggggtgccctgatggggcccgggcaaaccggaccagcagcacggtggggggtgtggggggcggccgctggacccccgtctctgcgtggggctgccccttcctcaggctctctgctggcccagctgtacctgtgatgcccgaggttgccacttacaggtgggggctgggcctgaaactgcctccccaggtctccctcccgacctgtccccagcctgttcctaggcttgtgttcccggggtgtagaggaggtgaagacaggatgtggcctctcttttctttggccttcctttcttctccggctgttgcatgaggggtccagctgacaaaagagccctggagaggtgatcaatctgagctgaaactttgcagtttcaagctgggcccgctgcttgttcctggcaaatgccttatttttcctttctctctcctgtgcctccttggtttggttccctgcaccaccccccgctccccccccgcctcccgccctcaagctgggtacctcctatctcccccgggagctctggcactgagagggtagcgctgagccctgccctgttggctgccacgacactgctctgctgtcttagcagcctggggctgactgggtgtggcctggggactaagtgccagtcccagcactgtccctgtggctcctgccctgtctctccaaggccttgactgtatttggggacattgctcctcctcttgtaaggctcctgggactccaaagggcaggtagggccccctgtacattcccttctccagtgaacccctgggtctggagggggagccatgcaggctgtggctgagcagagcttgactgatgtgtgtctgggtgcgtggctgaggggcaggcgcgacttggctttgtgttgcatcggggaggccagacagcgggctcctggatggccagctgaggcccttgtcggggaggcagctggggcccctgcaggggacatggtggtgctggatcctgcatcaggcctccattccccagacctctgtcccagggctcctggtggcagtgccactccaggtggtgttcctggccctgcccctctcccccagcttgcgattattctgtgcctgcctccctctcccctcagctcaggcgttgggggcagcccagaggcctggggcttgctgttctttgctgttggttgccccgggctctgagatgtggcatctggggtcccagttccagcatctgctctgctacccccttgggtgtggcccagctgaggcgaggcctcctggctcctttccagcatgggggctgagggacgattgatggcccccaagcctgccctcgctggctgctcactcatgcgccctggcggaggcccctcctctctccctgtcacggtggccatctggggctttggcggggtggtgggtgaatggcccagccctctgtggctcgaggcctctgactcccacacaccgtctctccctaggcctgtccccaggcgcggctgccggccatgccctctgtctgcctcctcctgctgctcttccttgccgtggggggggccctgggcaacaggcccttccgtgccttcgtggtgacagacaccacgcttacccacctggctgtgcaccgggtgactggggaggtgttcgtgggcgcagtgaaccgagtctttaagctggcccccaacctgactgagctgcgggcccatgtcacggggcccgtcgaggacaacgctcgctgctacccgccccccagcatgcgcgtgtgtgcccaccgcctggcccccgtggacaacatcaacaagctgctgctcatagactatgcggcccgccgcctggtggcctgcggcagcatctggcagggcatctgccagttcctgcgtctggacgacctcttcaagctgggtgagccgcaccaccgcaaggagcactacctgtcgggggcccaggagcccgactccatggctggtgtcattgtggagcagggccaggggcccagcaagctgtttgtgggcactgctgtcgacggcaagtcggagtacttccccaccttgagctcccgcaagctcatcagtgatgaagacagcgcggacatgttcagtctcgtgcgtgagccttccttctcttcttcctccacccagtcctggctctgcctcccagaagagccctgttctttctgagaggggactttcggctcctcagtgtctgggatgcagacaggttgcggagggtgggatgacagcctgaacccaggttgcgggggtcccctgtgtgcagggaggctggtcaccctgccctctgcagcctttctggcctgggcctctgtgatcatccaggcgggagggggatgcagagggaagctggcggtggcccgtgatgttggcacagggcctcaccggatgctgtctcctccccctgctccccaggtgtaccaggatgagtttgtgtcctcccagatcaagatcccctcagacacgctgtccttgtaccctgcctttgacatctactacatctacggcttcgtcagcgcctccttcgtgtacttcctgacgctgcagctggacacccagcagacgctgttggacacagcgggcgagaaatttttcacgtccaagatcgtgcgcatgtgcgcgggagactcagagttctactcatacgtggaattccccatcggctgctcctggcgcggcgtggagtaccgcttggtgcagagcgcccacctggccaagcctggcctgctgctggcccaggccctgggcgtgccggctgatgaggacgtcctcttcaccatcttctctcagggccagaagaaccgggccagcccaccccggcagaccatcctctgcctcttcaccctcagcaacatcaatgcccacatccggcgccgcatccagtcctgctatcgtggggagggcactctggctctgccctggctgctgaacaaggagctgccctgcatcaacaccgtgagcccctcatcaccccacactggtcctctgccctgtcccaggtctaccatgcccagcgtgggctcacggccagtcatcctgtcccaggctttgccatggccctgggagtggcacctttgccctcccacctgtttctccctcccaggggtccctgccctctccttgcctctctctgggctgcccagtgccccacttctgcttccttccgttcccagctcgttcctccttgctccgtctcccggttgccccttgtcttgagccaacaagagtcttgtgggcccaggcttcgctcctcgctccctgctgtccctcctctgtctccctccgcagccaccaatttcctggagcaccctagggcgagcagtcagtcctggctggaggggaccgggttctagatcccgctctcttctgggactcaggaactgccggcctccatcttgcgcctgggagctttgactctcacgggttcctcctctgtttcaccagcccatgcagatcaacggcaacttctgtgggctggtgttgaaccagcctctgggaggcctgcatgtgatcgaggggctgcccctgctggccgacagcaccgacggcatggccagcgtggccgcctacacctaccgccagcactctgtggtcttcattggcacgcgcagcggcagcttgaagaaggtggcccccagagccctgggcatgtgggggtggggacagtctcagatatgggacaaggctggtggtgggaacacacgggagagctctgaggacaggacaggagaggacacggctggtgcagggagggagatttccctggctgggtcccaggcgcctggccctgctcctcgggtcgccccttggccgcccaccctcaccattgccagttcccactgtggactgaattgccagcttcgtatggctctggggacagagaacagacctattgtggagtctccctgccacgagagcaggcctggggctgagccagcattgctgggtcctctgttgaatgaacaagggagcaaatgccttgcccctcaagcctccctatgcctgggacagacccacttgcccctgccctctccttggctcactacttcccatccttcccctcctacccatgggcccgggggctgaagctgcttccattggggatctgggggtagcttggcatgaagggggagatgaacttctgggcactcaggtacgtgttgaataggtaggagtcgggggactgcagtgctctcatcctgcttgcctcgtagatgcagtgccatcccccaggagggcaagtgttggtctgggggcgcagggaagggtttgtggagaaggatgatgaactctcctggcccacctgctctgttcctgggaccctcttttcctttgtagcagctttgttgaacgcgtactatccaattcacccattttaaagtgcacagttcagtgggtttctgtggatctgcagagtggcacaaccatcgccactacctcattctcctaatcaatgccatcttctagctcttcccctcccctgcatcccctgaccttgggcaacacgaatcactccgtccttctgtttgctgagggcattttctggcgtctgcaccctcctttttttggcctccgggctgtgggtgtgagtgctgaaccccaccaggtcctgacgtcagctcagccacaacctccaaagtctttggctggagaagacagtgtcccaggtgcaggaggctgtggtggcatcaggctggtcttgtggctcaggtgcgggtcgatggcttccaggatgcccacctgtatgagacagtccccgtggtggatggcagccccatcctccgagacctgctcttcagcccggaccaccggcacatctatctcctgagtgagaagcaggtgggcctgtggtgggtggcggtggctggtggggcgggggtgggctgggtgctgatgtggctgtccccaggtgagccagctcccggtggagacctgtgagcagtaccagagctgcgcagcctgcctgggctccggggacccgcactgtggttggtgtgtgctgcgacacaggtgagggcgggggcccctgctcggggagttggagggccccactggccagggggagccagccacacccagccgtgcccttgcggcctccccccgccctcctccactttctccagctaatgagtggaacctccaccccgagtgacgtccctcgggccccaggggacgcggccaaggctcgctgttgcctggcactgtgagctggacaggcctgggccctcccggggcagtggcgggaccggctctggcccgaccccgtgcaggtgctgccgcgaaggggcctgtctgggcgcctctgccccacacggctttgctgaggagctgagcaagtgtgtccaggtgcgggtccggcccaacaatgtgtcagtgacgtcacctggggtgcaggtgagcagcttgggggtgcccggctgggtgtgcacatgtgtgctgggagtccgccctgccctgagccctctgcttcccccagctgaccgtcaccctgcacaacgtgccagacctcagtgcgggcgtgagctgcgccttcgaggcggcggcggagaacgaggcggtcctgctgccctccggtgaactgctctgcccctcaccctccctccaggagctccgagctcttaccagggggcatggtcagtgggttggggctgcccaggatggggcagagtggggcctctccctacccccagcgagttcacggccaccccgggactgctgcaggggccacccgcactgtgcggctgcagcttctctccaaggagacaggcgtgaggtttgccggtgctgactttgtcttctacaactgcagcgtcctccagtcgtgagtacctggccagcacccgtccctacccctggggatagaggggacctctgggacaggcgacaccttcagggcagctgtttctggggcatcaggggctaactgtcaggccctgatagcccctgacatccccacatctctctgtcccctgatatggctgccttcttccttcagttcccgatgtgtcctattggggagcagtgaggggcagtgcagcctcctctgttatttctgaagccacttcccccccaggtgcatgtcctgtgttggcagcccttacccctgccactggtgtaagtaccgccacacgtgtaccagccgcccccacgagtgctccttccaggagggcagggtccacagccctgaggtgaggcgggcgccgcatgtgaggggctgggctctgtggtgcgggcggggccaccggcttctatgcgttctcggtttctttgagccttctccaggttgggcctggagaagggtggccctgtgtgcagctgacaggtgctttccccgcagggctgccctgagatcctgcccagtggggacctcctgatccccgttggggtcatgcagcctcttaccttgcgggctaagaacctacctcagccgcagtcgggccagaagaactatgagtgcgtggtgcgggtgcaggggcggcagcagcgggtgcctgccgtgcgcttcaacagcagcagtgtgcagtgccagaacgcctcggtgaggtcccacccgctgcctcccttcggggtctgggctgtggcgtggtgtggatcgttcttgtctatgcccagctctctggcagggaactgtctgagtctcctgctagggattcctgtacctggaggaggggggcagctggcaaaaatcttgggtaggggttctgcacatcttatctggggtcccatgggttcctttcctccagtactcctatgaaggtgatgagcatggtgacaccgagctggacttctccgtggtctgggatggagacttccccatagacaagcctcccagcttccgaggtgaaggcatgggccagggagcttccctcctaaggcaattggcactgctggggtcgggtctgggggccctagtgctccccactttccacttttctgccactgcctgctccgtcagcagtgccttctgtgcctgcagccctcctgtacaagtgctgggcgcagcggcccagctgtggcctctgcctcaaggctgatccccgcttcaactgtggctggtgcatctcagagcacaggtgccagctgcggacccactgcccggccccgaagaccaactggatgcacctgagccagaagggcacccggtgcagccacccccgcatcacgcaggtcagcctccctcaccgcccctgcccactgccaacagggcccctgggagtctgagccaactctctcactgcccatcctgctccacagatccaccctctcgtggggcccaaggaaggaggcacccgggtcaccatcgtgggtgacaacctgggcctcttgtcccgagaggtgggcctgcgggtggctggcgtgcgttgcaactccattccggccgagtacatcagtgctgagaggtgagtgcggctctgtgggtgcccgggccgtatgtggcctggccggccctgacgctctctgagccctaggatcgtgtgtgagatggaggagtcgctggtgcccagcccgccgccggggcccgtggagctgtgtgtgggtgactgttcagccgacttccgcacgcagtcggagcaggtctacagctttgtggtgcgtggctgccggccctaccccttcctgtcccttctctctcccgcaaggggcgtgtggagcagcccggcccggctcctcccctcagggcagcttctcccgcagaccccaacgtttgaccaagtgagtcccagccgtggcccggcgtccgggggcacacggcttaccatctcaggcagctctctggatgctggcagcagggtcacagtgactgtgagggacagcgagtgccagtttgtaaggtgggccggggccctgccagctttgggttgggcatcgtgtggggggccgtggggacgggtggctgagggccctgggccacccgctccaagcaccctgcttgccaatgtaggagagatgccaaggcgatcgtgtgcatctcacctctctccaccctgggccccagccaggcccccatcacacttgccattgaccgggctaacatctccagccccgggctcatctacacctacactcaggaccccaccgtcacccgccttgagcccacctggagcatcatcaagtaagaccctgggggactggggagcctggcagtgtccagagggctcagggactgggtggtctctgagctccggtggggcccctcctggagcctaggccctcattggtggagggggtggagctgtcctggctgcacagtacccggcacccactaggcgatccagggtcagggaaggcctgggctgccatggcagccttgatcgctctccagggctgggtgggtgcactggaggagggagcctgaggcccctgccctgtccctagtggaagcactgccatcactgtgagtgggacccacctgctgacggtccaggagccccgggtccgtgccaagtaccgcggcattgagaccaccaatgtgagtaccagctgccccgccccaccccgaccctgcagcccatggcttcacgtgcctggctgtccacctttgtccccacagacatgccaagtgatcaacgacactgccatgctgtgtaaggcccccggcatctttcttgggcggccccagcctcgggcgcaaggcgagcaccctgatgagtttggcttcctgctggaccacgtgcaaacggcccgctccctcaaccgctcctcctttacctactaccctgatcccagctttgagccgctggggccctctggcgtgctggacgtcaaaccgggctcccacgtggtgctgaaggtgcgggcggggtgggggcggggaggggcgggaaagtggagagtcctgggctgaagttgtcctccacccccagggcaagaacctgattcccgcggcagccggcagctcccgcctcaactacactgtgctgataggaggccagccgtgttcgctcactgtctcggacacacaactcctgtgcgactcacccagccagactggccggcagcctgtcatggtaggtggggatggggagaccccctgggcagcccagggtgggcgtggtggtcagctcacctcaggcctgtccccacaggtgctggtgggtggcctggagttctggctgggcaccctgcacatctcggcagagcgggcgctgaccctaccggccatgatggggctggcggcggggggtgggctcctgctgctggccatcacagccgtgctggtggcgtacaagcgcaagactcaggacgcggaccgtaccctcaagcgtctgcagctgcagatggacaacctggagtcccgtgtggccctggagtgcaaggaaggtgcctgaggcggggcgggatgtggtgtggaagctggggacctccctcctgcccactcattccctctctccaccccccagcttttgcagagctgcagacggacatcaatgagctgactaaccacatggacgaggtgcagatccccttcctggactaccggacttacgccgtgcgcgtgctcttcccgggcatcgaggcccacccggtgctcaaggagctggatgtgagcctctgcctggcctgccccccaccattcccttcagggccgcccccaccctctgagacctcctgctccccacagacgccacccaacgtggagaaggccctgcgcctcttcgggcagctgctgcacagccgcgcgttcgtgcttaccttcatccacacgctggaggcccagagcagcttctccatgcgcgaccgcggcaccgtggcctcgctcaccatggtggccctgcagagccggctcgactatgccacggggctgctcaagcaactgctggccgacctcatcgagaagaacctcgagagcaagaaccaccccaagctgctgctacgcaggtacctgcctcgctctatccaggccacacctttgtcctgcctgggcctgccccctgtccaagccccacccctgccaggcccgagcccccttctcttgccctaggacagagtcagtggctgagaagatgcttaccaactggttcacgttcctgctgcataagtttctgaaggtgcgccaggtgggtgggcggcagggaggtggtggcagaggaccggccagtggtcaggcaggcagccagctgtgcacctgtccctggctgcaggagtgtgctggggagcctctcttcctgctttactgtgccatcaagcagcagatggagaagggccccattgatgccatcacgggcgaggcacgatactccctgagcgaggacaagctcatccgtcagcagatcgactacaagacactggtgagcgcagggccaggcgggccagaggtaggggcgcagagagaggcctcgccccagactgacactggagtccgctttcccctcagacccttcactgcgtgtgtccggagaacgagggcagcgcccaggtcccagtgaaggttctcaactgtgacagcatcacccaggccaaagataagctgctggacactgtgtacaagggcattccgtactcccagcgtcccaaagctgaggacatggacctgggtgaggtccccaccctctcctcctggctcccactcataccctcctgtgccgtgtgacctccgtgggctctcccgctccccacctgaaccctgtttcctaagaggagtgggccaggcacttgggggctgccagcataatcttaagggctgtctgtggcccacagagtggcgccagggccgcatgactcgcatcatcctccaggatgaggatgtcaccaccaagatcgagtgtgactggaagaggctcaactcactggcccactaccaggtgaggggttggggcccattcctccccagggccacctgggagccaggaccctgccttgagctgcagcaggacacgggagcagtggccctggctcccctcgcccttctccctgggctcgtgggctcccctcctgggtgtgggtgggtgggggcgccttggcttctcagcttcctgcactgcccccctctgtctctggggcctccaggtgacagacggttccttggtggcattggtgcccaaacaagtgtctgcctataacatggccaactccttcaccttcacccgctccctcagccgctacggtaggtgtcctcagtgtggtggccatgtgcccttcgagggaacccccacttccaagtgccatcgattctgtagagtgtagacggagggtcggccagcgagggcagatgggtccccacatgctgctgagctcccgggagagtggggcaggggccaggtggtggcctaagggtcacatgcattctctgctccagagagcttgctccgcacggccagcagccctgatagcctccgctcacgggcacccatgattacgcctgaccaggagacaggcaccaaattgtggcacctggtgaaaaaccacgaccatgccgaccatcgcgagggggaccgtggcagcaagatggtctccgagatctacctgacacggctgctggccaccaaggtatgggcctgcctctcgccaccttggcctccgcccagaggttgtcccggccttacaggggaggggccatggatcatttgcttccagtgggcctttcttcgggtctttgctgtgggaactctgagccttagataaaggccatgtctgtctgagagaccactggccctgtagggaagcccctctctttgccaagcctttctgcctccatctgtcctgctctggggacatcccgacctggctccctcatagcctgtgacctctctgccccacacagggcacactgcagaagttcgtggatgacctctttgagacagtgttcagcacagcccaccggggctcggccctgcccctggccatcaagtacatgttcgacttcctggatgagcaggcggaccagcgccagatcagcgaccccgatgtgcgccacacctggaagagcaactggtatcaccccgtgctgggctgccagcagcctgtctggagactggtgggcggaagacgctggtggctctgctgagacccagggcctggagtagcatccaggcaggagggaatgaggcctggcctggggttgacactgacggtgccatcaagccaaggggcctgttgcgtccagttctggagctggactgcctgggtgggtgggatggtggtggtgaggcctttgccctctggggtcttgcaccaggtagagatgctggtggtcggtcgcaggtggtgagagcggtgacaggagaagctgcggagggggttgagccctattgagaacagaagttcagcagagacttagaggaaaggccgttcaccctaaatgtgttgctctcaccacctctggacaagatgtgagccggccggacaggaaagagatgtgcacatgggaggggccccttggggctaactagggagcctcaggcgcacgtccctctgttgtccacagcctgccgctgcgcttctgggtgaatgtgatcaagaacccgcagttcgtgttcgacatccacaagaacagcatcacggatgcctgcctgtcggtggtagcccagaccttcatggactcctgctctacatccgagcaccgcctggggaaggactcgccctccaacaaactgctctacgccaaggacatccccaactacaagagctgggtggagaggtgggctccgccctgctgtgggtggcagagggcaggacctgcccctccctgggctgcctgtgcgaggcaggccagctacaggcaggaagcccgggggctggctgggcagtgagggcaggggttctagtttttgtgatgtcgcctgagtgacatactcagggtcccaacaggtattatcgagacattgcaaagatggcatccatcagcgaccaggacatggatgcctacctggtggagcagtcccgcctccacgccagcgacttcagcgtcctgagtgcgctcaacgagctgtatttctatgtcaccaagtaccgccaggaggtgtgtgtcatccccacagactcccagttacttggtcctgaaggtgcagccagtgacaaaggcaggagggttggtgggggttggggattgttcacggtctctcccctgaccagggcctggggccggcacaggtgatgctctctgggatcacaggtagatgctggaatttgagggacccaggagataagccactggctgggtacaaagtggccactgggcaaaagttaaagggcctgagcactggaagggatgggtcaggctttgtgatgagaaatagccagaggcaggaggacatagaggtgtggactttaggatggagtctgggctggacacatttgcaagcctgtggatggcatttaaagccctgagcctggatgagctcacagggaagccacaagtgggtgtggagggagaagcggcccaaacactgagcccagggccccaggacacaaagaggggaggggaggggaggtgcagcagccagcggggaggatgcctgagagcgcctggtggggtctggcaacctgagccagtgaggacccctcacaggtcagggagtggcagtggccggctccatcttccagtgctgctgctggtgaaggatggtgacctgcagaacactcactgggtctggcgagggtcacggggtcctggcgcgagggaggcttgggctaggaggtaatgggagggggaatccagcacggcgagtccagagtccaggtcactctagggacaggccgcaccctagctgtggagaggaggaggagaaagtgctgtcgtcggaggggcatttggggctggggagagctggtgggtttgtacaggggctgcgggggaggacggagggatgaggcgtgtgggagggaggagcccagctgggaagtggggactttgcatggcaggagctgcgccccctacagagcccagctccaggggactcctctcccccagattctcacggctctggaccgagatgcctcttgtcggaagcataagttgcggcagaaactggaacagatcatcagcctcgtg

SEQ ID NO: 174 - DNA, 32613 bp, mus musculus
tacaggggccagctatgctcccgggagtgttgatgttttccagtcattccggctgacagcgttcaagttggaatcctggaggggaggtgtttttcctgtcgtacgtgggacaggccacgctgtccgtccgcagtaccgacgcctgcaggtcagagcttcggggagaaaagtgaagagcaagacggaactgacggggagaaaggctgggaaccagggtgtcgactttgactgaaatttgagacggagggcaccggagggcgagcactcgcctgtgattggcccgtgggcgtcgtcgaggtcccacgcagctgctcaattggttggtgttgcaattgttgtggcggcggcggcggcgattttgcccacgtacttccgagtaaggggcggggctgtgccctggcgcgcgtgcgcagcgccccggggccccacccggtagtgcaagaacctgcgagggggcggagcgaagaggtgcttgttttggttctgtttcctttgaagcagaaggccggaacaagcgtagcaataaacttgctggacttggagagaaggctaagacaaactcgccgcactgccttcatcttggactttacatccgggttctcctctcggcgtgacccgcgcgccgccaccgccgccgccgccgccgccgccgcctccgccgccgagggttctcgaaccggtgccgcgatccctttatccgggtctcgccgttcccgtcgtgcctcgcgcactacactagccccctcatccgggttctctcccggcgtgccccgcgccgggtttgttggggggtactcggcagtgcagccatgactatactccccaaaaagaagccgccgcctcccgacgccgaccccgccaacgagccgccgccgcccgggccgatgcccccggcgccgcggcgcggcggaggtgtgggcgtgggcggcggcggcacgggcgtgggcggcggcgatcgcgaccgtgactccggcgtcgtgggggcccgtccgcgagcttcgccaccgcctcaaggcccgctaccaggaccgccgggcgctcttcatcgctgggcgctggccgtgccgcctggtgcagtggcgggtccccggccacaacaggcttctccacctccttgcgggggcccaggtggtcccggcggcggtcccggcgacgcgctgggcgcagcggcggcgggtgtgggtgccgcgggcgtggtggtgggtgtgggtggtgccgtaggcgtgggcggctgctgctccgggcctgggcacagcaagcggcgacgtcaagctcccggggttggcgcggttggcgggggcagtcccgagcgtgaggaggtcggcgcaggctacaacagtgaggacgagtatgaggcggctgcagcacgcatcgaggctatggaccctgccactgtcgagcaggtaagagctgtggggtgaggggtgagcggccacggcagatgggacccccagactgtgaagggactcaaggaaggctgtttgagatcgccccaagggatctaggcgttttcactgggcctgacagtcttctctggcggtagggatgtgagacaccttctttcctcccctccaggattttggggctagaggcctacggtaaggtgtcagacttaaagatccgaggtctcttttaaggtctatagtcgtcattccagtccctgggacctcatcatatagggccaataggtgggaattctccaagagatacaggtaggatcgcgcccctcttgagtaggagtctcaggtctcccaagagacttaggtatgtgttcagtggcttaagagctcttttcctctgggatagaagtttgagattccccttccaggaaagtcaaataaggtggagacctcggagatcggggctgaacatccccaaggagcctaagccctttcaagagtctgagacactctgcatataggacaatcctctcccgcttcgctgggtaacactgcacaggaccactgaatagccagacctgagacctcaagggtcctaagtctgtcttcaggggcctgagagtcctgcttctagaatcaaggtcctgacacacacacacacacacacacgccccctttaaggatagggatcttctaagctttttccagggatgtaagacttttcacagggagatatgattcccttgcccttggggacagggaccaaaaccaacacccaatgaccagcagctttacttatctcctttctgagtgacaaaggtctgcatttcctatcagtggcctgagacctacctcttgggagacaagggcctgaaccgcttcaggatcttaagcttcttgtaagaagagatgggccctcagcacccccaccaggggcctgaacctttcttcaggaaaatgagactcacagcgttggatcctagggcctaagatccacctgcttatggactgaggtttttagagaccgagtctgaggcctcttcaggggcctggtgtcctgctgcaaaggtctcagacaaggtgaagtctttaggagatccttcttctcaaggctggtgtctgagtggttttggggatctgagactccccaccccacgagcatatgtgacccttttaccccaattataagggactgaaacataccttggggatacagtatcccattttcccctctgtaacaggggtttgaggccctcccaccttgggcctaagctttttgtcagggacatacgacccatgccttgggaacttgagcctgagacgactactcaggggacatgggcaacatgggatcccagagatgatgtctggggcctccctacagatctttgcctacttttaagggcctgagacccactctgccaaggacacttgagctttccttcagggacaggagactcatacataccttggtgacttgtgtgtctagaggtaaggtctgagcttcctcctcaaggaacttaagatgtacacctgagaaacaggaggactcctccccccagacctgagccctgagactcttcccttggggcatggataaaggatccctgtggaacagggtcctgagtctacctccaagggtttgaatcataactcaggtgtgtgaaggcctgttccccaccttaggacctgatttctgaacctgccctgagggtactgtcacctcacctcagacaacttacatacaccctagtcttaggggtcatttagggacataagacttcctgcctcggggacttgggccttagactcccaactccttttggggacatgaatagggtaggattctgaggaaaagagtctgggcccaagctttctctctgggacaagataccgtttgccttagggactgggggcctggctcccacttgggcatgaggctctcctcctaccacaccaggcaatcctttctgtccagggagaggaacgtgaggtcatcctctcccattggacagaaggacctggatgctcttcagggtcatatgaaccccttatccagagctccctcgtggccagggccaagaaggtcctcctactttctatgagaagattgtcaggtcctggggacatggagtctggagcctcccttctgaaaccaagagcgattccgagtctctccctgacctagctatgcttgcttctcacctctaggtcatataataagttttgaactgcttttgacaagcttttttcttcccagggacaggaaaggggtttgggacatcgccactctggggaaattctcctcccacattccttttccccttggctcaggtaaatctttctgtacttcacaggggccccaagccttgtcttgagctccttgttcttggtcccttcctcccatcattaattctggcacgataagccatttgtactcaagggtcaggaccagttatttcttctctctctggttgggtagtttctttcctcctctagaagcagggagccatacatcactggtcctagggacagaggaaaaacatcctatgcagccatgataattcaaaaacacctccttactcccctcccttgcgatacatccctggtcccagggacagagagaaagaacatcctatgctgccatggtaactcaaaaacacttccttatgccccttgcagtccctcccttatacttgtccccataagaacataggagtaagccgggcatagtggcgcatgcctgtagtcccagctactcgggaggctgaggcgggaggatcacttgagccctggagttcaagacctgcttggcaacatagcgagacctcatctttactaataaaaaaaaaagaatatgaaaatcaagttttgtgggttcatgaaacctgcccttcccaatgacaggagaggctttctgtccccacacttcttaggacaaagaaggtgatcctcttctccctgcctcacctggtccaacttgagagcttttggggatgagaagagggaagattcctcctgccaccccagtcttggtcctaaactgtcactgggggtggttgtagcctggaggtcagttggatcccttgggaagagaggcgtcgttgagggggagtctagatggcgattctggggttctgactacttgggcttcctctttgtcctgattctcttgtatccctacttcctttaggagtctttttggcactctggggtccaggtgctgggtgggtggtgatgtcaggggttcccaggcatggctgccttgctgagagtctgctctatgaaaaggttggcctgtaagcatcctgagtttggagaccccacagagctctttgagaaggggcatgtgaactgaggtggtggaaaaagctgggtgtggcacggtagttggtgcctgggttccaactctgggtctttcaaggctttgctggatgaaccagggtaggttctacctatgctctctgggcctcagtttcctcactggccaggcaaaatgctggtgaggtgttgtttagctttgggattttagggaactcagtccaaagttctctggacctggaggtggcaaagaatggtggatgtcttttgaggaggaactgggtttctcccctctcttcctggctcctctgttccctctcagccatccaagcttggtgggcaggacaagcagcctgttttgtgtgaggctcagggttgatgaacagccattttttgtgggcagccatgttgtaatgaacaagctcgatgggatttcctgtcaggaggcctgttggatagtggtgtagagaggtagagttgtgtgtggagtttgggctttggagcaaggcaagctttgagccatcatccctcaattctctcatcacctccagacctcagcatctcctccttacctgctttatagctttaggcaaactacttgccccctcagctgcccattttgcaaaagtttgtccatgcccaggtgtgtctgaccttgctcaccttggaccttggccggttcttcctcttgcccagaatgggcagtttgccccagggtcatcttggttcttcctaggagcctttgtccactcctagtaacctatctttgatagcaaaggcccttcatttggcatctaggaacctgctgatttcttgggctcttcttaccccaactggaattgggtagctagctggtggggaagcaggaaggggtctctgcccaggcaacgtggatttgagtcctgtttctgcagtaagcttttctgtggtcttcaggcagttctcttttctggttcttggtttctccctccatgaaatgggtagtgttgaggagggaggttggactcattgctctgaagcaagttatagtctcctccctgctcccactcccctcacccttcatgaaagttttaagtgggaccccttggcctttggggattgtgctaggacatttcaagcagtgttcagcgtccttggctggtgctgagcccttgggtgtgtttcttttaacaactttaatgagatgtaattcatgtaccatactattcacctctttgaagtgtacagttcagtggcttttagtatattcacagatttgtgcgtccatcacatcactacagtccattttagaacattttcatcaccttaaagagaaatccagcactctttagctatgatcccccaatttcctcatccctttccagcctctggcaaccactaatctactttctggcttgattgatttgtctgttctggatgtttcatgtaaatggaataatagaatatgcagttgtttgttacttggcttttttcacttagcataatatgttcaaggcttatccatgttgtagcatacatcagtgcttcattcctttctattactgaataacaggaccttgggtttttttgttttttggtttttgtttttgtttttgttttttttttaaggcggagtcttgctctgctgcccaggctggagtgcagtggcgcaatctcaggtcgctgcaacctccggcttccgggttcaagtgattctcctgcctcagcctcccaagtagctggggctacaggcatctgccaccacacccggctaatttttgtatatttagtagagatggggtttcaccatgttggcaaagctggtctcctgaactcctgacctcaggtgatctgcctgccttggcctcccaaagtgctgggattacaggtgtgagtcaccgcaccctgccaatcttagaggtttttaatccccctgccctcagtggcctagccaaatgttggggccttgctcttctccccttctgccctggagggcttgtgttggtccttagagagtagtgtgtctatgttcctcgttggatgggttgcctgtgtgtgtttttttttgagatggagtctcactctgtcccccaggctggagtgtagtggcgcgatcttggctcactgcaacctccacctcccaggttcacaccattctcctgcctcagcctcccgagtagctggaactacaggtgcctgccacctcgtctggctaatatttttgtatttttagtagagacagggattcactgtgttagccaggatgatctcgatctcctgacttcgtgatccgcccacctcggcctcccaaagtgctgggattacaggcgtgagccaccacgcctggccccctgtgttttgtccatggagccaggctagtgttcctgggtgctttgctggagggggtggtcttggcaccagggctgctgggacagagctgtgagtcacagaatgctaaacaccttttgaccataggctctgggaagacatctgtccatgaactgccactgctgctgccatcttttgcccccccaccccacccccacttcagtggcagctcatccatccataggcagggtcagtagtttcccagggtgagaagggagattccaggcccctgctgccttaattctaacctcccaccctggaggatggtaggcaggtggaccttgcagagcgggatccatgccatattgtctcacacctgtgaggcactagggaacagacaccaaggagtgctaccaaggggggtgtgttagtttcctgtggctgttgtgacaaatgttaccacagactgggtggtttaaaacaacagaagttggccgggtgcggtggctcacccctgtaatcccagcactttgggaggccgaggcgggtggatcacgaggtcaggagttcaagaccagcctggccaagatagtaaaaccccatctctactaaaaatataaaaattagctgggtgtggtggtgggtgcctgtaatcccagctactcgggaggctgaggcagagaattgcttgaacccaggagacggattggaggttgcagtgaggtgggggttgcagtaagctgagattgcgccactgcactccagcctgggtgacagagcgagactccatctcaaaaaaaaaaaaaaaaaaaaaaagagagagagaagtttattctgtcacaattctggaggccagaagtccacaatcagtttcactgcatccaaatcaaagtgttggcagggccacactccttctggaagctctcagggagaatttagaccttctctagcctctcgtggctgccaacattccttggtttatgactgcatcattctaatctctgcctccatcttcaccatcgccttctctgtatatgtggtttccttttctgtctgtatcaaatttccctctgtctctcttttataaggacacttgtgattgcatttaggtcctacctgatactctaagataaccccccatctccagatttaataatgtaagttaattacatctgcaaacactttttttcttttctcttctctttttttttttttttttgaggtggaatctcactctgtcacccaggcgcagtctcggctcaccgcaacctccgcctcctgggttcaagctattctcctgcctcaccctcctgagtagctgggattgcaggcgcccaccaccacacctggctaatttttgtatttttagtagagatggggttttgccatgttggccaggctggtttcaaactcctgaccttagttgatccacccgcctcggcctcccaaagtgctgggattacaggcatgagccactgtgcccgggcttttcttttcttttcagacagtgctggcctctgtcacccaggctggagtgcagtggcgtaatcttggctcactgcaccctccacttcctggactcaagtgatcctccagcctcagcctcctgagtagctgggaccacaggtgcgagccaccatgcccggttaatttttggtgtttatttatttgtttttgagatggagtctcgctgtgtcacccaggctggagtgcagtggtgctatctcggctcactgcaaccttcgcctcccaggttccagcgattctcctgcctcagcctcctgagtagttgggattacaggcgcctgctaccatgaccagctaatttttgtatttttagtagagatagggtttcaccatgttggccaggctggtctcgaactcctgacctcaggtgatccacccgcctcggcctcccagagtgccgcgattacaggcgtgaatcaccgtacctggcctgtattttttgtagagatgagatttcaccatgttgcccaggctagtcttgaactcttgagctcaaagcaatctgcctgccttagcctcccaaagtgctgggattgcaggcatgagccacgacgcctggccctacctttttcattataaggtaacatttacaagttccaggggggttagggtttgatatctttgcgtggctattaatcagcctactagagaggcttttttccctcctggggaagggaagggaactcattaagtggtctcttactgggcaaagccctgtaatatttgagtctgcccagcatccctattattgggaggcttggtatccccattcacagattggaaaactgtggctcagagcagttcatcatcacatggctaataattggtggagctagattggaacctaagtcagttgggttccacagcctgctccaacttcacttgggcccttagaccactaggttacagaatcttgcctcagctcctgggatcctctggtgttagggagctttactcagcctttttgtggaggctcaaagatatggagggattttcccataggctcagcgatgagtttgcaaggttcacaatctcctcaggccagggcattgttggagcttaaacttatctatggctgagctatcccctaccccccacccctactagcccttcctgagcaacattttctccccaaaaggagaaagagaagggccagagcccaaactcctcaggctgctgatgacaaagccagtgggtggctagcagtccagcctctagatccaagcctggatgccagtttgactgccccaggacccaaaccctgcagtgcgaggggcctattcaggtctctttcatgtttagagacaaaccaggatattctgtggatgggctgcaaggtatgtcctccatgctgtggctcgtgggggccttccctgttgcctctacactaggctttgctggtatccaaactccagctcctttctctttctgcctttgtttttttgttttttgttttgtttttgtttttgtttttgagacatagtcttgctctgttgcccaggctggctggggtgcaatggtgccatctcggctcactgcaacctccacctcccgagttcaagcgattctcctgtctcagcctcccaagtaactgggattacaggcacacgccaccacgccctgctaattttttgtattttcagtagagacaaggcttcgccatgtcggccaggctggtcttaaactcctaacctcagatgatccttccgccttggcctcccaaagtgctgggattacaggcgtgagccaccgtgtctggcctcctttctgcctttgtaaagtgagggtaatgtttcctgccacctgggctgtggtcaggaaaattaaacgaggtcaccctttgcatctggcatggggcaggtattcagttaatatgagttcatctttcttcctggtcctccctgcttacctgcctagtactacccagaactttagctctactgaattcattgctgggctccaggcattcctggtacttcgtggcagaagtgacttcatttctcatccagttaacaagcatttttggaggtcttggtgttttaatcctttggtcaggtggcacctcctctcaggtgctagccttaatgactgtgtttctttttttcttttttttttttttccttgagacagagttttgctcttattgcccaggctggagtgcaatggtgcgatcttggctcaccacaacctccgcctcccgggttcaagcgattctcctgcctcagcctcccgagtagctgggattacaggcatgcaccaccacacctggctaattttgtatttttcagtagagacggggtttctccatgttggtcaggctggtctcaaactcccgacctcaggtgatccgcccacctcagcctcccaaagttctgggattacaggtgtgaaccaccgtgcctggcccaatgactgtgtttcttttcttttcttcttttttttgagacagagtctcactctgtcgcctaggctagaatacagtggtatgatcccggctcactgcaacttctgtctcccaggttcaagcgattcttctccctcagcctcctgatttagctgggattacaggcatgcaccaccatgcccagttaatttttttttgtattttttagtagaaacaaggttttaccatgttggccaggctggtcttgaactcttgatctcaagtgatccacctgcctcggcctcccaaagtgctgggattacaggcgagagccacttcgcccagcctctttctgtttcacaacacctggcatttacatttttcacagccttgttcataccttgtggtggttacctgtttccctacccctctgctaagtagtttgtgagcttatcaagagtggagactaagtctgattcatttcactgtcctcactgcccagcccagtatcttacttagtagctacctggtaagtctttcttgaatggataagtaggagcccctctcctgtttgatctccttttctcctctctttttcccctctctccaaagccaggaagtcgctgtgttcccttctttttaagaacctattcttgtgtcaggtttgggactatagttgtggttgcaccatccctgctggagacccctggctggggcaggcccatgactctgggagatggctgaccatgtgtggccaggatggacttgggcataactggctggagtgtgttaatccacaggcttgggggcaaggagggacacctggactactggaatgttgtgcacaaacaggagtccttgtgctgcgcatggaagctcattaagggcttccaggtgtctttgtcatctctagaaatccagccacattttcctggggtgtgggccctgatgatgggactggctgggtattcccttgtcacctcttcctcccctcctgtcccgctactcacctaggactttctgagggtctctcagttgtgcataatctctgtgctgatctcctccccttctgtgattggcgacaacttcccctagtatatggtacgttatttacaaagcttctttaggtcctgaaactcctcacagctctgtccggtagatcaacatatcccccattctataggaaactgagagtgataacagacagcaagtgtgtggcaaagctggggttggaacccagagctcttgcgttccaaaccttgtgcttacaactttgccagagatgcttctcctctggctttcttaggggatgggttccaccccttgcttgagctggggaaaaatggccttacggataggtgggcccctatgtctggtctctaataccccagatcctataaatccctgggcaggcctgtgtccacaaggagcaggcttgggatcctgtagtttgcagccttgttgctaggtcaggctggctgcttctggtagccagcagagggcgtgaggggcccaggaaaggtctgctgcttctggttggttttgttttgaaatgaaaattatgttttaagaggttatatggtcattatttttttaataaaaaaatatgcatttgtacaggttcatttaagttgaaccttcgtggtgccaggtgtgctttggaatttaggaaaaaaacaatttataaaacttacctggtgtgtatactttgtgttacataacacctccagcagggtctgaggcagcacctcataatcaaacacctgaatgttttctgcattgaaatatttgaatatttaccccaagtgggataaatagattcttgtcagttctggtcaggttatgatgccaaatgaattagataaagacttttgggccgggcacagtggctcatgtctgtaatcccagcactttgggaggccgaggcgggtggatcacgagatcaggagatcgagaccatcctggctaacatggtgaaaccccgtctctactaaaaatacaaaaaattagccaggcatggtggcaggcgcctgtagtcccagctagtcgggaggctgaggcaggagaatggcatgaacccgggaggcagagcttgcagtgagccgagatagtgccactgcactccggcctgggcaaaagagtgagactgcatctcaaaaaaaaaaaaaaaaaaaaagacttgattttcaaagctttttgggtttagtgtaactttataaaagggaaagtgcaataaaatcgctgataacaccaggacttagggatattttgctgtctagccttcccaattttgtgtacgtgtgtttgtatacatacatatgtatatatgtgtagatatctgttaaatgtgttcagtcacagatgagaacattgtttgcacacttttgccttctagagtatatctcttttttttttttttgagacagagtttcgctcttgttgcccaggctggaacgcaatggggtgatcttagctcaccgcaacctcttacctcctgggttcgaacgattctcctgcctaagcctcccatgtagctgggattacaggcatgcaccaccacgcctgactacttttgtatttttattagagacggggtttctccatgttggtcaggctggtctcgaactcccgacctcaggtgatccacccaccttggcctcccaaagtgctgggattacaggtgtgagccaccatgcccggcctacagcatatcttggaatcctctagccctttgtcaggttcaggatctaggctcttgctagttaccccctcttcaccacctttcctagatgaaactccttgaggtagagccacattctccacccaggcacttgctgggtctgagtctctggctgcctgaggcagtgtggctccctgggccaggccctgcaaggtcaacagaagccataaggcatatggggccactgttctcagggcacctaggacccttttggaagtaagtcttagtttcactcagcaactaattccctaaaagagtctcctacttcacatgcatggagtggtcaaacagggctgagaactttaccttggccagcgtcctctctgtcaatgatctaggcctctcgggagcttgaggtcggggccctggggagggagtacaggttttccctgttgctgacccccacctcttccctccagcaggagcattggtttgaaaaggccctacgagacaagaagggcttcatcatcaagcagatgaaggaggatggcgcctgtctcttccgggctgtaggtgagtctctgccttagtccttaagggcctagggctgcccctaagctgtgtcccagttatcaggaatagcccctgagacagggttgaggcagagctagctaatcttttagggactctaggctccagcctcaagttggtatctgacctctagccgtgggtcttgagacattgtagtggtgcaagattaatatgcataataacagcaagaagaatgataaagaaaataatatcctttgggacacattgtcaggtgctacaggaaacctctttgattcccctctaagctaggtgagtgtagggactactgttgcttccatttgtcagatgagaaaagtggctcagagatggtgggtgacttgtctggagtgaaataataagtggtagagttgggattcagtgtctgggttagattagtctgaggcccatgctcttaaccatagcacactgctgccaccctgggctgtatgacccctaggtttatacccagatcccatctctggtgtgttgcgggtctctgttcctcaatctgtgtgtatgggggctatcagactagatctttacaaatttcttatatcatagaattttttttcaacttatataaaagtagagagaatgatgaaccctcatgtacccatcatccagcttcaaaatagtcaatacgtggccagccttgtttcatcactatcccgcccactctttctcactcccctgaaagaagagtatttttaaagcaaaaccccgacattggatcatttcattcataaatatttctgtatgtttctctgacagatacagacttactctcttctttttaacataatcaaaatgccattactgcacctaacagaattaataatgccttaataccatctgttatccagtctgagttagatctttgaggccattttggctctgaatctgtgacccaacaagtagttgtgaggtcctgtgctagggtgaaggggaagctgggaatgtgacctgatcctccctgtggttctctgatatctaccaaggaaaagtgccctctgataggagctttgagctgggagtcagaagacctaccttctagttctggccctgactcataactgctgtgacacttggccttggtcttcccgtctgtgaaatggtgttgattctcaatgcctctttgagttccttcttggtctgctattctctccgtctgtgggtaccccccatgtctactggtgggctggggtgttttaggctccatccctggctgcacaactgattcttggtatgaccttaggcaagcagctcttctttcctgaggctgtttcctcatctgtaaaatggggctaaaagaccctaatgctgtaacgatttaatgaagttgctttggtaaatccctttagtgcctgacacatatagtagaccctcatggaacagtagcatttgtaaaacccagatgccattttcactggtgcctcagagtcacatgtgtttgttgaaagggtggagtgaatggtctcctctctattctgccaagcagaagaggctcaggcaatgggctctattggactgggaaaaaacttatccctcctacccctctggctcaagtttgtgttttccctgggatgtttcccagaggaagagctgggtttcggggcatcttggacaaaagaaaggcaaagaaagaataggtgggggcctgttaggtgctaggccctgtgttgagacctcaggctagatgtggggtaagcagggcttctggtggagttaggattagagaatgcagcgggcatctgagtcttgggcagtcattgagggtaagccttgggactggctagtgaggacctggcttgtgtagtaactcatatcaagagccgtgtgtgtgtgtgtgtgtgtgtgtgtgtgtgtgtgtgtatctagctagctgttctctgtgtgtgtgtgtgtgtgtgtgtgtgtgtgtgtgtgtgtgtatgtgtgtgtgtatctagctagctgttctccccaaatacccccgacccttggggctagctagtgaggacctggcttgttgtagtaactcgtatcaagagcagtatttgtgtgtgtgtgtgtgtctatatgtatctagctgttctccccaaatactcccgacccttcctcccactggggccttcggtaaggggcctctacttacaggaagagctgaccagggcaggttgaaggcctttccttatcggcactatggctacacatttcccctgactgggctgcctttggcttttctctgtaaaacctcagaagtcctctggcctctcccccgaagtacatggcccttggtctctagaccttatctggaggtttccttggtgcagagtgcataatacatgtgcctgggaaggggactttgtccctgggctttttgctgcccccgtttccagcctcgcctggatggggacagatggcagtcagcttagactgtagtgtgaagccctacaggctgacttcctgccatgtgttgaatagtggaaggaacgtggagcagagagttggagttgggcgggggctgcaaacatagagggcactgtttccttgacccctgctgtgtgctaggcattcagctgggtgcttcaggctcactgcaaaacttggatcattatcccatgagacaggtgaaaagattgaagcatagaaagggaaatgacatgctcagggccattagccagagctggcctgggaacccagaggtgtccaaaggacacgcattcttttttttttttttttttttttttgagatggagtctccctctgtcgcccaggctggaatgtgcagtggcgtgatctcggctcactgcaacctctgcctcccgggttcaagtgattcttctgcctcagcctcctgagtagctaggattacaggcgtgcaccaccacacctggttaatttttgtgtttttagcagagatggggtttcaccatgttggtcaggctggtctcaaactcctgactttgtgatccacccgctttggcctcccaaagtgttgggattataggcatgagccaccgcatccggccaggacacattctttttatgatcctaggatccttagcttcttagcttggttgtcaactggctggatgaccttggctgtgttccttgacttctctggaccttacctcctccaagtaggagcacgtggccctctgttgttgggagtcttgaggcaggtggctttctgccttctgttcccctggattatcttcctatagggtcctaccatttgctttagagacttctgagaattgcctactccccaggtagctgcctgcctgccattggttcccctgagttaagcaatatccattgcttgcgctcagttctctcccacctcctcttattggggattcatgagcatcattgaaggcttgggtggagtggaggtgggaacctgagcctcagaggtatcctgtggcccaccctgtccctgttatgctcagataacctcctcctggaaacatgactctgcatctctcccttgctccctccctccatgtggctttgactcagcagaaacctctaaccctgaccagggtcctggtgctagcttctgtgggcagagtgaaggccacatggttgtttctacatgggccatgggggagtggcaagggctgtgcatgttaccacgatgaggcccagaaacattagctaggcccactcttctgggccttttggtcttggaacatcagcactaggagggatggatctgagatcaattttgattgttttataaatggggaaactgaggcctcaagagaaagccaagaccctaccctatctaggtcatacaaccagtgtcagaacattggtatttgaggttgaaccaggccacagaaagaagattcccacgggccatttcctgtacaccagcttccttcagcctctcccgtgtatccttcaggtttctcatccttgcagtgggaatccttgagcagaggagcacacatctcaggaaccagactatccagtgggatgagttctgtctctcccactgagggtatgctagttggggtagttggggctacagaccaggtcacaccacagctgcttgacaggcaagtgagacctttgtcctggctcatctcctcaggagattggttctcagtggggccagggttcccactggaccaggagggtagtggggagcagaccaggtccctgtctccctctgcagctgtgtgtacacacgttagtgtggtttgtttttaggttccctgtagacacctagcttccttttttgcccttagcggaacttgctgtggctcttctgggaggcaggcagctacctggggagtaggcagttctcagatgtctctaaagcaaatggtaggaccctataggaagataatccaggctctcatgtcttgcttcttaacataaatctgggtacattattggttacattacattagttacataaggacttcccccgggcaacagaggagagaggttgaggctagtctgttagagctcttggttatttcccctgccctccacctaccctgccagaggccaggaaggaggttggtggggtagggggtccctcagtttatagagcctcacatcttcagtctttcctgaagtggcaagggcatctactcattgaatgtgatagttctctgttgtgggatttgttgggtgagcatttggcctcagggagcatctttggcagtctctgctgtatgtgtatacacatgtgcatttctatactggtgtctctgtgtgtccagaaaaaggaaagaagtggggtgtgtatggggagggtaaggttcatattggcctctgtggccctagggagagatgcagcccctgatatctataatctctgccctctcccatgcctttcctgggttctagctgattcctgcttgtgctggtgtggaaactgaggcacacaagatcaggtcctgccccagggagtaaggtgactaagatggtggctggattggggtgaaggtggtaatatcagctggggccagcagttaccctttgagagcctggcctccccttcactccccctaaatctgtgatcccaggcaagctttgccacatttctgtgtctcctgggtaaagtaagagtgttttggtaaggatagaatgagttggagtgtgaaaagtctttggtgtgggaccaattgtagtattgtactgaggatttctgagccctgtttgagatgggaacagaggtagaatggtgggggacccccttccagctggcctctgggaggggagaacaggtgcagattgcccacaagtgcagcgtcagcaagaggaggagtttcagtttctatcaaaacaagttctctgaattcccctacctctgcaggtcatccccccaacctcagacccctccacagggaagtcaagcctggcccccagccctgtgtgccagccttctgggaagaggagggctttctggaggacagaggtggagctaggaaagtcagaaaaacgaattcttttttttttttttgagacagagtttcgctcttgttgcctaggctgtagtgcagtggtgtgatcttggctcattgcaacctccacctcccgggttcaagcgatttttctgcctcagcctcccaaatagctgggattacaggcatccaccaccccgcctggctaattttttgtatttttagtagagatagggtttcaccatgttggctcggctggtcttgaactcctgacctcaggtgatccacctgcgtcggcctcccaaattgctgggattacaggcgtgagccaccacacctggccaaaaatgaattcttgttgagtacttcctatgtgtttagctctgtgcttagatgcttttcctgccttatattattggagaaatccttctattctcccttgttgggatagtactattgctgttttccttggtttggagatgtatattttcttccacgttaatgattccaaacttagggtataccttataatcagtgtggtgtgtttcccccctcaaaagctgtgattaggtacatgttataccatatcacctatcagtgccatcataggattgaggagagaaggtggtattttacattttacagataagtaaagaagtgtcataactcgtccatactttaggaccctgttttatgaagcctgtattgttaattcgatattaatttaactgctgaagttttgttagaactaacggcctagaggtagacttgtggacctttggtttcgctaaaggtagagagccaggagaggacatgcatcctaggtctgcatttggggctttcctctggctgaggaattgcaacagaaatgaggaagggcttcataagtggttatggcaacattctggctgactcgtgggtaactagcatatgaaggaatcattgtcgtcatgacaaattgtgttcctgtttcttgaccacctactgtgccttaggtgcttggcaaacctcctgtgtagttttgacaacacccagcagatggaagaggagttactgtctccaccttatgcatgaggacatttcagcttagagaggttaaaggccttatccattgctacacagctaggaggcagcagagcctttctgccaggcaaaggggtcagtggcagagaaatgggaccctcagggggttttcccccagatcccttccctgttccacagtctcctctctttccccattttcctgcatctggcatctagctcttgaagatagaactcccaggcctggaaatgaccgttgacctttccataggagatgggctttctccagcacctcagcctatctctctgagcctggccagccaacccctatttaaccccttcattctcatctttgttcctgtttactgcagctgccaacagcactgcctcccagtaccccaagctcagtctacagaaatagctccccaagtagctcactgtgcgggctctgtggtcctggcttctaagaaaggcagcagcagggggcccccagcctgtgcgcaggacatgtgacttgctggaaatgccgctggggagggcgggggagagtgtggccgcagaacccacatccttgtttacattggtgaaggggctaccccccttcccgccttcacaacctccacacccccttacccttcaggtctcttcacctccaagaggactggagacaaacatgggccctattttctatctcagagtagcctttctcacagaacactccagggtaggaaggggaaggcagggaaggtgttcttctgacagttcttcagagaggtagactgacagggaagaactcaggagtgttcctgtgtgacctgaccctagccccatgccccagggagatcccatcagagcagtggtcctctggggaaacaaagggaaattcccaaaaccagtggaaatcagacttgcatgatcttcaggcccactttaatttcacagggagaagagctccctggcttacccagcctatccatttgctcagtaaacttttcctgatttcctttactgtatcgggccctgagctgggggtggactttggtgtgaactgccctttgccttctgtgggagcccagtgtggtcgggcagaagtctatgcacacctttgataaatctggtgatagaggtgtcctgggtagtggggaactgtattaaagaacatgttgggccaggcgcggtggctcacacctgtaatccaggcactttgggagtctgaggcgagaggatcgcttgagcccaggaggtcaaggctgcagtgaactatgatcgcgccactgcactccagcctgggcgacagagcgagaccttgtctcaaataaataaataaataaagaacacattggtgtttgagaagtaggcagctgacgaggatggaaggagcgtcctgaagagaaggaacggcatgtgtgaagatcctcaagcgaagcagagggagtgtgtttccttctcgccttagtttgaccaaatctcacgacgcctggactattcgggccacaggctgcccatcctgagttaagctaaagttagttgcatgtgtgtcttatctcttttactagactgtgtgctccccgaaggtaggggcaggattttactcacctctgtcaccttcacagtaccccacattcaggcctccctacggaggaaggaattctgatttactctgtggctactctgtcccaagcccagtggtagttattttatacccgttatctcatttaatccccacaaaaggcctgccatttggttatccctttttttttttttttttttttgagacagagtcttactctgtcgcccaggctggagtgcagtggcatgatctcggctcactgcaacctctgcctcctgggttcaagcgattctcctgcttcagcctcccaagtagctgggattataggcgcccgccaccatgcccggctaatttttgtatttttggtagagacggggttttaccacgttggccaggctggtctcgaactcgtgacctcaagtgatctgcccaccttggcctcccaaagtgctgggataacaggtgtgagcctccacgcctggcctgttatccctctttttcccattttacagatgaggtatatgaggctcagaacacttgggtcacttgcctctggtcactcaactctctagtatctggcagaactgggcttggagcccatttttttttctttcctttttttgtctttgttcccttttttttcagcctacaaaggccatgttgacttgtaggagtcaggaaaactgaattcagagttgactctgtcacagactgactctttgtgaccttggacaaaccacaaactccccctgaacctcagtttcctcatgtggaaagcaaagggggtgtgggaatcaatagcatttgaggccaacctgtggaacttagaatgttgttgatttctctgagtggccacgtgtaccctagacaaagtcatctgcccaagaggcctgtggatgtgttcctctcacctgcactctcttgttcttcaagtctggccctgcctgccatatttttccatgaccccgttctagcctacaagggcaagaactctccaggccttggggtagaaaagggaatttccctggtcccccagttcctcctccccaaaggatgttctatgattcagagctcttctctggcatctctgaccctagctgctgctttcttctgcccccacagctgaccaggtgtatggagaccaggacatgcatgaggttgtgcgaaagcattgcatggactatctggtgagaaaatggaggcctttggggaaggggcagggtgggaggatttcttctccacacagaccttaaccttccaatctattctgcagatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacaggtacttctgcagtgggtaggtgagggaaagatggtgcctcattcgagcctgcccaacctggcctgctgtggatgctccctccttctctttctctgcagaacccatcaacacattccatgggatacatcaaaacgaggacgaacccattcgtgttagctaccatcggaatatccactataattcagtggtgaatcctaacaaggccaccattggtgtggggctgggcctgccatcattcaaaccaggggtgagtgggtccctgtgcccagaatggctgctggatatagaggtcagaaacctctgttggagtctgttttgcccctaactcacaaaaatatcctgtctcctctctcccctgaggtctcacccttacaaaaaaaaaaaaaaaaaatagggagttacttaaggtgatctctcagggcttgttctttggtcttggtttgcctgtctgagttggcttacctatcttttgtgcccgttgagggctggcattttaggatgtggagtcctattttggagcagtgagccagggcttgctctgggcatcttggcatggatctttctcctgggatcatagtggttacagacagccatggtcacagagacatggggtacaggcctggccccaccactcactggctgtgtgatctaggcagattctgtaagtattccaggctggcagcttggctgatacagaaagcacctcccactgggcctggggcctagtaggtgttcagaaggtggcagtgcattttcccagcacataccgatagattctcattcatttctctctctctctcttacagtcatttgctgaggattttggtatcttctattcaggtttcacttctacaaacacaaagtactcctgcttcattttcggaaacacatagcctaacaccaacacaccctccaacatagggttcttttttgttttgtttttaaataaacttaattttagagcaggtttagatttacagaattactgcaaagaggctgggcacggtggcccacacctgtaatcccagcattttgggaagccgaggctggcagatcacctgaggtcaggggttcaagaccagcctggctaacatggtgaaaccctgtctctactaaaaatacaaaaattagctgggtgtggcagtgggtgcctgtaatcccaactactcttgggaggctgaggcaggagaatcacttgaaactgggaggcagaggttgcagtgagccaagattgtgccactgcactccagcttgggcgacagaatgagactctgtctcaaaaaaaaaaaaaaaagttacaaatatattacagagttcccatatgcctcgctatgattaatgtattaacatagtacatttgtcatagttaatgagccaatatcgacatattattaactaaagaccatacttgactcaaattaccttagtttttccctaatgacctttatctgttccaggatcccatccagggtgccatattatatttagttgttgtgtcccctttatctcctcttggctgtgacagtttctcagaattttcttgttttttgtattcgatctgtttactgactctcgttttgccttttctagaatgtcatataattggaaatgtacagtatgtagctttttcagactggcttttttcacttaacactatgcatttaagattcatctgtgacttgtcctggtttaatggctcattttcttttttggtgggcgggtggagagacagggtctcactctctcacccaggctggagtgcagtggggcaatctaggctcactgtagctagcctccacttccctggctcaagcaagcctctcacctcagcctcccgagtagctgggagactacaggtgctcgccaccatgcccggccagtgttttaaaaaaactttttgtaaaaaaatgaaaaaaaattttttttttttgtagagacaaggtctcactatattgccgaggctgaccttgaactcttgggctcaagtgatccttgtgcctcggcctcccaaagtgctggaattacaggcatgagccactgcacccagcttcctctttttctttcttcaaaaatatgaatgttctggccaggtgcggtggctcacgcctgtaatcccaacactgggaggctgagatgggaggatctcctgaggtcaggagttcgagaccagcctggccaacatgatgaaaccctgtttctactaaaaatacaaaaaaaaattagccgggtgtggtggcacacacctgtaatccgagctacttgggaggccgaggcaggagaatcacttgaacctaggaggcagaggttgcagtgagctgagatttgacccctgcactgcagcctgggtgacggagcgagactctgtctgaaagaaaaaataaaaatgaatgttttaagtttttgtatttaatagacttaattgtttagagcagttttagatttacagaacaattgaggagataatacagaattcccacatatccttctcttcccaaacacagttctgctattattattattattattattattattattattattatcatcttttttttgagacgaagtttctctctcatcacccaggctggagtgcaatggcgcaatcttggctcactgcaacctctgcctcccgggttcaagcaattctcttgcctcagcctcccgagtagctgggattacaggcacccgccaccacgcccagctaatttttgtgtttttagtagagacggggtttcaccatgtcaaaggctggtctcgaactcctgacctcaggtgatccacccatctcggcctcccaaaatgctgggattacaggcgtgagccaacgcgcccagcccagttctgctgttattaacagttcaaatcattatggtacatttgttacaatgtgcgaaccaacattaatactttttttttttttttttttaaggcagagtttctctctgttacccaggctggagtgcaatgaggcgatctcggctcactgcagcctccgccttctgggttcaagcgatttttctgcctcagcctcccaagtagctgggattacaggtgcccaccaccacacctggctaatttttctatttttagtagagacggggtttcaccatgttggccacgctggtctcaaactcctgacctcaggtgatccacccgcctcggcctcccaaagtgctgggattacaggcgtgagccaccatgcccagcctaatacgttactattaaatgaaatctgcatgcctccttaggcccctttatctttgatagtttctcagttttgttttgatgaccttgacagttttaaggagtactgatcaaatattttgtaggaaatgtctcttttggactttttctcatgtttaaactagggttgtgggtcttagggaggaagatcacagaggtaaagtgccattgtcattacatcatttcaagggtttatactatgagtgtcatttatgcctgttggtgttacccttgatcaactggcagaagtagtgtttgttaggtttctccacctaaggttactctttcccaccttttccatactgtactgtgtggaaggaagtcactatgtgcagcccacgcctaagaaatggttatgccccatccccttgagggtagagtatctacatagattatttggaaatctttaaggaggatctgtgtctcatccttaactcatccttaatttattaatttttccagttattacgtacatcaatatggtcttttttttttttttgagagggagtttcgctcttgttgcccaggctggagtgtaagggcgccatctcagctcactgcaacctctgcctcccaggttcaagcgattctcctgcctcagcctcccgagtagctgggattacaggcatgcgccaccacacccagctgttttttgtattgtttagtagagatggggtttcaccatgttgggcaggctgaagtctcgaactcctgacctcaggtgatccaccctcctcggtctcccaaagtgcagggattacaggtgtgagctactgcgcccagctcaatcagccatttctttagagagccctggcatgtattggagactgttaacagaaatcaagacctaggtgttgaatgtgctcttcgatatcaggttgtccatgcttctaggccctgtcagctgatagagcaaggagctacatgtatgtatagtggcctttgtacacatatctataaatatttctacctgtaaccatctgtatttatattaaacatgaatccttactgatgtctccaactcagatccattatcacatgcttcattctagccttctccccttgttcatctgcaaattccctctccaacagtagatacgccatcagatgtatatgcactggttcctaccatccatttatgtaactgctcatttccatatacacgcgtagcagaatcacacttgttcacccgtacccccgtgggaaacaactttatcactatagctcaatgctacatatagttcttttttgcctttggtgttacagactccattcattttgaaagtgacctacttgtacccccacccccttcaaatgagggtgtttatttttattttattttattattattattttttgagacagagtctcgctctgtcgcccaggctggagtgcagtggcgtgatctcggctcacagcaagctccacctcccaggttcacaccattctcctgcctcagcctcccgagaagctggtactacaggtgcctgccaccacacctggctaattttttgtatttttagtaagagacggggtttcaccgtcttagccaggatggtctcaatctcctgacctcgtgatccgcccgcctcggcctcccaaagtgctgggattacaggcgtgagccaccgcgcccggccaaggttgtttcatgtttgtaatacatttgtattattttgtcacatttttgcattctatgctgggatctcagatctcctaattttttatttatttatttttgagacagagtctcactgtcgcccaggctggagtgcagtggtgcgatgatctcaactcaccgcagcctctacctcctgggttcaagcaattctcgtgcctcagcctcccgagtagctggaattacaggcatgcactaccacacctggctaatttttgtatttttagtagagacggggtttcatcatgttgcccaggctggtctcgaactcctgacttcaggtgatctgcctgcctcggcctcccaaagtgctgggattacaggcatgagccaccgcgctggccatagatctcctaatttttattttattttattttatttatttatttattttttgagacagagtcttgctctgtcacccaggctggagtacagtggtgcgatctcggctcactgcaacctcagcctccgtggttcaagtgattctcttgcctctgcctcccgagtagctgggattacaggcacgcgccaccacgcccagctaatttttttgatttttagtagagacaggtttcaccatattggccaggctggtctggaactcctgacctcaggagatccacccaccttggcctcccaaagtgctggaattacaggcatgagccaccgtgcccagccttcctaatttttttttaaatagcatatattaaggtccactctttgtgttgtacattctatgggttttgacaaatgtgtaatgtcatgtatctactattacagtattattcagaatagtttgaccacccttaaaattcctcatactccatatgcttacccctcccttcctccctcttcctgcaaacactattgtctttgtgggttgcctttttcagaatgtcatataattgtaatcatacagtatgtagccttttcatactgtttttttttttttttttttgagacagtgtatcactgttgcccaggctggagtgcagtggcacaatatcactgcagcctttacctcctgggtttaagcaatcctcccacctcagcctcccaagtagctgggaccacaggcacacaccaccatgcctggctaactttaaaaatatttttattttgtagagacaggatctcactgtgttgctcaggccaatctcaaattcctggggacaagtgatcctcccgccttggcctctcaaagtgctggtattgcaggggtgagccacctgcagccaatttgcttttttcccccctgaaattaaaatggtcaatgtgacagactgcttcttttcacttagcagtatgcattaaggtttctccatgttctttcatggcttgttagctggtttctttcttatcacttaatgttccttttatggaggtaccagtttaattattcacctattaaaagacattcttggttgcttccagtttttgatgattatgaataaagcttctgtaatgtgcatgcaggtttttttgtggacgtaattttttagatcagttgtatacatacctgggagcaagattgctggattgcgttgtaagattatgttttgatttatgaggaactgagaaactgtcttcccaagtggctgtattatttgcatgcccaccataatgatttggaagttcctgttgtcagcattaccagcaattgatactgtcattgtgttggattttagccattctcttaggtgtgtagtggtatctcattattttaacttgcagttgcctattggcaaatgctgttgagcatcttttcatatgcttatttgccatctgtatagcttctttggtgaattgtgtttgtgacttcctgacatacaattcctaaaatccttagaatctgcaaagtgttgcctttttgtatgctaatgaggtgactgatggctggcagcctctaggtagcttcaggatgggggctggtgacctgaaagaccaaggcaggattagaggtttgcaactttaagcccatcccccagcctttggggaggggagagaggctgaagattaggttgatcactagtgtccaatggcataatcaataatgcctgcataatgaagcttccaaagaatcccaaaaggattgggttctgggagcttttgggtagctgaatacatggaagtttctagagggtggcaccccagggagggcatggaagctccacgtcccttcccccatatctcactctgtgcatctcatctgtatcctttgtaattttctctataataaactggcagacgtgtttcctgggttttgtgagctgctctagcaagttagttgaacccccaaaaaagtattgtgggaatcccaatttatagctggtcagtcagaaattctggaggcccagactttcgactggtgttcgaagggggttggggggagtcttgtgggactgagccctcaacctgtgggatcccaggctgtctctgggtattgaattgcattggaggatggacaccaggtgtccgctgcttgctgtgtgggaaaacaccctccccccagcccgcacacttggtcacagaagtctcctgtgttgattgttgttgagtgagagtagaaaaaacacttggagtgtgtttaacactgccagagtggttagattttttgactatttttttaattggcttgttctaacatagttttacgaattgtttttaactattcacagtaaaaaattacattttatctgaatgcaaggtctgcaggaaaaagaaaagaatacattttacatgattacttagcatatatgcatttgtgtgtgatgtgtatatgtgcattaaaataatgttaactaaagcttcatgaaacaacatttgcacttattccctgggatatattctgatattttctattttttaaaaatgctgttggatctcagcctgaaaaacagtactctgatgtagtgtcctgtaactcatagcaccccacaccatgttgatactgcccccttattccctcacacacccactacttcccccaacccctcacatgcttgaatactccctccacccggtgcacacatagctaatttttgtatgtgtctcatctgctcatgtgtgtgaaagtcctcaacattatgaaacagtcatcactggatggggcttctttaaattaaggcccagggccaggtgcagtggctcacacctataatcccagcactttgggaggccgagtcgggtggatcacctgaggtcaggagttcaaggccagcctggccaacatggtgaaaccccatttctactaaaaatacaaaaaagttagccgggggtggtggcactcacctgtaatcccagctacttgggaggctgaggctggagaatcccttgaacctgggaggcggaggttgcagtgagccgagattaccccactgcactccagcctgggcgacagagcgatacttcgtctcagaaaaaaaaaaaaaataagtcccaggttggaaggcacctgactgctccagtctcagtgcctcagttgaggtggtttgggggttagagtcaggtcttacaagcataggagtttggaatgacaggtcccacatcccaagcctgctttcccctggtccccaatcaagaggtagtctgtggagtgttgctctttgggagtacctgctttcctgtctccttttttttctggggcctgtgggcctacctcgctgagcctgttctggctcttgggcaggttcagtgtgttattgcacatccctgttcctctccctccttgcagtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccaggtgggtcatggactctgtcacaggcttggccaaaaactcattacttctcatgctttgccctcaagcgagcagaaaaaaattaagcagttttgac

SEQ ID NO: 175 - DNA, 37095 bp, mus musculus
ttgaagcagaaggccggaacaagcgtagcaataaacttgctggacttggagagaaggctaagacaaactcgccgcactgccttcatcttggactttacatccgggttctcctctcggcgtgacccgcgcgccgccaccgccgccgccgccgccgccgccgcctccgccgccgagggttctcgaaccggtgccgcgatccctttatccgggtctcgccgttcccgtcgtgcctcgcgcactacactagccccctcatccgggttctctcccggcgtgccccgcgccgggtttgttggggggtactcggcagtgcagccatgactatactccccaaaaagaagccgccgcctcccgacgccgaccccgccaacgagccgccgccgcccgggccgatgcccccggcgccgcggcgcggcggaggtgtgggcgtgggcggcggcggcacgggcgtgggcggcggcgatcgcgaccgtgactccggcgtcgtgggggcccgtccgcgagcttcgccaccgcctcaaggcccgctaccaggaccgccgggcgctcttcatcgctgggcgctggccgtgccgcctggtgcagtggcgggtccccggccacaacaggcttctccacctccttgcgggggcccaggtggtcccggcggcggtcccggcgacgcgctgggcgcagcggcggcgggtgtgggtgccgcgggcgtggtggtgggtgtgggtggtgccgtaggcgtgggcggctgctgctccgggcctgggcacagcaagcggcgacgtcaagctcccggggttggcgcggttggcgggggcagtcccgagcgtgaggaggtcggcgcaggctacaacagtgaggacgagtatgaggcggctgcagcacgcatcgaggctatggaccctgccactgtcgagcaggtaagagctgtggggtgaggggtgagcggccacggcagatgggacccccagactgtgaagggactcaaggaaggctgtttgagatcgccccaagggatctaggcgttttcactgggcctgacagtcttctctggcggtagggatgtgagacaccttctttcctcccctccaggattttggggctagaggcctacggtaaggtgtcagacttaaagatccgaggtctcttttaaggtctatagtcgtcattccagtccctgggacctcatcatatagggccaataggtgggaattctccaagagatacaggtaggatcgcgcccctcttgagtaggagtctcaggtctcccaagagacttaggtatgtgttcagtggcttaagagctcttttcctctgggatagaagtttgagattccccttccaggaaagtcaaataaggtggagacctcggagatcggggctgaacatccccaaggagcctaagccctttcaagagtctgagacactctgcatataggacaatcctctcccgcttcgctgggtaacactgcacaggaccactgaatagccagacctgagacctcaagggtcctaagtctgtcttcaggggcctgagagtcctgcttctagaatcaaggtcctgacacacacacacacacacacacgccccctttaaggatagggatcttctaagctttttccagggatgtaagacttttcacagggagatatgattcccttgcccttggggacagggaccaaaaccaacacccaatgaccagcagctttacttatctcctttctgagtgacaaaggtctgcatttcctatcagtggcctgagacctacctcttgggagacaagggcctgaaccgcttcaggatcttaagcttcttgtaagaagagatgggccctcagcacccccaccaggggcctgaacctttcttcaggaaaatgagactcacagcgttggatcctagggcctaagatccacctgcttatggactgaggtttttagagaccgagtctgaggcctcttcaggggcctggtgtcctgctgcaaaggtctcagacaaggtgaagtctttaggagatccttcttctcaaggctggtgtctgagtggttttggggatctgagactccccaccccacgagcatatgtgacccttttaccccaattataagggactgaaacataccttggggatacagtatcccattttcccctctgtaacaggggtttgaggccctcccaccttgggcctaagctttttgtcagggacatacgacccatgccttgggaacttgagcctgagacgactactcaggggacatgggcaacatgggatcccagagatgatgtctggggcctccctacagatctttgcctacttttaagggcctgagacccactctgccaaggacacttgagctttccttcagggacaggagactcatacataccttggtgacttgtgtgtctagaggtaaggtctgagcttcctcctcaaggaacttaagatgtacacctgagaaacaggaggactcctccccccagacctgagccctgagactcttcccttggggcatggataaaggatccctgtggaacagggtcctgagtctacctccaagggtttgaatcataactcaggtgtgtgaaggcctgttccccaccttaggacctgatttctgaacctgccctgagggtactgtcacctcacctcagacaacttacatacaccctagtcttaggggtcatttagggacataagacttcctgcctcggggacttgggccttagactcccaactccttttggggacatgaatagggtaggattctgaggaaaagagtctgggcccaagctttctctctgggacaagataccgtttgccttagggactgggggcctggctcccacttgggcatgaggctctcctcctaccacaccaggcaatcctttctgtccagggagaggaacgtgaggtcatcctctcccattggacagaaggacctggatgctcttcagggtcatatgaaccccttatccagagctccctcgtggccagggccaagaaggtcctcctactttctatgagaagattgtcaggtcctggggacatggagtctggagcctcccttctgaaaccaagagcgattccgagtctctccctgacctagctatgcttgcttctcacctctaggtcatataataagttttgaactgcttttgacaagcttttttcttcccagggacaggaaaggggtttgggacatcgccactctggggaaattctcctcccacattccttttccccttggctcaggtaaatctttctgtacttcacaggggccccaagccttgtcttgagctccttgttcttggtcccttcctcccatcattaattctggcacgataagccatttgtactcaagggtcaggaccagttatttcttctctctctggttgggtagtttctttcctcctctagaagcagggagccatacatcactggtcctagggacagaggaaaaacatcctatgcagccatgataattcaaaaacacctccttactcccctcccttgcgatacatccctggtcccagggacagagagaaagaacatcctatgctgccatggtaactcaaaaacacttccttatgccccttgcagtccctcccttatacttgtccccataagaacataggagtaagccgggcatagtggcgcatgcctgtagtcccagctactcgggaggctgaggcgggaggatcacttgagccctggagttcaagacctgcttggcaacatagcgagacctcatctttactaataaaaaaaaaagaatatgaaaatcaagttttgtgggttcatgaaacctgcccttcccaatgacaggagaggctttctgtccccacacttcttaggacaaagaaggtgatcctcttctccctgcctcacctggtccaacttgagagcttttggggatgagaagagggaagattcctcctgccaccccagtcttggtcctaaactgtcactgggggtggttgtagcctggaggtcagttggatcccttgggaagagaggcgtcgttgagggggagtctagatggcgattctggggttctgactacttgggcttcctctttgtcctgattctcttgtatccctacttcctttaggagtctttttggcactctggggtccaggtgctgggtgggtggtgatgtcaggggttcccaggcatggctgccttgctgagagtctgctctatgaaaaggttggcctgtaagcatcctgagtttggagaccccacagagctctttgagaaggggcatgtgaactgaggtggtggaaaaagctgggtgtggcacggtagttggtgcctgggttccaactctgggtctttcaaggctttgctggatgaaccagggtaggttctacctatgctctctgggcctcagtttcctcactggccaggcaaaatgctggtgaggtgttgtttagctttgggattttagggaactcagtccaaagttctctggacctggaggtggcaaagaatggtggatgtcttttgaggaggaactgggtttctcccctctcttcctggctcctctgttccctctcagccatccaagcttggtgggcaggacaagcagcctgttttgtgtgaggctcagggttgatgaacagccattttttgtgggcagccatgttgtaatgaacaagctcgatgggatttcctgtcaggaggcctgttggatagtggtgtagagaggtagagttgtgtgtggagtttgggctttggagcaaggcaagctttgagccatcatccctcaattctctcatcacctccagacctcagcatctcctccttacctgctttatagctttaggcaaactacttgccccctcagctgcccattttgcaaaagtttgtccatgcccaggtgtgtctgaccttgctcaccttggaccttggccggttcttcctcttgcccagaatgggcagtttgccccagggtcatcttggttcttcctaggagcctttgtccactcctagtaacctatctttgatagcaaaggcccttcatttggcatctaggaacctgctgatttcttgggctcttcttaccccaactggaattgggtagctagctggtggggaagcaggaaggggtctctgcccaggcaacgtggatttgagtcctgtttctgcagtaagcttttctgtggtcttcaggcagttctcttttctggttcttggtttctccctccatgaaatgggtagtgttgaggagggaggttggactcattgctctgaagcaagttatagtctcctccctgctcccactcccctcacccttcatgaaagttttaagtgggaccccttggcctttggggattgtgctaggacatttcaagcagtgttcagcgtccttggctggtgctgagcccttgggtgtgtttcttttaacaactttaatgagatgtaattcatgtaccatactattcacctctttgaagtgtacagttcagtggcttttagtatattcacagatttgtgcgtccatcacatcactacagtccattttagaacattttcatcaccttaaagagaaatccagcactctttagctatgatcccccaatttcctcatccctttccagcctctggcaaccactaatctactttctggcttgattgatttgtctgttctggatgtttcatgtaaatggaataatagaatatgcagttgtttgttacttggcttttttcacttagcataatatgttcaaggcttatccatgttgtagcatacatcagtgcttcattcctttctattactgaataacaggaccttgggtttttttgttttttggtttttgtttttgtttttgttttttttttaaggcggagtcttgctctgctgcccaggctggagtgcagtggcgcaatctcaggtcgctgcaacctccggcttccgggttcaagtgattctcctgcctcagcctcccaagtagctggggctacaggcatctgccaccacacccggctaatttttgtatatttagtagagatggggtttcaccatgttggcaaagctggtctcctgaactcctgacctcaggtgatctgcctgccttggcctcccaaagtgctgggattacaggtgtgagtcaccgcaccctgccaatcttagaggtttttaatccccctgccctcagtggcctagccaaatgttggggccttgctcttctccccttctgccctggagggcttgtgttggtccttagagagtagtgtgtctatgttcctcgttggatgggttgcctgtgtgtgtttttttttgagatggagtctcactctgtcccccaggctggagtgtagtggcgcgatcttggctcactgcaacctccacctcccaggttcacaccattctcctgcctcagcctcccgagtagctggaactacaggtgcctgccacctcgtctggctaatatttttgtatttttagtagagacagggattcactgtgttagccaggatgatctcgatctcctgacttcgtgatccgcccacctcggcctcccaaagtgctgggattacaggcgtgagccaccacgcctggccccctgtgttttgtccatggagccaggctagtgttcctgggtgctttgctggagggggtggtcttggcaccagggctgctgggacagagctgtgagtcacagaatgctaaacaccttttgaccataggctctgggaagacatctgtccatgaactgccactgctgctgccatcttttgcccccccaccccacccccacttcagtggcagctcatccatccataggcagggtcagtagtttcccagggtgagaagggagattccaggcccctgctgccttaattctaacctcccaccctggaggatggtaggcaggtggaccttgcagagcgggatccatgccatattgtctcacacctgtgaggcactagggaacagacaccaaggagtgctaccaaggggggtgtgttagtttcctgtggctgttgtgacaaatgttaccacagactgggtggtttaaaacaacagaagttggccgggtgcggtggctcacccctgtaatcccagcactttgggaggccgaggcgggtggatcacgaggtcaggagttcaagaccagcctggccaagatagtaaaaccccatctctactaaaaatataaaaattagctgggtgtggtggtgggtgcctgtaatcccagctactcgggaggctgaggcagagaattgcttgaacccaggagacggattggaggttgcagtgaggtgggggttgcagtaagctgagattgcgccactgcactccagcctgggtgacagagcgagactccatctcaaaaaaaaaaaaaaaaaaaaaaagagagagagaagtttattctgtcacaattctggaggccagaagtccacaatcagtttcactgcatccaaatcaaagtgttggcagggccacactccttctggaagctctcagggagaatttagaccttctctagcctctcgtggctgccaacattccttggtttatgactgcatcattctaatctctgcctccatcttcaccatcgccttctctgtatatgtggtttccttttctgtctgtatcaaatttccctctgtctctcttttataaggacacttgtgattgcatttaggtcctacctgatactctaagataaccccccatctccagatttaataatgtaagttaattacatctgcaaacactttttttcttttctcttctctttttttttttttttttgaggtggaatctcactctgtcacccaggcgcagtctcggctcaccgcaacctccgcctcctgggttcaagctattctcctgcctcaccctcctgagtagctgggattgcaggcgcccaccaccacacctggctaatttttgtatttttagtagagatggggttttgccatgttggccaggctggtttcaaactcctgaccttagttgatccacccgcctcggcctcccaaagtgctgggattacaggcatgagccactgtgcccgggcttttcttttcttttcagacagtgctggcctctgtcacccaggctggagtgcagtggcgtaatcttggctcactgcaccctccacttcctggactcaagtgatcctccagcctcagcctcctgagtagctgggaccacaggtgcgagccaccatgcccggttaatttttggtgtttatttatttgtttttgagatggagtctcgctgtgtcacccaggctggagtgcagtggtgctatctcggctcactgcaaccttcgcctcccaggttccagcgattctcctgcctcagcctcctgagtagttgggattacaggcgcctgctaccatgaccagctaatttttgtatttttagtagagatagggtttcaccatgttggccaggctggtctcgaactcctgacctcaggtgatccacccgcctcggcctcccagagtgccgcgattacaggcgtgaatcaccgtacctggcctgtattttttgtagagatgagatttcaccatgttgcccaggctagtcttgaactcttgagctcaaagcaatctgcctgccttagcctcccaaagtgctgggattgcaggcatgagccacgacgcctggccctacctttttcattataaggtaacatttacaagttccaggggggttagggtttgatatctttgcgtggctattaatcagcctactagagaggcttttttccctcctggggaagggaagggaactcattaagtggtctcttactgggcaaagccctgtaatatttgagtctgcccagcatccctattattgggaggcttggtatccccattcacagattggaaaactgtggctcagagcagttcatcatcacatggctaataattggtggagctagattggaacctaagtcagttgggttccacagcctgctccaacttcacttgggcccttagaccactaggttacagaatcttgcctcagctcctgggatcctctggtgttagggagctttactcagcctttttgtggaggctcaaagatatggagggattttcccataggctcagcgatgagtttgcaaggttcacaatctcctcaggccagggcattgttggagcttaaacttatctatggctgagctatcccctaccccccacccctactagcccttcctgagcaacattttctccccaaaaggagaaagagaagggccagagcccaaactcctcaggctgctgatgacaaagccagtgggtggctagcagtccagcctctagatccaagcctggatgccagtttgactgccccaggacccaaaccctgcagtgcgaggggcctattcaggtctctttcatgtttagagacaaaccaggatattctgtggatgggctgcaaggtatgtcctccatgctgtggctcgtgggggccttccctgttgcctctacactaggctttgctggtatccaaactccagctcctttctctttctgcctttgtttttttgttttttgttttgtttttgtttttgtttttgagacatagtcttgctctgttgcccaggctggctggggtgcaatggtgccatctcggctcactgcaacctccacctcccgagttcaagcgattctcctgtctcagcctcccaagtaactgggattacaggcacacgccaccacgccctgctaattttttgtattttcagtagagacaaggcttcgccatgtcggccaggctggtcttaaactcctaacctcagatgatccttccgccttggcctcccaaagtgctgggattacaggcgtgagccaccgtgtctggcctcctttctgcctttgtaaagtgagggtaatgtttcctgccacctgggctgtggtcaggaaaattaaacgaggtcaccctttgcatctggcatggggcaggtattcagttaatatgagttcatctttcttcctggtcctccctgcttacctgcctagtactacccagaactttagctctactgaattcattgctgggctccaggcattcctggtacttcgtggcagaagtgacttcatttctcatccagttaacaagcatttttggaggtcttggtgttttaatcctttggtcaggtggcacctcctctcaggtgctagccttaatgactgtgtttctttttttcttttttttttttttccttgagacagagttttgctcttattgcccaggctggagtgcaatggtgcgatcttggctcaccacaacctccgcctcccgggttcaagcgattctcctgcctcagcctcccgagtagctgggattacaggcatgcaccaccacacctggctaattttgtatttttcagtagagacggggtttctccatgttggtcaggctggtctcaaactcccgacctcaggtgatccgcccacctcagcctcccaaagttctgggattacaggtgtgaaccaccgtgcctggcccaatgactgtgtttcttttcttttcttcttttttttgagacagagtctcactctgtcgcctaggctagaatacagtggtatgatcccggctcactgcaacttctgtctcccaggttcaagcgattcttctccctcagcctcctgatttagctgggattacaggcatgcaccaccatgcccagttaatttttttttgtattttttagtagaaacaaggttttaccatgttggccaggctggtcttgaactcttgatctcaagtgatccacctgcctcggcctcccaaagtgctgggattacaggcgagagccacttcgcccagcctctttctgtttcacaacacctggcatttacatttttcacagccttgttcataccttgtggtggttacctgtttccctacccctctgctaagtagtttgtgagcttatcaagagtggagactaagtctgattcatttcactgtcctcactgcccagcccagtatcttacttagtagctacctggtaagtctttcttgaatggataagtaggagcccctctcctgtttgatctccttttctcctctctttttcccctctctccaaagccaggaagtcgctgtgttcccttctttttaagaacctattcttgtgtcaggtttgggactatagttgtggttgcaccatccctgctggagacccctggctggggcaggcccatgactctgggagatggctgaccatgtgtggccaggatggacttgggcataactggctggagtgtgttaatccacaggcttgggggcaaggagggacacctggactactggaatgttgtgcacaaacaggagtccttgtgctgcgcatggaagctcattaagggcttccaggtgtctttgtcatctctagaaatccagccacattttcctggggtgtgggccctgatgatgggactggctgggtattcccttgtcacctcttcctcccctcctgtcccgctactcacctaggactttctgagggtctctcagttgtgcataatctctgtgctgatctcctccccttctgtgattggcgacaacttcccctagtatatggtacgttatttacaaagcttctttaggtcctgaaactcctcacagctctgtccggtagatcaacatatcccccattctataggaaactgagagtgataacagacagcaagtgtgtggcaaagctggggttggaacccagagctcttgcgttccaaaccttgtgcttacaactttgccagagatgcttctcctctggctttcttaggggatgggttccaccccttgcttgagctggggaaaaatggccttacggataggtgggcccctatgtctggtctctaataccccagatcctataaatccctgggcaggcctgtgtccacaaggagcaggcttgggatcctgtagtttgcagccttgttgctaggtcaggctggctgcttctggtagccagcagagggcgtgaggggcccaggaaaggtctgctgcttctggttggttttgttttgaaatgaaaattatgttttaagaggttatatggtcattatttttttaataaaaaaatatgcatttgtacaggttcatttaagttgaaccttcgtggtgccaggtgtgctttggaatttaggaaaaaaacaatttataaaacttacctggtgtgtatactttgtgttacataacacctccagcagggtctgaggcagcacctcataatcaaacacctgaatgttttctgcattgaaatatttgaatatttaccccaagtgggataaatagattcttgtcagttctggtcaggttatgatgccaaatgaattagataaagacttttgggccgggcacagtggctcatgtctgtaatcccagcactttgggaggccgaggcgggtggatcacgagatcaggagatcgagaccatcctggctaacatggtgaaaccccgtctctactaaaaatacaaaaaattagccaggcatggtggcaggcgcctgtagtcccagctagtcgggaggctgaggcaggagaatggcatgaacccgggaggcagagcttgcagtgagccgagatagtgccactgcactccggcctgggcaaaagagtgagactgcatctcaaaaaaaaaaaaaaaaaaaaagacttgattttcaaagctttttgggtttagtgtaactttataaaagggaaagtgcaataaaatcgctgataacaccaggacttagggatattttgctgtctagccttcccaattttgtgtacgtgtgtttgtatacatacatatgtatatatgtgtagatatctgttaaatgtgttcagtcacagatgagaacattgtttgcacacttttgccttctagagtatatctcttttttttttttttgagacagagtttcgctcttgttgcccaggctggaacgcaatggggtgatcttagctcaccgcaacctcttacctcctgggttcgaacgattctcctgcctaagcctcccatgtagctgggattacaggcatgcaccaccacgcctgactacttttgtatttttattagagacggggtttctccatgttggtcaggctggtctcgaactcccgacctcaggtgatccacccaccttggcctcccaaagtgctgggattacaggtgtgagccaccatgcccggcctacagcatatcttggaatcctctagccctttgtcaggttcaggatctaggctcttgctagttaccccctcttcaccacctttcctagatgaaactccttgaggtagagccacattctccacccaggcacttgctgggtctgagtctctggctgcctgaggcagtgtggctccctgggccaggccctgcaaggtcaacagaagccataaggcatatggggccactgttctcagggcacctaggacccttttggaagtaagtcttagtttcactcagcaactaattccctaaaagagtctcctacttcacatgcatggagtggtcaaacagggctgagaactttaccttggccagcgtcctctctgtcaatgatctaggcctctcgggagcttgaggtcggggccctggggagggagtacaggttttccctgttgctgacccccacctcttccctccagcaggagcattggtttgaaaaggccctacgagacaagaagggcttcatcatcaagcagatgaaggaggatggcgcctgtctcttccgggctgtaggtgagtctctgccttagtccttaagggcctagggctgcccctaagctgtgtcccagttatcaggaatagcccctgagacagggttgaggcagagctagctaatcttttagggactctaggctccagcctcaagttggtatctgacctctagccgtgggtcttgagacattgtagtggtgcaagattaatatgcataataacagcaagaagaatgataaagaaaataatatcctttgggacacattgtcaggtgctacaggaaacctctttgattcccctctaagctaggtgagtgtagggactactgttgcttccatttgtcagatgagaaaagtggctcagagatggtgggtgacttgtctggagtgaaataataagtggtagagttgggattcagtgtctgggttagattagtctgaggcccatgctcttaaccatagcacactgctgccaccctgggctgtatgacccctaggtttatacccagatcccatctctggtgtgttgcgggtctctgttcctcaatctgtgtgtatgggggctatcagactagatctttacaaatttcttatatcatagaattttttttcaacttatataaaagtagagagaatgatgaaccctcatgtacccatcatccagcttcaaaatagtcaatacgtggccagccttgtttcatcactatcccgcccactctttctcactcccctgaaagaagagtatttttaaagcaaaaccccgacattggatcatttcattcataaatatttctgtatgtttctctgacagatacagacttactctcttctttttaacataatcaaaatgccattactgcacctaacagaattaataatgccttaataccatctgttatccagtctgagttagatctttgaggccattttggctctgaatctgtgacccaacaagtagttgtgaggtcctgtgctagggtgaaggggaagctgggaatgtgacctgatcctccctgtggttctctgatatctaccaaggaaaagtgccctctgataggagctttgagctgggagtcagaagacctaccttctagttctggccctgactcataactgctgtgacacttggccttggtcttcccgtctgtgaaatggtgttgattctcaatgcctctttgagttccttcttggtctgctattctctccgtctgtgggtaccccccatgtctactggtgggctggggtgttttaggctccatccctggctgcacaactgattcttggtatgaccttaggcaagcagctcttctttcctgaggctgtttcctcatctgtaaaatggggctaaaagaccctaatgctgtaacgatttaatgaagttgctttggtaaatccctttagtgcctgacacatatagtagaccctcatggaacagtagcatttgtaaaacccagatgccattttcactggtgcctcagagtcacatgtgtttgttgaaagggtggagtgaatggtctcctctctattctgccaagcagaagaggctcaggcaatgggctctattggactgggaaaaaacttatccctcctacccctctggctcaagtttgtgttttccctgggatgtttcccagaggaagagctgggtttcggggcatcttggacaaaagaaaggcaaagaaagaataggtgggggcctgttaggtgctaggccctgtgttgagacctcaggctagatgtggggtaagcagggcttctggtggagttaggattagagaatgcagcgggcatctgagtcttgggcagtcattgagggtaagccttgggactggctagtgaggacctggcttgtgtagtaactcatatcaagagccgtgtgtgtgtgtgtgtgtgtgtgtgtgtgtgtgtgtgtatctagctagctgttctctgtgtgtgtgtgtgtgtgtgtgtgtgtgtgtgtgtgtgtgtatgtgtgtgtgtatctagctagctgttctccccaaatacccccgacccttggggctagctagtgaggacctggcttgttgtagtaactcgtatcaagagcagtatttgtgtgtgtgtgtgtgtctatatgtatctagctgttctccccaaatactcccgacccttcctcccactggggccttcggtaaggggcctctacttacaggaagagctgaccagggcaggttgaaggcctttccttatcggcactatggctacacatttcccctgactgggctgcctttggcttttctctgtaaaacctcagaagtcctctggcctctcccccgaagtacatggcccttggtctctagaccttatctggaggtttccttggtgcagagtgcataatacatgtgcctgggaaggggactttgtccctgggctttttgctgcccccgtttccagcctcgcctggatggggacagatggcagtcagcttagactgtagtgtgaagccctacaggctgacttcctgccatgtgttgaatagtggaaggaacgtggagcagagagttggagttgggcgggggctgcaaacatagagggcactgtttccttgacccctgctgtgtgctaggcattcagctgggtgcttcaggctcactgcaaaacttggatcattatcccatgagacaggtgaaaagattgaagcatagaaagggaaatgacatgctcagggccattagccagagctggcctgggaacccagaggtgtccaaaggacacgcattcttttttttttttttttttttttttgagatggagtctccctctgtcgcccaggctggaatgtgcagtggcgtgatctcggctcactgcaacctctgcctcccgggttcaagtgattcttctgcctcagcctcctgagtagctaggattacaggcgtgcaccaccacacctggttaatttttgtgtttttagcagagatggggtttcaccatgttggtcaggctggtctcaaactcctgactttgtgatccacccgctttggcctcccaaagtgttgggattataggcatgagccaccgcatccggccaggacacattctttttatgatcctaggatccttagcttcttagcttggttgtcaactggctggatgaccttggctgtgttccttgacttctctggaccttacctcctccaagtaggagcacgtggccctctgttgttgggagtcttgaggcaggtggctttctgccttctgttcccctggattatcttcctatagggtcctaccatttgctttagagacttctgagaattgcctactccccaggtagctgcctgcctgccattggttcccctgagttaagcaatatccattgcttgcgctcagttctctcccacctcctcttattggggattcatgagcatcattgaaggcttgggtggagtggaggtgggaacctgagcctcagaggtatcctgtggcccaccctgtccctgttatgctcagataacctcctcctggaaacatgactctgcatctctcccttgctccctccctccatgtggctttgactcagcagaaacctctaaccctgaccagggtcctggtgctagcttctgtgggcagagtgaaggccacatggttgtttctacatgggccatgggggagtggcaagggctgtgcatgttaccacgatgaggcccagaaacattagctaggcccactcttctgggccttttggtcttggaacatcagcactaggagggatggatctgagatcaattttgattgttttataaatggggaaactgaggcctcaagagaaagccaagaccctaccctatctaggtcatacaaccagtgtcagaacattggtatttgaggttgaaccaggccacagaaagaagattcccacgggccatttcctgtacaccagcttccttcagcctctcccgtgtatccttcaggtttctcatccttgcagtgggaatccttgagcagaggagcacacatctcaggaaccagactatccagtgggatgagttctgtctctcccactgagggtatgctagttggggtagttggggctacagaccaggtcacaccacagctgcttgacaggcaagtgagacctttgtcctggctcatctcctcaggagattggttctcagtggggccagggttcccactggaccaggagggtagtggggagcagaccaggtccctgtctccctctgcagctgtgtgtacacacgttagtgtggtttgtttttaggttccctgtagacacctagcttccttttttgcccttagcggaacttgctgtggctcttctgggaggcaggcagctacctggggagtaggcagttctcagatgtctctaaagcaaatggtaggaccctataggaagataatccaggctctcatgtcttgcttcttaacataaatctgggtacattattggttacattacattagttacataaggacttcccccgggcaacagaggagagaggttgaggctagtctgttagagctcttggttatttcccctgccctccacctaccctgccagaggccaggaaggaggttggtggggtagggggtccctcagtttatagagcctcacatcttcagtctttcctgaagtggcaagggcatctactcattgaatgtgatagttctctgttgtgggatttgttgggtgagcatttggcctcagggagcatctttggcagtctctgctgtatgtgtatacacatgtgcatttctatactggtgtctctgtgtgtccagaaaaaggaaagaagtggggtgtgtatggggagggtaaggttcatattggcctctgtggccctagggagagatgcagcccctgatatctataatctctgccctctcccatgcctttcctgggttctagctgattcctgcttgtgctggtgtggaaactgaggcacacaagatcaggtcctgccccagggagtaaggtgactaagatggtggctggattggggtgaaggtggtaatatcagctggggccagcagttaccctttgagagcctggcctccccttcactccccctaaatctgtgatcccaggcaagctttgccacatttctgtgtctcctgggtaaagtaagagtgttttggtaaggatagaatgagttggagtgtgaaaagtctttggtgtgggaccaattgtagtattgtactgaggatttctgagccctgtttgagatgggaacagaggtagaatggtgggggacccccttccagctggcctctgggaggggagaacaggtgcagattgcccacaagtgcagcgtcagcaagaggaggagtttcagtttctatcaaaacaagttctctgaattcccctacctctgcaggtcatccccccaacctcagacccctccacagggaagtcaagcctggcccccagccctgtgtgccagccttctgggaagaggagggctttctggaggacagaggtggagctaggaaagtcagaaaaacgaattcttttttttttttttgagacagagtttcgctcttgttgcctaggctgtagtgcagtggtgtgatcttggctcattgcaacctccacctcccgggttcaagcgatttttctgcctcagcctcccaaatagctgggattacaggcatccaccaccccgcctggctaattttttgtatttttagtagagatagggtttcaccatgttggctcggctggtcttgaactcctgacctcaggtgatccacctgcgtcggcctcccaaattgctgggattacaggcgtgagccaccacacctggccaaaaatgaattcttgttgagtacttcctatgtgtttagctctgtgcttagatgcttttcctgccttatattattggagaaatccttctattctcccttgttgggatagtactattgctgttttccttggtttggagatgtatattttcttccacgttaatgattccaaacttagggtataccttataatcagtgtggtgtgtttcccccctcaaaagctgtgattaggtacatgttataccatatcacctatcagtgccatcataggattgaggagagaaggtggtattttacattttacagataagtaaagaagtgtcataactcgtccatactttaggaccctgttttatgaagcctgtattgttaattcgatattaatttaactgctgaagttttgttagaactaacggcctagaggtagacttgtggacctttggtttcgctaaaggtagagagccaggagaggacatgcatcctaggtctgcatttggggctttcctctggctgaggaattgcaacagaaatgaggaagggcttcataagtggttatggcaacattctggctgactcgtgggtaactagcatatgaaggaatcattgtcgtcatgacaaattgtgttcctgtttcttgaccacctactgtgccttaggtgcttggcaaacctcctgtgtagttttgacaacacccagcagatggaagaggagttactgtctccaccttatgcatgaggacatttcagcttagagaggttaaaggccttatccattgctacacagctaggaggcagcagagcctttctgccaggcaaaggggtcagtggcagagaaatgggaccctcagggggttttcccccagatcccttccctgttccacagtctcctctctttccccattttcctgcatctggcatctagctcttgaagatagaactcccaggcctggaaatgaccgttgacctttccataggagatgggctttctccagcacctcagcctatctctctgagcctggccagccaacccctatttaaccccttcattctcatctttgttcctgtttactgcagctgccaacagcactgcctcccagtaccccaagctcagtctacagaaatagctccccaagtagctcactgtgcgggctctgtggtcctggcttctaagaaaggcagcagcagggggcccccagcctgtgcgcaggacatgtgacttgctggaaatgccgctggggagggcgggggagagtgtggccgcagaacccacatccttgtttacattggtgaaggggctaccccccttcccgccttcacaacctccacacccccttacccttcaggtctcttcacctccaagaggactggagacaaacatgggccctattttctatctcagagtagcctttctcacagaacactccagggtaggaaggggaaggcagggaaggtgttcttctgacagttcttcagagaggtagactgacagggaagaactcaggagtgttcctgtgtgacctgaccctagccccatgccccagggagatcccatcagagcagtggtcctctggggaaacaaagggaaattcccaaaaccagtggaaatcagacttgcatgatcttcaggcccactttaatttcacagggagaagagctccctggcttacccagcctatccatttgctcagtaaacttttcctgatttcctttactgtatcgggccctgagctgggggtggactttggtgtgaactgccctttgccttctgtgggagcccagtgtggtcgggcagaagtctatgcacacctttgataaatctggtgatagaggtgtcctgggtagtggggaactgtattaaagaacatgttgggccaggcgcggtggctcacacctgtaatccaggcactttgggagtctgaggcgagaggatcgcttgagcccaggaggtcaaggctgcagtgaactatgatcgcgccactgcactccagcctgggcgacagagcgagaccttgtctcaaataaataaataaataaagaacacattggtgtttgagaagtaggcagctgacgaggatggaaggagcgtcctgaagagaaggaacggcatgtgtgaagatcctcaagcgaagcagagggagtgtgtttccttctcgccttagtttgaccaaatctcacgacgcctggactattcgggccacaggctgcccatcctgagttaagctaaagttagttgcatgtgtgtcttatctcttttactagactgtgtgctccccgaaggtaggggcaggattttactcacctctgtcaccttcacagtaccccacattcaggcctccctacggaggaaggaattctgatttactctgtggctactctgtcccaagcccagtggtagttattttatacccgttatctcatttaatccccacaaaaggcctgccatttggttatccctttttttttttttttttttttgagacagagtcttactctgtcgcccaggctggagtgcagtggcatgatctcggctcactgcaacctctgcctcctgggttcaagcgattctcctgcttcagcctcccaagtagctgggattataggcgcccgccaccatgcccggctaatttttgtatttttggtagagacggggttttaccacgttggccaggctggtctcgaactcgtgacctcaagtgatctgcccaccttggcctcccaaagtgctgggataacaggtgtgagcctccacgcctggcctgttatccctctttttcccattttacagatgaggtatatgaggctcagaacacttgggtcacttgcctctggtcactcaactctctagtatctggcagaactgggcttggagcccatttttttttctttcctttttttgtctttgttcccttttttttcagcctacaaaggccatgttgacttgtaggagtcaggaaaactgaattcagagttgactctgtcacagactgactctttgtgaccttggacaaaccacaaactccccctgaacctcagtttcctcatgtggaaagcaaagggggtgtgggaatcaatagcatttgaggccaacctgtggaacttagaatgttgttgatttctctgagtggccacgtgtaccctagacaaagtcatctgcccaagaggcctgtggatgtgttcctctcacctgcactctcttgttcttcaagtctggccctgcctgccatatttttccatgaccccgttctagcctacaagggcaagaactctccaggccttggggtagaaaagggaatttccctggtcccccagttcctcctccccaaaggatgttctatgattcagagctcttctctggcatctctgaccctagctgctgctttcttctgcccccacagctgaccaggtgtatggagaccaggacatgcatgaggttgtgcgaaagcattgcatggactatctggtgagaaaatggaggcctttggggaaggggcagggtgggaggatttcttctccacacagaccttaaccttccaatctattctgcagatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacaggtacttctgcagtgggtaggtgagggaaagatggtgcctcattcgagcctgcccaacctggcctgctgtggatgctccctccttctctttctctgcagaacccatcaacacattccatgggatacatcaaaacgaggacgaacccattcgtgttagctaccatcggaatatccactataattcagtggtgaatcctaacaaggccaccattggtgtggggctgggcctgccatcattcaaaccaggggtgagtgggtccctgtgcccagaatggctgctggatatagaggtcagaaacctctgttggagtctgttttgcccctaactcacaaaaatatcctgtctcctctctcccctgaggtctcacccttacaaaaaaaaaaaaaaaaaatagggagttacttaaggtgatctctcagggcttgttctttggtcttggtttgcctgtctgagttggcttacctatcttttgtgcccgttgagggctggcattttaggatgtggagtcctattttggagcagtgagccagggcttgctctgggcatcttggcatggatctttctcctgggatcatagtggttacagacagccatggtcacagagacatggggtacaggcctggccccaccactcactggctgtgtgatctaggcagattctgtaagtattccaggctggcagcttggctgatacagaaagcacctcccactgggcctggggcctagtaggtgttcagaaggtggcagtgcattttcccagcacataccgatagattctcattcatttctctctctctctcttacagtcatttgctgaggattttggtatcttctattcaggtttcacttctacaaacacaaagtactcctgcttcattttcggaaacacatagcctaacaccaacacaccctccaacatagggttcttttttgttttgtttttaaataaacttaattttagagcaggtttagatttacagaattactgcaaagaggctgggcacggtggcccacacctgtaatcccagcattttgggaagccgaggctggcagatcacctgaggtcaggggttcaagaccagcctggctaacatggtgaaaccctgtctctactaaaaatacaaaaattagctgggtgtggcagtgggtgcctgtaatcccaactactcttgggaggctgaggcaggagaatcacttgaaactgggaggcagaggttgcagtgagccaagattgtgccactgcactccagcttgggcgacagaatgagactctgtctcaaaaaaaaaaaaaaaagttacaaatatattacagagttcccatatgcctcgctatgattaatgtattaacatagtacatttgtcatagttaatgagccaatatcgacatattattaactaaagaccatacttgactcaaattaccttagtttttccctaatgacctttatctgttccaggatcccatccagggtgccatattatatttagttgttgtgtcccctttatctcctcttggctgtgacagtttctcagaattttcttgttttttgtattcgatctgtttactgactctcgttttgccttttctagaatgtcatataattggaaatgtacagtatgtagctttttcagactggcttttttcacttaacactatgcatttaagattcatctgtgacttgtcctggtttaatggctcattttcttttttggtgggcgggtggagagacagggtctcactctctcacccaggctggagtgcagtggggcaatctaggctcactgtagctagcctccacttccctggctcaagcaagcctctcacctcagcctcccgagtagctgggagactacaggtgctcgccaccatgcccggccagtgttttaaaaaaactttttgtaaaaaaatgaaaaaaaattttttttttttgtagagacaaggtctcactatattgccgaggctgaccttgaactcttgggctcaagtgatccttgtgcctcggcctcccaaagtgctggaattacaggcatgagccactgcacccagcttcctctttttctttcttcaaaaatatgaatgttctggccaggtgcggtggctcacgcctgtaatcccaacactgggaggctgagatgggaggatctcctgaggtcaggagttcgagaccagcctggccaacatgatgaaaccctgtttctactaaaaatacaaaaaaaaattagccgggtgtggtggcacacacctgtaatccgagctacttgggaggccgaggcaggagaatcacttgaacctaggaggcagaggttgcagtgagctgagatttgacccctgcactgcagcctgggtgacggagcgagactctgtctgaaagaaaaaataaaaatgaatgttttaagtttttgtatttaatagacttaattgtttagagcagttttagatttacagaacaattgaggagataatacagaattcccacatatccttctcttcccaaacacagttctgctattattattattattattattattattattattattatcatcttttttttgagacgaagtttctctctcatcacccaggctggagtgcaatggcgcaatcttggctcactgcaacctctgcctcccgggttcaagcaattctcttgcctcagcctcccgagtagctgggattacaggcacccgccaccacgcccagctaatttttgtgtttttagtagagacggggtttcaccatgtcaaaggctggtctcgaactcctgacctcaggtgatccacccatctcggcctcccaaaatgctgggattacaggcgtgagccaacgcgcccagcccagttctgctgttattaacagttcaaatcattatggtacatttgttacaatgtgcgaaccaacattaatactttttttttttttttttttaaggcagagtttctctctgttacccaggctggagtgcaatgaggcgatctcggctcactgcagcctccgccttctgggttcaagcgatttttctgcctcagcctcccaagtagctgggattacaggtgcccaccaccacacctggctaatttttctatttttagtagagacggggtttcaccatgttggccacgctggtctcaaactcctgacctcaggtgatccacccgcctcggcctcccaaagtgctgggattacaggcgtgagccaccatgcccagcctaatacgttactattaaatgaaatctgcatgcctccttaggcccctttatctttgatagtttctcagttttgttttgatgaccttgacagttttaaggagtactgatcaaatattttgtaggaaatgtctcttttggactttttctcatgtttaaactagggttgtgggtcttagggaggaagatcacagaggtaaagtgccattgtcattacatcatttcaagggtttatactatgagtgtcatttatgcctgttggtgttacccttgatcaactggcagaagtagtgtttgttaggtttctccacctaaggttactctttcccaccttttccatactgtactgtgtggaaggaagtcactatgtgcagcccacgcctaagaaatggttatgccccatccccttgagggtagagtatctacatagattatttggaaatctttaaggaggatctgtgtctcatccttaactcatccttaatttattaatttttccagttattacgtacatcaatatggtcttttttttttttttgagagggagtttcgctcttgttgcccaggctggagtgtaagggcgccatctcagctcactgcaacctctgcctcccaggttcaagcgattctcctgcctcagcctcccgagtagctgggattacaggcatgcgccaccacacccagctgttttttgtattgtttagtagagatggggtttcaccatgttgggcaggctgaagtctcgaactcctgacctcaggtgatccaccctcctcggtctcccaaagtgcagggattacaggtgtgagctactgcgcccagctcaatcagccatttctttagagagccctggcatgtattggagactgttaacagaaatcaagacctaggtgttgaatgtgctcttcgatatcaggttgtccatgcttctaggccctgtcagctgatagagcaaggagctacatgtatgtatagtggcctttgtacacatatctataaatatttctacctgtaaccatctgtatttatattaaacatgaatccttactgatgtctccaactcagatccattatcacatgcttcattctagccttctccccttgttcatctgcaaattccctctccaacagtagatacgccatcagatgtatatgcactggttcctaccatccatttatgtaactgctcatttccatatacacgcgtagcagaatcacacttgttcacccgtacccccgtgggaaacaactttatcactatagctcaatgctacatatagttcttttttgcctttggtgttacagactccattcattttgaaagtgacctacttgtacccccacccccttcaaatgagggtgtttatttttattttattttattattattattttttgagacagagtctcgctctgtcgcccaggctggagtgcagtggcgtgatctcggctcacagcaagctccacctcccaggttcacaccattctcctgcctcagcctcccgagaagctggtactacaggtgcctgccaccacacctggctaattttttgtatttttagtaagagacggggtttcaccgtcttagccaggatggtctcaatctcctgacctcgtgatccgcccgcctcggcctcccaaagtgctgggattacaggcgtgagccaccgcgcccggccaaggttgtttcatgtttgtaatacatttgtattattttgtcacatttttgcattctatgctgggatctcagatctcctaattttttatttatttatttttgagacagagtctcactgtcgcccaggctggagtgcagtggtgcgatgatctcaactcaccgcagcctctacctcctgggttcaagcaattctcgtgcctcagcctcccgagtagctggaattacaggcatgcactaccacacctggctaatttttgtatttttagtagagacggggtttcatcatgttgcccaggctggtctcgaactcctgacttcaggtgatctgcctgcctcggcctcccaaagtgctgggattacaggcatgagccaccgcgctggccatagatctcctaatttttattttattttattttatttatttatttattttttgagacagagtcttgctctgtcacccaggctggagtacagtggtgcgatctcggctcactgcaacctcagcctccgtggttcaagtgattctcttgcctctgcctcccgagtagctgggattacaggcacgcgccaccacgcccagctaatttttttgatttttagtagagacaggtttcaccatattggccaggctggtctggaactcctgacctcaggagatccacccaccttggcctcccaaagtgctggaattacaggcatgagccaccgtgcccagccttcctaatttttttttaaatagcatatattaaggtccactctttgtgttgtacattctatgggttttgacaaatgtgtaatgtcatgtatctactattacagtattattcagaatagtttgaccacccttaaaattcctcatactccatatgcttacccctcccttcctccctcttcctgcaaacactattgtctttgtgggttgcctttttcagaatgtcatataattgtaatcatacagtatgtagccttttcatactgtttttttttttttttttttgagacagtgtatcactgttgcccaggctggagtgcagtggcacaatatcactgcagcctttacctcctgggtttaagcaatcctcccacctcagcctcccaagtagctgggaccacaggcacacaccaccatgcctggctaactttaaaaatatttttattttgtagagacaggatctcactgtgttgctcaggccaatctcaaattcctggggacaagtgatcctcccgccttggcctctcaaagtgctggtattgcaggggtgagccacctgcagccaatttgcttttttcccccctgaaattaaaatggtcaatgtgacagactgcttcttttcacttagcagtatgcattaaggtttctccatgttctttcatggcttgttagctggtttctttcttatcacttaatgttccttttatggaggtaccagtttaattattcacctattaaaagacattcttggttgcttccagtttttgatgattatgaataaagcttctgtaatgtgcatgcaggtttttttgtggacgtaattttttagatcagttgtatacatacctgggagcaagattgctggattgcgttgtaagattatgttttgatttatgaggaactgagaaactgtcttcccaagtggctgtattatttgcatgcccaccataatgatttggaagttcctgttgtcagcattaccagcaattgatactgtcattgtgttggattttagccattctcttaggtgtgtagtggtatctcattattttaacttgcagttgcctattggcaaatgctgttgagcatcttttcatatgcttatttgccatctgtatagcttctttggtgaattgtgtttgtgacttcctgacatacaattcctaaaatccttagaatctgcaaagtgttgcctttttgtatgctaatgaggtgactgatggctggcagcctctaggtagcttcaggatgggggctggtgacctgaaagaccaaggcaggattagaggtttgcaactttaagcccatcccccagcctttggggaggggagagaggctgaagattaggttgatcactagtgtccaatggcataatcaataatgcctgcataatgaagcttccaaagaatcccaaaaggattgggttctgggagcttttgggtagctgaatacatggaagtttctagagggtggcaccccagggagggcatggaagctccacgtcccttcccccatatctcactctgtgcatctcatctgtatcctttgtaattttctctataataaactggcagacgtgtttcctgggttttgtgagctgctctagcaagttagttgaacccccaaaaaagtattgtgggaatcccaatttatagctggtcagtcagaaattctggaggcccagactttcgactggtgttcgaagggggttggggggagtcttgtgggactgagccctcaacctgtgggatcccaggctgtctctgggtattgaattgcattggaggatggacaccaggtgtccgctgcttgctgtgtgggaaaacaccctccccccagcccgcacacttggtcacagaagtctcctgtgttgattgttgttgagtgagagtagaaaaaacacttggagtgtgtttaacactgccagagtggttagattttttgactatttttttaattggcttgttctaacatagttttacgaattgtttttaactattcacagtaaaaaattacattttatctgaatgcaaggtctgcaggaaaaagaaaagaatacattttacatgattacttagcatatatgcatttgtgtgtgatgtgtatatgtgcattaaaataatgttaactaaagcttcatgaaacaacatttgcacttattccctgggatatattctgatattttctattttttaaaaatgctgttggatctcagcctgaaaaacagtactctgatgtagtgtcctgtaactcatagcaccccacaccatgttgatactgcccccttattccctcacacacccactacttcccccaacccctcacatgcttgaatactccctccacccggtgcacacatagctaatttttgtatgtgtctcatctgctcatgtgtgtgaaagtcctcaacattatgaaacagtcatcactggatggggcttctttaaattaaggcccagggccaggtgcagtggctcacacctataatcccagcactttgggaggccgagtcgggtggatcacctgaggtcaggagttcaaggccagcctggccaacatggtgaaaccccatttctactaaaaatacaaaaaagttagccgggggtggtggcactcacctgtaatcccagctacttgggaggctgaggctggagaatcccttgaacctgggaggcggaggttgcagtgagccgagattaccccactgcactccagcctgggcgacagagcgatacttcgtctcagaaaaaaaaaaaaaataagtcccaggttggaaggcacctgactgctccagtctcagtgcctcagttgaggtggtttgggggttagagtcaggtcttacaagcataggagtttggaatgacaggtcccacatcccaagcctgctttcccctggtccccaatcaagaggtagtctgtggagtgttgctctttgggagtacctgctttcctgtctccttttttttctggggcctgtgggcctacctcgctgagcctgttctggctcttgggcaggttcagtgtgttattgcacatccctgttcctctccctccttgcagtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccaggtgggtcatggactctgtcacaggcttggccaaaaactcattacttctcatgctttgccctcaagcgagcagaaaaaaattaagcagttttgacatctgggagggaaggaagcatccagcaccatctgtaactcatcttggtcttagttttggcattgtaccttggaactttaaatacttgtgcagaacaggcacttaaggagtgagaggagggcagccatgctgctggtgacacgagaataatggatagcttcagagacacaagcttttgttgactgcccttgtgtgccaggtctctactgagaatgtaacatcagatctggactactctgccctcaacgatctcgtctgttggcagagacaactcaatggtggggtccttgaccctgactgggagatcagtggaggtgggggctccggttagtcttcacagaggaaggttgaattgttaggggagcggggaggggcggggcagacaagcatctgaggaattgtaaaatcgcaaggagtttggagtgattgtagatgttggctggcaggagctgagttttttttttttttttttttggagacagagtcttgctctgtcgcccaggctggagtgcagtggcgcagtctcggctcactgcaagctccgcctcccaggttgatgccattctcctgcctcagcctgcggagtaactaggactacaggcgcccaccaccacgcctggctaattttttgtatttttagtagagacggggtttcaccgtgttagccaggatggtctccatctcctgacctcgtgatccgaccacctcggcctcccaaagtgctgggattacaggcgtgagccaccgcacccggctgaaggagctgagttttattccacaaatacctactaccagtctgtggcaggccctgttttcagtatatggggatacataggtgagcccagcagaccaagatccccgtccttgtgatgttcacagttttgcagagtgaaataaaataataaatataatgaataaattagttgggaagtgctatggatggaaagtgtagagccaggataaaggggctgagcaggaatgtgcgttcacggtatgaaatagcgcagtcagggtaggcctcagagcaggtgagatttgagccttgcagaaggtgagagttagctgagcgcacatggaggggaggacagcaggcccacacacctggtacaactcaggcacagcccagagggaggccggtgtatccgaacagaatgtagtagtagatgaagtcagagaggttgtgggtccaattgggtaggggcttgtgggctgtggcgaggactttggcatttactctcagagaggcagaaaccatgggaggattgtgagcagaggacggacaggatgtggttggggatttaataagatcgccttgcctgctagtcatccagtggagtctggtgagtgagggcagaagcaggggccagtgaggaggaggctactgcagtaggccaggtgactggtggccagtgctggcagtggagttggtgagaaggggttggatttgagatctattttcaagatagaggtaacagggtttcctgtcagattggctgtaggggtgtgagagaaagggtaaggagctccacctctgtcctgtgaggagtcttgtggtccaccgtgtgagtggggatgatgttgacctacatagaagctgtatcatagccaaggtcctgggaagggagccagcattcagggatgggtcacaagaaggtcatggctgctggtggtccttaacgcatttaccttccccgctgcagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtcagtgacttgcccacagggaatgtgctgggagttaggaggcacgtcctgggtcctgggtcctggatcctgggtccctacctttgactgtccgtctgcttcaggtacaagcagtcagttctcggcaggggccgaccgggcaacttccccccttgtgtccctctaccctgctttggagtgccgggccctcattcagcagatgtccccctctgcctttggtaagcctcctttgtctggggggatggaggctgctaggagctgggagagactggaagaagtggcaagtcctgagaggggctttctggagcctctggccatctccccaagaaaagaagggagaggcactggaggggatttttcagatccaaggaatttgccccagaagggtctggggtctaagtggggtttcacaggcctagcagatccttctgttttgagaaaggagtgagaagggccctatgggatttctccagagccccagatgtcggcacagggtgaggagaaggcaggctgagagcgctccatcatccttttcctcttcctctcgcccagcaggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccagtactcctgctctccggtgccacctcaccttctttggcttcttccctcttgcctccttctgttctttctgctctcccctcttttccctcctcctcacttccctctggctagcccacccctgcactctctctcattgccgctgccactatcacctgtctctctgccagctgatgtgccctgttgccccccaccccatcccgcacagaaccatccctgcattccacaggggactcgggcaagggtgccgaagatagacaagaggcacacagagacagaccaactggcagccaggcagccccagaggagagagacattcagacagaggaaagtctccctgcccctcattccttccaagatgagaaaaacttgccgccaccccccgacactgatgccagggaggtgggaggaagaagtgggaaatttcccttcccagtacccccaagaacgtctgagccttcaatgttgaattttttctttattaaaattacttttatcttataaaatcaactaatcaaaaatgatatagacgacagcactggctctgtgaaggtggcatctttctgggcaggcaggccatggggcatggaggagggtgcaaagatatgggttgctgtcttctggcctccagctgcatggaggccggcccagggtctagggtgtgcactgggcaagggcagggcggcaggtgtcaggccggcttggacaatgaaaccctgaccttgctgcattccttttgcttccaccaccactagcttctttggaatcttggggtgggggtcatctttggggattatggctgccacccgggatttgagtgtagggagtgtgggagcagccttggcagatggggcacccgtgccctgcaggtgttgacaagatccgccatctgtaatgtccttggcacaataaaaccaaatgtcagtttccctgagcgactctgttctgtgtggggcaggggttgggcgggcctctgggcagaggatgcaatggcacggaccttggcttgacctcagaggtgtgaatgctctccagcagggtctgtctgggggcctggagtttgtatttgatttgctgcttattaaacctccttctggacctattgccactggaaaagctgcgtctttgcctgctgaccccacccctgcctaccctatttcctgggggggggggggtgatggtagcagaggactgtgagcttgaacttcctgcctgaattccagcttctccgcctgcctctcaccatgaatgctgctctttccttatcatgatctgatgaagaaaagccttggaaaagtgcaactgatactttgtagcaacatgagtttagtggaagtaaccagaggggcctcacccactaggttttagaaggtgaaggacggctaaacccttttttgttcttgtcccccagtctgacacctctttgcctgtcctccctaggggtaaatccaaggtaaagaaggctggctggcccccaggttttctcaagcagctttttcaccatgccatgataatggagaccctctgacaggatgtgtgtctggttctgcagttgagggcatggctagctgagtggctgtctgcggagtgtgtctggaacccagtggccaagcatctatttgttgtagagttgctttgaaaccttcctggccctggtcaattgcttctctgtttcaagtgtctcatctgtacaagaggtgattaggctgggtgcagtgactcacacctataatcccagcactttggaaggctgaggtgggtgaatcacctgagatcaggagttcgagaccagcctggccaacatggagaaaccccatctctactaaaaatacaaaaattagccgttcatggttgtacgtgcctgtaatcccagctacttgggtggctgaggcatgagaatcgcttgaacccaggaggtggaggttgcagtgagccgagattgcgccaccacactccagcctgggtgacagagcgagactcagtcttaaaaaaaaaaaaaaaaagtgatatctactccctcatgcttctgctgtgatcatctagagggaatatgtatgatcaaagtaacgtactacctgggcacagtgcttggcacattgagagagcacaaatgttagtagtattctttttgtagaagtttctgcaccatttggcccctgccaatctctcgccgctctgtccagtgttcttggcctttgcctgcaatttgccctcccctgtcctgagccaccaaccttctttgtctttcaagacagagggtcacctgctgagaagcccattcacattctcacttctatctaaaaatctccccagtagctgtactacagataaacttcatggcacgggtttgatgcctgactta

SEQ ID NO: 176 - DNA, 3979 bp, mus musculus
cggcgaaggccgaaccacgccatgtttctcctgacttcgtaatctcctagccctgttaacgaaaaaagacacgctggacgatccatcccggctaggggtggtacggtgttgaccggaaatccccagagttgccgccagtggtttttcccaggtcgcctttgtcagtggggggcggggcacggatgaacctgttgagggccggcggggacggtggatgcttcccgcggtcgctcttggtttttcccagttgtgccggattgaaaaggggcggggcatggttggacgggctcaccgtcggagaaggggtgcgacgcggtcctgctttgctgacagtctgtcttggctagttaacacgcctatgtcgcttattgaaacgtcaactctgcgtgtgccaattcatttaatctttgatcacagtaaaaccgttggctgattccttggttggtagacagggcgaagactaatatttctccccctttgccccatttctcgctttaatgggggggtgtgtggaaaaagcgtgacagaactagctcattattatctgaagtgtttgttcctacttaggaacttcccattctggtgacttggtttctcccagttagaaaagagttcgtgtgacaggacctgggggagggctcacattaaccccgtccttcccttcctgcttgcagcccatggcgaattgtggatgattgcggtggagccttcactatgggtgtcatcggtggcggagtcttccaggccatcaagggtttccgcaatgcccctgttgtgagtccaggccttccctgggttggtgtggggttagctatcttgcccacaagggaggctgctctgaaaactgcttggagctgccagtcacgtgcacttattcattctggtgcccactcacctactatgtgccgagcctggctcctgtatctgggattttgtagggattgcaaacatggcctctgtcttccaccctccaccccacccaactggagctcctctgtggaaatgctgtgtcgttcaaagagtcatcaccaaattttaaatgtatgtgcaaagccagacagttttttttttttttgagacagtcttgctctgttgcccaggctagagtgcagtggcacgctcttggctcactgcaacctctgcctcctgggttcaggcaattctcctgtctcagcctcccaagtagctgggactacaggcatgtgccaccagacctgacgaatttttgtaattttagtagaaatggggtttcactatgttggccaggctggccttgaactctggacctcaggtgatccacctacctcggcctcccaaagtgctgggattacaggcgtgtgccactgtgcctggccatgtttttttttttttttttttttttgagacagcatcttgccctgttgcccaggctggcgtgcagtggcctgatcatgggtcactacagcctccgcctcccaggctcaagtgatcctcccacctcagcctcccaagtagctgggaccacaggactgcgccaccatgcccggctaattatttatgtatgtatttatttatttgtagagacggggtttcaacgtgttgcttaggctggtctctaattcctgaactcaagtgatccacccacctcagcctcccaaagtgctgggattacaggtgttagccactgcgcattttacctagaggcagattctggctcagaaacccggatagaggaaaatgacaggaatttaattggcagacggaagacagccttgaagttgagagaattcttttaacataattctttttctctgaccacctcccctcccagaagatcgcaaatgccatgactttaaatgccatctattagccaaggtctctgcaatttatatatgtagccccgtccctcccctagactcctggaactctcctccctggatctttgcccaagtttgtcatcctcaaggtctcagcacagattccccctccttcaagaggcctttcctgacccctcagccccagtcatatttcttcatggcatttcctctacagtgcagattgctgtctgaagctcccttgtttatctactcttgctcaagatctgtgtctcccaccgttaatgtgagctctgagagggcagagagcagacctaccttgttcatggctgtatccctgcatatggcatggtgcttggcacatatagtaggtacttgttaatcattcactgaatgaatgaatgaacaaatgtatgaatgaattagcacttctcaacctagctctgagaacacccatgttggggcgctctccaggccactagttcttggccacttctccacatctctacagctcatacctctaacaggtctcccatcttcttccctctcttaaaagttggaaacgtgtctgccagtggcttcagccctgccctaacgcccttccttcctttccccagggaattcggcaccggttgagaggtagtgccaatgctgtgaggatccgagccccccagattggaggtgagggacttggggagatagatataggagatgtcttggcaaaggtgggagtggttgatcctttgggtctaggctgcaagttaggggttcagattctagcccctgccagagactttctaggggggtgatgtttcccaacaattgaatatggaggggaagaaagtgggttctggagtttaaatctaggtcctgactgttccctgccatgtgaccttgggctagtggcttaacctctctgaacctcacttgtaccgtgggggtggtgataacagtaaccatttcatcggtagttttatagtttatgtaatttacatactactaagtgctggttgctatgctaaacactttaataacattaactaatttaaaattgcagaagtcaaataacagagcacctcgaacaggtcctggcacacagtaagccctcagtaaacattttaactatcatattaactgggtttcctaacctatttccttctcactgaaacccaaatcagaattccaactctgtgtggtgattatgaagctcaaagttgctctgttaaaagccatatgaagataaatctgcttgtaaacatttgtcaactccccataaagatgaagggaatgttgatggtgattatagacggcttgaagtgggagctaccacaggatggggacagataggaaatactctgtgtgggtttgctatctgcctttgtgtctgggtttttctccctgttcttggccaaagcattcaggccttggaagtcccctgagatgtgaattctcaggatttcccaggaactaattaggcctcggttccactacaggtagcttcgcagtgtgggggggcctgttctccaccattgactgtggcctggtgcggcttcggggcaaggaggatccctggaactctatcaccagtggagcattgaccggggctgtgctggctgcccgcagtgagtgacccctggccctggccccagccccttccaccctgttctgcctgctctcacctctgtttctctgcctccaactcccccaggtggcccactggccatggtgggctcagcaatgatggggggcatcctgttggccctcattgagggcgttggcatcctcctcactcgctacacagcccagcagttccgaaatggtgagtaactggtggtcgggggagtgggaaatactccacctggcctcttccactcatccttacccaagtctcccttctccagcgcccccattcctggaggaccccagccagctgccccctaaggatggcaccccggccccaggctaccccagctatcagcagtaccactgaggaagccactgccaccatgggagctacttctcggttccctccccgatggtctacctcgaagggagggctggctcccagttagccctgggaccctccagagagggtttctactctgctccctagtcccagggtgggggtggggcaccccagctgccctgacagatgggtccccttt

SEQ ID NO: 177 - DNA, 61541 bp, mus musculus
ggtaataggcggaaagctccgacgccggtgtgcgtctacgctgggggcgtggcctgactgcgcggccagacgccagcgccatggaggagtacgctcgggagccctggtacggcaatgggcacaggcatccggaatattgctgcgacgccaaggccagccgtgggggtcgggcgggggaggcatcggccgcacagagccatgtaccagactcgggggactcttaacgtatctcccgctacccccactcggttcctgtcattcgggctccgttatgaggggccacaaccagagaaggtgcggcgaaggccgaaccacgccatgtttctcctgacttcgtaatctcctagccctgttaacgaaaaaagacacgctggacgatccatcccggctaggggtggtacggtgttgaccggaaatccccagagttgccgccagtggtttttcccaggtcgcctttgtcagtggggggcggggcacggatgaacctgttgagggccggcggggacggtggatgcttcccgcggtcgctcttggtttttcccagttgtgccggattgaaaaggggcggggcatggttggacgggctcaccgtcggagaaggggtgcgacgcggtcctgctttgctgacagtctgtcttggctagttaacacgcctatgtcgcttattgaaacgtcaactctgcgtgtgccaattcatttaatctttgatcacagtaaaaccgttggctgattccttggttggtagacagggcgaagactaatatttctccccctttgccccatttctcgctttaatgggggggtgtgtggaaaaagcgtgacagaactagctcattattatctgaagtgtttgttcctacttaggaacttcccattctggtgacttggtttctcccagttagaaaagagttcgtgtgacaggacctgggggagggctcacattaaccccgtccttcccttcctgcttgcagcccatggcgaattgtggatgattgcggtggagccttcactatgggtgtcatcggtggcggagtcttccaggccatcaagggtttccgcaatgcccctgttgtgagtccaggccttccctgggttggtgtggggttagctatcttgcccacaagggaggctgctctgaaaactgcttggagctgccagtcacgtgcacttattcattctggtgcccactcacctactatgtgccgagcctggctcctgtatctgggattttgtagggattgcaaacatggcctctgtcttccaccctccaccccacccaactggagctcctctgtggaaatgctgtgtcgttcaaagagtcatcaccaaattttaaatgtatgtgcaaagccagacagttttttttttttttgagacagtcttgctctgttgcccaggctagagtgcagtggcacgctcttggctcactgcaacctctgcctcctgggttcaggcaattctcctgtctcagcctcccaagtagctgggactacaggcatgtgccaccagacctgacgaatttttgtaattttagtagaaatggggtttcactatgttggccaggctggccttgaactctggacctcaggtgatccacctacctcggcctcccaaagtgctgggattacaggcgtgtgccactgtgcctggccatgtttttttttttttttttttttttgagacagcatcttgccctgttgcccaggctggcgtgcagtggcctgatcatgggtcactacagcctccgcctcccaggctcaagtgatcctcccacctcagcctcccaagtagctgggaccacaggactgcgccaccatgcccggctaattatttatgtatgtatttatttatttgtagagacggggtttcaacgtgttgcttaggctggtctctaattcctgaactcaagtgatccacccacctcagcctcccaaagtgctgggattacaggtgttagccactgcgcattttacctagaggcagattctggctcagaaacccggatagaggaaaatgacaggaatttaattggcagacggaagacagccttgaagttgagagaattcttttaacataattctttttctctgaccacctcccctcccagaagatcgcaaatgccatgactttaaatgccatctattagccaaggtctctgcaatttatatatgtagccccgtccctcccctagactcctggaactctcctccctggatctttgcccaagtttgtcatcctcaaggtctcagcacagattccccctccttcaagaggcctttcctgacccctcagccccagtcatatttcttcatggcatttcctctacagtgcagattgctgtctgaagctcccttgtttatctactcttgctcaagatctgtgtctcccaccgttaatgtgagctctgagagggcagagagcagacctaccttgttcatggctgtatccctgcatatggcatggtgcttggcacatatagtaggtacttgttaatcattcactgaatgaatgaatgaacaaatgtatgaatgaattagcacttctcaacctagctctgagaacacccatgttggggcgctctccaggccactagttcttggccacttctccacatctctacagctcatacctctaacaggtctcccatcttcttccctctcttaaaagttggaaacgtgtctgccagtggcttcagccctgccctaacgcccttccttcctttccccagggaattcggcaccggttgagaggtagtgccaatgctgtgaggatccgagccccccagattggaggtgagggacttggggagatagatataggagatgtcttggcaaaggtgggagtggttgatcctttgggtctaggctgcaagttaggggttcagattctagcccctgccagagactttctaggggggtgatgtttcccaacaattgaatatggaggggaagaaagtgggttctggagtttaaatctaggtcctgactgttccctgccatgtgaccttgggctagtggcttaacctctctgaacctcacttgtaccgtgggggtggtgataacagtaaccatttcatcggtagttttatagtttatgtaatttacatactactaagtgctggttgctatgctaaacactttaataacattaactaatttaaaattgcagaagtcaaataacagagcacctcgaacaggtcctggcacacagtaagccctcagtaaacattttaactatcatattaactgggtttcctaacctatttccttctcactgaaacccaaatcagaattccaactctgtgtggtgattatgaagctcaaagttgctctgttaaaagccatatgaagataaatctgcttgtaaacatttgtcaactccccataaagatgaagggaatgttgatggtgattatagacggcttgaagtgggagctaccacaggatggggacagataggaaatactctgtgtgggtttgctatctgcctttgtgtctgggtttttctccctgttcttggccaaagcattcaggccttggaagtcccctgagatgtgaattctcaggatttcccaggaactaattaggcctcggttccactacaggtagcttcgcagtgtgggggggcctgttctccaccattgactgtggcctggtgcggcttcggggcaaggaggatccctggaactctatcaccagtggagcattgaccggggctgtgctggctgcccgcagtgagtgacccctggccctggccccagccccttccaccctgttctgcctgctctcacctctgtttctctgcctccaactcccccaggtggcccactggccatggtgggctcagcaatgatggggggcatcctgttggccctcattgagggcgttggcatcctcctcactcgctacacagcccagcagttccgaaatggtgagtaactggtggtcgggggagtgggaaatactccacctggcctcttccactcatccttacccaagtctcccttctccagcgcccccattcctggaggaccccagccagctgccccctaaggatggcaccccggccccaggctaccccagctatcagcagtaccactgaggaagccactgccaccatgggagctacttctcggttccctccccgatggtctacctcgaagggagggctggctcccagttagccctgggaccctccagagagggtttctactctgctccctagtcccagggtgggggtggggcaccccagctgccctgacagatgggtcccctttttctctctcagggcaccccagccccacactcacatgtacgaagttctcaccccagctcctttgtgtggcaccctgatgagtatttaaagcccgttttgaaatgcctatgtgtggactccttgaactgcctatggggcccctccttaggatgaggggcagagcctgcttcagggacttggaagccctaggacttggaggcccacagcaagtgggctctagtaaatgtctatgggatggatgagcaggaagggagaatgaagatgtgaattagggacatgaataaggttgtctggggcctggtgatgggtcctagctgtcagaggaacaagcttgggaaagaagtgaatgaacaccaggattgctggggatgggggtggttctggacgttgcacccttgaccccatccccccccacacactccaatatccctgactcctggtccacaagcccccgtcaccgaggctgggaaatgtggcctcacaggagtcccttctttctggacactcagcacggcatttgtgaaggtgattcccctccctccatgtggcctcagggtggatctgggatggaagaagggggccaggagacctagctccttcaaagaaggtgccctggatcagcctccccttctgtcacagagctgcttttctgctttcctctgctcagtgtggtcaagtgtttttatttgttgttttgagacggagtcttgctctgtcacccaggctggagtgcagtggcgtgatctcggctcactgcaacctccacctcccgggttcaagtgatctcctgcttcagcctcctgagtagttgggattacaggcgtccaccaccacacccagctaactttttgtatttttagtagagacgaggtttcaccatgttagccaggctggtttcgaactcctgatctcaagtgatccgcccacctcggcctctcaaagtgctaggattacaggcgtgagccaccacgctcggccaatttttgtattttcagtagagacggggttttaccatgttggccaggctggtctcaaactcctgacctcaggtgatctgcccgcctcggcctcccaaagtgctgggattacaggcgtgagccaccgcacccggccaggtctagtgtttttaaagggtaaccacaaaataaccagaaatgagttttcattttgggatgggggagctaggagatttttctgggtggacatacccccgcccccaagctgtgacttctgcgaaaagctctacctgggtggggcaaacattgcctacactggggtgcagaagccacggggaggctcaaaagcttcctgaggagttaagggtttcctctgcacaaactgctccagtggcgaatacctcgagagacatgaaaaacgtccctttcttgcaagccagtcccttacaaaactggtccgtgggaatgtaaagagtcctcagcggtgacagctgtgatacctgtttgagcgactcaatgccgggcagggcgcagccacgccactgagggaccagggagggcagcgcggggcccgggcttaggcctcgaacccgcatctccacaagtaccgcggcggcagcaccaggcatgcatctttgagatcggagcgccagtcagacccagggtgttccttgtgtcctggggccaatacctcctttagtcccgccccttctggatctttgggccggccctgccccctgcaggccttcacttgcgtggatctagcgccgcccctggagagtagctcctggaggcccttcccttccgagagtcctggaggctccacgctcccttggtctccggccctgcccctcggacccgccctggtcgtttcgctcaacaccgtcccctgagcccgcggcgggccccacctccttcctacaaccacccggctcctccgaggctgcgcctctccacgctccccgagacccgcaggctcccgccctcggcagcctctggacccacctcctcccaccgccaggccccgcccctctcccgcgcgcgggtccagctgcgcagtctccaggctgcgggcggccggacccacccgcggggcctaggagcggtccttctgcgtgccctcggcccgggtggcttgaccgcttgcggcgacgttcggggcctcctccggccgctggctggggcggggctggggggccggagtcacctggagtggggcgggagcagcaccacgtttagaagcgagggagcgggctgggaaaccgaggctaggggcctcgcgtgagagttgcagggaggctggggacggtgccgggggaggggggactccgtggaggcctcgcgtcaacggcatcacccaggctcaccaggcccggagctggggctggggcgccctgggtcgtccgcggctcgcgagctggggcgcgcggctggggcgagccctgaggccccgccctctgactgacctaggcccggggccggcggcctctgttcctataagaaggaaatacggggtgagacccttggttgtttcgacgagaagagactacagagaccaagggaagacgggggatggagagataaagagagggagagaaatagaaacagacatgcacgtagggaggtagagaccgacagagaggtggaaagagatggaggcagagagacacgcaagagatcaatgaaaagagacagagaggaggagagacgctaagaaatagaagaagctgcgtgagggtcagaaacgcaggcaggtagaggggaataccacgtcagatgcaggcaaacacaggagacatagtgaggagcgggtgagctgtgagctggcttcaggccgggcctcctccggctgccgcccacccacaccctagctgcggggcctcaggggacagatgccttacctgcatcctcttggtgtctctctctggcactctcccagtctcgtcgctcatttaatcccatctgcttccagcaaggacttcagcggctctgtctcaggttcctcctcctgtttcttcctgcttcctccctgcctaagcccttagtctctgcctctatctgtcttgatctctcagctccgcatcctcattttttttgctttggtctccctggctggtgctttcacagtgtgaccccggtggcccttgagtttgccacccacctgtctgcatggggagaagggaaatagtctgtgggcaagaggggttaaggaggtgggtgggatcagagaagagcaagggggtccagccctgacaggtgtgggatcactttactcacttcctcagggacagaccccgacaggtcagggagaaagagacagacatgggggaatcaaagggacagaaagagaatagggagaaagacatagaaagagaagccagagtttacggagagatcaaaggagagagagatgcagaaaaagataccaagaggccgggcgtggtggctcatgcctgtaatcccagcgctttgggaggccgaggtgggtggatcacctgaggtcaggagttcgagaccagcctgaccaacaaggtgaaaccccgtctctactaaaaatacaaaagttagctgggcatggtggcacatgcctgtagtcccagatactcgggaggctgagacaggagaattgcttgaacccgggagacagaggttgcagataactgcactccagcctgggtgactgaacgagaccctgtcttaaaaagaaaaaaaaaaagtgagaaggaggggccaggtgcagtggcttatgcctgtaatcccagaacttgtggaggccgaagtgggcaggtcacttgaggtcaggagtttgagaccagcctggccaacatggtgaaaccccgtctctactaaaaatacaaaaattagccaagcacggtgacgggcgcctgtaatcccagctacttgcacggttgaggcaggagaattgcttgaacccgggaggcggaggttatagtgagccgagatcgcgccactgcacttcagcctgggagccagagtgagaatccgtccaaaaaaaaaagtgagaaggagaaagacacattggcaaagacacaaggcagaggtaacagggaaaaaagaaaaacaggagcagagagagaatgagattgagaaggtaaaacggatacagaggagcaagagatggagtcaatgcagaggcaggaggagcaaaagggagacggaagagaggtgcacgcacttcaccttgagtcgggctgctggtctcagtgttcctatttccgctgctctcttagtggcagttggagaacagggcttgacaggcagggcagctctgacacccctgaccccaacctaggggcagacctttagagattgatgctctgacgttaaaaaatgcgaaccatcccggtgggcccatttaggaccacgtctgaggtgacacaaaactgccttttgttgtcctcatttgcacttgaggaaactgaaacacaaaaaggcgaagcaacttcccatgactacactgcctcagaggggcaaggctgggactaaaatccacggccgggcgcagtggctcgcacctgtaatcccagcactttgggaggccaagacgggaggatcgcttgaggccaggagttcaaaatccttatttacagcacttagagtttcagagatgtcatttacaacatagacaacatattctcaattataactacaggtgtcatttgaaggttttatgagccttctttgctaaagtaataatttcaaggacaaacattcctctttttgcttttattattttatttatttaagacagtttttctctctgttccctgggctggagtgcagtggcacaatctcggctcactgcaacctctgcctcctgggttcaagcgattctcgtgcctcagcctcacgagtagctgagattacaggcacatcccaccatgcccagctaatttttgtatttttggtagagatggggtttcaccatgttggccaggctggtctcgaactcatgacctcaagtgatccgcccgccttggtctcccaaagtgctgggattacaagtgtgagccactacacctggcctattattattattattattattattttattattttcgagacagagtcttgctctgtcacccaggctggagtacagtggcgtgatctcagctcactgcaaactccacctcctgggttcaagcaattctcctgcctcagcctcccaggtagctgggcttacaggcacacaccaccatgcccagctaatttttgtattatttttttttttagtagagatggggtttcaccatgttggccaggctggtctaaaactcctgacctcaggtgatccacctgcctcggcctcccaaagtgatgggattgcagatgtgagccactgtgcctggccccagcctattatttttaatagacacataataattgtaaatatttatggggtacagtgtgactttttcattttgaggcaggatctcactttgtcgcctgggctggagtgcagtggcaccatcatagctcactgcaccctcaacctcctgggttcaagcgatcctcctgcctcagcctcccaagtaggtggtactacaggcatgcaccaccatgcctggataattttttatttattttattttattttatgttattttattttatttgagatggagtcttgctctgtcacccaggctggagtgcagtggcgcaatctcagctcactgcaagctccgcctcccgggttcacgcctttctcctgcctcagcctcccgagtagctgggactacaggcgcccggcaccacgcccagctaatttttttgtatttttattagagacggggtttcactgtgttacccaggatggtctcaatctcctgacctcgtgatccgcccgcctcggcctcccaaagtgctgggattacaggcgtgagccaccacgcccggcctttattttttattgaagacaagatctcaccatgtttcacgggctgctcttgaactcctgggctcaagtgatcctcccaaagcgctgggattacaggcaagagcagcctggcctggcctatagctgtacttttgtatttgttaaccaaccttttgctctccccactgtggacagacttgacttaatggagatggcgttggtaacgatcctgggcatttcagagggttctgtagttgtacagggactcaagacagacattcttgtcaaagtttctcaattcaacacttcaccaaatcagatggtgtaaacaaactttatgatggagattggactctctccccccacagccaaaaggaaacttagattcctttagttaattataaagacaatcattattaaggctagtgtctggatctggaatttaattaggtgaacattaaaaagaaaatacatttaggcctatggagctaactttttattgcaaaatacaaaggatagtcaattttctttaaatttcagtgaaataatgagcatgttatgttttccatctacaaaatcaaaggattcctttaggatctgtcccccacttagccccctttcagttcaaacaggctttccttctttcgttctttttgagacaaggtctcattctgtcacccaggctgaagtgtagtggtgccatctcagctcactgcagcctcaacctcctgggctcaagtgattctcctgcctcagcctcccgagtaactgggaccacaggcgtgagccaccacatccagctaatttttatacttttttgtagagatggggttttgccatgttgcccaggctggtcttgaactctggggctcgaatgatctgcctgccttggcctcccaaagtgctggggttacaggcatgagccactgtgcccggccaacacaggcatcttctgagatgtgccagatactatgtggtccttggatgttgactcatgtatgatgctcctgctttatccctcaaactgactatggggtacttccaggtctaactctcggttaaatctgtatcccctagaggcataggaaatatttgcttgctcttcccagccataacgggagtgcagtggttttgtggggcccatctgcctagaccgacatacagatatgtctacccaaaaagacatagtcagcttcaaacacatatggttgacaaaggatgaatagccacaatacaaggggacttcaaaaagtgtggaaaaatgaaatgacaattgcctttgtttgatgagaggagtaggcaggagcattgttgtggtggagaaagattttctggtgaagctttcccaggtgtttttctgctaaagctttggttttctcaaaacactcagaatacataacttttttttttttttttttgagacagagtctcgctctgtcgcccaggctcaagtgcagtggctcgatctcggctcactgtaacctctacctcccaggttcacgccattctcctgccttagcctcccaagtagctgggactacaggcacccgccaccacgcctggctaattttttgtatttttggtagagatggggtttcaccatgttagccaggatggtctcgatctcctgacctcgtgatccgcttgccttggcctcccaaagtgctgggattacaggcgtgagccaccgcgcccggccctttttttttggagacggagtcttgctctgttgcccaggctggagtgcaatggcgtgatctctgctcactgcaagctccacctcccgagttcatgccattctcttgcctcagcctcctgagtagctgggactacaggtgcctgccaccacgcccggctaatttttttgtatttttagtagagacagggtttcaccatgttagccaggatggtctcgatctcctgacctcgtgatctgctcgccttggcctcccaaaatgctgggattacaggtgtgagccactgcgcccggccctttttttttttttttcagatggagtgtcgcttttattgcccaggctggagtacagtggcaccatctcggctcactgtgacctccacctcctgggttcaagtaattctcgtgcctcagcctcccgagtagctgggattacaggcatgtgccaccacacctggctagttttttcgttgttgttagtagacatgcagtttcactatattggccaggctggtctcgaactcctgtcctcaagtgatccgcctagctcggcctcccaaagtactgggattacaggcgtgagccacctcacccggccaaccttggcaaagtaaacttcaaaactgattgagacctgtctgggatactttttggttcacaccctcttaggaggctgccccttacctggtcctttggctaaggggaagaggtttccccaggtctctgggtcttttatttctttgtttagagatgagggtctcactatgttgcccaggttagatttaaactcttgggctcaagcgatcctcctgcctcagcctcctggatagctgggactacaagcacgcaccactgtgcccgccaggctttcctgagtcttttttttctgcaccgcttggtgttctgcgttgctgctttctccagcacctggtcttgaatgcataagaaaacccacggggctcagcaccatgtcatttctcgattccgaatccctagccatctgctggctcttctgtaccttgcagtcttctcaagcttgttttctatgtaacatccattggtttcagctgtactttgtaggcgaaacagggaggagtgtatccactccgtcttttccaggaactgtggcaggtcaggtctccataagccctttgttgtaatgatgagtgtataagtcaaacattaaagcaggagcaaaaaatgaatactgacctgggaaaactggtgcctgagtgccagagctgaaatgcaaaaacaaaccatgaaaacccctcctggatttctcaatctcaaaacctgatagagtaataaaagcattcctacacatgcgacccctaccaaaacccatttaggattaagattaagaaacttggccagccacgatggctcatgtctgtaatcccagcactttgggaggccaaggtgggcggatcacgaggtcaggagttcgagaccagcctgaccaacatggtgaaaccccatctctaccaaaaaatacaaaaattagccaggcgtggtggcatgtgcctgtagtcctagctactcaggaggctgaggcagaagaatctcttgaacccgggaggcagaggttgtagtgagccgagatcacgccattgcactccagcctgggtgagagagcgagactccgtctcaaaaaaaaaaaaaaagaaaaagaaaaagaaataaagtttcctaccttcagacccctagttaagaggattagatggccaggtgaggtggctcacgcctgtaatcccaactctttgggaggctgaggtgggtggatcacttgagcctaggaggagttcgagaccaccctcggcaacattgggagactgcatctctacaaaaaatttaaaaatcaattgggcatagtggcgctgttctgtagtcccagctactcaggaggatgaggtgggaggaatgcttgaaccggggaggtctagactgcactgagctgagatcataccactgcagtccagcctaggcgacagaacaagaccctgtctcaaaaaaaaaaaagacaaaaaacaaaaaaaccattagattaagaaacactcctgcacataggcatagagtttgaattgtatacataagctaacaaaacacctaactttgggtgggtctggtgagttactccgaccttctctctgtagccagctgcagaaaaaaactcccttctcttctagtctgactgcttcttattattggaccacaagaacaagcaggtccatctgggaacagaaccagaagactgggtattggcgtttatcaaatactggggtgggccgggtacagtggtcacgcctgtaatcccaccactttgggagaccaaggcgggcagatcacttaaagtcaggagttcaagaccagcctaaccaccatggtgaaaccgtctctactaaaaatacaaaaattagctgggcatggtggtgcacgcctgtagttacagctacttgggagtctgaggcaggagaattgcttgaacttgggaagtggaagctgcagtgagcccagattgcgccactgcactccagcctgggcgacagagagagactctgtctcaaaaaaaaaagaaaacaaaaaataaaaaactggttttgtttgtttgttttttagatggagttttgcgcttgttgcccaagctggattgcaatggcgtgatcttggttcactgcaacctctgcctcctgggttcaagcgattctcctgcctcagcctcctgagtagctgggattgcaggtgcccgctaccacgcccggctaatttttttgtatgtttagtagaggcggggtttcaccatgttggccaggctggtctcaaactcctgtcctcaagtgatccacctgcctcggcctcccaaagtgctgggattacaggcgtgagccaccacacctggccactgggttgtttttgttttctcatcaattgatatgatcatatgctttttttttttaacctgtcgtggtggatgacattgatgagtatcaaaaactgaaccagcctttcatacctggaacaaatcctacttggtcatggtgtataattcctttaaaacattcctggatttgatttcctaatattttgttgagggtttttgtgcctaaattcacaagagatatcagtttgtagctttccttttgtgtgtatgcttttttccctggttttggtagcaaggtaaaactggcctcatacaatgagttgggaggtgttccctttgcttctattatccggaagacagtctacaaaattgacactaatttcgctttaagtgttaggaggaattctccagtgaaaacatctgggcctcaagatttcttttctgagggctaaataataaatttaaatttttaatggttgtagaattattcagatcgcctattttatattgcttgagtttggtcgtttgtgcttttggagtaattggtccatttcttctaagttgttgaatttatgagaatagagttcttcttcatggaacttgcagtatcctttcagtgactgcaaaatctgtagtgacatcccctctttcattcctaatattgatgatttgtatcttctctctttatctttgccagtcttgctacaagtttttcaattgtattgatcttttcaaagatccaagtttttgtttcattgattgttttctctgctgtttttctgtttttaattgtattgatttctgttcttatctttattatttcctgccttctgcttccttgaggttcctttgctcttctttttctagtttcttgaagtaggaacttagattattgatttgagacctttcctcttttctaatgtaagtacctagttctataaatttccatctcaacactacactcatgcattgcacatattttgacaggtgtattttcattttttccagttctgtgtatttataaaatttccttttgacttactttgtgacccatgggttattgagaagcatgtttttaaataagtgtttagggggttttcctgttgtctttctgttatgatttctaatttgattctatataatcagagaagatactccctctgattttagtttttttaaatttgttgaggtttgttttatggcccaggtaatgttctatcttgctgaacgttccacaggcactcaaaaacaacatgtattctgttgttgggttgaatgttctataatgtcatttcaatactgtttttttgttttttattttttgacacagaatcttgctctgtcgcccaggctggagtacagtgatgtgatcttggttcactgcaacctctgcctcctgagttcaagcgattctcctgccccagcctcccaagtagctgggactacaggtgtgtgccaccaaacctggctaatttttgtatttttagtagagacagggttttgccatgttggccaggctggtctcgaactcctgacctcagatgacccacccaccttggcctctcaaagtgctgggattacgagcgtgagccaccaagcctggccttgttactgttgattgatggtgttgtttagttcttctttatcattgcttgaatttctctctagtaattccatttgttgcaggggtggtgttgatatcctcaattataattgtggatttgtccatttctcctttcagcctgatcattttttcttcgtgtaatttgaaatgatcttgtttagtgcatgcacatttaggattgctatatctctttggtggattaatgtgttttttttgagacagagcctcgcactgttgcccagactggaatgcagtggcacgatctccgttcactacaacctccacctcctgggttcaagcgattctcctgcctcagcctcttgagtagctgggactacaggcgcatgccactacgcccggctaattttttgtatttttagtagaggggggtttcaccatgttgaccaggatggtctcgatctcctgacctcgtgatccaccagccttggcctcccaaagtgctgggattacagacgtgagccaccacacccggcccacgttttctttattcacacattgttggatagaggttgatttcctatcttggctattgtgaataatgatatcatgaacataagagtgcagatattattttaacatattgatttcttttttcttttttttgagacagagtttcactcatgttgcccaggcttcagtgcaacgatgtgatttcagcccactgcaccctctgcctcccgggttcaagctattctcctgcctcagcctcccgagtagctgggattacaggcatgtgccactaagcctggctaattttttttgtatttttagtagagatggggtttctccatgttggtcaggctggtctcgaactcctgacctcaggtgatctgcccgcctcggactcccaaagtgctaggattatctttcatcttttaaaaaaatgtattttatttttattttagagacaggtgtctcactgtgttgcccaggctggcatagaactcttgggctcaagtcatcctcccaactcagcctccctagtagctgatactaaaggcatccactgctgtgcccaactttgtcttttggttttaatttatttttatttattttattttatttttgagacagggtcttgctctgttgcccaggctggagcatagcggcgcgatcttggctcactgcagcctctgcctcctgggttcaagcgattctcctgtctcagcctccctagtagctgggactacaagcacacatcaccatgcctggctaatttttgtatttttagtagagacagggtttcaccatgttggccagtctcaaactcctgacctcaagtgatctgcccgcctcggcctcccaaagtgctgggattacagatgtgagccaccacacccagcctcttcatctttttatttgagatggaatcttgctctgtcacccaggctggagtgcagtgacgcaatcttggctcactgcaacctctgcctcccgggttcgagcaattctcctgcctcagcctcttgagtagctgggattacaggagtgtgccaccacgcctagctaatttttctatttttagtcgagatggggtttcaccatgttggccaggctggtctctaactcctgacctcgtgatctccccacctcagtctcccaaagtgctgggattacaggtgtaagccacagcgcctggccctcattgtggtttaaattagtatattttactattgttttctgtttgttccctctgattctcattcctttgtttctctccctttgccttccttggggtgggtacatgaccattgtttttagaattccattttgacttatttatataatttttgagcatatcaccgttatgatttgaatgtttttgtcccttccaaaaattcatgtctaaacttgatccccaatgcagcagtgttgggaggtggggtcttttgggatgtgtttaggtcaagaggactctgcccttatgaacagattaatgctgttagaatagggcttgaaggagggaatgcctccctttttgccctttcaccttttttgccacgtgaggacacagtgttcccccgctccagaggatgcagcattcaaggcactgtcttagaagcagagagcagcccttcccagatgccaaacctgttggtgacttgatcttggacttcccagcctccagaactgtgtgaaataaatgtgttttataaattatccagtctcaggtattctgttacagcagcacagaatgtactacgacaatcactttgtatggtcttcttagtgattgctctaggtattacaacctgcacgtgtaacttatcacagtccaccaatgtcaatgttttactactgtaattgacgtggaggaatttacttccctttagatccctttacctatcctattttcaaaatgtaattgtcctaagtgttctctctatatacattgaaaaccgtatcaaatgttgttacaatgttttgcttcaaccatcaaatatggtttaaaaacctcatgagaaaatgaaaaagctcatgaggagaagagtatttactcctattttaacccattttgttgttctcttttcctttctgaagttccacaccttcgtctgttatttcacttctgtttgaagagcttcctttcacctttctttaacagcagatgtcctggaaacaaatttgctatggactgaattttgtctcccccaaaattcatgtgttgaagccttcaccccccatgtgacagtatttggatgtgggattttggggaagtaattgggtttagatgaggtcatcaggggcccttgtgatgggacaagtgcccttataagagacaccagagagcttgtttcccctacccttctctctcctcccaccatggaaggacacagccaggaggcagccctctgcaagctgctaagagagccctttctggaaaccagatcagccagcatcttgactgaggacttcccagcctcccgaactgtgagaaatgaattcatgttgttcaagccacccagtctatggtatttcatcatggtagcctgaactgattaacacagacttgttttagttttccttcgcctgagaatgtctttatttccctctcattcctgaaagagactttccccaatgtaggactctcagttgacagttctttcagtacttgaagaatatcatgccacttccttttagtttccctagtttcagatgaaaacaccactgtcattctaatcagtgtcccctatgcctcatgtgtcatttctctctagctgctttcaagggttttcctttgtttttagtgtttagaggttaaatgatgacatatgggcgtgggtttcgtttggtttatcctactggggtttgcacaacttcaatccgtaggtttatgtcctttgcccaatttgggaagctttcagccattatttctttaaatatgttttcttcactactatttctcctcttcttgcagaagtccagtgacataaatcttagatctttgttgttgccctataggtctctgagactctgtccatctttttttcagtgtattttctctctgttgttgagattggacactttctactgttctgtctgccagatcacttctctgtcatattcattctgccattgaaccttttgcattagctttaattttctgttttctttttctttttttcttttttttggatggagttttgctcttttgcccaggctggagtgaagtgcagtggctcactgcagcctccgcctccttggttcaagccattctcctgcctcagcctccccagtagatgggattacaggtgcccgccaccacgcccggctaatttttgtatatttagtagagacagggtttcaccatgttggccaggctggtctcaaacccctgacctcaggtgatccacccaccttggcctcccaaagtgctgggattacaggcatgagccaccgcgccaggccagttttaattttcatttataatttttagttctatcatttctatttggttctttttctatatcatctatatgttgataatttttttttgagatggggtctcactctgttgcccaggctggagtgcagtggtgcaatcacagctcactgcagcctcaacctcctaggctgaatcgatcctcctaagctcagcctcccaagtagctggaaccacaagtgcacaccaccataactggctactttttgtattttctgtagaggtggggcttcaccatattgcccaggctggtcttgagctcctggactcaaacgtcctaaccgccttggcctcccaaagtactgggattacagttgtgagccatcgcacctggccaaagaatttctatttcttcttttgtttccagtttatttgtaattccttattgactcatttttatggtgactactctaaaatccttgtcagataattccagcatgtgattcatcttgctattggcttctgttttttgttttgttttgttttgttttgagacagactcttactctgtcacccaggctggagtacagtggcatgatcatggctcactgcagcctcaacttaccctggctcaggtgattctcccagctcagcctcccgagtagtagctgggactacaggcacgtgccaccacgcctggctaatttttccatttttttgtagagatgaggtttcgccatgttgctcaggctggtcttaaactcctgggctcaagcggttggcctgccttggcctcccaaagttctgggattacaggcatgagccgccacacctggcccattcttaagctgagttatctatttgtaaactgctgatttatttgggggcattgtccccataaacttttcagaaagcatcaatgatttttcaccattcttccacccaaccatcaccataaatttgattttgttcttgcttcagtattagcagaattcatgtggctctggtagaggctcttttcaaattgatgtcttatccttcttaacccctcaaaccagatcctgttcagacatgttataacaagttagtacagatttattttggtgtaaaaaaaaattgaaattcaaaaaagaaaaaacaaaaataaataaataaaagcaaaacaaaaataggaaggaaaaaagcaaaacagaaaaacaacaaaaaactataaaacatttgaaatccatgcatatagtttttttcaccaaatgcattttccgtgtacttttagatgacccctcatataaaaagaactcctaaaaaattttaagggaaagacaagacgcccaatcaaaaagtatgcaaaggttatgaacaaacattttgcataagaggaaacccaaatggccaataaatatatagaaatatgctcacactaaatcagagagctgtatattaaaggaacaaaatgttatttcctgtctatcagataggcaaaaagatttttttttttgagatggagtcttgctctgttgcccaggctggagtgcagtggcactatctcggctcactgcaatctctgcctccggggttcaagcaattctcctgcctcagcctcctgagtacctgggactacaggcatgtgccaccatgtccggctaatttttgtactttttaagtagagacgaggtttcactatgttggccaggctggtctcgaactcctgacctcaggtgatctgcctgccttcgcctccctaagtgctgggattataggtgtgagccaccgctacccagccccagatagagaaaaaatttaaaatctgataataccaactgttggtaagcatttccagagacagaatgtctcattcacagctgatgggagcataatggatacaacaattattttggaaaaccgttttatagttccttttttctttctttcttttttttttttttgagacagagtttcactcttgtcacccaggctggagtgcagtggcaagatcttggctcactgaaacctctgtctcctgggttcaagtgattctcctgcctcaggctcccaagtagctggaattacaggcgctcgccacaacgcccagctaatgtttgtatttttagtacagatgggattttaccatgttggccaggctggtctcgaactcctgacctcaggtgatccacccgccttcgcctcccaaagtgctgggattacaggcataagtctccatgcccagccggcagtttctactagagctgtatatgtgcacacccatcactcagtgatgccacttctgggtatatactaaacagaatgtgtataaatgtttttttgttttgttttgttttatccttttttttattattatactttaagttttagggtacatgtgcacaacgtgcaggttagttacatatgtatacatgtgccatgttggtgtgctgcacccagtaactcgtcatttaacattaggtatatctccaaaggctattcctcccccgccccccatcccacaacagtccctggtgtgtgatgttccccttcctgtgtccatgtgttctcactgttcaattcccacctatgagtgagaacatgtggtgtttggttttttgtccttgcaatagtttgctgagaatgatggtttccagcttcatccatgtccctacaaaggacatgaactcatcattttttatggctgcatagtattctatggtgtatatgtgccacattttcttaatccagtctatcatttttggacatttgggttggttccaattctttgctattgtgaatagtgtcacaataaacatacatgtgcatgtgtctttatagcaacatgatttataatcctttgggtatatacccagtaatgggatggctgggtcaaatggtatttctagttctagatccctgaggaagcgccacactgacttccacaagggttgaactagtttacagtcccaccaacagtgtaaaagtgttcctatttctccacatcctctccagcacctgttgtttcctgactttttaatgatcaccattctgactggtgtgagatggtatttcattgtggttttgatttgcatttctctgatggccagtgatgatgagcattttttcatgtgtcttttggctacataaatgtcttcttttgagaagtgtgtgttcatatcctttgcccactttttgtgatggggttttttgtttttttcttgtaaatttgttagagttcattgtagattctgggtattagccctttgtcagatgagtagattgcaaaaattttctcccattctgtaggttgcctgttcactctgatggtagtttcttttgctgtgcagaagctctttagtttaattagatcccatttgtcaattttggcttttgttgccattacttttggtgttttagacatgaagtccttgcccatgcctatgtcctgaatggtattgcctaggttttcttctagggtttttatggttttaggtctaacatttaagtctttaatccatcttgaattaatttttgtataaggtataaggaagggatccagtttcagctttctacatatggctagtcagttttcccagcaccatttattaaatagggaatcatttccccattgcttgtttttctcaggtttgtgaaagatcagatggttgtagatatgcggcattatttctgagggctctgttctgttccattggtctgtatctctgttttggtaccagtaccatgctgttttggttactgtagccttatggtatagtttgaagtcaggtagcgtgatgcctccagctttgttcttttgtcttaggattgacttggccatgcgggctcttttttggttccatatgaactttaaagaagttttttccaattctgtgaagaaagtcattggtagcttgatggggatggcattgaatctataaattaccttgagcagtatggccattttcacgatattgattcttcctacccatgagcatggaatgttcttccatttgtttgtatcctcttttgtttcattgagcagtggtttgtagttctccttgaagaggtccttcacgtcccttgtaaattggattcctaggtattttattctctttgaagcaattgtgaatgggagttcactcatgatttggctgtttgtctgttattggtgtttaagaatgcttggatttttgcacattgattttgtatcctgagactttgctgaagttgcctatcagcttaaggagattttgggctgagatgatggggttttctagatatataaatcatgtcatctgcaaacagggacaattcgacttcctcttttcttaattgaataccctttatttccttctcctgcctgattgccctggccagaacttccaacactatgttgaataggagtggtgagagagggcatccctgtcttgtgccggttttcaaagggaatgcttccagtttttgtccattcagtatgatattggctgtgggtttgtcatagatagctcttattattttgagatacgtcccatcaatacctaatttattgagagttttagttgttgaattttgtcaaaggccttttctgcgtctattgagataatcatatggtttttgtcgttggttctgtttatgtgctggattatgtttattgatttgtgtatgttgaaccagccttgcatcccagggatgaagccctcttgatcatggtggataagctttttgatgtgctactggattcggtttgccagtattttattgaggatttttgcatcgatgttcatcagggatattggtctaaaattctctttttttgttgtgtctctgccaggctttggtatcaggatgatgctggcctgataaaatgagttagggaggattccctctttttctattgattggaatagtttcagaaggaatggtaccagctcttccttgtacctctggtagaatttggctgtgaatccatctggtcctggactttttttggttggtaagctattaattattgcctcaatttcagagcctattattggtctattcagagattcaacttcttcctggtttagtcttgggagggtatatgtgtcgaggaatttatccatttcctctagattttctagtttatttgcgtagaggtgtttatagtattctctgatggtagtttgtatttctgtgggatcggtggtgatatcccctttatcattttttattgcttctatttgatccttctctcttttcttctttattagtcttgctagcggtctatcaattttgttgatcttttcaaaaaacaagctcctggattcattgatgttttgaagggttttttgtgtctctatctccttcagttctgctctgatcttagttatttcttgccttctgctagcttttgaatgtgtttgctcttgcttctctagttcttttaattgtgatgttagggtgtcaattttagatctttcctgctttctcttgtgggcatttagtgctgtaaatttccctctacacactgctttgaatgtgtcccagagattctggtatgttgtgtctttgttctcgttggtttcaaagaatatctttatttctgccttcatttcgttatgtacccagtagtcattcaggagcaggttgttcagtttccatgtagttgagcagttttgagtgagtttcttaatcctgagttctagtttgattgcactgtggtctgagagacagtttgtcataatttccattcttttacatttgctgagaagtgctttacttccaactatgtggtcagtttcggaataagtgcggtgtggtgctgagaagaacatatattctgttgatttggggtggagagttctgtaaatgtctattagatccacttagtgcagagctgagttcagttcctggatatccttgttaactttctgtctcgttgatctatctaatgttgacggtggggtgttaaagtctcccattattattgtgtgggagtctaagtctctttgtaggtcactaaggacttgctttatgaatctgggtgctcctgtattgggtgcatatatgtttaggatagttagctgttcttgttgaattgatccctttaccattatgtaatggccttctttgtctcttttgatctttgttggtttaaagtctgttttatgagagactaggattgcaacccctgcctttttttgttttccatttgcttggtagatcttcctccatccctttattttgagcctatgtgtgtctctgcacgtgagatgggtctcctgaatatagcacactgatgggtcttgactctttatccaatttgccagtctgtgtcttttaattggagcatttagtccatttacatttaaggttaatagttatgtgtgaatttgatcctgtgattatgatgttagctggttattttgctcgttagttgatgcagtttcttcctagcttcaatggtctttaaaatttggcatgtttttgcagtggctggtaccggttgttcctttccatgtttagtgcttccttcaggagctcttttagggcaggcctggtgatgacaaaatctctcagcatttgcttgtctgtaaagtattttatttctccttcacttatgaagcttagtttggctggatatgaaattctgggttgaaaattcttttctttttcttttcttttttttttttgagacagagtttcgctcttattgcccaggctggagtgcagtggtgtgatctgggctcactgcaacctccgccttctggtttcaagcgattctcctgcctcagcctcctgagtagctgggattacaggtgtctgccactacgcccgggtaatttttttttttgtatttttagtagagacagggtttcaacatgttggccaagctggtctcaaactccagacctcatgattctcccgccttggcctcccaaagtgctgggattacaggtgtgagccaccgcacccggcagaaaattcttttctttaagaatgttgaatattggcccccccactcttctggcttgtagggtttccgccgagagatcagctgttagtctgatgggcttccctttgtgggtaagccgacctttctctctggctgcccttaacattttttccttcatttcaactttggtgaatctgacaattatgtgtcttggagttgctcttctcgaggagtatctttgtggtgttctctgtatttcctgaatttgaatgttggcctgccttgctagattgaggaagttctcctgtataatatcctgcagagtgttttccaactcggttccattctccccgtcactttcaggtacaccaatcagacgtagatttggtcttttcacatagtcccatatttcttggaggctttgttcgtttctttttattcttttttctcagactgacacctcacacgggccgttactcctctgagacaaaacttccagaggaacgatcaggcagcgacatttgctgttcaccaatatccgctgttctgcaccctccgctgctgatacccaggcaaacagggtctggagtggacctccagcaaactccaacagacctgcagctgagggtcctgactgttagaaggaaaactaacaaacagaaaggccatccacaccaaaaacccatctgtacgtcaccatcatcaaagaccaaaggtagataaaaccacaaagatggggaaaaaacagagtagaaaaactggaaactctaaaaatcagagtgcctctcctcctccagaggaacacagctcctcaccagcaatggaacaaagctggacggagaatgactttgatgagttgagagaagaaggcttcagacgatcaaactactccgagctaaaggaggaagttcgaacccatggcaaagaagttaaaaaccttgaaaaaaaattagacgaatggctagctagaataaccaatgcagagaagtccttaaaggacctggtggagctgaaaaccaaggcacgagaactatgtgacgaatgcacaagcctcagtagccgattcaatcaactggaagaaatggtatcagtgatggaagatcaaacgaatgaaatgaagcgagaacagaatgtgtataaatgttaaccaaagacataaaataatgtttatagcaacttttttcataatagccccaaactaaaaactacccaaatgcacatcagccaaagaatggatacaaaaatgatggtatattcacgcaaggaaatactatatagcaatgtgttgggaggcagatctgcacagatcactcatgttcctgcatgggctaggccttctgaacaatgtttgaacagcagccttggatattgagatagtgcatccctctggagagatttagagacagttcagcgtaagaaacatagaaatgccccacccctccccacaaccaggagattgctgacattccagggtaatgaataatctctggctatggaggggaggacaggcaggtgtgtcagcaagttcacaacagcttagtctcctaattttagtttcttcccgcatgatgcaacccactgaacgcacaggaaatatctggcttcgtgtgagctggggcatgaggaattgatgcaaggtatagctctggctgctgattttgtggtaatcaatgatccatttttctgattcatgatcgtgtgtgtgtgtgtgtgtgtgtgtgtgtgtgtgtgtgtgttttgagacaaaatttcactctgtcacccaggctggagtgcagtgtcgtgttcatagctgactgcagcctcgacctccaggactcaagcaatcctcccacctcagcctcccaagtagctgagactacaagcatgtgccatcaagcccctaattttttttaatttgtttgtagcaacagagtctagctatgttgcccaggctggggtcttgtgttttatatatctgtgtgtatgcacatgtgcatgtatgtgtgtctgtgcaaaatttggcaggctaactttttagcttgcaagtagggtaaactcaaacccttcacagttctgacttacaatgaaactgaagaaaggataattccatgtgcataacagggatggacctcacaaacaatgttgggcaaaagaagctgcaggacacagaaggataatactatatgattccctttatacaaagttcaaaaacctggcttcatggccaggcatggtggctcatacctgtaatcccagcactttgggaggccgaggtgggtggatcacttgagatcagaagttcaagaccagcctgaccaacatggtgaaaccccatctctactaaaaaaaagtacaaaattagccgggtatgatggtgcacatctgcaatcccagctacctgggaggctgaggcaggagaatctcttgaatcctggaggtggaggtcacagtgagccgagatcacaccattgcactccagcctgggcaacaagagcaaaagtctgcctcaagaaaaaaaaaagccaaaaaacaaaaaacctggcaacatgaaatcatgctgttcaagtcacagggaggtgcctgaggtactacgggacatggcttttttgtttctttctttcttttatttttatttatttattttgagatagactctcactgtcacccaggctggagtgcagtggtgccatcttagctcactgaaacctcgacctcctgggctcaagcaatccccctgccttagcctcccaggtagctgagactacaggcgcactcggcctccagtgttgattctttttgcctgaaatacggatatacctttccatttattctggtcatttttttcttctgtcaaaatgtatagagctcatattttcttttctttttttttttgaaacggagtctcgctgtgtcaccaggctggagtgcagtggcgcgatctcggctcactgcaatctccgcctcccaggttcaagcgattcccctgctgcagcctcccaagtagctgggactacaggcgtgcaccaccacacccagctaattttttgtattttagtatgaacgaggtttcaccatgttggccaggatggtctcgatctcctgacctcataatctgcccacctcagcctcccaaagtgctgggattacaggcatgagccaccatgcctggccgagctcacacttttcttgcttacaagaggttgataaattttgttactgtgatcaacggtaccctgccctcttacattttctgatttcaggtgtctgtcaaggaaggctatacccatctttgttttttttttttcttgttttttttttttttttttttgagacggagtctcgctctgtcgcccaggctgaagtgcagtggtgctatctcggctcactgcaacctccgcctcccgggttcacaccattctcctgcctcagcctcccgagtagctgggactacaggcgccgaccaccacgcccggctaattttttgtacttttttagtagagacggggtttcaccatgttagccaggatgttctcaatctcctgacctcgtgatccacccgcctcggcctcccaaagtgctgggattacaggcattagccaccgcgcccggccccatctttgtattttgtattcatttttggttttggtcaccttgctgacttctcttattaagtctaagagtttttttttttttttttatgattctcttggattttctaagtgaataacaccaatgccctccagccaaagaccaccaggagcatagtggtagtttaccaaaattagatttttttttttttttttttgagacggagtctcgctctgtcgcccaggctggagtgcagtgctgcgatcttggctcactgcaacctccacctcccaggtttaagcgattctcctgcctcagcctcctgagtagctgggactacaggcatgggccaccatgcccggctaattttttttttgttttgttttgaggtggagtatcgctcttgttgcctaggctggagtgcagctgtgcaatcttggctcactgtgaccgccacctcccaggttcaagcaattctcctgcctcagcctcccaagtagctgggattacaagcatgcaccaccacacctggctaattttttgtatttttagtagagacgggggttttgccatgttggccagtctggtctcgaactcctgacctcaggtgatccacccaccttggcctccccaagtgctgggattacaggcgtgagccactgtgcctggcccggaagttggatttattaactcattgcaatgatgaagcatccacatcgtgggaaaccatggagcatctcattaaaagggtgttagaaaagggagccggacacggtggctcacacctgtaatcacagcgttttggaaggctgaggtgggagattcacttgagcccaggagttcgagaccaacctgggcaacctagtgagaccctcatctctaaaaaaaatttgaaaagtagataggcatggtggcatgcacctgtagactcagctattcaggagactgaggagggagggtcgcttgaccccaagagttcgaggctgcagtgagctgtgatcgtctcaaaaaaaacaacaacaaaaaaaaaaaaaaaaagaaaaagaaaaaaagaggctgggcacagtggctatgcctgtaatcctagcactttgggaggccagtgcaggcggatcacgaggtcaggagtttgagaccagcctggccaacatggtgaaaccctgtctctactaaaaatacaaaaaaattagccaggcatggtggggtgcacctgtaatcccagctactcaggaggctgaggcaggagaattgtttgaacctgggaggcggaggttgcagtgagctgagatcacaccattgcactccagttctaggcaacagagcaagactccgtctcgggaaaaaaaaaaagaagaagaagaaaagacaagacaagaaaagaaaaggtattactgggttggagtttgtgttaggtgatttcagagagggttaaagaagcaggactttgctctggattgcctcctgtcagaaagtaggagtaattctaggatgtaatatcttgatttatatctacaaggcaaaaggaatgaagtggatgaaagctataactgataaggaagcaggaaccactcacatcagccaggatggacggatgtttggccattttgtggtttggacaacgtccatgtttttttctgtgtctcagacttgattccagactggtcttgtttttgtcttgatctaccatgaccgcagagcagcttcatctgatgttaatattttgtggaattgttcatgatcaacaggagacaccgatgggagtgtcaggtcagctgctcacaacaccaaggcttaggtgatgaaccaggccagttcttggatgtcagggactgcatttctttttgtcagtaccccttttgtcaaggtcattactgtatcaccctgcagaggtgaggtggatccatgaatacacacacacagcaaatttggttcaaatgtcaagcctgctgatgccacgcatacaccaagaaggtatgaaaaatttattactcacacaatgaggcttttgagagagagtagggctggctcccaagctggtctgaaaatgatgtttgttttgttttgttttgagacggagtgtcgctctgtcacccactggagtgcagttgtttaatcacagctcagcaacctcgacttcctgggattgagtgatcctcccgcctcacccttccaagtagctgggactacaggcatgcaccaccacacctggctaatttttgtatgtgtttgtagagacggggtttcaccatgttgcccaggctggtctcgaactcctagcctcatgcaatcttcctgccttggcctctcaaagtgataggattacagatgtgagccaccgcaccctgcccctggtggcatttgtatgtcttctttggagaagtcttttgtccactttttaatcaaattattatttttttggtcaggcacggtggttcacacctgtaatcccagcactttgggaggccgaggcgggcagatcacttgaggtcaggagtttgagaccagcttggccaacatgtcgaaactccatctctactaaaaatacaaaaaattagccaggtatggtggaaggtgcctgtaatcccagttacttgcggggctgaggaaggagaatcgcttgaacccaggaggcagaggttgcagtgagccgagattgtgccacttcactccagcctgggaaacagagcaagactctgtttcaaaaaaaaaaaaattgttgttctttttgttatttgctattgagctgttggagtttcttctgtactttggatatcaaccccttaagcgagaaatggtttgcaaatcttttgttccattctgtatgatcccttttcactctgtgttgtttcctttgctgtgcagaatatttcggattgatgtagtcccacttgtctattttagcttttgttgcctgtgctttttgtgtcatatccaataaatcactgccaacaccaatgtcaagaagatttcctcctgtgttttcttctaggagttttacagtttccggtattacatttaagtctttaatccattttgagttgatttttttgagacggagtcttgctctgttccccaggctggagtgcagtggcacgatctcagctcactgcaacctttgcctcccaggttcaagcaatcctcctgcctcagcctcccgagtacctgggactacaggcgtgcaccaccatgcctggctaatttttgaatttttagtagagatggagtttcagcatgttggccaaactgtctctaactcttgacctgaggcaatctgcccgcctcagcctcccaaagtgctgggattacaggcgtgagtcaccacgcccagctaatttgagttgatttttgtgtatggtgtaagataggggtccaatttcattcttctgcatgtggatatctggtttttccaacaatgtttgttgaagatactatcatttttccattgtatattcttgacactctactcaaagatcagtcaatctactgattgacaatctactcaaagatcagactaagaccatatgtcttagtctgttttgtgctgctgtaacagaatactacagactgggtaatttttttttttttttttttgagacagagtcttgctctgttgcatgggctggagtgcagtggcgcaatcttggctcactgcaacctctgccttctgggttcaagcaattctcttgcctcagcctccagagtagctgggattacaggcacatgccaccatgcctggctaatttttgtatttttagtagagacgaggttttgccatgttgaccaggctggtcttgaactcctgacctcgtgacccgcctgccttggcttcccaaagttctgggattacaggcgtgaaccaccacacctggccagactgggtagtttataatgaacagaatttcattggctcaaggttctggaggctggaaagtccaagatcaagggaccagcaactaggcaaagcttgctgcatcattccatggcagaagggcaaagcaagggtgacagagagagagagagaatgggggtgatatgatttggccatgtccccactcaaatctcatcttgaattcccacatgttttgggagggacctggtgggaggtaattgaatcatgagggcaggtgtttccagtgctgttctcatgatagtgaataagtcccatgagatctaatggttttataaagggacttggagcaggacaagccacagacaaaatccctcaggcaccgagttaaagaaggaagggctttattcagccgggagcttcggcaagactcatgtctccaaagaccgagctccctgagtgagcaattcctgtcccttttaggggcttacaactctaagggggtccacatgagagggtcatgatcaattgagcaagcaggggtaggtgactgggggctgcatgcaccagtaatcagaatggaacagaacaggacagggattttcacagtgcttttccatacaatgtctggaatttatagataacataacccgttaggttggggtcgatctttaaccaggcccagggtgcagcgctgggttgtctgcctgtggatttcatttctgccttttagtttttacttcttctttctttggaggcagaaattgggaataagacaaaatgaggggtagtctcctcccttatttccccgctttgagaatctcactcaatagtgggagttctcactttcattctcactacccatgccttcttgcaagatagatcgatagtgattcatatagcatacctgtgctgaagcattttggtgaactaaggtagcgatgaagctccttatcgtttgaagaagtacagatagtaaacaagggagcagtaagcaggtttctattactattataactcccattataagagttttaaatctttccagtgctgggaaccattttccaaacatggccccaggatcaaatccatgccacatttgcacgggcacatgtgccaattttgtcatatttctaactatgtcttcaactactcgcccttgatcatctatgtgtagacagcaattagtaaggttaaatttcccacagacccctccttcagctgctagcaagtagtcgagaaccaatctattttgataaatagcatttctcatttgggtttcttgccgggccagaatagtcaaggctctgctggtcttattagtgattatttctaagacagcttgtaaccatatgattcggttgagcatgtaaatggggatctggtatccccacaagccgtcttgtgcccaagtagcaggctcataatattgtatgattctctcagggggccattcattatctttccaatttccaatagctatgcttctctttgcgtgggaagcatagacagggaagcccaggagttcgcctgtctttatgggcagtaggaagaaagatggtttaatagtgccaataatacaactacctgcccactggttgggtaatttgacataaggtctatgcccacatatccagtataatctagtgggggctgtccagtcccggtgggactctgggtgggtccacacgttttgcaactttgggaatttactaaatggatttttcttagtgtggtttgaactccactaggtggctgtttttgtagtactattatacagtttttgcccaaggcagctgagtcttcccacaggaagggtgaagtccttccccactcttgctatatagtattatctaatgattgaggcttttaggacccagaaattatcagggtaatttttttgagccaggaattcatcaggaactgggtctgtaggtactaatttttgggcttcccatggccattggtctcccattaccgttcctccacatacataacatgaagtgacattgagagactgggctacatgctcggctaattgaaaaaacaaatttcttgtttttcctggaatttctggtactggcacattcagttcatcatagaaggtttgaaatactggctcaggagagtgtttataaacttctactcaaaccacaatatttactcgaggatccagtccagccccatcagttcctaaggttacatgctccccttttttccagcaaggatcaagggatttggttattaccagttctaaggggttacactgaccactggtacaggaagggccacttttccctttctgaagatggacaggattttttttattttttatccaagtagcctaaatgacacaagaccactatccacatttatttccacacagtcttaattcatgacaagtgtacttacgttctgccatatagcctctttcttaattaagggaaccacatcatattcctaacttattactattaatgacagcacaggcatcagatttcaaggtgacttgtttgggcacccctttttcttctgttttggctaacactttactcgtattgtttatgagcccccatcagtcctcagttcttaatcttatttcaaaaactgtggtcatgggaggctcagatgggtcataacacacattaggttggtcatttcctgggctatgtaccttgtatagaataacattatacaagcaagttctttttagagttctagtacacttataataaccataaaataataggaccatagcaaccttttgtcctacctcagtgacttgatgtatacactaggaacagtcctcagtccaaggaaggtcagttgaagtccttactgtacaagtccaaatgttaaggaaaatgagtcccgcgatgagttttctcatgcttcagccgtgcgtggaccagtcagcttccgggtgtgactggagcagggcttgtcgacttcttcagagttactttgcaggggttggcgaagctgctcccgtccacataccgctcacagtctactgatgttcaaggatggtctcaaaggttgggcccactagaataaactgagtccaatacctctacacagttgtgttcaactgggctctctgatactgggagcaaggtagctgggtttagggtgttgcaaacttcagtggttatgtggggattttcacatagcaagctttggtacttggttaatctagcatttgttatccagtgatgtcctttggtattcatcaaagttaccacagcatggggggcctttatattcaggttttgcccaagggttagtttatctgcttcttgtgctaacagggccattgctgccagggcccttagacatgggggccagcctttggaaaccccgtctagttgttttgagagagggccccacagtctgggttaaaactccaaaactgccattttttctctttctgacacatagagtgtaaagggttttgtcaggtcaggtagccccagggctggggccgacatgagtttttcttttaactcatgaaaagctcattgctgttggttgtaatagatgtagtttatccaatctaaatttttattaactgtcaccgaccaaaatattgactcaaatcctgcagctatttgatttcaagctttaaattgatctggtattccccatgggactccaattgcgtctaaatagacatgagagtcgaaagacctataaggggcttctctcgctttacaatgtcttatttttcctccctctggttgatgaaatgccagggtgaaagggatagccaattggactaaagtacaagtgccactccagttattcggcagagtgcccaataaaggtccaccccaataccaccacacatccactcagggatgaacaagcgctgactgattgataagctcttgaaaattattaagctcactgcatcccttcaggtctccaaggaatgctaagtttcctccctgtcgtgagagacaagaagtgaagttagtgttgggagacggaagctggatggcccttgggggctgacccacagggtgccgtactttgggatatagcagagagagcttggcacgacttatcactccaggctgtagaatcctggaaaagagctaccatgcagcgcatgcctggtccactggaggaccaccttagtggaaaggggacaatctgggactctggcctgccatatgcacaagcataagaattgcttttgtttaaggtgcagacggaatatttgatccattccaaccaggcatttgcatcttggtatcctgtcttaattgccaaagtttgttttaagtctttaacttctatgatcctctagtaaaatgaatgtatgattttaggaaattacaaaaaccagttggggcagtccatccttgcactttagtggtccacagaatgttggaccaagtacagcataaaagctctacattggggagcaagactcctggttgacactggagtctttattgaaatttcccctgattaaatggtcctaatttaccaatgcccagtctgaggagagtcaggagggacagatgtatttttctcaagtacagaactgtctttgacttggcaggtccccacagggtataacaagacaagcattaaatgcaatagtctgaggtaaaattgacttggttatgttaataactagatggtcagcaatagagcgaggaaagaagaaagagtaatagaatagatgaaagagttaaatttttcttagctttagtttggtagggttttcccctgggactatggcccatgattctggagggggtggcgctttcttgactcaggtgtgatgagtccatccttttttcgctgtacgaacagcagtctcggtggttagcagcacaagatagggtccttcctaggctggctcgagtttccttttttttcatcctttgatgagaacgtgatcttcaggctggtgctggtgctggtttactggaaattctaggggtggtacatgtgctaaaagacttttagttttgagggaaagggaagtggaggattaaccaagtatataatttttaagaaactgaccttttgttttaaatgtggggacatcagcagtggacattatagtccttggtgactttctactgagaaatttcctttagcacctatttttattagtttttggaccaaagaagtcaaacaccattttatatttgataatgcttcctgtatgatttttataccagataagctaaatttcacctttatattagtgtgttattaatgttaaacttagttttttttttttttttgagatggagtctcactctgtcacccaggctggagtgtggtggctccatctcggctcactgcaagctctgcctccctcctgcctcagcctcccgagtagctgggactacaggcgcctgccaccacgcccggctaattttttgtatttttagtagagacggggtttcaccgtgttagccaggatggtctcgatctcctgaccttgggatctgcccgcctcggcctcccaaagtgctgggactacaggcgtgagccactgcgcccggccaatgttaaacttagttttaataaaactttgcagacatatttattcagtttttaatgtcagaccataaggtaagatttttatagactctttttaaccttttataatctgtgttaaagagcaggttagtgctttaagagaaacacgttgtgtttttattttaatgttcacttcacagaaaaactggatgatacccctttaactttagctaatatgtttacacgcagaattttttttacaattaacattttaaaacttgcttaaaccttcaaaacaaatttgttttaaccttttaatgtaggtaaaaatttacattcttatgccaccttataatccttttaccaaaggtatattttactttccttatacaccttgcacataaactattttttcaatagttttacattcaggaggcttagttacttttaaattatacaacatttcttgcataaattctttttttataatatatattttttctctttcatgactttcacagacaattctttgacctgcctcaactttcagacttattacaaacatttctttctttaaacaaccagttaatttatttcaggacaagaatttaccatataatattctttttacataaactctgcccccatcttttcccccctttttttttttcttctaagataaccattcttttccaaagtgaacttcctttatgtctgtgggctagattgtctaaggccacaagattagaagttattataatacatgttacattgttaacttttagcaaactttacttttgttgaaaatcttgtaagtttgggatttcaattatcctttgctattaataagaccttgtttagtccaaattaacttagaattggtatagatggcttttttttcttcaattacctgggaggaagcatctatcatcctgtcctgaagggagttcctcctaggtctgatcagacctttgtatggtaattaagatttagatcccctgttaggaaacctgctgggttaagggaattttcagtggttaatgttaaatcatctttttttttcccccgcttaggatacttctgaactagtgaggtgtgctcataatgagatttcctctaaaagttatttttctactttattctgttagcaaagcagttgccactacagattgaatgcatttgggccatccacaggttactgggttaaggatttttgataggaaggctacaggtagtcagtggcctcaatgctttcaggctacgcccttgtttacacttacaacaaggttgtattggagtgttgtagggtcacggagaagaccttcaattatcaattataggttttaaatttacccgggcttttaaaggaatagatagggtacgctgttttttttttttttaactacttgtatatttctctctttctttttttgactttctgtctctctttttgactttccttttgcctctgtctcttcctctctttttctcctcgactccctctttgtctctctgtctcttcctctctctctttgcctctttcctctctgtctctttcctctctctccctctgctggtctttccttgcctctgccagccgcttatgctgctgttctctcaaccactgtgtgtgtgggggggtctaaaaccacctgtaaccaagtgtctagctacgggaactggtctgggttccctggcttacaggttaccttgtgccatacctttaaaacaagggacctgtccaagcttccttctgatggccaacccacctctaatgctggccagtctatttcacacaaagttctaagttttcctggtgtcatagtaacactgtaatctcccgtaaatcctttcttgaaaattttcaacatagttcctagtggggtgggcttaccttgtgcccgacccatgcttcctcaagacaaaacaccactctcacaccacacacacaccacaaaacaaagaacgggtaaaaagggcacacacacacttttacagtttacaccaaaccagaatcaaaaccaaaatcagagtatccagaaatctaagccaggtcaaaaccaaaaccaaagtatcaagcaacccaagtcaagtcaaaaacaaaaaccaaagtgccggtacaggcacatcgtgggtgatcaggccacgcttccattgaaatggagtgggcaagttccaaagaccagtcttaccaagtttcagatgtccagactccaagtgccagttccttcccggtgttcagccactgagttgatcttccacaggggcctgccacatgctgctctggtgaggcgttccactggggtaattgcctaccccggggcactctcaggatccgcgtcactcaagctggctggagtcccctgcagggatgctccacagggcaggcctaagctgcctaaggggctgcctccaccatccattaatcacctttctaactggtcagggaaccaagtaatgtagcaggacaagcctcagacaaaatccctcagacaccgagttaaagaaggaagggctttattcagctgggagcttcagcaagactcacatctccaaaaactgagctccccgagtgagcaattcccatcccttttaagggcttacaactctaagggggtccacgtgagagagtcatgatcaattgagcaagcagggggtacgtgactgggggctgcatgcactggtaatcggaacgggacagaataggacagggattttcacaatgcttttccatacaatgtctggaatctatagataacataactggttaggtcaggggtcaatctttaaccaggcccagggtgtggcagcctatggatttcatttctgccttttagtttttacttcttctttctttggaggcagaaattgagcataagacaatatgaggggtggtctcctcccttagactaatggttttataaaggggctaatacagtaaattggtaccaggagttgggtgctgctataaggatacccaaaaatgtggaagcaactttggaactgggtaacaggcagaggttggaacagtttggagggctctaaaggagacaggaagatgtggggaagtttggaacttcctagacatttgttgaatggctttgaccaaaatgctggtagtgatatgaaaaataaattccaggctgatatggcctcagatggagatgaggaacctgttgggaactggagcaaaggtatgctttagcagagactggtggctttttgcccctgccttggagatctgtggaactttgaacttgagagagattatttaggatacctggcggaagaaatttctaagcagctaagtgttcaagaggaaacaaacagagcataaaagtttgaaaaatttgcagcctgaatatgtgatagaaaagaaacccccattttctggggagaaattcaagccacttcagaaatttgcataagtaacgaggaaccgaatgttaatcaccaagacaatggggaaaatgtctccagggcatgtcagagacgttcggggcaggcccgcccatcacaggcctggatgcctaaaagggaaaaatggtttcctgggctgggtccagggcaccccctcctgtgtgcagcctagggactcccagcctttccagccgtggctaaaaggagccaaggtacagctcaggccgttgcttcaaagggtgcaaaccccaagccttggcagcttccatgtggtgttggtcctgcaggtgcacagaaaacaagaactgaggtttgggaacctctgcctagctttcagaggatgtatggaaatgcctggctgtccaggcagaagtttgctgcaggggcaaagtcctcatggagaacctctgctagggcagtgcagaagggaaatgtggggtcggagcccccacacagagtccccactggagcactgcctagtggagctgtgagaagagggccactatcctccagaccccagaatagtcgatccaccaacagcttgcaccatgagcctggaaaagccacagacactcaacacaagcccatgaaagctgctgggaaggagtctgtaccctgcaaagccacaggggtggaactgcccaagaccatgggagcctacctcttgcatcagtgtgacctggatgtgagacatagagtcaaagaagatcattttggagctttaatatttgactgccccactagatttctgacttccatggggtctgtagcccccttgttttggccaatgtctcccacttggaacagttgtatttagccaatgcctgtacccccatcatatctaggaagtaactaacttgcttttgattttacaggctcataggcggaagggacttgccttgtctcagatcagactttggactgtggacttctgagttaatgctggaatgagttaagactttgggggactgttgggaaggtatgattggttttgaaatgtgaagacatgaaattttggaggggccaggggcagaatgatatagtttggctgtgtcgccacccaaatcttatcttgaattcccacctgttgtgggagagacctggtgggaggtaattgaatcatgggggcaggtctttcccatgctgttctcacgatagtgaataagtctcatgagatctgatggttttataaaggggagttttcctgcacaagctctcctctcttgtctgccgccatgtgagatgtgcccttcatcttccaccatgattgtgaggcctcctcagccacgtgtaactgtgagtccattcaacctctttcttttgtaaattgcccagtctcgggtatgtccttatcaacagcatgaaaacagactaatacagggggttaaactcccccttttatagtgaacccactcttgtgataatagcattaattccttcactctgccctatggcctaatcacctctcattaggcctcacctcccaacactgttgcattgggaattaagtttttaacacatgctttttggggacacattcaaaccacagccttctgcctctggtccaccaaattcatacccttctcacatgtaaaatacattcattccatctcaatagacccatagtcttaatttgttccagtaccaactcaaaagttcaaagcccagagtctcgtctaaaccagatatgggtgatactgtaagcacagttcattctaaagcaaattcctccagctgtgaacctgtgaaatcaaaacaaattatctcggctggatgcggtggctcacgcctgcaaccccagcactttgggaggccaaggtgggtggatcgcttgaggtcaggagttcaaaaccagcctggccaacatggtgaaaccccgtctctactaaaaattcaaaaattagccaggagtggtggcacgcacctgtagtcccagctactcaggagggtgaggcacaagaatcgcttgaacccaggaagtggaggttgcagtgagccgcgattgcaccattgcactccagcctgagtgacagagtgagactccatctcaaaaacaaacacaagttatctacttccaaaatacaacagtgggacaggcagaagatgaatgttcccattcctaaagggagcaacaggaaagaaaaaaggaatagcagttcccagcaaatccaaaagcccacagggcaaacaacattgtcttaaacctccacaattatctttgacggtatgcaccacctttgggcacactggggtagggattgggcccccaaggcttcaggtagccccgcccccacaagcttgctgggctcagcccacacagcaatctctcaggggttgcaggcacccaagctgctgttgcttgctggtagctctacagttctgggttcttggggagtggggggggcccacctccaaagctccactagacctattctctgtggtggctctgacctcacagctttgttcttttttctcaagattgctttggctattctgggtcttttgtggctacatatgaattttagaattgttttctctattgctgtaaaaaatgtcactgggattttgatgggtctaggattgaggctgcagattactttgttgttgttgctgttgtttttgagacagaatgttgctctgttgcccagactggagggcagtggcacaatctcggctcactgcagccctgcaaccttcatttcccaggcccaaacaatcctcccacctcagcctcccgagtagctggaactacaggtgagtgccgccacacccgacaacttttttgtatttttagtagagacagggtttcaccatgttgcccatgctggtcttcaactcttggcctcaagtaatctgccttcctcagcgtcccaaagtgctgggattacaggtgtacaccaatatgcctggctaattttgtatttttagttgagatggggtttcaccatgttgcccaggctggtctctaactcctggtttcaagtgatccacacacgtcggcctcccaaagtgctgagattacaagtgtgagctactgcgccagccttgtagacttctttgaatggtatggatattttaacactattaagtcttccaattcatgagaacaggatgtctttccatttatttgtgtcttcattactttctttcactaatgttttctagtttttggtgtacagatatttcatttacttggttaagtttcttcctaagtatttaattatttgtgatgctattgcaaatgtgattgttttcttaatttccttttcagatagttgttagtgtatagaaacacaattaatttttgtatgttgattttacaggaatctcaaagagctatccacacttccatgttcatcatagcattatttaccatagccaaggtatggaaacaacctgaaagtccattgacacatgaaaggatatcaaaaatgtggtatatacatacagtgggatattattcaaccacaaaaagaaggaaatcttatggccgggtacagtggttcacacctgtaatcccagcactttgggaggctgaggcaggcagatcacttgaggtcaggagttagagaccagcctggccaacatggtgaaaccccgtctccactaaaaatacaaaaaaccagctgggtgtggtggctcatgcctgtagtccagctactgcttgggaggctgaggtatgaaaatcacttgaacccgggaggcagaggttgcagtgagccgagattgtgccactgcactccagcctagacaacagagtgagactctgtctccataaaattaaaaaaaagaaaaagaaatcttaccatttgcaacaacatggatgttatgctaagtgaaatgagctagtcacaaaaaaagacaaatactgcaggattccactaatatgaggtatctaaagtagtcaaactcatagaggcagagaatagaatggtggttgccagggtctccggggagaggaaagggagacttgtttctcaatgggtataaagtttcagttatgcatgaagaatcagttctagagatctgctgtacaacatagtaattatagcttacaatatggcattgtgcactttaaaatttgttaagagggtagatctcatgttaagggttatgccacacacaaaaaaaccaaagctaaaacaaaccactacaaagggacacaaggaaacgctggaggtgatggatatgattattatcttgattgtggtgatagtatcatgagcatatacataagtcaaactcacagattgtatacactagatatgtgtagtttttgttgtaagtgtacaacattagttatatctcaatacaagtatacctcaataaagttgttttaagaaaagacattttttggccagccatggtggctcacacctgtaatcccaacagtttgggaggccgaggcaagtgggtcacttgagcccagaagtttgagaccagcctgggcaacatagtgaaaccctatccctaataaaaatacaaaaaattagccaggcatggtggtccatgcctgtaatctcagctactcgggaggctgaggcacgagaattgcttgaacctgggaggcagagattgcagtgaactgtgatcataccactgcactccagcctgggcggtagagcgagactgtctgtcaaaaacaaacaaacaaacaaaacaaaataaacaaaacaacaacaacaaaaaccatatatttatttatttaaagatgagctcttggccgggcacagtggctcacgcctgtaatcccagcactttgggaggccaaggagggtggatcacctgaggtcaggagttcaaaaccagcctgaccaccatggtgaaaccctgtctctactaaaaatacaaaaattagccgggcatggtggcacatgactgtaatcccagctacttgggaggctgaggcttctcttgggaggagaattgcttgaacccgggaggtggagtttgcagtgaactgagatcgcgccattgcactccagcgtgggcaacaagagcaaaactctgtctcaaaaaaataaaataaaataaagatggggtctggctatgttgcccaggatgaagtacagtggctatttacagacgtaataatagtgcaatatagcttcaaactgctgtgctcaagctatcctcctgcctcagcctcctgagtagctggaaatacaggtacagaccaccatgcctggctaatttttatatttttagtagagacagggtttcaccatgttggccaggctggtcttgaactcctgacctcaggtgatccacccaccttggcctcccaaagtgctgggattacaggcatgagccaccatgcccagccactcccttctgcatttttgatgctctggagagcgtcggcttcatactcaccattatggctgctgggttgcctcagtctcccaagctcccagcactgctgcagcaacggggagctgcatggcccacctggccaccatccgcgatgcttcccgccgccctggcggaggtgcggcctcagccctaagaaaaggtccagatgttataggcccagccggggctactgctaccgcctctctcgaggtcgcaagttctggctcctcccagcgctgcagcctacaccacatggactggggtccccacaatgcagaatgtgaggcactcgcacaaggctctcctctatgcctggccaggcccctgcaaggccaggatccacgacccaggagggacctagcttccctacaggacaccaaagcccagccttggattgctggatggctatgacagccaacggatgaacttggaacccttagaaagtgctactccccaggaagacatttaaaaactaacagaagaactcagctctaactacaaataaatactatcttaaaaacttttttttttttgagacagagtctcactctgttgcccaggttggagtgcagtggcgagatcttggctcacaacagcccccacctcctgggctcaagtgattctcctgcctcagcctcctgagtagctggcattatagatgcccgccaccatgcctggataattttttttttctttttagtagagaccgggtttcgccatgttggtgaggctggcctcgaactcctgaccttgggtgatccgccttccttggcctcccaaagtgctgggattacaggtgtgagccactgtgcccggccaaaactttttctttttttgagacagggtctctctctgttgcccaggctggagtgcagtgatcacagcttactgcagcctcaacctcccaggctcaagtgatccttccacctcagcctccctagtagctgggattacagacgtgaaccacgacactggactttgaaaacctttttaaaaaaaagactctggacaggatacattggccaaatgcaacacaggcaatcacagaaacaagctgaggtttagtctttataatagacactgaaggctgggagctgtggctcacacctgtaatcccagcactttcagatgctgaggcgggaggatcggttcagcccaggagtttgagaccagcctgggcaacatggcaagatccccgtctctacaaaaatacaaacaattagccaggcatgatggctttcacctgtcgtcccagctagtcaggaggctgaggtgggaggattgcctgagctggggaggtcgaaggtgcagtgaactgtgatcacaccactgcactccagcttgggtgactgagtgagagcctgtctcaaaaaaacttcaaccaaacaaactagactccgaagacaggagcctagacggccaaaccagaccagggaaatatgtcccaaagcctagttggtctcctgtagagaaccaggtaactttttcttttctttttttttttgagacattctcgctatgttgcccaggctggtctcaaacttttgagctcaattgatcctcctgcctcagcctcccaaagtgctaggattacaggcatgagccactgcacctggccaactttttcttttaacctcatcagaaactgttctacttgacttgcagagttgatataggtgcatcaaaaagtatttgctttatgttgagtcttgacaatgaggaaaaaaaaaaagaagtgtttactaaagcatacactcccccttgactagccaaaggaaatcaagggttatgttcatgacaattctggctaatgaatatttttgtgggggttatcctgcatctcttttttattttttatttttatttatttatttttttttttttgagacagagttttgctcttgttgcccaggctggagtgcaatggcgcgatcccggctcacctcaacctccgcctcccgggttcaagtgattctcctgcctcagcctcctgaatagttgggattacaggcatgcgccaccacgcccagttaattttgtatttttagtagacacagggtttctccatgctggtcaggctggtctcgaactcccgacctcaggtgattcgcccgcatcggcctcccaaagtgctgggattacaggtgtgagccacagtgcctggccttatctcgcatctcgttacgtcgagatggcaaatgaatttaaatttaaactggtttgttgggtttctagagtagaagttgtgtcatctgctaaggtcagagacaagtttgggaccaccttttccaattgtgtgactgccactgtgggaactgcagctcatatgaagagactcagcagtccctactgagagttcttctgcgtagcccatgcttgcctccctttgggagatttttgaatacccgagggaaacagggtccccaggaggtgacagttctcctgctctgtcaccccggctggagtgaagtggtgtggtcaccactcaccacagcctcgacctcccaggctcaattgatcctcccgcctcagcccccaagagtagctgggaccacaggtccttgccaccacgcccagctaatttttttattgttgaatttttagtagagacggggtttcaccatgttgcctaggctggtctctcgaccttctgggctcaagtgatccacccacctcagctgcccagtgttgggattacaggcatgagccatcgcgcctagcctaccaatgattttatttaaaaatttattttattatggtacaatacaacatgagatctaccctcttaacaaaatgttaggtgcacagtacagtattgttgactctagatgcaatgttgcacaacaaatctctagagcttattcatcttgtttttttctttttcttcttctttttttttttttttttgagacagagtcttgctctgttgccaggctggagtgcagtggcacaatctcggttcactgtaacctccgcctcctgggttcaagcagttctcctgccttggcctcccaagtagctggaactacaggcgcatgccgtcacgcccggctaattttttttttttttcgtattttagtagagacagggtttcatcatgttgcccaggctggtcttgaactcctgagctcaggcaatctgcccacctcagcctcccaaagtgctaggattacaggtgtgagccaccgcacccggctgagcttattcatcttgcccgagactaacctttatgcctgttcattaataactccccattttgggccaggtgcaatggctcactcctgtaatcccagcactttgggagaccgaggtgagtggatcacctgaggtcaggagtttgagaccagcctggctaacatggcgaaaccccgtctctactaaaaatacaaaattagctgggtgtggtggcgggcgcctgtaatcccgactactcgggaggttgaggcaggagaattgcttgaacctgggaggcagaggttgcagtgagccaaaattgcgccattgcactccatcctgggagatagatcaagactcttgtcttaaaaaaaaaaaattagccaggcatggtggcacatgcctgtaatcccagctacttgggaggctgaggcagaagaattgcttgaacacgggaggcggaggttgcggtgagccaagattgtaccattgcactccagcctgggcaacaagagcgaaactccatctcaaaaaaaaaaaaaaaaagccctccccatttcctcttcctcctggcccctggcaacgactccatgacactctttgggtctatgaatttgactattttagatacctcagatacgtggaatcatgtagtgtttgtgtttctgtgactggtttatttcacttagcatgatgtcctcaataccagtttaattggtgtcccttttattggagaataaattgggattccctaagtcggaatacagtttccccctgtattgcaatggctctccagcaaagaaaagctcaattcaccctgaaaataaccaaggaccagaacttactcatagcccacttggaagtgttcaaaagggcctcaggtctttggttcctatccatgttctacctttatagtcattgccatgactgtgtcactggaggaagtaggacatggaagaaccatcctggcaatacccttaaagtgaccccatcaatgttggttcagtatcagggtccatttagctctcagatcatggctccttcctttctttcttcttcttcttcttttttttttttttttttttttgagacagggtctcacactgttgcctaggctggagtgcagtggcacaatcttggctcactgcaacctctgcctctgggttcaagtgattcttctgcctcagcctccctggtagctgggactacaggtgccccccaccacgcccggttaatttttgtatttttagtagagacggggcttcaccatgttggccaggctggtctccaactcctgtcctcagatgatctgcccacctaggcctcccaaagtgctgggattacaggcatagctactgctgccagcctaatttttttttctaaagtagatatggggtttcaccatgttggccaggctggtctcgaactcctgacctcaggtgatctgcccacctgggccagtgctgggattacagttgtgagccaccgcacctggccttggctcatttcattagtagctatctcagtaataataaggcatacaaatttttcttaatttgttgtccattcttataagggttcctgtagtgctctgggaatccttttgttgataaaacatttcaaagtcatggactgacccgaaatcatatatgtttatatcagtattaatatatgcacctcctaggccgggcgcggtggctcacgcctgtaatcccagcactttgggaggccaaggtgggcggatcacgaggtcaggagatcgagaccatcctggctaacacagtaaaaccctgtctctactaaaaatacaaaacattagctgggtgtggtggcgggtgcctgtagtcccagctactcgggaggctgaggcaggagaatgacgtgaacctgggaggcggagcttgcagtgagctgagatcgcaccactgcactccagcctgggagacagagcgagactccgtctcaaaaaaaaaaaaaaaaatgcaccttctattttctgtcagctggcagatctaggcaagggcaattaatttagccatatgaactaatttatatataactctctctctctctctctctcgctctctttctatatatatgtgtgtgtgtgtgtgtgtgtgtgtgtgtatgtattttttttttttgagacagagtctcgttctgttgccagtctggagtgcagtggcacgatctcagcttactgcaagctctgcctcccgggttcaagcgattctcctgcctcagccttccgagtagctgggagtacaggtgtgtgccatcaggcctggctaatttttttctatgtttagtagagacggagtttcactgtgttagccaggatggtctctatctcctgacctcgtgattcgcctgcctcggcctcccaaagtgctaggattataggtgtgagccaccacacctggccgtaaatatgtattttttgagacagagtctcactcggcttactgcaacctctgtctcccgggttcaagtgattctcctgcctcagtctcccgagtagctgggattacaggcatgcgccaccatgcccagctattttttgtatttttagtggagatggggtttcaccatgttggccaggctggtctcgaactcctgaactcaagagatctcccggcctcagcctcccaaagtgctgggattacaggcatgagccaccgcgcccggcatatttgcattgttgtgtaagtacagtcatcatccatctgcagaactcttctcatttccacaactgaaactctacacccattaagtgataaactccgttccctcctcccccgagaccctagaaaccaccattctactctgtctctgaatttgactgctctaagtacctcatataagttggaccatacagcatttgtcttgtgactggcttatttcacttagcataatgtcctcgagcttcattcatgttgtcaggtgtcagaatgtccttcttttcaaggctgaataacattttattgtaggtatatatcgcatttgcttatccattcattcatcaaggaacatgagttgcttctacattttggccattgtgaataatgctgctctgaacatgggtgtataaatatctctttgtgttcctgctttcaattctttttgctgtatactcagaagtgaaattctacctactcctagggtatataaaagtaaaaaaaaaaaaaaaaagagctgtgtgtggtggctcactcctgtaatcccagcactttgggaggccaaggcaggtggattgctcgagcttaggaattcgagaccagtctgggcaacatggtgaaaccccatctctactaaaaatacaaaaattagctgggcatggtggcgtgagcctgtggtcccagcttcttgggaggcttagtcacaagaatcacttgaaccctggaggcggaggttgtagtgagcagagatcactgccactgcactccagcctgggtgacacagccagacattatctcaataataataataataataataaaagtttttaaaaagtggaattcctttagttcgtattagttttcacttttattttttgtggagatggagtctcaccatgttgcccaggctggtcttgaactgctggcctcaagcgatcctctggctttagcctcccaaaacgctgagattacagacatgagccaccgagtcccaactagtgtttctttttgagtatgaactgccaacaacacaattaaatcaggagagctgagggggtctctagcaagtgtgcgcagggtgcggctggtttcccagcagaggtaagcaacaaggggctttcatcgcccaggtcattcaggaggggcagagtgttgcagcaatggctagtgatgtgtgaaggggaagcaataatgtttcataggctacgccttggctcctggatctaatcgaaaactaaagtaaataacaggcctccaaagagtcccaggtaattgaggcaatagtcctgatacttgtttagacatatcatcaacaaaaagggaagcgggcatctagaatcctggaaacacatctttttgtagacagttcttataccaggatttgtgcttgattgtgtcataattatggttcttttaaacacaaaaagtctataatcattaaaatacacttatgagaacatattttacttttgcagaattagcatagaaagataagttttctttttgatttgtcagttttttaaaaatctgtttaataagccaaagagcacttataagaattttgaattaattcacatgtgaagcattctagataaacctaattacttctcttgcccttccttttataaggtgaaggagaaatctttagattacctaataaccatttaatttaatttaatttaatttgtttttgagacagtcttgctctgtctcccaggctggggtgcagtggcgtaattatggctcactgcagccttgacctctggggcccaaacaatgctcccaccttagtctcccagagtgctgagattacaggcgtgagccaccatgcccagccctaataatcattttaataagccccaaaatagtttatatagaaaagacatctaaccaattttattctgaatttgggaaaatcagaattacaaagagttgttagaggagtcaaaatatttcataaatacctaagcacaagaaatatttataattactgcagaatcataaagcaataaacaacgtttattagaaacttttttcaaaaataagtacttactgggcgtagtggcccacgcctgtaatcttagcactttaggaggctgaggccagcagatagatgacttgagcccaggagttggagaccagcctggccaacatgacgaaacctcatctctactaaaagtaccaaaattagctgggcgtggtggcacgtgcctgtagtcccagctactggggaggctggggcaggagactttcttgaacccaggaggcgtaggttgcattgagcccagatcgcgccactgcactccagcccgggtgacggagtgagaccgtctcaaaaaaaaaaaaaggtaaagaaggactcttttaaaaaatggtttaagtggccgggcgcggtggctcacgcttatgatcccagcactttgggaggctgaggcgggcggatcgcttgaggtcaggagttggagaccagcctggccaacatagcaaaaccccatctctactaaaaatacagacattagctggtcatggtggcacacgcctgtaatcccagctactcgggaggctgaggcaggagaatcgcttgaacccgggaggcagagtttgcattgagccgagatcatgccactgcactccatactgggcaacagagtgaaactctgtctcaaacaacaacaacaacaacaaaaaaaaaagatttaagaatatgtcgaaaagcacagagagatagattatttttgatgacaaaagaaacctccactgaactaggaaaacaataatttagttatttcatagtaaaaggacacaaattctaattttacatcttttgtacattattcatgtaataatttccagtagagaatttattaatataagtatatgtatgtagttagttatacatggaaatataaatctacagatacaggcctggcatggtgactcacacctgtaatcccagcattttgggaggctgaggcaggcagatcacttgaggtcaggagtttcagaccagcctgggcaacatggcaaaaaccccatctctacaaaaaatacaaaaattagccagatgtggtggcgtgcacctgtagtcccagctgctcgggaggctgaggcatgaaaatcacttgaacacaaggggagtaggttgcagtgagctgagatggcaccacagcactccagccttggtgacaaagcgagactctgtctcgaagtcagtcaatctacacatagtcaataaattaaaaaattttccacagtttcaaaatacaattaacttagtatgataaataaaattatgtatgtattaattataatattaccattaataagctgtaataactttttatttttatttcttaatttttgtagtcttttgtcctcgcccctataacttttcaataaacaaataaaactcatatccattttcatgtatacatatttgtatttatctgtaattctttttacctaggataatcaaccatgcatatcaaatgtttttaatctttaattcctttttttgagacagagtcttgctctgtcgcccggctggagtgcagtggcgcgatctcggctaactacaacctccgcctcccgggctcaagcgattctcctgcttcagcctcccgagtagctgggattacaggcgcctgctgccatgccagctaatttttgtatttttagtagagacgaggtttcaccatgttggccaggatagtctggatctcttgacctcgtgatccacctgcctcagcctcccaaagtggtgggattacaggcgtgagccaccatgcccggccccttaatctttaatttttataagtacatggtgtgtatatttatgggatacatgagattttttttttttgagacggagtctctccctgttgctcaggagtgcagtggtgcgatctctgctcactgcaacccatacctcccaggttccagcgattctcctgagtagctgagattacaggcatgcaccaccacgccccgctaatttttatatttttagtagagatggagtttcgccatgttggctaggctggtctcgaacttctggcctcaagtaatccgcctgcctcggcctcccaaagtgctgggattacagcaccacacccggcctcacttcattcctttttatggctgaataatattcaatgatatggagaaacctcattttacttatctgttcatctattgatgaacatttgggttgtttccactttttgctattataaataatgctgctttgaacatttgtgtacaaatttttgcatggactcttatatacatttaaaaatatggccaggtgtggtggctcatgcctgtaatcccagcactttgggaggccaaggtgggtggatcacttgaacccaggagttcaagagcagcctgggcaacatggtgaaacccatctctacagaaaaatgcaaaaattagctgggcatggtggggaacacctgtagtcccagcaagtcggaaggctgaggtgggaggattgcttgagcctgggaagtggaggttgcagtgagccgtgatttcgccactgcattccagcctgggtgacagagtgagaccctgtctcaaaacacaaataaacaaaccaaaacaaattttattacacattttattacagaaggagtaggattaaaaataaaacaaaataaaaagtacatttaattgattttctttaaaatattcagctggggtttaaattgaaattacatagaaattatatattagtttggatagacttgacatctttataaaatgaaattgcctcatccaggaacatgtattgtgtcttcatttattcagatgatctttttttgtttttgagacggagtcttgctctgtcgcccaggctggaatgcagtggcaccatctcagctcactgcaacctctgcctctcaggttcaagcagttctcctcctcctcagcctcctgagtagctgagattacaggcgcgtgtcaccatgcctggctaatttttgtattttcagtagagatggggtttcaccatgttggccaggctggtctcaaactcctgacctcaggtgatacacccacttcggcctcccaaagtgctgggattacgagcatgagccaccgcgcctggcctattgtaatttttttttttcagacaacagaaaagtataaaggagaaagtaacaaaccattagttacctccccagagataaccattgatgacatttcctccccaacatttttccccctatggatacacatacattttttcaagatcttgtttcctttgatatgtcattttagtggcttgaacttatttctggaacaatatatgggtaaagtctatgcatatatgtatctatgtatatatctatctatggaaaacaagtagatatagacagtaaaataaagacagagacaagacagcggttggagagatgaaaggagagaaagtcatagacaaggagagacatatggggagaggaagacacagagagagctgtgggcacataagggcagaaagataaacacagagagccatggagagatgaaagtattgggctggggccaggcatggtggctcaacgcctgtaatcccagcactttgggaggccgaggagggccgattgcttgagctcagaagttggagaccaacctggcaacatgacgaaaccccatctctacaaaaatacaaaaattagccaggcgtggtggtgggcacctgtagtcccagctacttggcaggctgaggcatgagaattggttgaaccctggaggtggaaattgcagtgagctgagatccggccactgtcctccagcctggaggacacagcgagacactgtcagaaaaaaaaaaacacaaagagacaaggagaggatggaaaggagcatttatggagctcctactgaatgtcattctaaacctccaaggtcactttgagggaggctgtcagtagtaacccctttacgccgctgagagcctgagccttagaatggccaactgagctgtccatggtcacatcacctagattgaacccatctccctggcgcgggccgggcccactgcgggtgatccattaactatttatctaatgaacaaactaaagtccatctcctcccccaggaagagagatgaggaccagacccccattccactccactgagtcaatttttcttacctgttttcctgtctactaaggtaacagtaaggtcggttgccccagcaactgccctccgactgccatggcaaccgccagctctccaccttgccctttgggcatctccatggcgacgggaggtctggtggggctgccagctccccaggctgcgcctgcgtcggtcgggtgggtggggtgggggcggggagggggggcctggttccgggcgtgcgcagccgcagagcgccgcagcctcgccagctcgccccggcactgcgcacttgccagccagtccgcccgtccggagcccggctcgctggggcagcatggcggggtcgccgctgctctgggggccgcgggccgggggcgtcggccttttggtgctgctgctgctcggcctgtttcggccgccccccgcgctctgcgcgcggccggtaaaggtgcgaccccagtccggcgaggggtgggggttgggggaggatgccaccggcgagggttggggttggggctgcgccgcctcacccccgcccgagccggctcccgggacgtgcggagagatcgacgagggtggcccgggctccggccgccggtccgcgcccaggccacgccggcacacctgagacctgacttggtctctgcctgtgcgggtggcgttgtccggggcgccgccggtaaccgtgccctgccca

SEQ ID NO: 178 - DNA, 61541 bp, mus musculus; identical to SEQ ID NO: 177

SEQ ID NO: 179 - DNA, 15 bp, mus musculus
gccacgcccccagcg

SEQ ID NO: 180 - DNA, 203142 bp, mus musculus
gagggcggggccggaggtttcgattagttgtctctgccgctggggaaggtaaagcggcgacggcgtcctcaggagctgtggggtcccctgctagaagtgggggactcggcggggtgagtagtcgcgccgccacccgcccgccaagccttcttacccttacatcggccccgcgtccacccagcttctcctgagagtggagacccacccagtccccccgggcggacaagagaaggggcgggggcgccggttcccccggaacggggcgacgcggtgaggacgtcccagcccggagtagcccctcctcagcgctcccctgcgcctctggaagggcttcccccgaggggctggggctgtcttttggggtgtggggaggcgaaagggtgtgaaagaggggcggcgggtcgagcccgccccgcggggttcccctcagcggcgggtctgcggcgtccccgccccgccgctcccgcggcacgagctccccggggcttgcggcgaggtaagccccttcccgccggcgccgaggaggggcctgcgcgccccagccccctgcccgagttcggagggagcccgagactcgccaggggccgtcagtcgcggcccgggcccttctgaccttggctgcccgcgagggtgggctagcgaccgggcgccggccccgcggctccgcaacctcccccggacaagtttcaggcgatgctgtgaagttcacgactggcatagtgcggggaagaagaatggccccttctcagaccttcataccttttggaccctcatagaaatcggattctgggatttggaaccgtctcccagaacgaacaggtcctccttgcattgacacgttttgtgcccacgttggggaaaaaaataacctgaacatatttcagtgtaaaggcagatcttccttgagggttttgtttttcgcttcatttgagtgttaaagaacagatgcctgaataagaaaagcctgaccttagtatctctacagtgagattagacgggtgctgtgatatttaagtagttgcagatcagtattctgttagcacaatctattttaattggctggaatttaagctgattttagaaagtattgttgacaccgaatgatttctttctgtgcatctgaattaggtttgtttgaacgtaatggttatatagttaatgtaaaagattacacaaattaatttgtctgagagcgtttgtcagaaacaggagacagagatgtgtatagaacaggattatcgttttaggtaacatctgctggaacatttccagcttgtttctttcttgctgtagggttacaaaaaagacatcttcaccgaggctattcggaattacatgtgagtgacacttagatgtaaatttgtttttatttccttcaagtgttttaaaatgttttgttcacaaaatgtgaagaggctatatttacttgttcctgtatgttagtgttgaaggtgatagtatgatcttatgattaacaatccaattagggtccattaataatagatttttaaaaaaggcgtgctgcttttcgagaatatgataggttgagtacctagcaagacttctaatttctttttattaaaagtactattttaggattgagaatttttggcgttgacactgaaaccaggaataaggaagcctgcagcagtcttagcagtttgacaccaccagtaggtgtttctgttgacaaatgcagagaagagaacatttgggaaggaaatctttttttcggggcgggggttgggggggaggtgagggtggttgaggggggaaggagccagaagagagaagctaatgctgccagcactgtatgctgagcatttcacaagtacaaggaaacctaattagggaaaaattccgtttggctctattaaataatagaactacaaaagaggcatactaaataaagttaaccattccaagagtgttagatattatctgccatttcagagtagttgggggttcctcaattggagagggtatcaaatctctttgaattgtcttgcctttttaacatagtcaatgcagcgattaatttgctagatgtatatatatcaaacagttgagtattccagttttgttgtttagcatatttcctaagcctaaattttttaaaatcaaaatccgatatattttttttaaatttgaaatagaattctttgtccagagagtaattccttttttcctggctcagtcttaaaatttattcatgatttaggggtttgtgattggtatttttttacccctttttctcaggtttttgatttttacttatgcaagttccctaagtctgcctttgtttatattgtaattttcttggaattatttaaatcagagtgtggcatctattgtgtcccctggggttttaaaaggaaaggctcccattgaaagaaattgcagggccgtctcgcatagatgggtaatagaaggttgactgattgcgaatcagatgtattcggttgcaaatatgctgcttggggttaaggcagtttcagttaacgggaaccagattttacgtggtgtttctactttgaaggtacagtattgttacattacaaactgaaagacagaggtggagaaattcctttaagtatcacccctagccttgtttcaccactgtgtccaggaatctatgagagactgttaacaatagctgcattgttggaaatgacagtggcttctcttgcagaaagttaacctttcattatgattttcatttcagtttactttgtaaaagaaaatttagctttatctgagaaattggctgtaagaaatttgcaaagagagcaaggaaaataggttttcttcaacgtgtctgttaaaattcacattctctccccttccgttttgataactggtggtgatctttatttcctctagatattaggtatgctaacacagtacctgatttttggcagttactgtgggaatatgacttttttatgtaataaattgatgtcaaataataatatgaggcttttaggaataattaattcacatgcatagatctaaaacatgagggaaatcttttagatgacccttcactttggtacaagaatagcacaatttgaagtattaagttgctttctaagtagaaaaagctatttactcagaattgggtaattttagattttaaagttttttttttttttttgcaacatcaaataatttggcaacatcaaatttcttgttaaaggaggcgacagaatctcacagattctttatcatctgatcatggcatcagttggactacatttcaacttaggacaataatgcaattaaaagactacatttaaactttctgtttggaggtttttctaatttgctttcaatctcaagcccaatgttagaaatcttttgttggtgacgcacaattttagtgttcagattttaggttttgatcgtttttagaatttttttttatgtgtgtagagcagcgcatggatgactgaattaatcaaagatctggcctcatttctcattcaagtttgtacatttcttcacactgagatacgagcttgggtgcaattctgttggtgggcgtgaaagctgagggtaaggaccttctacctagagactgataacatttaaatatttcagatttgggaattaatagaaagttatttattaggttaaaaggaactagcccattcaggtatttgaaaatgattgtcaatactttgaattaagctcttagaaacattggggtttgagacaatcctaatcagggtcaggttttgggtgtggtctctcttttgggcagtcttctctgtaataattataatactccatctattgagccttactgcatgccagacactgtgacacgtaatttatttgcatgaatacatgtgtgttctcacaacagctctatgaagtaggtcttcttacctcctgtatacatgtcaaatgggctcagagaaataaagtactttgctcagattacccagctagtcatcagaaacagcaaaattgccatccaaactggtctgacttgaagccgtgctcttcaaaaccatgctttctgcttctctttaggaaactgatttcccaagcatatttatttttgacaccgggtctcactctgttgcccaggctgaagtgcagtggtgtgatcacagcttgctgcacccttaacttggcagactcagtggatcctcccatctcagcctcctagtagctggagactacaggcacgtgctcccataccaggccaatttttctttatttttaatagaggcggggtctcatgatgttgctcaggctggtcttgaactcctggcgtcaagcgatcctcctgctttggcctcccaaagtgcttggactacaggcatgagccaccgccaggcccaccccaagggtattttgagttcctactgtatattatgcctcgggtgtactgaaggtatatgtatgcttcttggagttcatgggctacattggcaaggctgctggacctttagtcacatgggggactgaactcagatccatcaggactgctagataggacaattggaagtgcagacttttctaaccagagggtcagacttttctaacagaggttctgtttcttcataaatgaaggctgtacataatcatgccaaaaatgaggtagttgtttctaattagctacttggtatttcatgtttctggatattgcattataacttttgatggactttgattacatttgctacactaataaaggcttcgaagatactccttgaattcaattttgtggcttagatatacccttgaagtaaaatggcagccattataatttgcagatgggcacctcttgtgtaattatgaccagtgaaataaaatctggaggtaaagtctatagagatatattattgtgtgtgcgtgtttttttgagatggagtctcgctctgttgcctaggctggagtgcaatggcgtgatctcggctcactgcaacctccgtctcctgggttcaaacgattctcctgcctcaacctcccaagtagctgggattacaggtgcatgccaccatgcccagctaatttttttgtattttagtagagacggagtttcaccgtgttgcccaggctggtctcgaactcctgagctcagacagtccccccgcttcagcctcccaaagtgctaggattacaggcatgagccactgcgcccaccgcttgttgtgtgctaatacagaggttggactctgaaaatttttctacatgaaagtagaactttctgctatttaaagcttcttgtgattaaaacaaattttctttacatttttaattttttttttcttttttttttgagatgagtcccccactctgttgcccaggctggagtgcagtgatgggatctcggctcgccgcaacctccgccccccaggttcaagtgattctcttgccttagcctcctgagtagctggaattacaggcgcctgccaccacgcctggctaatttttttgcatttttagtagagacggggtttcaccatgttggccaagtggtctcgaactcctgacctcaggtgatcttcctgcctcggcctcccaaagtgttgggactacaggcatgagccaccgcacctggcggtgatttttttttaaaacaagacccatcattaagagaactaaacagttatgtgccctaaggaacacttagaagtccatgttaggaaaaaagaaaacttaacatctttttctgtaatcgattaaaatcacttttgttacctatttaagttagaaagtgctgatgaatactgtagagcctcagggccagaaatatcttggccaaagcaggaccatatttctacacaggtgggacctgtgtgttaattttgttgatttcttttcttttttttttttttttgagacggagtctcgctctgttgctcaggctggagtgcagtggcgcggtctcggctcactgcaagctctgcctcccgggttcacgccattctcctacctcagcctctggagtagctgggactacaggcgcccgccaccatgcctagctaatttttttttttgtatttttagtagagacgggtttcaccatgttagccaggatggtctcgatctcctgacctcgtgatctgcccacctcggcctcccaaagagctgggattacaaaattttgttgatttctttataacgtaatggaggtgtactttacataccataaaactcacctttttagtgtatgattcaattatttttaagttaatttatggagttggtgtgactatcattacaatccagttttagaacatttccatcaccccccaaaattctctcctgtcaatgagttttttttaaccttatttacttgcttcacctagacctctcctttttttgagacagggtctcactctgttgcctaggctggagtgcagtggtgtgatctcacctcactgcaacctccacctcccaggctcgagcgatcctcccacctcagcctcttgagtagctggaactacaggcacatgccactgcacctggctaatttctttctttctttctttctttctttttttttttttttttgagatggaggctcgctctgtcacccaggctggagtgcagtggtgtgatcttggctcactgcaacctctgcctcctgggttcaagcgattctcctgcctcagcctcctgagtagctgggattacaggcatgtccaccatgcccggctaatttttgtgtttttaatagagacagggtttcaccatgttggccaggctggtcttgaacccctgacatcaggtgatctgcctgcctcagcctcccaaagtactaggattataggcatgagccatcatgcctggcccacctggctaatttttgtattattagtagagacaggatttcaccatgttggctaggctggtctcgatctcctgggctcaagcaatctgcccgcttcggcctcctaaagtgctaggattacaggtgtaagctaccgtgcctggccaacctagatctttttgtcatcagatactgacaaatgaaatcatgtagatcttaaaagatgtctttttttttttttttttttgagaccggatctcaactctgtcactcaggctagagtgcagtggtgtgatcacggctcactgcagtctccacctccccaggctcaagtgatcctcccacctcagcctcctgagtagctgggactacaggtgcaggctgccatgcctggctaatttttttgtattttgtagagatgggttctcacagttttgctcaggctggtcttgaactcctgagttccctactttggccattcccctactttggcctcccaaagtactgggattacaggcatgaaccactgtgcctggtctaaaagatgtccttaaaaaatatcttctggagaccaggcgtgggtggctcacgcctgtaatcccagcactttggcaggccgaggcgggcggatcatttgaggtcaggagtttgagaccagcctggccaacatggtgaaaccccatctctacaaaaaatacaaaaatcagctgagtgcagtggtgtgcacctgtaggcccaacctcctgggaggctgaggtgggaagatggcttgagcttgggaggcagaggttgcagtgagccaagatcgtatcactgcactccagcctgggcaacaggagtgaaaccctgtctcaaaaaaaaaaaagaaaagaaaagaaaaaaaatacacttctcggccgggcctggtggctcacgcctgtaatccctagcactttgggaggccgaggcaggcggatcacctgaggtcgggagttcgagaccagcctgaccaacatggagaagccatctctactaaaaatacaaaattagccgggcctggtggcgcatgcctataatcccagctactcgggagcctgaggcagaagaattgcttaaaccggggaggtggaggttgcggtgagccgagattgcatcattggactccagcctgagcaacaagagcgagactccgtttaaataaaaaaaaaaattttcacacacagtatcatttcataatgctttttgtattttcaaaagttcttgcctatgcataatacatagcggaatttaaaggatcataactgcaaatgatataaattaccttgtgtttgtggcttaaattttattttcatttgatcttttttaaaccagcaaataaaatacaacattcttggtgatatgttgggaatgcagggaaaataaatgaaggtaaaagtaatgtaattattgtgcaagaaaaagttactttcaaatgtaagagcacagggaaacaattggttttcttgattttaagctaatgacattgtgcattttgttgtttggacctctaatcccccttgacagatccatgcctaatgcgcgtgtcgtagagcaggcttcatcaaatttaggtatttagacactgtgtctacttcagactggattgtgatgggatttgcaaacagcttaacatgcaaggtactgtaactgccttttcctgcctgcatcattttcttcttagttaccttctagggtgggctgaggagtaaggccagcttaggaacgggaagtctcatcagcacaggctgatccccacttgtgcaggtttcctcctttgctcagtgtattgcttgggtagacggacactgcttagggatgttatttttttgggtacatataggagaggaatgtaatggtttggttagaagtaaagtgttttggaaaatgtatctaattttctttgcttttagatgaacatttctctatggaaagtgacccttatatgtaccaggcaggtaaatcaataactccttgtgtggttggttgtgtctggatttttaatggcaaacaggttagacacacggcactggtctgatattaatattttactgtcagttcaatcgtaactggtttgaaataggcataggtaacatgaagtgccagtgtaacttgattttgatagtaagaacaactttggtttctggaaattaacaaaacatatataaataatatatattgtttaaaaggattatgttattttaggtaagttgcaattttagatatcagttttaaactgtgtattttgtattatgggccaggcatggtggctcatgcctgtaatcccagcactttgggaggccaaggtgggcggatcccttgaggtcaggagttcgagaccagcctggacaacaaggtgaaaccctctctctacaaaaaatacaaaaattagctgagtgtggtggcacgcacctgtaatcccagctactcaggaggctgagtcgggagagtcccatgaacctgggaggcaggggttgcagtgagccaaggtcgcaccactgtactccagcctgggccacagagtgagactctatctcaaaaaggaagaaaaagattttgtattatgtttaaagattaggttcttggaagtatgagattgtattttgataattaaagtaaacatatacagtctcatgaggaagatatgacagataaaaaaaggtggtgagtaatagttgaagaacaacttactgacccggatttacctgattaccctgacattgctgattttagaaactaatttcctgatgagtagaatctttcaaagattaccagaggctgggtcagatgtgacatatcctagaatttatccacaccctcagacacacaccccaccaaggtttgtcagccgcttatgggatatattaactttaattgctagtaattattattcctaatattaccactaaattcaagtttagcaatgcaaatgaaaagaaaaaatttgattttaattgtacttactgaaaatagttggggtagacaaaagctaattttgtgcaaataattattttatactttatcaattatttatttctcaaataacctgtcctacatcctgaggatctgtccttcattcatttaacaaatattacttaatgattctgtattgtgtgccagactttgctggagactacatggagtgataaaatgtaagtaggccctgccctcaaaaaattaattaattaatttttgagacagaatctcactctgtctcccaggctggagtgcagtggtgcgatcttggctcactgccacctccgcctcttgggttcaagcgatttttgtgcttcagcctcccaagtagctgggactacaggtgcgtgcctccacacctggctaatttttgtattttcagtagagacggggtttcactatgttggccaggctgatttcgaactcctgacctcaagagatccacccaccttggcctcccaaagtgccatgattacaggtgtgagccggccaaagaatttagtcttgagatggaggcagaggagaactgcagaacactatgggagtgtacttgacccttgaacaaggtaggggttagggtgctgaccctcacgcagtcaaaaatccaagtataacttttgacccccccaaaaacttaactactaaaatggcctactgttgactggaagccttattggtaatataaatagtcaattaacacattgttttgtatgttatatgtattatgtagtatattcctacagtaaagtaagccagagaagaaaatgttattaaaatcataggaagagaaaagatacttactattcattaagaggaagtggatcattataaatgtgctcatcgtcttcacattgagtaggctgaggaggaagagggaggggttgtcttgctgtctcagcaggggcagaggtggaagaggtagagaaggtggaaggggaggcaggagagggaggcacactcagtgtaatttatattgaaaaaaaatctgggtataagtagatccatgcagttcaaacctgtgttgttcaagggtcaactgtatgtaacagggtagggttggagagtctgtccttgggggaagaggtgggaaggtcgctctgaggaagtaacatttaagtgagacccgaagaatgagaaggacctggtctagttggggaaataagttttccagacagaaggtgcaaatgtgatgaggcaaggtgagagagctggggtttttgcacaacagaaccttttaaagaactgaaagagggctgggcatggtggctcacacctgtaatcccagcactttgggaggctgaggcaggcagatcacttgagcccaggagtttgagaccagcctgggcaacatggcaaaaccccatttctacaaaaatgcaaaattagccaagtgtggtggtatgtgcctgtagtcccagctactcccagagagtaagctgggaggattgcttgagcccaggagctggaggctgcagtgagccgtgattatgccactgcactccagcctgggtgacagcgagactcttgactcaaaaaaaaaaaaaaaaaaaaaaaaagaactgaaagaaatctaaaacgaccagaaaatagagaaacaggcattgaagcacaagttggcagcaggggccaggtcttgaaaaggtttagtaggccattttgctgggtttttgaacttgtcctaaatctcctgggaaacggttgaagattttaaggaggggtgtgacatgaaatgaaatgctacaaaacccaagaattttagttcaatggaaccttggtaatttaccagaaaggtcataatctctgcaaagtaaaatattcttcccttgtttcattaaaatttttgtaactcctttcttgattgattgtcgtctgcggtactcctttcattgtttttgtagaaattccctttaattttctaaaggtaccttttcttttatccctcactgttctgttaaccttatataggaatgtcatttctatttataactgaattagaatattttttctaacagctttagctctcttccatatttaaacttaaaattctttgctgtttttttccctccagacacctttaatctgctcgaagtatttaatgttttaacgaaatgtttcattaagtttgctttattcttttgttcttccaaatacagtgtcttagatctagtttaatatttctcagcatttatgctatttcatgttttatgaaatcacatgtgagcacccagaatgtttttagaaaattttgttactattgtataggagcactactcttcatcaggagcaccattttcaaatctggttcacattctgtggccttatcttttacattaaattggtctctgttaaacattttatgttcaggtgggcttatgtatatataagtgctataaaggtgttattttttatatcctgatttgtttctttctccgacaataaatgcccctacatgctgaattctttttaggaaatctttgccatactaagtttgtgattgccttggtgattgtgtgagcattcattcaagtctttcttggtgtaaagttgttagctcatgcctgtaaagaatacttttgcccactgttcctctccacatatacgaagaataactgcagcatcacctctttcaaatagttccttggaaatctacatagtgattcaggcttgaattgagttcgcttttgccatgagttattttctttcttttctttttttttgagacggagtcttgttctcttgcccatgctggagtgcagtggcgcaatctcggctcactgcaacctccgcctcccgagttcaagcgattctcctgcctcagcctcccgagtagctgggattacaggcatgtgcccccacgcccggctaagttttgtatttttagtaaagacggggtttcaccatgttggccaggctggtctcaaactcctgacctcatgatctgcctgccttggcctcccacagtgctgggattgcaggcttgagccaccatgcctggcctgaagaggtacactcaacaggcacttaaggggactgggaaaggaaatgactcttgagtgcttgtgaagagtcttaaaggaagtccagaatgtcaggtgcaggtaaagggtttacaggcagagggtgcattaaaagacaaggatctggctggccgcggtggctcatgcctgtaattccagcactttgggaggccgaggcaggtggatcacgaggtcaggagttcaagaccagcctggccaacatggtgaaacccccgtctctactaaaaatacaaaaattagccgggcgtggtggtgtgtgtctgtagtcccagctactcaggaggctgaggcagtagaatctcttgaaccctggaggcggaggttgcagtgagccaagattgcaccactgccctccagcctgggcgacagagcgaacctccgtctcaaaaaaaaaaaaaaaaaaaagacaaggatctaaggatgggcatataaagctgggagaattgcaagaagtaatgtttatttatgtattacatgctttgctttgatgcttgtaccctagctatatcccaggatcttttctactgtaagctccgtggaggcaaggagtgttgactgttgtaccctcagtatgtggcacattgccttgcacataggaagtgctcaataaacacttcccttatcaaaggtgcccctttttgcccccccccccgccccccaccatttcctcatgtctgtatcttcttccttgtgcagtggtatatcaggtgcctatccagtggatcctcctctctgcttaccctatagttatgcctgtcctgtgtctagttacctgtgtaagatatgtaattgttataattggatccacactggtaaatgagtaggtgctaatagctctctgtggggctccagaatcttttctaccaacatttatggtatggcagatgaaggggaagccaaaggtgacaactaccagagtgacatatctgagctttttttcatgatttattgcatgaattcattgaaatgctgagttctattccataataggtgtgtgtgtgtgtgtgtgtgtgtgtgtatgtgtatctacattgtacaatacaggcatactttggagatagttttggttttagaccaccaccataaagcaaatattgccataaagcaagtcacacaaattttgtggttactgagtgcatataaaagctttgttggctgggcgtggtggctcacgctatatcccagcactttgggaggccaaggcaggcagatcaccagaggttgggagttcgagatcagcctggctaacatggtgaaaccccatctctactaaatatacaaaattagctgggtgtggtggctcccacctgtaatcccagctactcgggtggctgaggcaggagaatcgcttgaagccaggaggtggaggttgcagtgagctgggattgcatcactgcactccagtctgggcgacagagtgagatttggtctccaaaaaaaaaaaaaaaagctttgtttatactatactgtagtctattaagtgtgcaataacattatgtctaaaaaaaaaaagcacatactttaattaaaaataatttattgccaaaaaatgctagcaataatttgacccttcagtgacccataacctttttgctggtggtgggttttgccttagtattgatggtgactgactgatcaggatggtggttgctgaaggttgggggatctgtggcagtttcttaaaataggacagcaatgaagtttgccatatctgttgactgttcctttcattgtaggttcttctgtagcatacgatgctgtttgatagcgttttacccacattagaactatttctccaagcctgctgctgctttatcaactaagtttatagagtagtgtatttttgaaatagtcatttcaaaaatgtttaaggcatctttaccagtagatttcatctcagaaaaacagttcctttgttcttccataagcagcaactcctttgtccattcatgttttatcatgagatcacagcaattcagtcatatcttcaggctcctcttgccttggcctcccaaagtggtaggattgtaggtgtgaaccactgcacctggccatatcatttttttgtgtgtgttttgggtttttttagacggagttttgctcttgttgcccagactgtagcacaatggcactatcttggctcactgcaacctctgcctcccgggttcaagcaattctcctgcctcagcctcccaagtagctgagattacaggcatgtgccaccacacctaggtaattttgtatttttagtagagacggcgtttcactgtgttggtcaggctggtctcgaactcctgacctcaggtgatccacccacttcagcctccatataatctttgtgtctttaaatgggtatgtctttccttctgctaggccgttagtgctggtatttgagttaatctagttaggaattggtgtagccaagtccaaggttgtactactcaccaaatgacagccaataagttaagagacaaggtgttggcgcaaagaaagcaaccttatttggagagccagcaacctgagaagatggtggactagtaatgtccgaaagaaccatcttaatatgaattttcgcctccttttatgttagaggaagagggaagagggaggaggttgaggtcaagagatgactatgatgaccacagacatctaggtggcagtgagggtctgtggaggttgtgaaacttctttgtccttggtcaggtcacaatactataaatctttaacatggctgggcatggtggctcactcctgtaatcctagcactttgggaagccgagtcaggcagataacttgagtctaggagttcaagaccagcctgggcaacatggtgaaacaccgtctctatcaaaaatacaaaaattagctgggtgtggtggcacacacctgtagtcccgctactcaggaggctgaggtgggaggatcacctgagcccaggaggtcgaggctgcagtgagccatgattgcaccactgcactctagcctgggtgacagagtgagaccctgtctcaaaaaaaaaaatcattaacaacgttgttacttgtgtgtacactgcccctatctcttcaggggttttcagaagggactatttgctttaaactataaactgaatttctcccatagttagatggtttcactgggtggtggtgggggggcttagaagcaaaatgatgttagtcatgctaggcttccttttcactgttacattgggctggatttgagtttttttgtgttgttatggttaacctagtgtaccccagttttcaaattctcttagagatactttgtgatcagggtgggaattggtttaccagaacagtgtctgttccagtctaaatttcaggtctccccttcgaagtgtgctttagtgagggtctctttacatactcttgattttctcccgtccctttctcagtgatattctgctcttactgttcctggaagtttgtttgcttggaggtggggaggggtgataggatgtggtctctgttcttgattaagcctcagtttcaggcctgactctcaggatcttgccccttccctggctgttgtattgggctcaatgtggaatcctacccctctcccaggacttgggcccccacccctcctccctgctgctctgatttttcactattgtcttaagggtagaagtaaccattgtcctttctgtcacagtgaaggcttgtcttcctgagtggagataggggagagtgatctgagggtagtgtccagcctctcaggcttagctgctgcccacccccaggtttgcatcacaatgagcctacctcaggactctttagagctctgagtgagtggggtgggggagttggaggaggaagaccctacaggaagttgaggtatcatatcctcaatttctgtgacccccagtggtttcacactatcttttcagcaagccacattggatttcacgcatttactgactcttctacccgttctttttggtgtccagctgtactctccaacaggcgagcacatggtcgtctcctctctcccttcaggtactctccttagtttttgagccaactggttgctctgttggtttttttgttttgttttgttttgttttgttttgttttgttttgttttgaggcggagtttcgctctttcgcccaggctgaagtgctgtggcgcgatctcggctcactgcaagctccgcctcccgggttcacgccattctcctgcctcagcctcccgagtagctgggactacaggtgcccgcctccacgcccggctactttttttgtatttttggtagagacggggtttcaccatgttagccaggatgatctcaatctcttgacctcgtgatccgcccgcctcggcctcccaaagtgctgggattacaggtgtgagccaccgcgcctagcgctctgttgggtttaaagaaagtcttgaatttgaaattagttcagctctttttcattgtagttctcttattccagggtttaagccagaaatttggttactcttaaaattttaacatgagcgtttccttaagtctaagcttaattattattcctgtcctcctgaataagaccaagagtttggaatgatttactccttaaccgtcagcccctcttccatgttaatgttatttatgtgttagttttgccttatttaagccaccttacaccaataaaaatagtgaatatttactcatgtgcttttcaggtttctttgctcaccattcttccttcactccatttcttccttcttggttcagtttcttccttctttattaaaaaatgttcttaattatttcagtaagggccccttaatagtaaatttggttttggtgtttgtgaaagtgtctgtacttcactttttcccttgaatggttgttgagctgggtccagaattttgggttaattcctttccccgagtactttgatgttattctcttgtgttttgacaaatttgtaaattttttttaacttttaagtttggggctacatgtgaagttttgttacataggtaaacacatgtcacaggggtttgttgtacatattatttcatcatccaggtaataagcccagtacctagtagttatcttttctgctcctctccttcctctcacccttcccctcaggtagagggggatagttaatgttattcttttgtgttttgacagatttttaaattttgtttaacttttattttaggtttgggggtacacctgaaggtttgttacataggtaaacacatgtcttaggggtttgttgtacagattatttcatcacccaggtattaagcccagtacccaatagtcattttttctgctcctctccctcctcccatcctccaccctcaggtagtccccaatttctgttgtttccttgtgttcataagttcttatcatttagctcccgttaatttttagttttttggtctaggctggtctggaactcctggcttcaagtgatcctcctcagcctcccaaagatctgggattacaggtgtgaaccactgcacctggcctagttttatttgctaatgacaagtcaacagtcagtttagttgtaatttcgttgtaggtaagtaattctctctcctcttgagctacttttaagagcttttccttgtttatttatttattttttatttacagtacttttgagttgctgtttatttccttgtttttttgatcttcagggttttttttttttgcgatatctctaggtgtggatttgttttatgtatcctgcttttatttgatgtattccattagtctgaggacccctgatgtcttcagctgtgggagaaaatcttagccattatcttttaaaatagtttcgtctccattttccatttatggaaccattatttagatatgttttgggatttttcatcacatccttcgtgttgtttaatttacatttctatctcttctggctaatctcttgacatctatcatacgattcactaatttcctctttggctgtgcagttaatttgttaacttattgagggtttcactaaaaacatttggctatatatagtcaaatatataaatattgatatttatacaaatatacaaatatatatgtgtgtacaaacatatatatacatgttttaaagataggatcttgctgtgttgcccaggttggtgttgaactcttggtctcaagtgatcctcccaccttggtcccccaaagtgctgggatgtacaggcatgagccactgtgccccacctcgaatatattttcaaatttaagaatttctgttacattttctttcaaacctgtatttaaattttctttcaaatcagcttttaaattttcataagagcattttctttggacatttaaaaatatagttatgtttaagtcctctttggattattttcttagctgtaatttttgaggaatgaaatctcccatttggcttcccttcttccctccaagatttttgctgtttctccgtgtggtgtgcagtatttgacaatttaacgattgtttgcctatgcccgggttgtggaatgctcttttggtctagttttgcatttgtctctgatgggaccctttgggttcactgcgtctagagaggttttggtctattctcagatgggtctccagcacctggaaagtagtgtaaattttgactccatatttgtgtagaacagacttggggttttcccttctgtttgggtcactttttttttttttttttttgagacggagccttgctctgttgcctaggctggagtgcaatggcacgatctcagctcactgcatcctctggttcccgggttcaagtgattctcctgcctcagcctcttgagtagctgggattacaggcacacgccaccacgccctgctaatttttgtatttttagtagagacagggtttcaccatgttggtcaggctggtctcggactcctgacctcaagggatctgcccgcctcagcctcccaaagtgctgggattacaggcatgagccaccgcatccagcctgtttgggtcactttctctgcacagcgctgggctggtgcttgtagcttttctttttattttttcactcaaggacagtcctttatgtctttgtctttgtgctagtggttcacctccagcttctttcccatgcacaggcttcaggcaactgataatactttggctcagtatctccacccaaatctgatctcgaattgtaatccccacatgtcaaggggagggacttagtgggaagtgactggatcatgggggcggtttcccccgtgctgttcctgtgagttctcatgagatctgatgattttataaggggctcttcaccctttacactctgtgccctgctgccttgtggagaaggtgcctgcttccccttctgccatgattgttaagtttcctgaggcctccccagccatacggaactgggggtcaattcaacctttttcctttataaaataaattacccaatcttgggtagtatctttaaagcagtgtgagaatggactaatacaggaaacttctccagtttcctggtcctgtaatcatttgcatttgcagcccttgatttagagggcaggggtgagcaggtgtttatcatatgaagaatctcatttaatacgtttttctgtctttgcagccactcctttctattctattttcttcctgactgttgatcaggaagtagttctaccagttaagaacaagaaagtaggcttgtaatcccagcactttgggaggccgaggtgggcagatcacctgaggtcaggagtttgagaccagcctggccaacgtggtgaaaccccgtctctactaaaaatacaaaaaaaaaaaaaaaaaattagccagggatggtgggcgggcacctgtaatgggaggctgaggcaggagaatcgcttgaacctgggaggcagaggttgcagtccgtgagctgagaccacgccattgcactccagcctgggcaacaagaacaaaactctgtctcagaaaaaaaaaacaaaaaaacaaaaaaacaaaactgggaagtagttgtaaccacagacaacccccaccttgaacaggttatttaccaaaagttcttttggacattgattgtatagaacacagttcacattatctgataggaactatgttatttaaaaaatggatttgtttcccaggtgagcctgaggagtctgttctctcctttatgcagttgaaattcatatagacttgtgagttctttgggactgtaatcaatatacagtatgtgatttctgtgggaaggtataatacattttaacgttctcagtgaagaagggagtatgctgttttccaaccccagtcggtattccctggtgtgacctgccagctaccagaccccaacagttgttacaaactctagccactgttttcaaatctgccactaaatatcaccactcatactcagcacatgaccttgcctccacttcactgagaactttgagccatctggttgattttcttcacacttctaccagtttgtcatccctgcttctccagagttgccctctcctcctgtctcaggggatgagatgcttcttctgctgtttgaggcagtcctttgccaggagccttaggcttcactgctgcttctttggcagtcttttctcatcagttattccccttcattctccccattctgttcccagtggctgtccacttggggaggaggggtgaagattttgcctccaggagacatttggcagtgtctgcagacatttttggttgtcacaattggggggtggtggtgatgcatgtgctgctagcatctaacgggtagaggcgtgtagatatcctacaatgtacaggacagccccatgacaaaggattacctggtccacaatgtcagtagtgcctgggttgagtaatgttgctgcatcctcagggtctcacttttgactccttcgtttttctctgcccattatcttatgcctaagattctcatcctaggaaaccttccctgaaccacatgtccaatcctctcctagctacctaacttctccccttctcactgaaacttctgaaagagcgatttacacgtagtctctcattcactcttcaaattttagctgttgctttctggcttcccacccccaccgctgcttaaactgtttttgctgagaatgcctgtgacctcttgtgtgctgcatctagtggattcatttagtcctaattttacttgacatttttgttgcacctgacactgttaatcactatccccttgaaccaatgtattccattgtcatccttgttctccatgtccttctcttgtatttctttccctccctcctgtgtgggcttcttgatgatctacttactccttacacactgctgttacctggttttgacttcttagccaagaattatcataggtcattgtctccatgaagtaccttagttaccccaaggatttcagttgcacttatatacagatgtttttctaaatttctaaattctttttttttttctttttgagacagggtctcactctgtttccctggctggagtgcaatggcatgatcacagctcactgtatcctcaccctgtaaaaacggggtttctctgtgttgcccaggctggtctcagaactcctggtttaagcgatccaactgccttgacctcccaaagtactgggattacatgcatcagccaccatgcccggcttaaattcttccatgacttttcccctccaggctttagtgtctcttgtaatctgctggaaatctacacctgaatattctataggtaccttacgctcagcatgtctaatgtgaagtacatcttttcctcaaacttcgttttctgagatccacctgggctcccaagacagatagtggggtcttgtccagttcatatattatctacagttgccaatgtgatataaaatatgatttaggtcatatcacctacttgaaagtctgcactggtgctgtcttggtaacagaaagagaaagactgaattcccttattttgcccatcaggctctccttgatatagtctctgcccacccacctctccaacctcacatcatctctcttctgcctcatacgctatgctccggcacgtataggttcctatacaattttgtttcatacttgatgtctttactttttgtcttttgcctggaatgcagtatttttctattgaatatgtgggttgcttgccttctgagtggtgagattccccattcctcatggaagctacagttaattggcaccttgccccacttctgtggcctcaacattatgaggagtaaggatgtctgaattatttcagagagccagggcttggtaaatgctgcattagtcttgttgaaagaaggtagggaggggacattggcaagggtgtttcacagctcttcagttgtttctttcctcagtccctacttcctctattttattacctttcaggggttcttctggaaaaatgtatctttggagggagagcctcttttctttatttttttaaatttatttatttatttttgagacgaagtctcactctgttgcccaggctggagtgcagtggcacgatctcagctcactgcaacctctgcctcctgggttcaagcaattctctgcctcagcctcctgagtagctgggattacaggcgcccgccaccatgactggctaatttttttgtatttttagtagaggcaggatttcaccatcttggccaagctggtcttgaactcctgacctcatgacccacccgccttggcctcccaaagtgctgggattacaggcgtgagccactgcgcccggcctgagagcctgttttctttgggttttgccatctattttaacttgcttcagtgctccttggaattcctcactgatctatgtgctgagagcatctcctagattctcagggctgctctggattaattttttatttctttcgcttatttcactgagttttggtgtgggaggaaaggtaaatgtgtgtttggtcagccattttaaagtagagcttcagtgccctgtcttcgtgggtttcccccttttctctattgcagacatcatggccgagaatgtcttttaaagtgaatcattgtgtacacctttgatcattttattaagatactggccttatatcctgcccttcccccctgccgccccccagaatcactgggtggtgatggtagatgattcacatgggaatgtgctacacttgtgaaagatgtagaggaaatactgctgattctcctgaaggaaaagtctgttaatttttctctgttggccattctggccgcatggtttctccttattgtttttttgttggattttaaaaattactagtaagattgaacatttataagattcatttgttgcccatttatattttttcctgcattttcttttcatgttaataaaagttttttccccttaatacgattcccttaattctttttttttttttttggagacggaggctcactctgtctccaggctggagtgcagtggcgcaatcttggctcactgcaacctccacctcccatgttcaagcgattcccctgcctcggccttccgagtagctgggactaccggcgcatgccaccacgcgcagctaatttttgtatttttagtagagtcggggtttcaccatgttggccaggatggtctcgatctcttgacctcgtgatctgcccgcctcggcctcccaaagtgctgggattacaggcatgagccactgtgcccggtccccttaattcttttgaagtgaaataagcagatgctgccaaatgtaagatatggcccggtccccttaattcttttgaagtgaaataagcagatgctgccaaatgtaagatatgttgctcagtttttagtgtagatttattatgttctgattcttggaaaatgaaaatctactcctggttttttggttaatacatacctcatgcggtggctgtgaaaattaaactaaataacataggtgaagtgcccaacacagtacttggtacataataggcagcattaaatactagttcctgttattcattctttcttctttgccagattattaaaatgactacagtactccacaccttagacaaaaagttgtttttactgaacccttgttcgatgaaggacagtatgccaaataccttgagggatacagagatgttttaggctgcttcctgtccagggataaatattagcatactatatatatagttacattttgaggctttttttttgagacagagttttgctcttgttgcccaggctggagtgcaatggcgcagtcttggctcactgcaacctccgcctcctgggttcaagcaattctcctgcctcagcctcccaagtagctgcaattacaggcatccgccaccacgcccggtgttttcttgcatttttagtagagatggcgtttcaccatgttggccaggctagtctcaaactcctgacctcaggtgatccacttgcctcggcctcccaaagtgctgggattacaggtgtgagccactgtgcccggcctttttttttttttttaacatgctgttgtgaaaaccttttggtcttttaactgttactttatttgagcacagaacactttaaagtttggttgccacatttaatccatgacacctctgtgagagtagttattagttccattttatagatagggtccctgaagggtggcaggagtaaaaatagggtatattgggatgtagaagaatgctaaccattattgtttccaaccttggtaggtatagagtaaatacttgttgaatgaatgaatgttcttttataagttgtgtattaagcccatacctaaatcttatctctacttcttttcttttttatttttgagccggagttttgctcttgttgcccaggctagagtgcaatggcatgatctcggctcactgcaacctccatcttccgggttcaaacgattctcctgcctcaggctcccgagtagctgggattacaggcgcccgccaccacacaccgctaatttttgtatttttagtagaggcggggtttctccatgtttgtcaggctggtcttgaactcccgacctcaggtgattcacccgccttgcctcccaaagtgctgggtttataggcgtgagccaccacacccagccaatatctctacttcttatagttttattcaaccccttctatgtttaatttaattgattaatttttgtgagacagggtctcactctgttgcctgggctagagtgcagtggcatgatcttggctccctgcagccttgcctccctggttcaagcaattctccagcctcagcctcctgagtagctgggactacaggtgtgcgccaccatgtcctgctaatttttgtaatttttggtagagatggggttttgccatgttgcccaggctggtctcaaactcctgatctcaaaatgatccacttgcctcggcctcccacagtgctgggattacaggcctgagccaccatgcccggcccccttttatattttatctggcaaaaataagcattaatgtttagtggttgatagggaggacattggaagtcggaagagagataacccacactgttttatacataataaaaaggcattaagggaaggtatatgtgctgatactgatttaactttttgcccttgttctgattctttgcaagactacttttctggtttctgtaacaactgcaaagggcttcccaagtttggggctagggtaaatggctcaatttgttgcactctaaggatgattgtattaatagatttttcattctaatctctggtagagtacggaaaatcaattataattaggctcagactcaaggggaaaactttaggtagatgaatttcataatatacaaactttaatagaataagtgattactgtctcagagtttactctgtatttagctgtctgtagttggttgtcttagatagtgaaatatggtcttttagtaaaaatggtaagacccctgtataggatttgaagtaggacatctatgagcttatttcaggtagtaagtagtattaacacatcgctttcactctccacatggaacactgcattatttttttttattttttttgagacagagccttactctgtcacccaggctggagtgcagtggtgcaatcttggctcactgcaacctccgactcccgcattcaagcgattctcccacctcagcctcccaagtagctgggattacaggcacacgctaccacgcccggctaatttttgtatttttagtggagatggggttttgccatgttgcccaggcttaggtattctttttctgtgtttctcctcaagtgtatggttctctagtttgtgaattcactgggtggttgtgatgtccagtcagtaaaatgataaacatgaaagcactttgaaaatgatttaatgtcattgcatggaaatgttatagtatcattgcatcactatttataatagttctcaagtttttttttttttttttttttttttttttgagactgtgtctcgctctgtcacccaggctggagggcagtggcacaatcttggctcactgcaatctccacctcctgggttcaagtgattctcgtgcttcaacctccctagtagctgggattacaggcgtgcaccacgacgcctggctaatttttgtatttttttgtaaagatggggttttaccatgttggccaggctggtctcgaactcctgacctcgtgatccatccgcttcagcctcccaaagtgctgggattacaggcgtgggccactgggcctcaagtgtttttaaccacgtttgagtgccctcttctttttggtcacacaactttactgtaaccccactaattttttcagatgtagttcatatactatctcctgtataaaacataacctcttcagtctgaaaggggtactgtttcctttgaacatttatagctattttgatttgtacagttcatttggtcatcatgagtctgaattgtcacatcttgccttttgtcttgataagttaataatgtaggatcttaagatgtttatctcttagtgagaccagcaaacatttattaggacaataacacctattgtcctaatctctggacataaagtttttgtgtattaattccagtgttcacaactggattgtaaggtactttaaagaaaagaccatgatgtgtatgtacttcctggtttcatgaatgttttctttatatataataaaatgtagcagtgggtaagattagtggatgtatcattaatgttaaaattgagttttaacattttcctttttagaaccagtctagcacttctctggggtaactgaatttttgttaaaattggtccatatatatttcctgtcttttttagtttgtttcacatactttgacttatttcctacttatttctcctccattaaggtataaattctctccttaaattgcttagccttggattttcacagattcttttgaaaaacctacgttttcataggcgtgttgtctttgtaagatctaactctgcagtgatttattgagctcgttttgttttacttattgagcatcaagattgaaagaggaaagtaatgtaattttcattatttataatgcatttggctttttaaagtgttttgaggttaaaaccaatagcagtctagcactagttgaaggtattttgaagaggtggttagtatccttggggctgttaatcaggaggtagcctttatgtagagacttgaaggaatagtgttagcagggtgttcttgtaggagctccccttattcgatggtttggagtccataattggaaaattaattttaaaaattggtaaagctctaagcaatcaaatacgaatgcacatataactattttgccataaagcatacttttctttcttctttctttttttttttgagatggagtcttgctctgtcgcccaggctggagtgcagtggtgtgatctcggctcactgcaacctccgcttcccaggttcaagggattcttgtgtgtcaacctcccgagtagctgggattacaggtgcctgccaccatgcctggctaatttttgtatctttagtagagacatggtttcactgcgttggccaggctggtttcaaactcctgacctcatgatctgcctgcctcggcctcccaaagtgctgggattacaggtgtgagccaccgtgcccagcctaaagcatacttttgattaccagtatttgtttgtttgtttgaggcggagtcttgctctgtctcccaggctggagcgcagtggcgtgatcttggctcactgcaatctctgcctcccaggttcaaacgattctcctgcctcagcctcccgagtagctgggattataggcgcacactaccatgctggctaatttttacatttttagtagagatgaggtttcaccattttggccaggctggtcttctactcctgacctcaaatgatccacctgcctcattatatcatttgaaaatgatataatgtcattgcatggaaatgatataatatcattgcatcactataatagttctcaagtgtattttttttttttttttttttgagaccatgtctcactctgtcacgcaggctggagggcagtggcatgatcttgggtcactgcaacctctgcctcagcctcccaaagtgctgggattagaggcatgagccaccatgcctagctcattgccactattttgacgtatgtctaggatctttctcagttgactgaagttcggtgtcatcttgtataatccatcctatgtgtgcagtaggttcagtttcgacgacttgaaagtagagcaataatttagataacctatgaaactagtgcagaataatagatttttatagttgtctcctgtcttttaacataatctaacccacatccgatttgacaggcacattttttaagtgactcatcacctttgttgaatcttgccaaagcatccaatgtaatttttacaaaattggcactttcttgtaattggtttgcacactatttaaatgaaaaacatgtaatgattgttaccagaggaattgacagttttgggtaagaaatgcaactgacttttggatacaaagcatccagcttaatataagggagcagaagtgtgaagttgaactagatagttaaccattagccaaaaacatttgtactgatggcaacagccagatctctgttttccagaggtaatgaggagtttgatgaggagtttggtaactgttaggttgaggactgttaagaggcctgctggaggccagtatggcacttcagtgcacagtgcaaacccgcttctgtaatgcattttatactttttaaaaattccatttcccatgaataacatgcttttttatgtaacagaagataatcgtaacaattatcatgtaacagaagataactgttatttggaatgcttggagaaaatcactgtttaagatttctgtaaagccttttcctgtccaagatttctgtaaagcctgtttctgtcattgcctgaaacatcattatgcagcacgtgactacctttattttagcacttctcatttggagttaaccctttcacctttactatgaggtcttcctctgaaaaacttttgtatacaacatctgatccacagttgatacccaacaaactgaatgaaacagaagttctggccacttaagtagatgtcacaacccaatctttttctttctttctttctttttttttttttgagacggagttttgctcttgtcacccaggctggagtgtggtggtgctcactgcaatctccgcctcccaggttcaagtgattctcctgccacagcctcctgagtagctgggattacaggtgcccaccaccacgcccagctaatttttgtatttttagtagagacggggtttcaccatgttagccaggctggtcgaactcctgacttcaggtggtccacccaccttggccacccaaagagctgggatttcaggcgtgagccaccgcgcccgcccgtcacaacccaaccttccgtcacaacccaatcttgatgtggtgtagttttcattgatgtgctactgaaaaataagctgttattatttataaactcagttcagagaatattttaggataattatactcagttgagtatattatattccatatgtcaaagatgctgtgctatgtctacagagttctgagcttaataatacatagttcttgtctgtggacatgtatattgttggtacagtgggaatatatgaggaggagagattaattcaagcctgaaggaatttgagaggatttgagagtagataggacctgaactggacttggaatggtaacaataattaggattttttggcagatattttactgctttatggcattggatagtctggatctccttcaaattcttttcccttcttttctgtcaaatacacctagtcttcctacttccatctctagccttcttcctctgcaataatctttattttccttaacaatctattgcttttggccattttcctcttctttcttgcccttggtgtaatgcgttattgttttaaccctaaccctgtgcttctggaaatatgcttttctatcttctacatagccacaacacttcatcagtatccttcttagagcatttatcgtttctttgcactatagttacatacagactccatcctctgctggaccttaacttcttgagggcaagttgcacctttatagttcttaaagtatctagtatatagttttctaagtagtaggcaccacatactattctcttacatttagcttctttcctcaaactcaactcctcttctagacttgcctttttctgtgcatagtactagagttctttcaattccccattctggtcagtgagttctgcttctgtctttgaaatgttatttgtagccccaccattttttccactgtcgtcattgcatgccaattaaaagataaatatttagtgcatattgttctaagcactgtgtaggtgctaggaatacaaatataacagatccaattccttgttcttagaatcctagtcggggattattttggtactttgttgagcaaatgtttattgaacactttctctgtgcggagctctattgtaggcatagatgtattatatcattttccacaggctgctcatcttcaaggggaaaacatggctactggatttcctctgttctaaggtacacttttcttcccattttcttctagcatctctgaaatccagatgcgtctaaaccctggtatgtttaatgtttttttgtttgtttgtttgtttttttttgactgagtctcgctctgttgcccaggctggagtgcagtggtgtgatctcggctcactgcaacctctgcctcctgggttcaagcaattctcctgcctcagcctccttagtagctgggattacaggtgcatgctgccatgcccagctaatttttatatttttaatagagatggggtttcaccatgttggttgggctggtctcgaactcctgacctcgtgattgacctgcctgggcctcccaaagtgctgggattgtagacgtgagccaccatgcccggctttttttttttttttttttttttttgagatggagtttcactcttgttgcccagagtggagtgcaatggtgcgatctcgactcactggaacctccgcctcctgggttcaagagattctcctgcctcagcctcccgagtagctgggattacaggcatgcgccaccatgcctggctaatatttttgtatttttagtagagacagggtttcaccatgttggccaggctggtctcaaactcctgacctcaggtgatccacctgcctcagcctcccaaagtgctgggattacaggcgtgagccaccgcacccagcctgcttaatgttttttattcccccttcaagagctgttaaagtgatgctgcttacaactagtagttgtaactatagtataatttctaattactatactgtatactatagttgaactatagtatatattaatggtaaatatgatggacatgtgtagaattgtgctgtcaaatgtggtagcttctagctacatgtggctatgtaaatatgttaattagacattaaatttattaaattttaattaaaactaaaagattaacttgaacccaggagtttgagaccagcttgggcaacatggtgaaactctgtgtctacaaaaaatccccccccaccccaaaatcagctgggtgtggtggcacatgcctgtagttccagctactgtgggagttatggtggaggtggggctgaggatcatttgggaacgggacatcgaggctgcaatgagctgtgcattattgcaccgctgcattccagcctaggcgacagagcgagaccctgtctcaaaaaaaaaaagaaaaagaaaataaaggttcagttcctcagttgcactggccacagttcagatacccaatagccacatttgactagtggctactgtattagacagtgcagatatagaacattcccatcattgcagagtgttctgttaggtagcactggtctagaatgtggttccacagttgtacctggagggttggaaaagctttggttagtttacttcctggcattattattacctgtatttccttccttcagggaggtcagggaacttttctgtcttttccttctgcctttagttttaccagggcctgggacagtaagtggtaggtacgcagaaataaaaaacaactggagcattaaatagtttagataaaaaggggaaaggctatacatgtgcataacaggaaatagcttagctggctttattcaacgtgtatcctggtgtacttttttaagagggtttttagaacaaatttcatcacattgaaaatttaagaacttttatctaggtttgtatcagttttgttgtcgtgctgctataaagaaatacctgaggccgagcaccatggctcatgcctataatcccagcactttgggaggctgaggcaggcggaccacctgaagtcaggagttcgagaccagcctggctaaaacatggcaaaaccccgtctctactaaaaatacaaaaaaaaattagccaggcatggtagtgggcgactgtaatcccagctactcgggaggctgaggcaggagaatctcttgaacctgggaggtggaggttgcagtgagccaagatcgcgccactgcactccggcctgggcgacagaacgagactgccttaaaaaacaaacaaacaaaaaagaagtacctgagactgggtaatttataaagaaaagaggtttaatatgttcatggatggttctgcaggctttacaggaggcatgactgcttctggggaggcctcaggaagctttctttctttttttttttttttttttttttttgagatggagtctcgttctgtcaccaggctggagtgcagtggtgtgatctcagctcactgcaacctgtgcctcccgggttcaagtgattctcctaccttagcctcctgagtagctgggactacaggtgcatgccaccacacccagctaattttttttttctttttccgagactgagttttgctcttgttgcccaggctggagtgcaatggcacgatctcggctcactgcaacctctgcctcctgggttcaagcgattctcccaccccagcctcccgagtagctgggattacaggtgtgcgccaccatgcctggctaattttgtatttttagtagagacagagtaattttcgtatttttagtagagatggggcttcaccatgttggccaggatggtctcgatctcttgacctcgtgatccgcccgcctcggccttccaaaatgttgagacaggcgtgagccaccgcactcggcctcaggaagctttcaatcatggcagaaagcaaaggggaagctggcaagtcttacatggctggaggaagcggggtgccgtaggggggaccgtactacacacttttaaacaaccaggtcttttgagaactcagtatcacgagaacagtacccaggtagatggtgttaaactattagaaactgcacccattgtctaatcatctcccaccaggccccgcctccaacattgaggattacaattgaacctgagatttgggtgaggacacagatccaaaccatatcaaggttctttttatttatttatttattatttatttattttttggagacagggtctcactctcttgcccaggctggggtgcaggggtgtgatctcagctcactgcagcctctatctatccaggttcaggtgatcctcccacctcagcctccagagtagctgggaccacacaggtgcattccaccatgcccagctaattttgtattttttgtagaagcggggttttgtcatgttgcccaggctagccttgaactcctgggctcaagtgatcctctcaccttggccttccaaagtgctgggattataggtgtgagccaccattcctggcttatctaggtttttatcccttattaagtgggattcaaggaggcccatcatgtcagaatgctgtgggttggcaggaggcatcacaatgaaattttccatgttcccaaatttgatattcacagtactacatataatttctcagggaagatagggttggacacgatggaaatattttggtgaaccattcgttcccttgggtttctttctcatttggggagtgtggtttacaatgattggagcaaaagtttcctgaatctttttcttgtttccattttattgcatggtaaaacacaatttatccactttcttgtcaatgagtatctagttagattcctgttttttggctaattcaaataaaactatgaatgtttttgtaccggtcttttggtgggcagttgctttcctttctcttgggtacatacctaggaaggagggaagttgctgggccacagcatggccagttttctaaaacagttgtagcaatttatgttgctttctttttgaaaggacaaaagattaaagtttgccattaggcatttttactgtccgagtatttccatcaagcctgtgtgagttaagtcattaattaccaaacatcacagacctttggggtcacttgcagataaatctgaaaatagtatagacctaccatatcattcaaaagaccttaaaagaatataaaaactaagcatcttatctctccctctattgtcaatcttgatttactttcaagacacacggtctttgaagaaacttgttcatgcctttgtaaatggattgtgttgagtactgcttcctgttgcttactgttatgggaatgagtgtactttgcctgtcagtgatattactagctactatttgagggcttgcagtgtgtaacagaataaaggacaatgcccttttgaaattctagttcagcataagtcagcaagtttcaaactgagttcttgatatttgcaaggttctgtgctaggcatctccatgtccaaagaccaatgagaatgaatctcctaacctcttgaccttgtctaatggggataggaggcacataccatgatacaagaccaactataattgtcactagaattggaaataaagtgctgccgggcttccatatcacagcatatcacattttatttgggttgcagagaggggaaggtatccttgtaaagtaagcttatccaacccgcggtctgtgggctgcatgtggcccaggatggctttgaatgtggcccagcacaaattcgtaaactttcttaagacatgagattttttttgcggtttttttttttttttcttttttagcttattggttatcgttagtgttagaatatttcctgtgtggcccaagacaattcttccaatgtggcccagggaagccaaaagattcgacacccctgctgtaaagcttcatggaagggttgtggtctaagaggtccaccttgaaaggatttcagtcgcagctgcaatatatgccaggtgaagggaattgcttgatggaatcatgtagcaggaacatatagtctataccaagtggttctcagagtgtggtccccagaccagcagcatcagcatcatctggaaacttgttagaaatgcaaactcttgggctccactccagacctactgattcagaaactcagaaatcccagaaacctgggttttaactagttctctaggtgattgtgatgtgttaaagtttgaaaaccattggtctagacttaattggtcagagaatagttgaagtaaggtttgagaagggaagttatgagaacaagaaggcaggggccttactgcagagaccttgattgagtactagggtgtgagtatatggggctggggaaccgttagggtgaaggaaaggacatccttggagtttactttaggaagagtgagccaacaaactttttttgtaagatgaattaaaactaaaagatactggaggccgggcgtggtggctcacgcctataatctcagcattttgggaggcctaggtgggcggatcacttgaggtcaggagttcgtgaccagcctggccaacatgatgaaaccccgtctctactaaaaatacaaaaattaaccaggcatggtggtgtgcgcctgtaatcccagctactcaggaggctgaggcaggagaatcgcttgaacccaggaggcggaggttgcagtgagccaagattgcgccactgcactccagcctgggtgacggagcaagactctgtctcaaaaataaaaaataaatgaaaaaaataaaagataccggaagctgggagtagcagccttggaaagtgaaaggagcaacacagctgggatgagtgagccttgacagctggctggtcaagtgtcaggaaagaggccacagcctcagaagcagctatggttctgaacctgggtgttgagaggatggtggtgcctttagaagcagtgcaggcagaagacgcaaaggccacatggtgcaggaaaatgggacaagggggaagaggatgttttctacaaataattgcttcttcccctgaatgtacaagtttagtgtaagaaattcaggtacttgaggggacagtgaagaagaatgcagaatcgcctcaaatcccactttacagagattagcaaaacattattctctttaaatattttgagtatacatttgtttctttaaactcagttttgtatgcatggaattatacaattccgtaacaaattttctcagacaaattgaatttgaatacgttagtgttccacacatgaatgatcagtgtgcgtttggaaattggtggattttatatttgggaaacagaatgtttatacaagcagctaattggtaaagattgcaatttcattatccatggtcataaaaacatcctgtccacattagttgttacagaggaaatctggggcaaaacagtttaagatgcttggtgtgctgttagtctggggagaagaactgcaactaagaagaaaaaagatgaaacatttgtggcttttattagaatagcaagtttattacggtgtcttacaagaactaattaatattgggcataaaatagtctcattacataggtcaataccaagttccaaagttctcctttaaaataggcagctagctcctagtgaattttatgagccacaagcaaagatgtggaatagtttgcccatttcttagttttgtgacatgtatgacagaatataccatcttcttaagtatggtgtgtgtgttttttttgtttttgtttttgttttttttttaaagaaattatgggcagaaacctttatatttcttcctacctgatttgaatgtgagttcacattttcccatacctatgagagagcactagatattttccagttactttacttattaccaatctgataggttaaaactgatttctcatttttgttttttttttaatttaattgattactattgcgatggaacagggtttttctttttcttctttttatttaaaatagagatgaggtctcactaagttgcccaggatggtctgtaactcctgaggtcaagtgatcctcccacctcagcttcctaaagtactagaattacagatgtgagccatcatgcctggccaggaacaaacagcttttattagataattgcatttcttttgtgaaaggactgttaatatctctttgtctgttttctctttgggtgtttatattatactgatttgtaagatgctaacatattaaggatattcagcttctgtctttctcttttttttattttaccacttttttaaatcaagaggtgtagatactcattggctttttaaactatgccacagtgaagcatggcaaacacttcataaggtataggagatattcagtgaattatcacaaagccaaaccttatgtaacttgacctaggtgatgacataaacattgcaaaaccccaaaagtcagtagtgtacctaaggctgggggtgaaaggtgaggtctaccccaggttcaggcaataacaaagtgcattttctttagggaatttaaaatcagtaaaattattgactaagagttggtctgctttttgttatcatgtgttggccatttaaaaaatgtcagtgtgtgtacatgtatatataatatctgctttgtggctgaactgttaactttctttttgacaaatagaagttcttaattttaatatagtccagtttatctgtcttttcctttatggtgggtgcttgctgtatccacaaagagatattcttctatattatatttaaggagcattattgttttgacttttatatttaggtctgtaatccacctgaagttagtatttatgtatggtgtaagttggaggttaagttgaattttgttttcccttatgaatagccaaatgacagtgtcatttgaaaagatctgatttgcagtgccaactgtcttgtacagcaagcatccctgtatgatctatttctgggccttctgttcattcttttcatctgtttgtctagtgactgagctttataatatgtcctaatccagagagaaagtctttttgttgtacttcttcaaggacgtcttgtttgccttggctatttgtatttatgtatacatttttaaatcttctgccgggcatggtggcttatgcctgtaatcccagcacttttgggaggccgaggtgggcggatcacttgaggtcagaagttcgagaccagcctggccaacatggtgaaaccccgtctctactaaaaatacaaaaaaaattagctggatatggtggcgggtgcctgtaatcccagctactcgggaggctgaggcaggagaatcccttgaatccgggaaggggaggttgcagtcagccgagattgtgccactgctctccagcctgggcgatagagtgagactctgtctcaaataaataaataaataaataaaatcagcctgtaaatttcgattaaaaatttgttaggattggttgggattgttttgggtctctagatcaatttggatagaattgacatctttacagtgttaaatttcaagaacatgggatatcccttcactttattaggtccctttaatttgtaaaagtattttttgtttgtttaatagctttctacatagaagattttccactttttatttctaggaatttgataatttttgatggtttcaggaatggtattaaaaattcatttcctagctttattgctggtgtatagaaatactgttggtttttgaacattaacttttgtatccctcagctttgataagctaattttttctgctagcttacttgtagattgttttggattttctattgtgtacaatctgtggaaaatgataggttttttggtcattcctagcactcatttttgtctagatttctacctgttctcagtgaagagatttgtctgaattatatataatcattattactggaagcagaaagtcttcctaaatgaaagataaaaactacaccccattctcatttctgaattatctttgaatttaaacccaaatctcaaaggtgcctcaatcccagtgaaagctaatagtattttttgagacagtgttataaatgttcctaatggatttataagcaaatcttatgaaatctttaaaatttaattttttttgagacagcttttaatgtgtatctcaaggacttaaaatatgaaaacttatcagtagtttaaaaaattcttccaagtagtgaagtcactagtgaagccataaggtgtctctgatgtgctcatttttcttttcctttttttgagacagggtcttgctttgtcatccaggttggagtgtggttgctcattgcaacctcagccttgagctcctgggctcaagagatcctcctgcctcagcctcccgagtagctgggactacaggcacccgccaccacgcccagataattttttgtatttttttgtagagacagggtttcgccatgttgcccaggctggtcttaagctcctgggcttaagcagtcctcccaccttggcctcccaaagtgctgggattacaggtgtgagccaccatgcctggctcatttcctagtccttgttcttatgagcctcctactggaagtaccccagggagctctccgcatttgcagagggcattggcttgcttgggtaatgctctgtggtgccaatagagatgcactgcaggaagaactctggaaacttcgttgggagagaagtggcatatgagcatcattgtgagcaagtgtcaggtaatgttttccagaggaaaataccaaattgactagttgtatgccagacacatctgacagtaataacagaggcatactctgaatatgaacctgtatagcatatgtacctgacagcagtaacttacttaagcataccccgagaatgaccctgaggtctaagaacaacttgtgttcatagggtaccgaactaaggaatccagcagtgaccaaccagcagattcattcattatctataaggaacatctgagcccccaggccagtcctgtggatcctgggctttgccggaagattgaggatctttgttttgggttaaatgaaggttgccaggtggaggttggtgggggagggtgctaagtcaaaatgttatataaactgcatgcttttttacaagtgggatcagttcttctttctagcctgctgccactggactggatggccctgcatgtaagttccctcaaaaaccctacatctttttcactagctctgggtctcttctttggcttttcaaacatggtgctgtccctattgaagttaataggggttcaggacaacattagtaatttgatgagttgcagctgagggatcagagtattgtcataggttgtcctgtagcattttcatgcatgctccttgtgaacttgaggagtctgtaagctgctgtagtcaaggaggtcaacaaatgctaagcagcctcagtaaagggattgcaacttaaaacagcccaccattgcaggttcatctccatgaaggaccagcaagagacagttacaatgagcaagggctctgttgactattttgggaattaagggagtgggcaagcaaaagctgtaattgtaattagtgttgtggaaggagaattatcccccacctttttttttgtctttcactgcggtttacatgtgataggtgtttgattaatgtcagttgtatatgtgaattgttatgaagactttagaaaactttagaaactaatgttaagtgatgattgaaatgtgctcagattaaaaaaataattttagtatcttcaaccagtctagctggttaaataattttattattcctgtagattaaaaaattttaaatatcaagtttagagaaaaatcttattctaattttggagtatgattatatttcaattcagtatgtagttttccaatttgaaaaaaatagctatagctataattataatcagcaaatgaatgggatctgagactgatttaagttaaaatttgtgaccttaaaggaattgattcacagtgttctggattcttttcagaatgtgcggatactgtaagtacaatttttcttcatagtaagtgtaaattaaatataaactctatagtaaactcaagcattctataagaagccacataacgtgctatttctttcttttcccagtggtgttttagtgaatcattagttgtatgtttctttcttgagttggagctgaagaaatccttcccactggaaatatgagttctataccattttgtgggtagggatccagcggtgggcctttagtaagcgtaagcactggcttttgcatttatacttgtttttatagaataacaccatcttgtaaaatgatttgttcccagagtttttctagatacggtaattttaaacacaccttatgaatgttcttttaaaataagttataaagtgaattattttgtaaaacaagagttcttttattagcatgaatatctcctaatcttccctcacccccagtactactagctacttctagggttgggttttcagatacaatcaattttcttagtcttacgtagtgctttggagattagtgctcagatctcgtattgaagtatggttcttactcatggcagataatttctgtcttttcacttttgagttgtttttatacccttgaatatagtaggctaactatagaatacctaatgtcacaatcatgaaagaaatagttggtaatttataaaagctgtacgaaaatgtatattagacttttatggtttttaaggtcaaaaagaaactgaagactctttagaaaaggtcacaaaaaatcattgaatagggctgggcgtggtggctaacgcctataattgcagcactttgggaggctgaggcgggcagatcattggaggtcaggagttacagaccagcctggccaacatggtgaaaccccgtgtctactaaaaatacaaaaattagccaggcgtggtggcacacacctgtagtcccagctacttgccaggctgaggtaggagaattgcttgaacctgggaggcagaggttgcagtgagctgagatgctgccactgcactccagcctgggcgacagagtgagactctgtctcaaaaaaaaaaaaaaaaaaaaaaaaaaatagcggggtgcagtggctcatgcctgtaatcccagcactttgggaggccgaggcgggtggatcacctgagttcgggagttcgagaccagcctgaccaacatggagaaaccccatctctactaaaaatgcaaaattagctgggcgtggtggtgcatgcctgtaatttcagctactcgggaggctgaggcaggagaatcgcttgaacccaggaggcggaggttgcaatgagccgagatcgtgccattgcactccagcctgggcaatgagagcaaaactctgtctcaaaaaaaaaaaaaaaaaatttcattgaatcagacctaccagtgtctagttcaggatttgaatgcttagtatatattcattccttttgggggaaaagatatttctaatgactacttcatatgttttgtgtttttataattttctagttagaattcacgggcttatttcaaagaagacttctttaaaattaccaatttttagtccatttgtcttttctcttagcaaatccccaaatgacaaattgattaaaagaacacttagaataaatactgtaagttgtattatttaatatgtatttttatgtgccacatgtagagaaatgattaaagacaaaagtaatgaagcagactttttaaagaatcacttgacagaaagcagagaacatttcttacatatagaagtaaatgggctgggtgtggtggctcacgcttgtaatcccagcactttgggaggccgatgcaggcggatcacctgaggtcaggagttaaagaccagcctggccaacatggtgaaatcctgtctctactaaaatacaaaaattagctgggcatgatggtgggtgcctgtaatcccagctacttgggaggctgagacgggagaagcgcttgaacccaggagatggtggttgcagtgagctgagatcgcacagctgcactccagcctgggtggctgagtgagactccgtctcaaaaaaaaaaagaagaaaagaaaaaaaaaaaaaagaagaaaagaaaaaaaaaaaaaagaagtaaatggatgaggtgaacctcattatcttaggaacattttagcttaatagtaacaggaaaatagctttcagaatgggtttaatcagaataattaaacccattctgtcagtactgctggattacagattaattgctgaattttgagtacattactgagaatttggtcagagaaatagaaccactgtgagtattatgggtaaggaacttatatggtaatcagactgtacacaattataagaggtgctggggatgggaatatctatctgaaaaaggaaagacctgaaaaaatcactaatagatcctcctgaggtactggtacaggttgataaatgagagcttactgggaaaattttaagaagccaaatgtgtacagtcaccaaagtaggcatgcagaaaggcttttttctggagagttctgtggaaggctgtttcctccgtgtagctgctgcctctgtgggtccacagccaagcatttgttgttgggtcttgctctactgttggtcagatcagaagaagagctggacacagaggggacaagaggagagcagggacaagctggaagctgccacacacctctgcatttgtcgtcaccctgtgtgaccttcatgaagatcttgtaagaatttggccatcttgaacttggtgtactgtgcaggaaagggaattctgggaaacacagttcccggcttgatcaagttcacaagagactgatccactacattgagcttctcattttgagcatctcaagtctttttttttatgtgtggttaaaaatttttattttttatttttattttttgtgggtacatagtaggtatatatatttatggggtacatgagatcttttgatacaggtatacaatgcataataatcatatcagggtaaatggagtattcattacctcaagcatttatcctttctttgtgttacaaacaatccagttatactcttttagttatttttaattttaatttagttttattaattttttttgagacagggtcttgttctgttgcccaggcgggagtgcagtggtgcaatcacagctcactgcagccttgacttccagggctcaagccatactcccacttcagcctcctgagtggctgggactacaggcttgcattgccacacccagctaatgtttgtaatttttgtagagacgaggtctccttatgttgtccaggctggtgccttaactcctcagctcaagcaatcccctaccttggtctcccaagcaatcccctaccttagctgggattacaggtatgatccactgtgcccagcctagttattttatttttatcttattttgtttcagtttatgtattttatttattttattttttattgtttttttgaggcggagtctcactctgccacccaggctggagtgcagtggcatgacctcagctcactgcaaccagctcttcccgggttgaagcaatcctccaggctcagcctcccaagtagctgggattacaggtgggcaccaccacgccttgctaatttttgcatttttagtagagacaggagtctcaccatgttggccaggctggtctcgatctcctgacctcaagtgatccacccactttggcctccgaaagttctgggattacaggcatgaggctctgtgcctggctgctgcctagttattttaaaatgtacaataaattattgttgactatagtcaccccgttgtgctatcaattattcattctgtctaactatatttttgaacccattcagtgtctcttttggtctcatctcatcagtagatgatagcaatgttaaaatactttgagcctcaagattttcatttcctgatggtatttactgaggaatttaaaatgctgtactttggatagcttttgttcttttacttattaacaccatggcctttccctagtgtattttaccatacagtgcatctgtatcttattttctgacttttctcattgttgttaaagttttacaatcccagtaaatgaattccaggccagataatatcatttcagttttggagaggaaaacgagtacaaactttaagtagaagtaacttttacatagtctttggtggatttaggttaaaaatacccaagcatgccataagacattgtgctgtccttctgaaacgataatattccactctagcaataatgaataaaaggggatgacctttttcaggagatctaaatttgtgtacttctaggctctttgaaatacagagcatcaaaattttgttggctaggttgatatattcagccagcaaaattaagtggtttgctgttctctgattctgcgacacatcgtttgtgttctgggtctataccttctgtcttctgcagtgcaagtataacatacatgctagatagtttctgatttttttttttttaaatgtggatatctgacggagtaggggattttagggcatgataagatatagaaaatgctgaaaatagttttcatttatttccttcctgcagtccataatggggtgttcatttgcctctttcccatttaatttttcctctctagggttggagaatctcttctaattttttttttttttttttgagacaggatcttgctctgtcacccaggctggagtgcagtggcgtgatctcggctcactgcaacctctgtctcctggatgcaagccactttcctgcctcagcctcctgagtagctgggactacaggcacatgccaccacgcctggctaatttttgtatttttagtagagagaggggggtttcacaatgttggacaggctgatctcgagctcctgacttgaagtgatccatccgcctcggcctcccaaagtgctggaattacaggtgtgagccactgtgcccggccctcttctaatttcttttaagagcattcactgataataactgaagtatcctggagagttacatgaacctcttagatgtagtcatagaatatttaatatattttgttggcttctagtatctgttcacttttagaatagtacagtattttttttttccagtaggtgctcgtcacccaggtaaacactacattttccagtctccgttaaagccaggtgtggtagaggattaaatcttgtccagtaggatatgaatgaagatgttaggtacatcttgggtgttttgcctaaaaggagtggagttttggcctccctgtcctccacttttcccccttctctgtggctgagatatggggaaattggtgagagttgagttagatatctcagactgtgatatggacagtgctggaaccacttacctggacttttacatgaaagataaaaatgaacttctctctcttttttttttttttttggagactcagtcttgctccatcacccaggctagagtgcagtggcgccgatttcggctcactgcaacctatgcctcccggattcaagcaattcttgtggcattttttaaagacctgggggtggggagaggggatggtgtatgaaaagtaggccatcaggggaacttcggttcttttttttttttttgagacggagttttgctcttgtcacagctcactgcaacctctgcctcctgggttcaagtgattctcctgcctcagcctcctgagtagctgggattacaggcacgtgccaccacaccagggtaatttttgtatttttggtagagatggggtttcactgtgttggccaggctggtctctaactcctgaccacagttgatccacccgcaccatcccaaagtgctaggatgacaggcctgagccaccgtgcctggccctgggaactttggtctaatgaaataaaatttctgcaaattaaagtgttcgtttttgttaccttgatagcattagtctagactttcttcatttttacaagaccgtgaggagattattcatggtatagtatggtatcagaaaaattgtaagggtatggtatgtgttgattatttccccgaaaaccatcctattttcatctctgttgcctctacctttattaaggtacataagtccccaagttttataagtccccaagtttctacctcctcggaaccattttccctcatcctcaacaatcctttctgatatagaagtttatcacttgtggtatgactgttctccttaaaaccttcaataatttctaatgcctgaggaccaaagtaaacacagtttataacaaacaataatcaaacacaccttgtagcaatcagtataacaatgcccttttacagcagattaaattattgaagtgacttgttcaaagtagcagaggaagataaaagcataagcgtgttttgctgtacagaattgtgaaaatggaatccccgttcctagggaccttaacttttagtagtggaaaagcaacttaggcaggcaaataattcagagatttggtattgtttagtccaaagttagtgtttgaatgaatataaggtagtgaatgaaatttggagaatctgttgttcaaacttttaaaaagttaaatagtattaccttaaatataggaacacattttctcattttgtattctttgaatttttatttattttaaactttgtaattattttttgttttttggtttttttttttttgagacagaggctcactctgttgcccaggctggagtgcagtggcaatctcagctcactgcaaccgctacctcctgggttcaagcaattctctcctgcctcagcctcctgagtagctaggattacaggcacgcaccaccacacctggctaatttttgtatttttagtagagacggggtttcaccatgttggccaggctggcctcaaactcctgacctcacgtgatccgcccaccttggcctcccaaagtgctgggattataggcgtgagccaccacacctggcttaaactttgtaatttttatttcttttcttttctttttttcttctttgtttttttgagacagtgtcttgctcagttgcccaggctggagtgtagtggcacaatcacggctcactgcatccttgaccttttgggcacaagcgatcctcccacctcagcctcctgagtagctgggaccacaggcatgcccaccatgcttggctaatttttaaaaatttttctgtagactcagggtctccctgtgtggtccaggctggcctcaaactcctgggctcaagccatcctcctgcctctgcttcccaaagttctgggattacaggcatgagccactgtacctggcctgaactttgtaattttgtaagaacattttaagaaaatgctaattggaaaattatcatctctactctttttcctgtcaaatattatatacatcatttataatttattttagccttctaatacttagtattaatacagtgagaactggtggtggtacttcagtgttccaaactcagtctactgcttttcttggaaaagatgatgaaaataactactttaatgtttgtggttattgctcttttctagtatctgaattttaaaaatacattgtatagagttatgtttactcatataacaaattttagattttgttcttacaatgtatttccaaaacaagtaacattactattcctatttcttagtaacttgtgtaactcaagatcagaaaatttatattgatcagaccttgaaatcagggttaagcattcacatttgaacaaaggataggtttcttgagtattttctctgtagttcattccttatgtatttcttactgtgctcatccaaattttctcatttctttggttcaactttcagtactttgtgagctctctcattaggtgcaatatgtttataatttttatcccttcctgttggattgactcttaatgtccttctttatctttttttaatttttgagatggggggtttcactgtgttgcccaggctggagtgcagtggtgtgatctcattgcactgcaaccttcgcctcctgggctcaggcagtcctcctgcctcagcctcccaagtagctaagatcataggcatgcaccacgatgcctggctacttttttgtatttttgatagagacaggttttcaccatgttgctcaggctggtctcgacctcctgggctcaagtgattcacctgccttggcctcccaaagtgctgggattacaggtgtcagccactatacccagcatccctctttacctttagtaattgatttttgattaccaattactgactattggttattgatagtgattattaataaagtccacattcagatttttttagttttttaccttatacttttaaaagtcttaacatctagtttgtttgattttaatatagccattccagctctcttatgcatttatatctttatcctttcaatttccacttatttatagctgaatgtaaaatacgcctcgcatagacaacatatagttgaatctttttttttttgagacggagtctcgctctgtcgccatgctggagtgcagtggtacaatctcagctcactgcaacctctgcctcccgggttcaagcgattctcctgctgccccagcctcctgagtagctgggactacaggcatgtgccaccacgcccagctaatttttgtatttttagtagagatggagtttcaccatgttggccaggatggtttcgatctcttgacctcgtgatccgtccaccctggcctcccaaagtgctgggattacaggcgtgagccactgcacctggccctgaatcttgttttttaattttaatttttattattattttttgagacggagtctcgctctgtcaccgaggctggagcacagtgttgtgagccggattcaagagattctcctgtgtcagcctcccgagtagctgagactgcaggcacgtgccaccacgcctggctaatttttgtatttttagtagagatggtgttttgccatgttggccaacctggtcttgaactcctgacttcaagtgatctgtccaccttggcctcccaaagtgctgggattacagacatgagccactgcacctggctgaatctttttaaaatccagtctgacaatctttgcattttgattggattgtttaatcctttcacatttaatatagttattgatatgtttggatttacatctattattttgctgtttgtttactgtatttttcattttgttgttttgtttttctgtttctcctttactgttttattttgtattaagggaagaatttcaagtgtaacattttaatttctttaatgatttttttttagtttttttggagttattttcttagtgttgctctaggacttaccacatacatgcttatcagaatctacttcagatgtatgctaacttaactccagtaagatatagaaaccgttccttccatgtagctctattctctcttcctttttgtgatgttattatacatgtcttatttatgttaaaacctgagatatgttgttaaaatgataactttatataatttcatattttaaagaagctgggagaataaaggagaggaagtatatatttgtagtttgttatattaactttcttatttaccatttctggtttccttaatttttgaagaaatttgagttaccatctggtatcatttccttactccagtatagctttgttcccacccacctcctttgtgctttagtggccctttaacaaaaattcgtgtggagtcatgttactgtctagtgtcacttgttttcagtatgtaaaacttcctttagtattttttgtaagttggatcttctagcaatgaattctctcaagttttcatttatctgggaatgtctttattttgccatcatttttgaaacatagttttgttggatatgaaattcttggttgacaagtttttttttttccttttctttcatcgctttgaatgtgtcatcttactgccttccagtctccatcgtttgtttcttttctttccttttttttttttttttttgagatggagtctcactcactttgtcgcccaggttggagtgcagtggtgctatgtcagctcactgcagcctctgcctcccgggttcaagtgattttcctgcctcagcctcccaagtagctgggataacaggcatgcaccaccacacctggctaatttttgtaatcttagtagagatggggtttcaccatgttggctaggctggtctcaaactcctgacctcaagtgatctgcccacctcggcctcccaaagtgttgggagtacaggtgtgagccaccgtgcctggccaatctccgttgtttctaatcagaaagtcagctattaattttattgaggattcttcttatgtgataagttgtttttctcttgttgctttctttttttttttttttcttaaatatatattttgttgttgttgttgtttttgagatggagtctggctctgttgcccaggctggagtgcagtggtgtcatcttggctcactgcaacctctccctctcgggttcaagtgattctcctgcctcagcctcccgagtagagtagctggggctacaggtgtgcaccaccatgccccgccaatttttgtatttttagtagagacggggtttcactatgttggccaggctggtcttgaactcctgacctcaagtgatctgcctgccttggcctcccaaagtgctggtattacaggcatgagccaccacacctggccttaaatgtattttttgatatagagatggggtcttgctgtgttgaccaggctggtcttgaactcctggcctgaagcaatcctcctatcttggcctcccaaagtgttaggattataggtgtaagacaccgtgcctggcctctcctgctgctttcaagactttctatgcctttcagcattttgactatgatgtttctgggtgtggatctctttgtgtttattgtatttggagtttgttgagtttcttggatatgtagttaaatgtttttcatcacatttgagaagttctcagccactatttctttttttttttttttttttttttgagatggagtctcacactctcgcccaggctggagtgcagtggcacgatctccgctcactgcaagctccgcctcccaagttcacgccattctcctgcgtcagcctccctagtagttgggactacaggcacccgccaccatgcctggctaattttttgtatttttagtagagacggggtttcactgtgttagccaggatggtctcgatctcttgaccttgtgttccgcccacctcggcctcccaaagtgctgggattacagacgtgagccaccacgcccggccagccactatttcttaagtatttttttctgttctttcttctcctctggtattcccattacatgtatgttgttgtgtattagtccaggctctccagagaaacaaccaaaaggggatgatgagatagatagatatgtttagtggtatcccatttttctctgaggttctgttcatttttcatttttttctgtgttcttcagattgcataatctctatcaatcagtcttcaagttcactgattcttctgccagctgaaatctattcatctcctctagtgagtttttaaaaataagcttcataatttagaataggttttggtttacagaaacattgcaaagatagtggagagtttccatgtaccccacatgtagttttccctattattaacatcttatattggtatgatacattcattctaattaataaaccatattgttagtgattattgattactgatattcaaagttcatactttattcaaatttcctgttttaatctaatgtctttttttttctgctctaggatctcatgtaggatatcacattacatttagttgtcatatcttcttagactcctcttggctgttacagattctcagactttctgtgtttttgatgaacagttttgagtaatactgcttaggtgttttgtggagtatccctcagttgggatttgtctgatgttttccttgtgattagactggtgttgcaggtttttgggaggaagaccacgtaagtaaagtgtcattttcatcacatcgtatcaaagggacatactatcaacatgcttatcactattgatgttaattaaccttgatcacctggctgaggcggtgtttgtcaggtttctgcattgtaaaactactctttttctccctttccataatgtcctctttggaagaaagttactatgtgcagcccacatttaaggactatggagttatgttccaccttattgaagatggggtatttacataaattatttagaattcttctgcacaggggatttgtcaactctgactctctcatttacttatttaaaaaatcattatggactcatggatttctttttaatactttggttaataatccaaatgtagtactactttattttgttgctaaaattgtccctgctttggctactgggggccccttcagttaactagtgtgatttgacatagcacacttcttcttccttcttcctttcttctttcttcttcttcctcttcctcttctttcttcctttttttttttttttttggagaggaagtctcgttctatcccctaggctggagtgcggtggcgtgatctccgctcactgcaacctccacctcctgggttcaagcgattctcctgtctcagcctcttgagtagcttggattacaggtgtgtgccaccacgcctggctaaatttttgtatttttaatagagatggggtttcaccatgttggccaggctggtctccaactcctgacctcagatgatccacccgcctcggcctcccaaagtgttgggatgacaggcgtgagccactgcgcctggccttcttttttctttctctctttctcctcctcctcctccttctctctctctctttttttttaaacctacttctttattttctggcactagaatatgctccaggctcatcttgtacatttttatgccccagtcctagtttcagccatttcaccaaagagtcctggtttctttctttctttctttctttctttctttctttctttctttctttcttttgaggcagggcgtcactctcacccaggctggagtgcagttgcatgatcgcggctcaccacagccttgacctcctaggctcaggtgatcctcccacctcagcctccagagtaactggggctacaggtgcgggccaccacacctggctaatttttgtattttttttttttttttgtagagaaggggttttaccatgttgcccaggctggtctcgaactcttgggctcaagtgatctgcccggcctgtctcccaaagtgctaggattacagacatgagccactgtgcccgactcctggtttatttttatcacagaatggtattagaaagcaggatctaggtgctaggtgggtgctaatgaatctttcattttggttatttactttcctattccagaatttccatttggttccattttcagtattctcagccttccttgcctggggtagaggtgctgccctataaatgaggctaggtggaggtagctctgcttgaccggaatagttcctgcaacatgaaacagaggctgcgaggggtggcaggggatgtgaaattctggtaacctactgctcctggggagaaactttcgtcttggctacactcactgggcatagagctgggggtgagggagagggaatgggcatgtaaggaagtgagtcctggttcaaatttttccaacttggtctttttaccaagattcagtagattttcttgactaaatattgctgcgtttgccccatgtccttagggcaatttctgcagactgtaaatagtttcttctctttccttctttttttgtatcctttgtaccagttaaggttgttttgctgaggagagggtccagggtccacatggaccacctcacactgccattctggaagtgcttttctttggtttaattttgttggaataaagtattacttatggaaacagcattaggtaaatatatttcacgtattctaaatagtaatcttcattgccccatcttgttttctatatcctttgatactaatttataacaacagttctttagaatttagacactaactcacctcttctctttgtattttatcttttgagaatgaagcttcattttatttttcatagccctggcagactacttccatttatagtcctgtaaccatcccttttgtgtgtgtattgtttctgtgatgtctttcatgaaacttcttagggctaaaggtaattgaagcacatttgcttttcctcccactcaaatgtttttatttccttcaaacaaataccttagcaattctgcatctagatgttcttcaatttgtcagttcttgtttttttttttttttcttggcacaacagaagatgttctatttcatacagttaatgaaaggtatctttacttacgtaactataaatgatcaataatgatgatagtgcaatgcaatttcagaagttgttctagatttagcatagttctaaattgttgaggccgagtagaaaaattttcagtgatattgttcaacttgataaagtaacattactttgcagataatataattgtcatcagaactggcaagactaaaattgtttgctttaaaatattttattttccttaataaaaatattgctttaaaaatgttaatgacatttcatgaatctattcttttgggcattgacataaattactggtctcatttggggaatccatttaaatgtaggctctttgagatgatataataaatccctctttctaaagttattggccttcttattacatcatctattgtgtttcattagtgttatcttttaattagtaataatctctattatgtggcttctatgcatcagaggctttatataatcttgaatcctcttcattagcctataagtaggtggtatcagttcttcttaatgaatgagaaaataggcttgaagggactacataacttgctcatggtcacataattagtgagggatgacacccagatgtgtcagtattctcaaaagactagaaagaagggtccaggtagaggaagggtttgtggcaaaagcagtgcatggactgcttgttcatcatctttttttttttgagatggagtctcgctctgttgcccaggctggagtgcagtggcacaattttggctcactgcaacctctgcctcccgggttcaagcaattctctgcctcagcctcccaagtagctgggattacaggcacccaacaccacacctggctaattttttttttgcaattttagtagagacggggtttcaccatgttggcctggctggtcttgaactcctgacctcgtgatccacccgcctcggcctctcaaagtgttgggattacaggtgtgagccacctcacctggcctcatcatcttaattggtcttggattgttgaaataagttttcatcttctaaggaggacatatcaaaatctagaaactaaaaagttaaaaaaaatttttatgttagcctaaacaattgaaaatagcagataacaaacaatatttaaatttgaaatgtctgtgggtttctatattgaatcctgtgtctatgattatataaactaggagttacttcaaggaaaatgatgacaccacattgagaagtaggctccttagtcaccaggaggctatctgattttcccacttactctattgtgaatggagaagaatcctttggtcaagccagagcatagctcctcctcagctgattaggagacctggagatgagatctgtttcctctttgctataatgaatgtgtagggtttattctctctatcagattctggattccctgaaaacaaagatggtggtttgtatttcaatgcactttacatgtcatttgcatgaaatgagaagcgcaagtaactaactagttggtattgtggaactataaaatagaatgcagtattgtttacaagttcattctctgttagatactgttataaatatgcataatcaattctttttttttgggggggggacagtctcgccctgtcgcccaggctgaagtgcagtggtggcgcgatctcggctcgctgtaacctctgcctcctgggttcaagtgattctcctgcctcagcctcctgagtagctgggattataggagtgtaccaccatgcccagcgaatttttgtatttttagtagagatggggtttcacaatattggccaggctggtctcgaattcctgacctcaagtgatccacctatcttggtctcccaaggtgctgggattacaggcatgagccaccaccactcctggctgcataatcaattcttaattatttatgaattgttagaatggtttatcccaagcccatttctttctctgtatcttttttttgtttgtttttgacacaggatctcaaaaatcatcactagatggtaaatctgtagggaattattattttgagtcaggatcttcctctgtcatcccggctagaatgcgggggtggtggggggcaggatctctcctcacagcagcctctgtctttcagactcaagcgatccttctacctcagcctcctgagtagctgggaccacagggacataccaccatgcccggctgactttgtaatttttagtagagccagggtctcgccatgttgcccataataaataacaactaagacctcatagttgtcagtcatgtaatattattttccatttgctccatctctattcccagtttcagttagtagagtcctgatatacccagtagtcaaggcagaatttttttttcttttttttttttaatataatttttgattttacaaaccctggcctacaggtcacagcagaaattttagcatcattttagacttttccatttctcattcatcaactatttttaaattgtcgctgtgtcttttgattacatctcttaaatatctcaactttatctgcctttctttgttcccactgttgctgctttagtttaaatttcatcattttgtgcctggcctctataaatcagtagctttctgactagtgtctgccctaactctcttcctgcctccatggtgatttttctgaagtataacactggtaaaatgctcaacttaaaccttctcttgatttcttgttgtctatggcagtagccttcaaacttcttgtaaggcagttagaccccttcttcaaatatagggtgtcaacaaaatttcaacaaattgagtctcagagatctgattgggttttattaacgattcatggaccaggtagcatccagtctacgaaacagaaagagctctaatgacctagacttagtgggtacattttgtatgcacaaaaaagtggaggaaagcaggaccaaggatcaaatagtgggttggtcatttcaaggttactttccttatagggaatcttggcttaagggaatttagctatcatctttctcctgatttcttaggtggtcagattttacaagtaaataagttaggttttggtttggtaacttggaaccttagcctgagtgactccatttgggcctgctgttctttctttaactaaggcaaatacaatgtttaaaatagattttttttaaaaagagagagcgcaacactattgtctgattgaagcaggacaggaatgtaggaactctgcttttgcttctacctttctcaaaaagccccttgagccatatagggcaaagtttgaaaaccaccatcctgaagcagaacctagacttcttagcatggtatagaagccttttatgattttgtccatgccttttttcgtgttattcctggacttttgccctggatttcagatatgctgcattacttgcattcaccgaacactcattttttttgcctatatttttgcacaaacttttcatagaatgcctttacccattttgtctatcagctaaacttctgttcttgtctcaagtattaattcagatatcacctcttcaatgaagctttctctgattttccaagtcaaagttaatcttttttttctgcttttctagtatctcttcacattggaaagcaggaagactttgttatatgtgattcagcactagtagcttgaacttacaacctgttatatgacttacaatatttgcatttaaaatgcctgaaccaaacttttgccaacatttaattgtctattttttgctttctcatgaaagaaaatgtcagatgttttgcttaaaaagcggtcaagcacaatggcatatagccttaacttggttatgaaattgggcaattaaatcttttcattttaggtaaagtcctttatattctgtggtattgtagatggcattattaaagtactgaagtttccttttgttatctattttaaaggattgaatatgtactatgattatcatgtattgtgactcgcataaagagtagcaaatttatgacatgattggttcccttcaatcaaggcaccttgttgaaactcttttgaggaaatttttcattcagatttatctttaatgcagcttccaaataagtgcttgatgaatattttatttaatgagtaaattgtgaattaccttgtggtcgaagatattgtctccttattcactactttattctctcctccttctccatattccacttagctacatctttctcctcattcctaaaaaaaaaaaaatctctaaatatcttggtgcataagaaaagaagaaagaccagtgaattttcttgtttcttgcctgctttaagaggtggaattgactgtagataagaattgtggttaggctaaatattgcatatatgaacagcaagcatgccataatagatgcttaataaatgtttgttgaatttgagtagggtagatcttaggctctcagtgctttaaatgattactgagatttgaggatttcttcactttgccattgaataaacttaaggcttagagaggtagaagtggctttgcagatttctggtgaataggaatttttcaataattagaacgatctgaaattggagtgagctgttttgttttgtttagacaggatcttcctctgtcaccggagtgcactagtgatcatagcttactgcaggcttgaactcctaagctcaagctatccttctgtgtcaacctcccaagtagctgggactacaggcatggaccagcacacacggctaatttttgaaattttttgtagagacaaagcctcgctgtgttgcccaggcttgtcttgaactccaggccttaaacagccctcctgccatggcctcccaaagtgctgggtttagaggcatgagccgctgtgcctggctgtgagctgtttttgtaggcactaagtttcatatcacacctggcacggtggctcattcctgtaatcccagcactttgggaggctgaggcgggaggatcacttgaggtcaggagttcaagaccagcctggccaacatggtgaaacactgtctgtagtaaaaatacaaaaattagctgggcgtgatggcgtgtgcctgtaatcccagctacttgggaggctgaggcaggagaatctcttgaacccgggaggcggaggttgcaatgagcctagatccccctactgcactccagcctgggcgacagagtgagactccgtctcgggggaagaaaaaaaatcacttcctagctagaccaatgtgaaaaaattatttgtttgagctcttgttttgatattaacatgatgtagctaagtggtatttttctgctaattgaccttttgaaattcaaatactacttaattctattatggaacagtagaggaaatggggattctggccagagaaaacaaggaaaaagtacctcttgaaggtacttgacagtgaaatgatgaaacctaaaatgttgagatgaattgcaacaaaactttgatatttaataatgcatttgaagggaggccctgttctgttgatgaggcagaccatcaagagcagtgtagacgttgccaactcataatggcaagctaagagttcaggattttcaactgaatttattaaatctggatattcaaaatttttgtcattttgccatatattgggggtgtcttaattaaagggattttatgtagttcaaaataaatgttacaattgttgtattatactagtactatgaagatgactatgataagagtgtcttttgtatgctaattgggtgactcctggcagaacctcctagatagcttctgatgggggctggtcaaccagaaagaagaaggcactattagagatttaggactttcatcttcaccccagactttctgggaggggaaaagggaaggagaatgagctcaatcaccaatggctagtgctttaatcagtcatgcctacataatgaaaccttcctaaatgatggtgccctggagccttgtgggttggtgaacacactgtaaagcaaaacaaaattctaagccgcccagccaactgaatgaaaccctcctctcagccaagggcactctaacctgaatgctagttcaggccatgataggaaagacatgcctcattatacctttgtccctttggaattcaggcatggctaaccagcattaatgttaaaacagactctttgtagcagtaagataccaacatgatacataaaatgtatcacactttgtagcagtaagataccaacatgattgcaggccctgaaagaaatagaagtattttaccctgaaatatatttctctattttgaaatggccctggcaaagctgtctctcatggggaaaaaaatctacattctatagataatccccttccctttccaggtctttttcctggtccaggagagaatactgtctggcacctttttaagtctgttttttttgggaacaaagtctccgctctgtcacccaggctggaatgcagtggcatgatcttggctcactgcaacctccgcctcccaggttcaagcaattctcgtggtattttttaaagacctggggtggggacaggggattctcctgcctcagcctcccgagtagctgggattacaggcatgcgccaccacgcccggcaagtttttgtatttttagtagagacggggtttctccatgttggccacgctggtcttgtactcctgacctcaagtgatcctcccgcctcagcctcccaaagtgctgggattacaagcaggagccactgcacagactgccttcttaagtctgataagaaacatttacaatctgttccataggaagcctctgcataataagaaccttggtctccacaaccccttatcttaacccaaatcatagaagggagattctattgattccaggtctttaggtaaactcaaccaattgccaatcaggaaatctctgaatccacttatgacctggaagcacccccctccccacctttgagttattctacctttctggaccaaaccaatgtacatcttacatgtattgattgatgtcttatgtctccctgaaatgtacaaaaccaagctgtagggggccaggcgtggtggccttatacctgcaatcccagcactttgggaggctgaggcgggaggatcactggagtccaggaattggagaccagctgggcaacatggtgagacctcttctctacccccaactctccctcaaaataatagtaattaaaaccaagctgtagcctgaccaccttgggcacatatatattctcagcatctcctggggctgtatcacagttcgtggtcttcatatttcgctcagaataaatctcttaaaatattttagagtttgactctgtcaaaatcatcgaggtgctgggaggctggtgtgctctgagaaggcacggaaggcctgtgctggctccccaacccctcataccttgccctgtgcatctcttccatttggctgttcctgagttgtatcctttataagaagctggtagtaaatgtaagtaatgcatttccttgagttctgtgagtcacgctagcaaattatcaaacttgaggagagtgagttgtgggaacccccaaatttgtagccaagttggatagaagtatgaatagcctggggacctgggacttgtgacaggaatccgaagtgagggcagttttgtgagactgagtccttaaacctgtggattgaattgaaggatactcagttggtgtcagagaatcagaattggtgttggaaaagataccacgcatttgctgtctggggaaaaaaaaaaagccctcaggtaggcacatgaatcttcagcttacaaatggaaacgtaccaaagcttcaagagactgctgagctcatcattaaggtagtatgcgggaaagctataactcaaaagtgctcttaaccatatctttttaaaaaattgtatcctctttgagggaaagaatctatcttttcttttttaaattgttattatttattagtcagcttctcagatctctttggaatttaattgaatgcttttatcaattaatggtcttgatgaaattgcttgtatttttgactattatttgtatggccaaagtaattttacgtacccttctgaagttagcagcacaaacaattgaggaagtgcaaagattttcgcttgatttttcttcagtttcttctatattttaaataggacacaaatatctctgtaaataaaaataacttccaatacatttggaaaacatcccagacttcctgtccatgcctcgcaaagttgctgctgtctagtcattattactatgttttttccctttgacataagtgaccctcacaggaatagcttcatcaccagctgtttggccagtggtattccacttactttgtttttcctgtttctctgaaatatgctgaaagataatcactccgtgccttcccttgtttagaatgaatttactcaattgctctggaagcttaccttggtaaatgatttggaaccgtaatgaaaaaagagggtaggctttatatattttatattggtgccttaggaattgacatttatttattgaggatttttgtgctcattttcaatttgaaagggtcctagtgtttagaattaaattgtgggacttgaaagctaaaaaggaacttggagatcgtccaactgaggagccttattttttaaatgaggaaacaaaagttgtcaagatcaaccataaatctgatagtttggcttggtgaaagaaacctaggtttcagaaaatctctcatgtagtttgcagtttatagccacaaggaccaggagtctgaagacttgataagagggtctgtttttcaaaatattaacaaagtttagcctggaagctccctttgtgaattttccatgtcattgacagtgtttgaaatctcgtcatgtcttcaggatcaataacctctaccatgtacttttatactttttaattagcggattttcaaacttttaaaaacagtaactcctttttttcaatataatcttatattgaaccacaggatacaaaaaagatacgtgatatttaattaaaatagttttaagcacaattttaatttgttggataataaattaatgatgacatagctaaaatttatgaaatgctgattagagtactgtacatacatatttcacttctctctctagcttaaaatatttgaatgggtgtactgtaattcatttaactaggcccttgttgatgtgtatttagactgtttccattcttgtttttgcaaacaatgttgcagtgaataatgtatgtatacattatgtggtgtgtgtgtatgtgtttctggggataaattctggaaatgtaattgctgtgtcattagaatatgtttttagttttgaaggattttatcaaattggtttccaatttgatatatattcccaccagcagtgtatgagcaagcttaattctctcatgctctcatcagcatggtatgttatttttggtttttgctaatgtaaaaaattgtatctcagtgtggttttaatcttctatttgtattatatgtaaatttgagtaacttttttatgtttaagagccatttgtgtttctttttctctgaactatttgttcatatcactttgcccattttaaaaattgggtttccgcccctcttaatgagcaggagtagccttctgtgtattgagtttaactttgtgatataagttgcagattcttttcctcaggttttcatttctatttttcctgtagtttgtaccttttccatttttatggatatctaaactcaaccttaacttgacaaatggaaccttggatttctatccttcctttaacctccttctcttctagtcttcctcagtgaagaaacagcacctctcatgtgtctctactcatacatagcccaagcccaaaaccaagaagttatccttgcctcctctttccctccctccctgtctctaatccatcctcagtggtattgacttcctctccaacatgtcccaaatctattcatttctcttaatatccaccaatttagtccatcctccccttatctttcacctgggtggctgccatggcttcctagctgttctaccccaaaactgatgtctcccgttccaggtactgagccattctctactctgtagcttatgtgatcttttcaaactgcaaataatcagattgtcataccactccctgaatccacccctcctattcttgttcaaaaccctcctgtaagtccttatgtcccatggcaaagattatgcttcttgaaatagcccaacctgctgtttctccagcctcaccttgtactatgttattgacccccacccctccccacctcacctgtgggtctcttgtgtcaccctgttccctcctgacttggggctttagcataaattattttctcctggagcatcccccttcttccatgagtttatgttgaattattctacaggcctcagctcactaattgctttctctaagagagccaacaactcttcctaataggtgggaaacccctgtcataagcccttccagcaacttatatctctttcatagcactaatatttactgttttatacttactgtgtgagtctttgattaagctctatgagatagggatcttgtctgttttctttactgttatgtcccagaatctatcatagtacccggtacatggttagctctcaaaacattgaatgattgcttaactataaacccttaggtgtagagtttacagaatgtactgttttgccctttctggaaaatgggacatttgctcttggccagtctttgttctcctcttcttttccctgtgattttcccaagactactaaatttcagcaattccattttgaaagtcttaaagcatttcaaacatgaaatttatccaggtcaatggtcttgaattcatttaaagcctgtaggtgttcttcaagtcttggacttcagttccttccattcctttttcatgtgaagtttatttttcttggagttgaggacaataactcagaccacattttctgacccacatcaatccagcaaaatctaggtggtccccaacttctgtaagtttattttaaattcagttacttagaatttgcagttcagaaaatattaccccaaagaaaccgtgttaaaattgatctttatattttcatgaagatgtcttcaaaatccttttaaccaatagggtatctgaaatagtacagttttagtatgaactctgagtttctctgatcctattttattgaggcagggtcttgctcatcacccaggctagagtgcagtggcgtgatcatggctctctgcagcttcgacttcctgtgttcaaatgattctcccacctcagcctcctgagtagctgggagtagctgggactcaggcatgcaccaccacgcttggttaattttttgtagatgcagggttttgccatgttgcccaggctggtctcaaactcctggagtcaagcgattggcctgcctcagcgtcccaaagtggtgggattacaggcgtgagccagcgcccctggctctgatcccattttagctctgtttttctttttctttctttctttttttttggggacaaagtcttgctccgtcgcccaggctggagtgcaatggcaagatcttggctcactgcaacctccgcctcctgggttcaagtgattctcctgcctcagccttccaagtagctgggattacaggcatgtgccaccataccccgttaattttttgtatttcttttttttttagtagagatggggtttttgccacgttggccaggctggtctctaatgcctgacctcaggtgatccacccgccttggcctcccatagtgctgggattacaggcgttagccacccagcccagccttagctctgtttttcaatctgaatccaaagaccctcatattaggaagggctgggagtttaggaggattggcagtgctgggagaagtatcaagtagctggtagaagatacattgggttgatactggatttcctcccttgtggaaggattctgaaggtcaagggtagggaggcacataacatatttggtagtttgaaatttttatgctagtaaattgtgtataactcatgataatcaaatatctgtttgatttaataaggggggactgaattataaaggatggattgataaatcaagttactctccacttttgggagaataaagcaaaatgaagatcctattaattatgggtcagatggtcccatctagaaagaaaactaagtaggagtgcttcatctccttgcttgtattcagcatggagaagtctttacaaaagggtaattaattagggtgtttttcacaaggccgtgccttccatagaaatggttttcttctgtatgtggatcttgagttttaagatgctttccaaccatttgaactctcttattataacagaagtttagtcatgtaccaaatgtattcctatgcaattttcagtgacaaaatggttctctcatttggatgtgtaaaaacaatgccaggaacaaaaacaaaactcatgattcaactgattttgtactctctttgggaagaagaaaagacccgttgagatgaagattataatttcagtaacaaagaaaacattcaaggcccaggcagctcttaaattcaatactaataatctatgaaataaattataagcctacgtttctgtcagttctttagatacctgcttgtttgctaatacagaaacattgcttaattttacatgtattttcttagtgtgagtcaaatccaacctaaaatgcatttggttatttgtttacacagttagtgactggtaatcaaaaacgcaaacaatttttgagggagttagaatcttcactttagtaggtaccttagagggcatctagtttagtacaggattcctttctaccagggacaaactgtttacagaggccccttcctgcctcttgcgaggttcctccttgtctgttctgcttcagatatacaggccttctgtgttccttgaatttatcaaactctctaagactctttgtactgccttgaacactcttctcatagccctggtggcttggaatttttacatgggacagatttctctgaaatactgccttctcagacaaccttccccagatctcctacctaaaggacctctccccttcccaactgccataactctatcataagactctgttttatttccttataatacttgtcactgtctgaaattatcatatttattgtctatctcctttagctccatgagagcaggagcatggtccatgttgttcaccgctatatcctgaagtatctacaatagtggctgtcccattgtaggcatctgacaagtatgacaaaaatgagaatgaatgaataaccattgatgattgatcattttgttaatgttaaaaccaaactctgtaaaatattttaaagaggtttattctgagctaatgtgagtgaccatggtctggggaacagtctcaagagccctgacaaaatatgtcctaggctatcagattgcagtctgcttttatatgttttagggagagaattgtaggtaaaatcatcagtcagtacttggaggatgatgtacattggttcagccaaggtagtgggggatcataggtggattaaaggattttctgattcgcagttggttgaaagagttaagctttttctaaagacttgaagtcagtagaaagaaatggtaaagttaagataagggggttgtggaggccaaggttcttgttatgtagtaaagcctcataggtagcagctttcagggagaatagatggtaaatgtctcttttcagaccttaaaggtgtcaggctctcagttaatgtctcctaggttgggggaaaggcccagaaagggaaggcttggctgcactatggagattctgttggccccgtgacagttattttaaaatatgtcaaagaaatatattttggggtaaaatattttgattgccttcagggtctgctatttgtcatgtgatgctataacacagtcagattggaaagtaagccacattatactttatactaggttaatcatctctgatgaggctttatggtttgtagggcgtgacttaacccctgctttgcctgaccttaggtgttgtttataatttgttatcttattgccacagtgtctggtttgccagtcttaggatcgccatccaaaaagagggagtataacgaggtatgtctgacctctcttcctggctgggaattcagtttttcaggtttctctggggtgcccttggccaagaaggagtttgttcagtcagctggggggtttaggatttttttttttttctttttgagatggagtcttgctctgttttccaggctggagtgcagtggcgctatctcggcttactgtaacctctgcctcctgggttcaagcaattctcctgcctcagcctcccgagtagctgggattgcagacatacgccaccacccccggctaatttaggattttatttttggtttacatgttccaatcactactgagctgaaatttgtctcctttttgcttctactactgaacttagttctgtcccctggaataaatcactggctcgattccattttttccaaagtcttcagacatttggatgtcagtcatctctcactgaggccaaactcacctggtttccttaccagttcctcatctggcatggttttaggtgagtggtcactatccaggttatcagttgttggcaatttttggttttgttgttgtgatacccagcactaaacatagtgcattatgtggtgtcttgaacttccgagagagagaacagttaaactttcttgtttaatgtgatactgcaatgctttgtctttgataaaaattattttttaataccatataaatgacgaaggaactatttatatatgaaatcattatcagaaatattctgaggtcttaaaagcttgttttataatggaatataacaacgtagaaatacattaaacataagtatatactctaatgaacaattataagtgaatgtctatttaaccatcactcaagacatagaaatagtgccccaggaacccctcctgtgttgtgttgtgttgtgttgtcttgtctagcctttccctttccctttctctttccctttcttccttcctttctttcctttctttctctgtcaccccggcagtgcacagtgcacagtgcacaatcacggctcaccgcagctgtgatcacctaggctcaaggaatcctcccacttcagcctcccaagtagctgggactagaggtgttcgccaccaacgcccagctaattaaaaaaaaaaaaaaaaagttgttgtagagacaaggtctcattatgttgcccaggctggtctcaaactcctgggtttaagtgatccttccgcctcagccttccaaagtgccgcctcagccttccaaaatgccgggctgccatatgtcttttctcaatctcagtccctccttagaggtaattaatatcctgatttttttacaataaacacttccttgatcacttttttatacagttaccacttacatgtacatacttaatatagtttatagttcagctttgcctgtttttaaactgtatataaaagaaacaatgctgttgtatcagttttctgttgcataataacttaccacatgcttagccatgttaagacaccatatattattagctcacagttctgtaggttcccagcctgatctttttattacttgtgttttctgtttcatgaatttttgctcttactcatttctttcttcacattttcattgggctcattttgtgtttcttttgtttagcctcttgagtttgatgcttagttcatgtttccagtttttagtattttctgatatatgcatataagattctcaatttcctccttaagcattgttttctttctatagatttgtatttttgttattgttaagtgtattatgttttcttccttgattgacatatggattattttgggagtgtatttatttccaaacataagaattattttctaactacttcttttgtgattgatcaactttagttgtggaaagagaccatccttttacttcagtccttgtaatttattttatttatttatttatttttgagatggagttttgctctgttgctcaggctggagtgcagtggcgccatttggctcactgcatcctctgtgattctcgtgcctcagcctcctgagtagctgggactacaggcacgtggtcatcacacctggctaagttttgtgtttttagtagagacaggatttcaccatgttaaccaggctggtctcgaactcctggcctcaagtaatctgcctacctcagcctcccaaaatactgggattacaggcccgagccactgtgcccggcccttgtaatttattttgaattgctttatggcctagcatatgatcagtttttgtgaatgttgtatgtgtgcttggagaggagaaaaagatattttgcagttctttgctatagttgatatgttcatttggtcaaattttaaaaacatgttcaatgtcttctttatcctaatatttttctctttcatttagttctctttttttgttatgctctctatctagcattctaatttatttttatagtttgatctttcaccttttggaccttttagttctgtcacaatgttcagtctttgtttttttttttttttttgagatggagtctcgctctgtcgccgaggctagagtgcagtggctcgatctcggctcactgtaagctccgcctcccgggttcatgccattctcctgcctcagcctcccgagtagctgggactacaggcgcccaccacaatgcccggctaatttttttgtattttttcagtagagacagggtttcaccatgttaaccaggatggtctggatctcctgacctcgtgatccacccgcctcggcctcggcctcctaaagtgctgggattacaggcgtgagccactgcacccggccagtctggtttttattgcatcaaccctaccgttgttttgtaggctattgctgatcatttataggctatccctgacccaaagtcttttgggatcattttctttttcagttgtttctattggttcttgttcgtggtatcttaccttgcgtgtttggccatctttgattatgtactgcacattgtaaatgagaaactatctgtagcagtattgtgaggcctggttgatgccatcttccctcagagcgttgctttttttctttgtttcacccagacaactggtggctttaacaatctgaatgtggaaccaccttaatccaaagtacatttaaagattttatctagatcgcccagatgacataaacctacagttcaagtttgtccaagggctgatttatttctgttttttcttatcctgggagtatattctggggttttggcttcaagtgagtggtgatttatcaaactttctccttatttataaaaattttatttttaatgattatagctacttaatagttgtatatatttatgggatacatgttatattttgatacaagcatacaatatgtaatgatcagggtaattggggtatccatcatttcaagcatttatcatttctttgtgttaggaacctcccaattccactcttttagttattttgaaatatacaataaattattgctaacaaactttctcattttgagacacccttgactttgaattttgtgttccttgatctctaacgatttcaagagcaaacctgtttttctctcattttctggatcttcaaataccagaaaagctaaaatagttttgggtggtttggattatctctctggattctattcttttgctttgattgctttgattttagccaggtaattcttcacaatcttgttaagtgtttggagcttttaagatgtttctgaaaagtattccctctagcatttgtatttgtctgtaaagggacatttcatccaagatatgtagtttgccatcaccagaactaaaacgttttagtttttatgccttaaaaaaaaagattaatcagttatattcatataaaattgcagctaaatccaatatggcataatttttttcttcagtatgaatactggtatttaaaagaccattcttgacatccaagataagtatccactcacatcattattattttttttatttgttttgagaccgactctccttctgttgcccaggctggagtgcagtgacgtgatcttggctcactgcaaccatcacctcccaagctcaaaaaattctcgtgccttagcctcctgtgtagctgggactacaggcacccaccatcacacccggctaattttttggtattttatctggagatggggtttcaccatgttggccaggttggtctccaactcctgaccttaagcagtctgcctgcctcagcctcccaaagtgctaggattacagacgtgagccactgtagccggccccactcacattctgattcccagtttttttgtttgtttgtttttgtttttgagacggagttttcactcttgtcatccaggcttaagtacaatggcaatatctcagctcactgcaacttctgcctcccgggttcaagtgattttcgtgtctcagtctcccgagtagctgggattacaggtgcctgccaccgcacctggctaatttttgtatttttagtagagacggggttgtaccatgttggccaggctggtctcgagctcctgacctcaggttattcaccctcctcagcctcccaaagtgctgggattacaggcatgagccatctcacctggcctaattcccagtttttattactcagttttgactgccacaaagaatagtgagaccaaatgttttttttaaaaaatttttatttttttttatttttttgagacagtctcgctctgtcgcccaggctggagtgcagtagtaagatctcggtttactgcaacctctgccttccgggttcaagcaattctcctgtctcagcctctcgagtagctggcactacaggcgcgcaccaccatacccagctaatttttgtatttttagtagagatcgggtttcatcatattggtcatgctggtctcgaactcctgacctcaggtcatctacctgccttggcctcccaaagtgctgggattacaggcgtgagccaccacgcccggccacaaatgttctttacaaatacttttatacagaactttttgggtcttcttagtgagaatgattaatttttatctcaagtttcctttgaaatgaaccataccattattggcagagagtagaatatttaaatatttcctgagtgttctttcaaaccagccgtagaaaatgaaagagtgattcgttttcagaaatgctctgagcatcttttaccaggaatgtgactgacatagatcctcatatagctggctccttgtcattgccatctcagctcaaatgttacctttttagagaagccctccctgtctatcattctttttccctctttcataacaaaatacaagataatagtctcgtattttttctccaccagcaaaatgtaaagttccatgagggtaaggaccttgcctgtcttgtttaccactatgttgtgtgtcttatcctgaaaacatgggaggcagtcagtaattatttgcttaatgaattaataaatatttcatctcaaattgtgacatctttttctctaaatatcagaataatccttaaaaaatttttgattccagtgaactaaagttttctaagctaagtatagcgaaaggaggtcagtgtagctggagtgaagctagtcaagggagagtctagtaggagatgatatcaggaggggaggtcaaggcctgtggctcatgtggattttgcttttcactcttaatgatatgggaggccattagagggttttgaatgagaagtttatgagaagtgacatggtctgagttatcttcaagagttactctgacttctttaaggtctgtaggaatctgtagggatactgaagtatggtctattctgggctctcacatctgttctattggttatttatccgtgccagaaccaccctgtcttaatttccctcactctattataatcctcaacctattcagtagggcatcctgccagatcctaccctcaaagcctagtgctcttgtaacttttcttatctttcttactcttttctttttcttattctttgctgctcatacttgtagtaggagggtgttgcttctacttggaactctgcccttccatatatattttaaaatcagcttgtcttaattctttagaaaaccttgttgggattgtgattggaattgcattgactatatagatcaatatggaaagaattgatacctttatagttttgaatcttcctagctgtaaaatttggataacttatttacgtgttttttaatgtcttgagtaaagttacatatatatttgaaaagtcgttttgaatatcttttgttaaatcttaggtgctttttaaaattattgtaaatgtggtttgtttttgtttttctttgagacaaggtctggctctattgtccaggctagagtgcaatggcacaatcttggcttactgcagcctccgcttcccgggctcaaaccatcctcccatctcagcctctggagtagctgggactacaggcatgctctgccacatgcagctaatttttatatattttgttgaggctggattttgccatgttgcccagtctggtctcgaactcgtgagctcaagcagtctgcttgcctcagcctcccaaagtgctgtgattataggcgtgagccattgtgccccgcccataaatgtgatttttaaaaattgcattttctatttcttacaaatgctctttacagatgctgctgatatttgtgtattaagcttatgttcagctaccttgccaaacactaataattccaataatttatgaattcttttgaattttctatgaggtaatatatgcaaattctgttttcgtttccctcttttcaatcatacattttattcatttattgtttcttattttactaagccagctataacccacaaggatgtttttgttttgtttttgtttttgagacagggtcttgcggtgttgcccaggctggagtgcagtggtgcgatcacggctcaccgcagcttcgccctcctgggctcaagcaatcctccctcctcaccatctgagagtagctgggactacaggcgtgcacaaccacacccggctagtttttgtagtttttctagagaaagggtttcaccacatttcctaggctggtcttgaattcctgagcatgagtgatccgtccacctcagcctcccagcagcctcccaaagtgctgggattatggacacgagccactgtgcctggctaggatgtttaatactaatgttaataagtattaatagtagaactccttgtcatgtttttgtttgtttggtggagacagggtctcacactgttgcccaggctagtgtccggtggcgcaatcacagctcactgcagctttgacctcctgggctcaagtgatcctcccgtctcagcctcccacaaccatgcccaccaggctaggttttttttgtttttgtttgttttttttgtttttgtagagactgggtctccctgtgttgctcaggctggtctctaattcctgggctcaagcgatccttctgccttggcttcctaaagtgctgggattatatgcgtgaaccatggtgcctgggcacatgttcttaagttttaaagggactatgtctactgcttcacatttaagaatgatgtttgttgtaggtttttgtcagatgcccttatcaggatatgcacattttaaaatcacctaattatgtatatattgctttttagaaaatttgcaccaatttacatttctaccatcagtgtatggaagggcactccttgacaatacttacccacatcacatggggtattcttgttaaaagtttcagattttggccgggcgcggtggctcacgcctgtaatcccagcactttgggaggccgagacgggcggatcacgaggtcaggagagcgagaccatcctggctaacacggtgaaaccccgtctctactaaaaaaaatacaaaaattagccgggcatggtggcgcgtgcctgtagtcccagctacacgggaggctgaggcaggagaatggtgtgaacccgggaggcggagcttgcagtgagtcgagatcgcgccactgcactccagcctgggcgacagagcgaaactccgtctcaaaaaaaaaaaaaaaaagaaagtttcagattttataggcagtaaggaacttcttgtttagatttgtttcttccttttaaaacaatattttgtgttgttaccactgttattcttagagatgggataagctttttgaaacaaagcttattttgaaaatatttcagatttagagaaaaactgcaaaaatagtgcaaagaatttcctacttcctatacccttgacctagattttccaagtgtgttaatattttatcatatttgctttatcattctttctgtcttttttctcttccctcatacacacatataatttttctcagtggtttaagttgtaaacatgatgcccctttaaaaactttagtgctgtttcttaaaaatgagagcattgttttatataaccgaagtactaatatgaaaattagaaaactactgacaacagtactataatctgtgaacatttgaattgtatcaattgttcttcatagcgaaaaaagaacaaaagctttttcttgtccaggatgtaatccaggatcatgcaatgtatttcattgtcatatctcttaatcttctttaatctggaatagtcgcttcttgttactcagttgtttcttgtctttcatgaccttgacattttaaaagaatatgggccaattatttagtaaaatgtccctcagcttgggcttgtctcttgcttcttgtgattagattcaggttttgcatttctggcaggaatgccacagaagtggtgatgtgatacatcctatcagggggcatataatgttggtttgtccccttattgatgacgttaacttgatcatttaattaaggtggtgtctggcaggattcttcagtgtaaaattactatttttcttcttgtaattaataggtatcttgtggatactttgagattagataatatcctgttttccatcaaattttcaaccactagttttagcatgtattgatcatacttgcttgaaataattattaccagagtgattgccaaatggcgatcttctaattttatcactacatttattatttggaattatacttcgcaaaagagctttctcttctcccccatttatttatttatgtcagtaaggacttttaaaaaaattatatgggttataatctgttactgtgcttatttactttgttgctcaaatattcccgattaggccagtgggagtcacatcagtctgactcctgtgtccttttgaggtacccctatcattctttgagcatttccttactttctggcaccacaaaaatatgccctaggctcctatggtccttctcctgccccacccttggaatcagccatttcttcaaggaaccctagttccttttatcagagcaccagctgtgttcatagctataggggtatcattgcttctaggccttctcagcagacagagctaggaaatatatgtatgtgagtgcacatttacacaaacacctttatatctgtctatactcctatatattaaaaactgagcttatattgttaactccaactccaagccttctccctttttatatttgttactcccttttatgagaataagaaaccaaggtcagtatattcacagaatatttacctatttgcccaatcttagaacacacacaaacaagtttcatgtcattgtataaaagcaggtagctaagtagaatatagtatttgtttataattctttttatttttagctttaggagagtagatagtgaaaatgctgtttttaaaagttagctgtggttaattcatttgtccttgtccccaaaagtgtggttatattattcatttcaaatacagagaggttcatttgtttgtattcattccattttgggttcttcgctcctattactgttggtttcttcttcattttaagtgtataaaacattaaaatggattgaaaaataactctacaaaaaggtaagattggttactagagtactgcaaatataaaacttacagcttttaattgtgtttgtttttttcagggagtcatttaatacttcatgattagaacaaatatgtgaaagttcccaccaaccagtgagaatttcttccttcagacggttttggatcttactgcacagctttctgagaagttcttttggtgccatgttttgtggcttgcatcaaaagaggagtttgtcttcatgaagattcctaacattggtaatgtgatgaataaatttgagatccttggggttgtaggtgaaggtaagttggaatttttgcgttccttgagttttgagcaatgaacagttagttattcctaccaccaaaaagttactaattagatcctgttaatttaacctatatcaattcacatgtgtgtctaagagtaaaatattaaaaataaaattactcttaaacaatttgggtctcactctccaataaaaaattaataactttttaaaaccctttaaagtttaataaatcaaagatttttttcccttttcttttaaaaagagccccagtgttacaacagtctttgccttcattctttttttttttttttttttagcaatcatgagttccttagtctgcattttttttcttggttccattttatttttatatcagctaggcttattttgaataacttaaatttcattcattcattcattcattcattcattcattcattcaagacagagtctcactgttacccagactggagtgcagtggcatgatctcggctcactgcagcctctgcctcctgggttcaagcgattctcctgcctcagcctcctgagattacaggcgtgagccactgtgcccagctaatttttgtattttcagtagagactgggtttcaccatgttggtgaaattttacttaatacctggtaaataaacaaataagtaaattctgtttctttgaaaatgggagactatgttttgtaaattctgaggcatacaattttatctctgaaatcagggtgtatcttataatcagtatcatgtcacagtttaattggcagcattctccctttcctaatagtacataaaataatgctcatgaccaatgatataccattgatttgatgaaatatgatgtcattttgtataaactgactcctaaaaaaaaatcatttcttctgatttttcctgcttagtgatttttgctctagacttaaagataactttggaaattttgataaatgattctgttaacagaagataagtgattataattatggtttcttagcatttatatctttaaagcatatgttacaaaaatttcatatttcagaattttcaaataaactctgaattcctaaaggactaaaaaagttcacctatgtgaacagcaaagctgttattaagttttaaagttggcaaatcctttcaaatacatagaaacaattaaaataaagagtttaatcattggatgcttgtttcaaggtctgaaattcaaaccatacaaaacaaataggtctttgttccttcactagtcaactcctcttccatttcttcatcgatgttatgtaaaaatttcattttcagtgtcttgcttaccatctgttctggaatagcctattttatttttcaaaagtattagaattagagaccaatgcaataaagctgctgactggagaaggctagcacatacggtgtaacaaggttagaatgctccagattctgggcctaagtttttctggatcataactagtttttctcattatagccataggtgatcatcttctttgggattggctcaaaattaccagactgttatatatatatatatatatcagaatatgttactttgttatcagaactaccattgctgtatgtttctttctttggaaagcacctcacatgtatttttggctaggatatacatataaagtatataacaatctgtcaccaggaacggtgactcatgcctataatcccagcactttgggaggctgaggtggtggatcacaaggtcaagagatccagaccatcttggccaacatggtgaaaccctgtctctactaaaaatacaaaaattagctgggtgtggtggcgggcgcctgtagtcccagctactcaggaggctgaggcaggagaatcgcttgaacctaggaggtggaggttgcagtgagtgagcttgtgccactgcactccagcctgatgagagagcgagactgtctcaaaacacacacacacacacacacacacacacacacacacaggttgcagtgagtgagcttgtgccactgcactccagcctgatgagagagcgagactgtctcaaaacacgcacacacacacacacacacacacacacacacacacacacacacacacacccctgtcaagcaaactctgcattcttgtagtttagacagtgtattttttaccccatagaataactggcataggcagttagaattggacaattgcctggcaattgtggagttaagttagatggttataatggctggttctatgctaactgtgataataggattcatccatctctaccaaagtgagggagacttgttcaggtcccatagactgtgttggagacacatttcccaattttgtatccgtgaagcccccttctcatagatgaatgcaggcttgccagtctgctaatgttaatgttcttgatgtttctgcaaagctcagctatcattcattacattttgattctcttaattagatttttcacattataattttaacctcagtttcctgagtactttgctgtcaactctgtcctacttctaaggaagaagtctattgcctagataataggataagtaaccccaaaggtagttacttgttgaaatacaccaaagacagtgggagtgcttgtcgcctttgtgcatgaactgagtctttatttatggcaaaaggtagcaaatcctactagctattaattggaatactgaggcctggactactttgccagtcaggagagacattcagctgggtgtggtggtgcatgcctataatcccagcactttgggaggctgaggtgggaggattgcttgaggccaggagtttgagaccagcctgggcaacatagtgagaccatgtctctacaaaaaaaacttaaaaaacaaaacaaaacagaaaaaaaaaaaaaaagaggggcatttcagtatcctagaggaagattttaatgtcttctagaacagataatgtatttggtgggctctgtgcttgagcttactactgggatgtcattagctcttaaggtttttttgtttgtttgtttgtttgttttcgagatggagtcttgctctgttgcccaggctggagtgcagtggcgcgatctggactactgcaacctctgcctcctgggttcaaacgattctcctgcctcagcctcctgagtagctgggattacaggcacctgcaactatacccaactaatttttgtatttttagtagagatgggtttttgccatgttggccaggctggtcctgaactcctgacctcaggtgatctgccagcctcggcctcccaaagtgctgggattataggcgtgagccactgtgcctggcctagctcttaagttttaagttccacagaatcttctgagttaattttcctttattctcaaagttcttgagaccaaatcttgtctccataaatgtgtaaccctacatttaaacgtatcgccagtgaaattttctttaaaaagaaacatttaaaaatacttgttggaagaaatgacttgtctatactcttgatttataataaatgtataataaagtatgttccatttgtatgtggctcattattgcattatcactatagaatcttgtcactttagtagtcattattataacactgagaagcaatgtcagtatagcagagctttgtagtttgtatgcgtgcccttgattgtttacttctttttattataggagcctatggagttgtacttaaatgcagacacaaggcaagtacattatttttaaaaagaaatatctgtatatgtttaactgttttgaaactaatgtagtggtctttgcgtgtgggcatgtacaggttgagcattccttatctgaaatgcttgagaccagaaatgttttggatttttttggattttggaatatttccatatatgtaatgagataccttggggatgggacccaaggctagacacaaaattcatttatgtttcatatatacttaatacatatagcttgaaggtaattttatgcaatattttaagtttttgcctaaaacaaagtttaaatacttatatgtggaattttccacttgtggcatcatatcagtactcaaagttttggattttggagcattttggatttttgaattagggatgctcaacctgtaattaaaactctggttatgaggatgttgtttaatgaagtggaattaatatgtgaatgctgccagaaagagactacttttagataagcttgatcatggttgggtagtccttagttcttagcaatcacgtgctatttttttttttcaactgacctatgccgtgcacctcataatgacatttagatcaacagtggacagcatgtatgatggtggtcccgtaagattatgatatggtattttttgtttagataaaaaacattttcagatacacaaatacttatcattgactatggtactcagtaaggtaacatgctatacaggtttgtagccttgaaacaataggctataccatgtagcctagatgtgtagtaggctataccatctaggtttgtgtaagtacactctatgatgtttgcacagtgataaaaatcacctaatgacatatttttcagaatgtattcttgtcattaagtgatgcatgactgtataagtgaaaagctgcctaatgggaaaagagaaaaggtggtgggacaggaataagaaggcagggcagtgacagatttaatttatgttcaagtacttatgagcaaagagtttttttaaaaattatttttcatgtagacccattaacttagattgcttgatgcatttgaatccagattttgaagggtaataaggtaggtgtttggatatgagctagaacttgggataatagtgtagattatgattactggctatagttgattacccttgaacagctgtgaaatgaaccttactagaaattattttactatggtaataatcacaaattattcagagaagttatttgaagtttccatagctgttattcagttgtaagcatgttttactgggagagtaactttcagatggcaagtgttgaaactgtaacaaacattagtttaaatatttttctattatggcatacctagtctgagtatttggcttcatttgcatataatttgttaagaccaaggttttaagttttttcgtgatgtttcagaatgatataatttatgtctgtggtgattttagcaatttaacccaaaacatttaaactcttgaatctgtcgtctattgaaaataatgtatgtgtgtgtatgtatgtaaatatgcacacacataaataaagatgatactcttatatttgctttttctttcctattgtacaaaatactacctgccttttgaatttaagccttcgtgacacttaatatatttttgtgtttagatcacagatctcttacttccatgcaatggcttttgtattcttcttgaaattgggtgattgaactattttatgttaataatagttatctgaagatctctttgccattaaattttcaaaaatggttcgaatactattggttcttgattaaggatgattaagaatttaaaataataaatataataaaaataaatttagcaccttgaacaccttgttaagaaatattactgtagtttgaaattaaacaaatgaaaagctccctaataaaatgctaaatgctatacttttaatgacttgcctttagttataagtttctgaagcttaaaaaaaattcctgggtggatattacttgggagaaataggttattagtttctaagttaaatttgactttttcccgaacataaaacctccttttatacaatggctctgtttatgcaacattgcaaatggaaacttcagttcttacttctaatcttgggttttaaaactcaaagatttatgagatatgtacatatcttacatatgtacatacacatatgcatacatgtattatacgtatacatatatctgatatatattacacatcatgtacagagtccaaatgttttctcctagtcattgtcatacttcaacctgtgaccttttcctctatactttcatgtaactttaagctctccttctgccttttatataaaaatagtttattatttaaatatgttgtttttatctttctatttactcatttgttaaaatggttgtttcatatacctggttctcaaaacacacactgttagtgccagcaggatgggcccagtgtgaaagtggatgagaatggacatctctactcttaggaaaccaactctaaatgtgaactctgatttttagttactgtgtgtagggaactttgaattacaaggataaataaaccatacttttcttgcctttatatggcttatggtctgtctgaagagatagaagaatagataacttaaaaaaaaaacaagtctgtgaggttgctgcaaatgagatacatctaaaacatttctctctttgctgtccttcactacatgaggtcacacaccagctctttaagtattgtagctttctccttgcatgtgtctaaaaagatatcactggatggaaaatttaaagcataaattagtgcctatctcagagtattataaaactcttttttagaatctgcagctgtttagtcattaggcttgttatagatagtatatccttttctcagctaaaatcagaccttcaaatctataccccattatccaaaaatagagaatttgatgcttctggcaagattgatgctttagggtcaaacaaatggattattatgaaactcatattataattaaaaatgtatgtaatcttcccgattgtacttatgtaaagtaatcaggccaatatcttttgcatacctttaaaaatttagtgaaatgtttataaaaatgtataagtcaggtctgtgtgattgtttatgcataaattgggtatctttttgaaaaggttgactgggggtgtatatataattaattcttagcatgttgtatatttgaacaagtatagaagaaagtcacttttttaatctgtgtactgttgcagtaattgagagatcatgctgataaataggtgtattttgcttttgtgcatagaatatgatgttgggctgatccagaccaaagatcatacttcctaatttactgaaattaatgctgctcaatttcaaaggaaaaatatagcttttactttttttttgacagctgaacaaaattaagctgtatatatttattgtatatataataataagttgttatatatacacattgacatgcatatgaaaactcttagcagtgactaagcttctttttaggactcattatgactactcacatttgaaagatgttctaggctgggcacagtggctcacgcctgtaatcccagcaccttaggaggccaaggtgggcagatcacctgaggtgaggagttcaagatcagcctggccaacgtggtgaaacctggtctctactaaaaatacaaaaattagccgggcgtgggggcgcatgcttttagtcccagctactcgggaggctgaggcaagagagtcacttgaacctgggaggcggaggttgcagtgaaccgatatcgcaccactgcactccagcctgggtgacaagagtgaaactccatctcaaaaaaaaaaaaaaaaagatattctggtttggacctttaccctgcagatatgcatagttaattatctttttatttgtatgtgtttgttttttttgttttttggttttttttgtgacgaagtctcactctcacccaggctggaacgcagtgatgtgatcttggctcactgcagcctccacctcatgggttcaagcgattcttgtgcctcagcctcccgagtatctgggactataggcgcgcaccaacatgcccggctaatttttgtattttcagtagagacggggcttcattacgttggccaggctggtcttggactcctgacctcaagtgatctgcctgcctcggcctcccgaagtgctgggatttacaggcgtgagccaccgcgcccagcctcgtgtgtctgttttaaagtgcctgtgaaataggcatgttttgtagcatgctcttcttagcaaaaacacgaaaaggtcatgcttacaacaaggcaaggataattgaatggggttgaaataaagacattcaattagaacttgaggaaagtgggcttgtacagcttgatagagagaggctggagggtgatgctcattgagcccaggacaggaaagtggtgattcatgtaatttgtttcctgtgactatggttgacttatgagaagtttttgtttgttttgaagcagtaggtgacatatgcttttgagatagctagttatacaaagctgtgaacatccaacattggggtacagcctataagtgttcaataaataataatcttacgttagagaactgaaaatgaaggatgcagtagagagctgttgcagagtagcagggacctggtatgtgtggagggatgaaagatgatcccagggacttgaatgtggtaaactagaaaagctttggtattatttatcaggctgggaaacttaataaaagatatatgagtttggggggagaaataatgagtttggctttaataaagaataaaaatggcagcagaacataaaacctagtattaacaaatactacctattgagcatctaccacatgctagacactctactagatgtctcaaccactacaacaagataactctattcttagcctcattttacacatgaggagactgagtcttagagggtctgtgtaatagggccaaaatcatgtggctgataaattgtggaactaggctttgatctgactccagaaatagctaacttgagcatgagataggagccttctcttctcttctcttttccttccttccttcctcccttccttcctttcttctttccttctttctctctctctctctctcactgtgttgcccaggttggagtgcagtggcacaatctctgctcactgcaacctccgcttcccgggttcaaacaattcttatacctcagccttccgagtatctgggattacaggcatgagccaccaccatgcgtggctaatttttgtatttttaatagagatggggtttcaccatgttggccatgctggtcttgaactcctgacctcaagtgatcagcctcccaaagtgctgggatgacaggcgtgagccattgcgcctggcctacgtttttttttttttttttattgctaaacaattttaagaagatacttgaggaaaaagatctgtctcctcttagagaagcactcatagagaaccattgtgtgtggtttctgctcttgtcctgggttttgttgctgatccaattaattgtagaacagtgcctggaacgctgaaatagtctcacccaaattctaattctttgtattttaatattttgtatttgagattttgctagactgttgataccggaaaaactacaaatgctgctgttgtctttttttttttctaataagataggatctcgctatgttgaccaggctggtctcgaactcctggcctcaagcaatcctcccatcttggcctcccaaagtactgggattacaggcgcctggccacttgtgttgtctttttatctattaaagaaataatgggtcatgtgtcattttccatgctgatctgactttttgtttttttgagatgaagttttgctcttgtcacccaggctggagtccaatggcgctatctcggctcactgcaacctccgcctcctgggttcaagtgatctcctgcctcagcctcccaagtagctgggattacaggcatgtgccaccacactgactaattttttgtatttttagtagagacagggtctcaccatgttggtcaggctggtcttgaacccctgacctcatgtgatccacaacgcctgggcctcccaaagtgctgcaattacaggcgtgagcacctggcctgacctaacttttttagggagctagaagagttttgggcctttgcaagcctcctgtttgcctttatcctcatcatccgaatctacatttagtttattgtttgtgagttttttagtaaacagagtaagggaatggtcatgttacaattagtattacctctttctactctgaaaacttttcctcattcctcctttttacagtgattcagttcctaaatcatcgtttccccgctcacttctagaggatgaattggctggaatgcttttccagtgtaccactttcaaatccttgggattatctttcatccctcttcagggactgagttcctgctactctgcaacagctctctactacatctttcatcttcagttctctaatttaagttaacattcttatttattgaatacttatagttaactttaaagtccttttatggtaatcataaaaatataattagttcaaagaagagaacatctcttctgtactataaggtgaataatttcattaggctctgataaatgtgcttaagtgatttatactagctccttaatgccacttttcttcaaaacttcagaaacaaaaatgagtgtgaatcatttttccccccacaggcctgcaatatataggcactgatgaacaaatacctatatagtggaaactcttgagtaatttaagcatagctctttatcagttgttgaaacttcttcaaagtagtgcatggatcccagcactttgggaggccaaggcaggcagatcacctgaggtccaagagttcaagaccagcctggccaacatggtgaaaccccatctctactaaaaatacaaaaaaatttgctgggcatggtggcggacacctgtaatcccagctactcaggaggccgaggcagaattgcttgaacccgggaggcggaggttgcagtgagcggagattgggccactgcactccagcctgcgcgacagagcaagactccgtctcagaaaacaacagagtagtacgtcgtgatctatttctacataaaaagtaatccaacactgatttactgtgtaattagaagctgtagttcatattttacaatttaaaggtgtatttcatatattaaagcattttaatttaaaaaaaatcaacttttttttttgtttttaaagttacttcctatacttaaaacactgtgttctaggcatgacatcataaagtaaaattcaaccagacatctaaggaaaatctgttgaatgcctatcaaatatcaggcacttagctaggcactgactacaaaaaaaaataagatgtaatttttacttttaaggaatttaacatggataaattaacaaatataaagtcatgttttcttttcttttcttatttttttttttttttttttttttttttttttttttgtgacagagtctcgctctgtcgccaggctggagtgcagtgggacaatctcagctcactgcaacctctgcctcccgggttcaagtgattctcctgcctcagcctcccgagtagctgggactacaggtgcccgctaccatgcctggctaattttttttatttttagtagagatggcgttttaccatgttggccaggatgatctcgatctcttgacctcatgatccaccctcggcctcccagagtgctgggattataggcgtgagccatcgccccagccctaaagtcatgttttctgttgtcaggaagtttaacatatagtttgggaggtgaatttgagataagatggtagttgacatgatagtgtgaaacctttcccttttttttttttccaataaatttctccattgaagcctgccttaggaaaaattcatgtcaataataaagcgggaggggaaaagcatttcccagaaccccacatgagaactaccataaagctgggaatagaattaaggagtaacattattagctgataatggactgaatgagaatggtatagtgagaacctctgttttacctctgtgtgtcagagggcccagaatccttggtgtagtaatgatggattgtagaaccttccccaaatggcacagttgaaacttgatccaggaagcccaagtcattgccgttaagactctaccatattaggatgggcaggagaacctctcctagctgtatagatccggagttggcaaactactgcctgtgggctctattttataaataaagttttgttggaatgcagccacagtcatttaagtattttttgtgcatgcttttgcaatacaatgacggttgagtagttgtgatagagactgacccacaaagcctgaaatatttattatctgactttgtatagaaagagtttgctgacttctgatattgagcaagccctaactaggagaatattgtgggaacagcgtagtggccttagtgaaccacagtcttaatttctatttgactctttgcccttggtgctctaagagcctgaggaataaggttaataaggtgggggacttcagtgaaaattacttttccgttgatctggacttgagtaaatcctttgaatggctgggcaggaagttttgtattggttacctctttcacgtgtcaactgtcacagcagagatgtggaatttgctgggtactgggcatacagagacgcatatagtctatttaccttctgtcacatcactggcctgcatagtaccctttccacccaaagacgaatacgaagaagaaaacagtcctcattgagattgtgaaaaaattcttcagctcaagagaaggacattctcataaatatgaagagatttatgagtgtaaaatactttggagaaaaatatgtgagattcaaaggaacgtaaataagaaattaagacgaaacagttaacttttgtttcaagtgcctcttccaggcgttgtgctagctgctttattttcgtgtctctttcaatcctcacattaaccataaaagttagaaggaattatcctcctcttatgtgggggaaactggtgctcgaataggttaatttcctgaaagccatacaagtcagtagatggttgagccgggaattagtcacattttaggctccccttctttcttaaaaaaattgaggtaaaagtcacataacatgaaattaaccattttaaagtatacaagtatgtgacattgagtacattcataatgttgtgcaaccaccacctctttgaagttccaaaacattttcatcacctcaaaagaaaaccctgtactcactatttaccccccattttcccttgcccctggcaaccaccaatctgctttctgtatttacctattttggatatttcatataaatggaatcatacaaatcatacaacatgtgaccgtttgtgtttggcttctttgacctatgttttcaaagtttatccacgttgtagcatgtaacagtacttcattccattttatgcctgcatgatactgtttcgtgttgtatgaatatacctcatcgtgtttatcttttcatcagtcatggacatttgagttgtttctaccttttgtctattgtgactattactgctatgaacattcatgtacaagtgttgtttgaatttctattttcaattctctggggtatataccccaaagtagagtggaaatgccatgtttaattttttgaaaaattgcttaaactgttttccacagcagctgccctcctttacattcccaccagcaatgtatgagagttccaatttctcaacatcctcaccaactcttgtttcctcctccttctcctcctcctcattgagacaaagtctcactctgtcgcccaggctggagtgcagtgtctccctgcaacctccgcctcccaggttcgagtgattcttgtgcctcagcctcccgagtaactgggattacagttgtgcaagccaccatgcctgactaatttttgtatttttattagagatggggttttgccatgttggccaggctggtctcaaactcctggcctccagcgatccacctaccttggcctcccaaagtgttgggactataggtgtgagccaccacgcctggccaccttattattactttttaattgttgccaccctagtggatgtagtgtggtatcttattgtggttttgatttccatttccccaatgatgagtgattttgagcatcttttcatgcgcttttggtcatttgtatatcttctttggagaaatgtctattccaatccattgagcattttaaaattgggttgtctttttggttgaattgtaagagttattcatataatctgaatatagattccttatcagatatatggcttgcaaatattttctctaattttgtaggttgccttttcactttcttaatagtgtgctagatgatgtacaaggtttttaattttgatgaagtccagtttattttttcctttattgctcatatttttaaaaccattgccgaatccaatgtcatgaagatttatggctgtcttttttttaatggtacagtagtatagttttagctcttatgttaggttgttgatccattttgaattgttgtttgtacagttaaaaattgttttaatgaaattttatttttatatatttaaggcgtacaagtacagttttgttacatgggtttatttgcgtagtggatgaagtctgaggtttttgtgtaaccatacccaaataatgtacattgtacccattaagtaatttctcataacgtttgtactgtttttgtatatgttgtgagatagaggtctaacttcattcttttgcttgtggatattcagttgtcccagcacctggatttgttgaagagatcattctttccccatttactggtgctagcacccttgttgaaaatcagttggccatagacatgtgggtttgtttgtggactctcacttttattcctctgggctatgtgcctgtctttatgtcagcacttcactggttcgattactataaatttgtggtaaatattgaaattcggaagtgtgagtcttccaactttgttattctttttcaatactattttgtctatcaagggctccttgcaattctgtatgaatttgaaattttttttttcatttctgggaaaaaaagctgttgaaattttgatagagattgcagtgactctgtagattgctttgggtagtactgtcatcctaactataaattcttccaatccatgggacctttccatatatttaagtgtttaacttcttttagcaatgttttgtagttttcagtgtgctagtcttttacctcattggttagatttattcttagatgttttattcattcggatgccttttttgtttttgaggcagagtcttgctctgttgcccaggctggagctttttttttttttttttttttttttttgagacagactttcggtgtgttgcccgggctggagtgaagtgttgtgatcttggctcactgcaacctctgcctcctgggttcaagcaattctcatgcctcagcctcctgagtagctggtattacagatgtgcaccaccacgcccagctaatttttatatttttagtagagacagggttttgccatgttggccaggctggtctcaaactcttggcctcacgtaatccacccaccttggcctcccaaagtgctaggattgcaagcgtaagccaccgcacctcgctgctattttaaatgaaatagctctgttaatttcttttttaagaaattttttaaagatttttttaagctattttaaatgaaattgctgttaatttctttttaagaaatttttttaagattgtttgttgccagtgtatagaaatattatcgatttttttttttttttttttggagacagaggctctgtcacccaggctggctgtagtgcagtagtgtgatctcggctcactgcaacctctgcctcccaggttcaagccattctcctggctcagtcccccatgcagctgggattacaggtgcatgccaccacacccagctaatttttgtatttttagtagagacagagtttcaccatgttggccaggctggttttgaactccagacctcaagtgatctgcctgccttggcctcccaaagtgctgggattacaggcgtgagccaccacacccggccccagtttatttttttttattgtggtaaaatatatgtaatataaaatttgccgttttaactatttctaaggccgcagtttgacattaattgtattcacggtgttacgtaaccatcactactatgtatttgcacatttttttcattaccccaaacaggaactctctgccaattaagcaataactctctaattcccctatccccagtagttgtaacttccaacctactttctgtctctgtgatttttgcctattctagatattttatataagtggaatattacagtatttgtccttttgtgtccgatttctttcacttagcatgatgtttttaaggttcattcatgtagagtatatcagaacttcattcctttatatgactgaacaatattggaacaacatataacaatattatatggttgaaccttgaaaacatcatgttcattgtatatgtatacaacgaacaaaatgtgttgtatacatgtaattagacatcatctattaccattgagtattcgtgctgttacctgtgggttttataaatgttctttatcaggttgaggaacttgccctctatttatagtcttctcatctgccatggatatgatatgtggggggagaatgtacaccacattttgtttatccatttgtttcttcgtggacacttgagttatttatacctttggttattatgaataatgctgctatgaacattcacatacaagtatctgagtccttgttttcaattcttttgaatatatacctaggagtagcattgttgggtcatatggtaattacatgtttaatattttggggcccactggtttttgtgttttgatcttgtattatgcaactttgctgaattcgtttattagttctaatatttttgtgtgtggattctttagaattttctctgtataaggtaccatctgtgaataggggtagttctacttatccatttacaatttggacaccttttatttcttctacttgtcaaattgctctggctagaacttccagtgctttgttgaatagaagtggtgaaagtgggcatctttgtcttgttcctgatcttgagaggaggggttttagtctattaccattgagtattcatgatgttagctatgggttttaaaaatgtcctttaacaggttgaggaagttgtcctctatttctagtcttctcatctgccatggatatgatatgtgggtaaaggtaggtgggcagtttaaaatgcacagtgttatcacaaagcagctacctctttcaccaagccttcctctggtagttgtgagtttttgaatacctgcagagttgtggaaaagttgattctgatactttttgcaagctcattagttgtttttgtggagggacagagtcctagatttcccagttctgccattttcagtgctaacactctccagatatgtgttttgcacatatttccttccagtctgtggcatgtcttttcattcttacaatggtatgtttaccagagcagaagtttttaattttaatgaaatcctacttagcaattttgtctttcatggacagtccttttggtgttacatctgaaacctcattgccaaactgaaggtcacctagattttctaggttatcttctggaagttttatacatttgcattttacgtttaggtgtatgatccattttgatttagtttttgtgagacttgtaaggtctgtgtctagatcctttcttttgcatttggacatctagcaccgtttgttgaaaagattgctttccccattggattgcctgtgctcctttgtcaaagatctgctgattgtaattgtgtcgagtctattttttgtttgtttgtttgttttagagatggggtcttgctttgtcatccaggctgcaatacagtgatgcagtcatggctcactacagcttcaaactcctgggctcaagtaatcctcccatctcagtctcctaagtggttgggactataggctcatgccaccatgccctgctaatttttaaattaactaattaattatttttgagatggagtctcgctctgtcacccaggctggagtgcagtggcgcaatcttggctcactgcaacctccacatcctgggttcaagcacgtcctagtctcagcctcctgagttgcaaggactacaggtacatgccaccacgcctggctaatttttatatttttagtagagatggggtttcagcatattgatcatgctggtcttgaattcctgaccccaggtgatctacccacttcagcctcccaaagtgctgggactacaggcgtgagccaccgcgcccagcctaatttttaaattttttatagggacagggtcttgctatgttgaccaggctggctcttgagtctgtttttgtgctttattctgttccattgatgtctgtgtctatttttcaccaataccatattgtcttgattactgtagttttgtgttatcttaaaggggagtagtagtatcagtcctttcactttgtcattcttcagtattgggttggctgttttgggcctttcaatacaccctttgactttagtttgtcaatattcacagaatagcttctggggatttggattgggattgcattgaatctgcagatcaagttgagaagaactgacatcttaacaatattgagtctttttttttttttttttttttaattggagtctcactctgttgcccaggctggagtgcaatggtgcgatctcggcccactgcaacctccgcctcctgggctcaagcgcttctcctgcctcagcctcccgagtagttgggattgcaggctcccaccaccacgcctggctaatttttgtatttttagtagagctggggtttcgccatgttggtcaggctggtctcaaactcctgacctcagatgatccacccgcctgggcctcccaaagtactgggattataggcgtgagccaccgcacccggccaacaatattgagtcttataatctgtgaacacaaaatctctctccatttatttagatcatctttgattttcaacagcaatgaataatttttcacatacagatcctgcaaatattttgttaggtttataccttagcactatttttggggtgctaatataaattgtattgtgttttcaatttcaaattctagttgttctttgctggtatacaggaaagtaattgacttctgtctgttaactttgcatcctgtgaccttgctgtaattgtttagtagttccaggtttttctttttcttttttttgtttttgtagattctttgggattttctacatagacagtcatgtcatctgtgaacaaaacagttttatttctttcttcccaatttgtatatcttttctttccttttcttatcttattgtatttcttatgacttccagtacagtgttgaatatgacttatgaggtggggcatccttctgatcttaaggggaaggcgtgcagtttcttactgttaagtaccaataatgttaggttttctgtagatgttcttcatctgaggaagttcctctctatgcctagattgctgggaggtttgttttttttcttaaatcggtgacggagattgagtttcaaaaaacgcttttctgtatccagtgataagaccatgtgatttttctacttagcatggtggtggtggtatattacatggcttgattttggaatgctgaagcagcctttctttctttttttttttttgagagggagtttcactcttgttgcccaggctggagtgcaatggtgcgatctcagctcaccgcaacctccgcctcctgggttcaggcgattctcctgcctcagcctcccgagtagctgggattacaggcacctgccaccatgcctggctaattttgtatttttagtaaagatggggtttctccaagttggtcaggctggtctcgaactcccgacctcaggtgatccgcccgcctcagcctcccaaagtgctgggattacaggcgtgagccaccgcgcctggccttgaagcagcctttcatacctggtgtatagttgttttcatatattggcggatttgattcccttaatatttgttgtggatttttgcatctgtattcatgagaggtattggtctgtagtttgccttttgaaaaatatatttagcttattttggtattaggatgatactgacctcatagaatgagttaggaagtattccctctgctcctgttgtctggaagagattgtagataattggtataatttcttaaatgtttgctagaattcaccagtgaaaccatgtgagaatggagctttcttttttggaatattaataattattgatcaattttcatatacacaggcctattcagattattattttatgtgtaaattttggtaatttgtatgtttcaaggaattggtccattttatctaagttgtcaaatttttaggcatagatttatttataataatctgttattttccttttaatgtccatgtgatttggtagtgatgactcttcattcaaatctgatgtgaataatttgtgtttttttttctcttggttaatttggctagaggtttatcagctttattgatttcagagaagcagcttttgtttttactgttgattgttttcagttcattgatttctactgtaattaaaaattttttttcttctccgtgttttaggcttaagttgcccttctttcttttctttcctaaggtaaagcgtagattattgattttacgtctgttttctaataacgcacttgatgctataaacttttctctaagtgctgctttcatagtattgcacaagttttgacttgtatttttatttagtccaaaatattttaaaatttctcttcagacttctttgactcatgtgttatttagtagtttgttgtttattctctaaacattttgagattttccagctatgtttttgttactgatttctatttttattccgttgtggtatgatagcatacttagtatgatagctacaaatttattaaggtatatgttatggcccagttgtggtctatcttggtaattgttccatgtaagcttgagaagaatgtgtattctgctgttactaaagtattatataaatgtcaagtagatccagttgcttgatggtattgttcaattcatagatacccatactcattttttttttttttttttttttgcctgctgtatctatcggttactgaaaggggctgttaaagtatccaactatagtagtggatttgtctatttctgtttgcagttatatcagtattttcctcatgtattttgatgctctctagtttggtacattcatattaaggattgttatgtcttcttggagaattttgcattttgtaatgctattctttatcccaatgattttccttgttctgaaatctgctttgtctaaaatttatataactacttcaacttcctcttgattagtgttatcgtggtataactttctccatccctttacttttatcctatcccttccctccctgcctctctctctctctctctctctttctcttgctttgctttgctttctatttatttattaattatttttagatacagtcttgctctgttgcccagcctggaatacagtggcacaatcatggttcactgcagcctccgcctcctaggctcaagtgatccttctacctcagccttctgtgtagctgggactacaggtgtgcactgccatgcctggctaactttttgtattttttgtagagacagggttttgccatgttgcccaggctggtctcaaactcctgggcctcaagtgatcctcccacctcagcctcgcaaagtgctgggattacaggcatgagccaccacacctggcccattcctttatattcatttttttaaatctactctgataatttcttttaactggtgtattgaggccattcacagttaaaatgatattaatatggttgtattaatatgaaccatgtttataactgattttctatttgttgtacttactttttttttttaatcccctctttttctgccttctggttttaactgaccgttttacaggattccattttctctcctgttttagtgtctattatacttgtttttactttttttttttttcggtcattgccctagagtttgcagtgtacatttacaacttatctaagtacactttcagataactctatactgcttcttgaggagtgtaggtaacttttactagaatttttgaactcctccctccagtcccttataacgttactattattcatattgcttatccatatgctatactcagtcaataatagttactattattattttgaacagttatcaattaagaataggaaaaatagattttatcttatttattccttctccaatgctcttttctttctgtagatcccagtttcttacctatataattttgctttctctctgaataactttttaaagcatttttaaagggcaggtctactggtgacaaattcactcagcatttatctgagaaactctccttcagttttgaaggatcatttcactgagtaactttgaggtagagttttttttttctttcaacattttataaatatttcactctactttcttacttgcatggtttctgacaggacatcagaggtaattcttatccttgttctctataggtaaggtgttttttttcctctgatttctttcacaattttctccttgtgtttagttttgtgtagtttgaatatgatgtacttaggtgtagatcttttggtatttattctgcttggtgttctctgagtttcctggatatgcagtttggcacccttaattttgaaagattctttgccattattctttcaaatatttcttctcccttgtctcacttttctcttcgtattccaattacatatgttacaccttttgtaattttcccataattcttggatgttctgttttgctttttaaaaatctttattttgccgggcacggtggctcacgcctgtaatcccagcactttgggaggctgaggcaggcggatcacaaggtcaaaagatcgagaccatcctggcgaacgtggtgaaaccccgtctctactaaaaatacaaaaaaaaaattagccgggcatggtggtgcacgcctgtaatcccagctactcaggaggctgaggcaggaagaattgcttgaacctgggaggcgacagaggttgcagtgagccaagatcacaccactgcactccagccttggcgacagagtgaggctccgtctcaaaaaaaaaaaaaaaaagaaaaaaaatttcttttttcctctttccattttagttttggaagtttctactgacatatcttacagcctagtgattttttgctcagccgtgtccagtttactgtcgagtccattaaaagcattcttcatttttgttacagtgattttgatttctagcattttcttttaattcttccttagagttatgtatgcttacattacccatctgttcttgcgtgctgtctacttttcctattagagcccttaacatattaatcacagttattttaaattccctatctgataatccccaagtctgtgccatatctgagtctggttctgatgcttactttgtctctttagactatgctttttcttgctttttggcctgccttgtaatttttttaaagctggatatgatatattaggcaataggaactgaataaataggcctttagtgtaaggttatatgttaatctgtctagaagctaggtcatgtttaatgatgtaggtatagatgccagaggcttcagtttcctctagtgtctttgttattttatttttcctagtctgttgtctgtgggttctcctaagaactcctttataaatagtgagtctgtgtcttgcaactctttcagttgtaattctctgttaatgtactggagctctgttgacatgatgggaagagtatggcgaagggaagaaagtgttctataatctcattcttctgtaagacctgagtctttggctacaaccttcagaagtgtttccagccaccccttcccctccttttcttctgttagatgaaacaagaaggctagagggactgtctttggctgatttcctttctccctggacaccaaggctctggtaaattttctcttggactgttgacctttgttatgaaaaacattctggccttatttcaaaatggttactttcttcctctccctacctaaaagaagaggagatttttattagatcttacccctgggtgtatttcaaattaattttccttgtgtcttacacaaaaggggaggagttttttcttgggtcttcatagtcagaacctggtgagatttcctggaggtaaaactgcaagaacttagagggcctcctaagatttagtccccaggagttctcattcacaagctagtctcagttagcctttgtcaaaattatcatttaagttttcttactagtgtatgattccagtgccttctgctccaggtactgctgatcttggatgtgattctttgtatttgcctgtttctctagatttcaggcgattggttcaccctctgacctcaattccgtaaatccaagaaatttgctgattttcaatttgttagggttttttctttttttcttttttcttttttttttgagatggagtctcgctctgtcgcccaggccggactgcggactgcagtggcgcaatctcggctcactgcaagctctgcttcccgggttcacgccattctcctgcctcagcctcccgagtagctgggactacaggcgcctgccaccgcgcccggctaattttttgtatttttagtagagacggggtttcaccttgttagccaggatggtctcgatctcctgacctcgtgatccacccgcctcggcctcccaaagtgctgggattacaggcgtgagccaccgcgcccggccagggttttttcttaatgtaaggacaggagtgatggtatccaagcactgtatgggttgatgctgaaactggaagtcctgtttacattttaaaattggaaatatcttgtccagtttataaataatattcagcaagaggttttttaactttcctgtgaaccattttcttagctgaaatgactcattcccagttattttcatccctttgaatttcaaatctctgtattttcatatgcttagtaagaactttttcagaacaaaatatttggaaaacttaagaactttatgtagttcttgcaaatggctactaactttaccctaaagaaactagaattattacacattttgatttccttttctcccctacagcattgttttttttttttaaccttctgtaaaccatgctcaagtagttctagggattattttcttcacttatttcaccccacttatttttgaagaagaactcagttttctaaggcactttgaaatctctagagactaagcacggcttaaatttgaaaaactaatgagaataaatgtggaactcttatgctgccaatggtttattttcaattaaccttgaagaatgtagtaattataaactacagatcgtggtgactttagcttaataggattagtttgagaatctgtgtgatagaggacaatttggctaaaatgtgttatttaagcaaccgagaaagtagtgtgtgtgtactttaaagccttataatttgattactggctacaaatttgcattttggtaggctttagttcttatccttggataacagttgtaactaacctcagtcatttgagacattataaatttcgttaaccttgcttcttttttagggttcattttaagttttatttttctcactgaacgtactgtgagaaacagccattaaaccaagaaacaaattagcagtatatttaaagatcgcttattagttagcagattaatgtgtttaataaatattttcctcttttctcatttgattaaaatgaatatttgtctttgagaattaaatatatttttaaaagaattaaaatgttaaatagaatgtaattttttttgtttttctctataaatgtaattttaatatactaaataaaatgtgttttaaaatgatttgccgtactgaaaggatttggttgaaaataattaatttttgctgtgtaataatcaattagctgtggcccattttacaataagatctatttgtgtagcatgctgtgaattagagacagaaaccttttactatgcttttgcttagagacctttattataaagaagtaagggccgtagagtggaaatggataaagactagcaggtcttcaggagtggcatgcttatgagttaagcaccatgccaggttccaccacccttagcagattagtgggtggtatcagtgttgctcctcccaaaatgtttttttaagaactcttcatgtattatgacagtaccctagaagaaacccacaagaatgaacacaatgtatagtaatatagtcttaacaaaatagcttccatgtgctaacaattcaactgaagatagatggtctatgttcagtaaatacatatttaagttgggacccctattgtcagggacttgacctccaattcccagataatgagggagcagcagctcattttttgtcctgatcttactacttcatgctatctgggctggcagatacccttggaaaatgccatttcattcactaaagcttcagtaccacagtgccaggattgattgcctgttcctctctccagagattctcaggaccagccccatcattcttgacatcccttactttttgtcaccaccaaaactcactggccatctgttagcacagaatacccatccttgtgctgctctgtaggttcctcagtctgatccagtttcctccaaccctcccactggcccctagaactcttgaataatttctcccatggcctccgtcttgccccagcatcacagtgtaatctcactttctgtccctggttctctgctgctgccaaatggatgcctgagggtagcccctgctctggcatcagtctcaggctgtgctgtttcttcctttgcctactacctggtaacctcactgcctgccttttagttccttgaatacagtgaggtcttcactcttaaaaatctttgcacaggctgcttccttcatctgcagcaattttctcagtgttttgacctggccgaccctatccagtctgatctgggtgtcttcgcgttgtcctctgctggggcctcctatttgttttcttcttggcacttaattaaatttgaagttgtatattcacttgctcactgagccttttttctggattctatgatatatatttttcctcatatttctgaaattgtgatgtatcttaaactggatttcttgattcctttctgaatggtaggtaaaataatggtttatcttacaattgtcttacatttaataaaatattgcacttttaattattgtttcccccggttgattgtgagttccacacgtataggaatttcattttactcaccaatgaaccagtgcctagcacagtacctggcacctaggaggctctaaataaatagtagttgaatgaatatcattatctatttgggagattttggccctaattttctcaagatgaattagtcagtgtgtaagtatgaattgttaattcagtttctgttgttgaatcattgttttcgagattcctttattctggaattgaaagagacctttagatttgtctattttgttcctccatctatgtaacttgccctattataggtatatgtacatccttgtttagaagtacttactcaccttgcatgaaaatgaattcacataaacttctacctggtgtgagcaattttctttcattagggagaaggagcgaggaaggtaccaaacagcagcagacttttgaacttgagacagttttggctgcttgaacttaacttttttcattttacttagtcccccaatgagtgcaatcatttggcatgcctacttcactttttttaagtgaactaacagcgaacaggcaacgttggtgactggagtgcctcaggcacctcctagagaaggttcaagcttagtccccagctggaggtaaggtgtggttctcagtccttttcatttccccaatcctgctcctgagtactgcagttgagtcagcctgggataatgagcagtttgcctttcattgaacactcaacagcctggttgtgaaaatgtctgctatgaccagtctttgccaatctcccatgtatgcttctgggttctgcagataatacttgtgtctcttcccccactcttgtacctgacacacatgttctacgtgatgtgaaaagaagagaagttgaacaggcaattgggagaactcgaagttgcccaaattgatgatgtcagtgtggagatgcacttgcagggaattgaaataaagaagttcaagtgtggccttgagaaacatggaagggtgagaatcccagggagcttgctgcgaacgtgtaccattggtgtcatcttcaggcctctgtttgaggtggccttcctgatgatcccgtggtctgtctatggattcagcctaagtgtggtttacacttgcaaacgagatctttccccacattaagtggactgcttactctctcgcccccggagaaaagcaccttcatcatcttcatgctggtggtgtccttggtgtctcttgccttgaacatcattgcgttattcagtgtctcatttaagagcatttaaggatcatgtgaaggatcaggagagtgatacacctggcctgcagagtccctccaatggctccatatcaactcttcctctctccaccatgtcccctcctggggacaagctagttcctggagaaagaaacaattcctcttgctgtaggcacaacaaggaagtgagcaaaaacccttctagttacagtgcatagcaagattgaatggagcaggcaggaagtaccccctctgactcccagtcttttgatttccctgctgataaacagagttcttaaacaaaagcaaaaacctagctactgggcactagccatggtaggccagcagccatcctgcagagccagtagtcatgccagcagcagcctgatgacctagagatcaagatgcatacttggaagcattatgattctgcttgattgtttaagagaaggaagtcgcagtagaaagcgcacctttgccccagtggaggtggtactcaaaaacctcagtcgtgagacttagcagacacaaagacattagactaccagggttcctgtacaatgagaaatgctaatttgcttaatatttgatagtaaactgctgtcatttttagctttattgcatgcaatgtagacctagttcatcatattacaagttctagagagtattatttattcaatacaggttttttttttttttttttttttttttttttttgagacggagtcccactctgttgcccaggctggagtgcagtggcgtgatttccgcttactgcaacttctgcctcccggttcaagtgattctcctgcctcagcctcctgagtggctgggattatagacgtgcgccaccacccctggctaatttttgtatttttggtagagacggggtttcaccatgctggccaggctggtctcgaacttttgacctcaggtgatctgcctgcctcagcctcccaaagtgctgggattacaggcgtgagccaccgtgcctggcctcaataaagttttaagaaagcaacctgtgtgtctccctcctgagagcttctggctgcaccgatctttcctagacttttaaactcttcattggcacatcttcatttaagcaaaataggctagaatcagaattttagaaatgaaattgcagtgactacattacagaaagttttagtattaacatttttaattatatgtagcaggatcacacatatacccattactttcaaatgtgccaaaaatgtagcttttttttttttttttaactgttgtacttttcatcagaagcttcttcccaccacagggcgctggagggaaggagaagacacagacaacttaaacattaaacctgcccatccagcatcttgctgtgacagtttaaacagtctcatttggaaaactcagtctcttggctaaatttccttctcataaacccttttatgagcatgaggaataatcacagttatttactaatgaaatgtgtgtgcctattggatactacaaaactcctgaaacttttgaatcagattggacgctgctgtcctcacttcctgtttcacattcattttcacatatatcttgctttttttcccttgaacttttaatcttgagataattatagttcacatgtaggtataagaaataatagattccttatatcctttgaccagtttttcccattagtaacatcttgcataattacagtatagtatcgtaactagaaaatggacattgatgtatttccattgaccttattcagatttcaccaattttatctgcactcctgtgtgtgtatgtttagttatgtgtaatggcatcacttgtgtagattcacatgtccaccacagtcaagctacagaacggttttatcacagggatcccttgtgctgcctttttatagccacagccacactcttgccttcccctctttctaacccctggcaaccactaatgtgtacttcatctctataattttgtcatttcaagaatgctattttagtggaatgatacaatatttaaccctttgagactggctttattcactcagcacaactcccttgagattcacccaagttttttgtgtgaaccaatagtttgctcttttttattgctcttttttagtatgctgtagtatagaggtgccagagtttgtttaccttttgaaggatctttagatcatttccagttttcatttccctgtgttaggtgctcaagagtgcagttgctgggttgtatggtatgtgaatgtaatgctttgtaagaaactggtgtatacttttccagactggctgtacaattttaccttcccatcagcaatgtgtgaggaatctagtttcttcacatgcttaccggcattttgtattatcactattattatttttatgttagccattctaatagttgtgtaggtgatcccattgtagtttaaatttgtatttctctaatggctaaaaatgttgaacaccgttcctgtgcttatttggcatctgtctattttcttcagtgaagtacccgtgccatttttccaattttgaattggattgttttattattgttgagtttaagttctttatatattctggatttaaatcttttgttctatatgtttgaaaatattttctcccagattatagcttgctttttcattctcttaacaatgtctttcatggaccaaaaattttaattttgttaaggtcatttatcaattttttttttcctatggactgtgcttttggtgtcaaatctgagaaatctgcctggccctagatcctaaagattttctcctttggttgtttctaaaagttttataagcttacattttacatttaagtccatgatctattttgtcaatttttgtacaaggtgtgagataaaggccaaagttcttttttcttctcccttatggatgtctagttgctccagcaccattcattgaaaagtctattctccctccattgagttccttttgcagtgaaaaatcagttgggcagatttgtgcatctctaattctggattctctgtccctcttctagtttctagatgagactgtataagattgctgttaattcttccttaagtgttaaaattctccagcaaacctatttgagcttgcagatttcttttattggaaacttgataattataattacatattcaatttctttaataattacatgactcttaaagttgtttatttcatcttggttaacttttggtagtttgattttcaaggaaattggtccatttcttctaagttgtcaaatgtaagagtgtaaagtttgtagtgttcctttatttatttttaatgactgcaggatctgtagagatcttccttgttttgttcctgatactgatgatttttgtcttctttctttttatctttaccagtcttgctagaagtttatcaatattaattgttctttttgtggaatcagccttttgcctcattgattttctgttttcaatttcatttatttctgcttttatcatgattatttccttcttgctttgggtttattttctttttctagtcttgagagaagaatttatcttactgatttgtaaccttctctctttttaaaaaatgtatacattgaatactataaatttccctctcaatactgcttaagctgcatcccacatattttgatacatgttgtattttcattttcatcaagttctatgaaattagaatttcctttgagactacttctttgacccatggattatttagaaatgttaggtttcatttctaactatttggagattttcctgttttctttctcttactgatatttaatcggattccattgtggtcagagaaaatactctgtatgatttcagctctttaaaatttgttaaggtttgttttgtggcccaagatgtgttctgtcttggtgaatattttatgggctcttgaaagaaacatgtattctgctgctgttgggtatagtattttatatatgacaatgagaccctgttgggtttcattttcttatttttttgtcttcaggaagttttaggattccatcttatttatacagttcattagtatatcagtttgtattgtgttcttagttactgatctaggtattaaaatatacatttgtatttaccacaatctattatcagtgttttaccactcaagtgaagtgtagaaatcttactctcctttagacccttttgccctccccacttaaaaaatatatatgtcttaagtatttcttctacgtacattgagcaccacatcagatgatgttataatttataatttttgtctcaaccatcaaatctgatttatgaaactcatgagcaaaaggatagtcttatattccccaccttttatttttgtagcctgttctaatatttttttcttaaattccaagcttctttggttatcttttactttcttggttgttgttgttgttgttgttgttgttgtttgagacagggtctcattttgtcacccaggctggagggtcacccagtggtgcaatcacagctcactgtagccttgtgacttcccgggctcaagcgattctcctacctcagcctcctgagtagctgggaccacaggtgtgcaccaccacacctgactaatttttgtgtttttggtatagatagggttttgccatgttgcccaggctggtctccaactcctgggctcaagcagtccacctgcattggcctcccaaagtgctgggattacaggagtgaaccaccacgcctggctggttatcttttacttcctatttagaaaactacctttaaccattctttaagggtaagtttgctagctacttctctttgttttccttcatctgcgattgtctttatttctctttcattcctgaatggtatttttgcttgatacaggatttctgattgacaattcttttcttttcttttttcttttcttttcttttctttccccttccccttccccttcccttctttttttttgagacagagtcttactctgcctccaggctggagtgcagtggcgtgatctcggctcactgcaacctctgcctcccaggttcaagcgattctcctgcctcagcctcccgagtagctgggactacagacacgcaccaccacgcccagctaatttttgtaatttttggtatagacggggtttcaccatgttggccaggatggtcttgatctcttgacctcgtgatccacccgcctcagccttccaaagtgctgggattacaggcgtgagctaccacgcccggccgacagttcttttatttagtgcttgaaaattgtgctgtttccttttagcctctgtggttactgatgagaatacactgtcattcaaattgtttttctcctataggtaaggtgctgtttttttgttttttagttttcaaaagtttcactatgatgtgtcttggctggaattactttgggtttatcttgtttggagtttgcttagctgcatgaatctgtaggttatgtcttttgctaaatttggaacttttccgttgtgatttctttgaatgtattttcagctctactctgtttgtcccatccttctgaacctccagtgacatgaatattaggtcttttgttatagtgccacatgtctctgagtctctgttcatttttcccccatctgtttcttttctgttgttaagattggattatttctattctgtctctaagttcacagattctttcctctgttttctccattctgttgtttagtccattcactgagttttaaatttcagttatttgctttatttttcaattcataaggtttttttgttgttgttgttcgtttttgtttttttgagacagggtgtcactctatcacccaggctggagtgcagttgcacagtcattgctcactgcagccttcacctccctaggctcaggtgatcctccacctcagcctcccaagtagttgggaccacagacgcgcccagctaatttttgtttattttgtagagacaggtttcaccatgttgcccaggctcgtctccaactcctggacttaagcagtcctcctgtcttgccttcccaaagtgctgggataacaggtgtgaaccaccatgcctggcctaaagttttttttttgtatcttctattaatttgttgagagttcctatattttcttatttggttcaagtatgcttgtaattactctaaagtatttgtatgatggcagcttggaaattttttctgtgatgattctaacatctctacagtcttcgctggcacctgttagtcttttttgcatgttgagatttccctactttttagtatgatgaataattttctactgaaacctggacattttggatgttatgtcattagaatctggatcttatttaatctcctgtttttcttggccttctttgacaccccttctggaaaggaggggaatggaagttgagttttctaattccacctccattgacacccactgagaggggctccttgctgctgctttgttgggtgggaattccagctccctaggcctttgctgaccactgtggctggagggccaggagtatcttgtgaccactccccacgttggcctccactgacaccagcctggcgggggattagacatgttctcttcgcagcatttgctggcatgggtagggccccagttttcactgttttgtggctggggtagagtagttattgtctaaggtcttttgtcctgctaggctgttcttttcctggtcctttagctggagaagagaaggcttttgttggggctctttgtctgtgcccatgggctcttctgggttctttattgaagtatttttattagggttgctttaaaatctctgtcagataattccagcacctgcttcatctcagtgttaatgtctcttaattgtcttctttcattcattcaggttgtgattttcatggttcctaatatgatgatttttttttttttttgtatcctggtcattttggatattgcaagactctggatcctatttaatgtgtgttttagcaggtagccacccagttgaggtataggataagggcaaatgtgtatattcaatttccctcttggtcccattgataccacctccgcaaaagctccacttttactcacgctgcctcattgtagatgggtgaggtggatgttcagctcctcatttggccccaccaacacctccccagtgaaatcggatctcagatttgcacctgccttattgcctctgctacatcttgcagacgctaccctggccggggagtcagaggtgctacggcctgatgggcaatgaaagattagctccttggtcagcctcactgatctcatcaggcagggaattctaacagtgccgcctgctttctcgggatgtgtatgtgtaaaagagtgttttcctacttgggcctgctgaaacctcagtggggtggtgctgcagtttttccattgctgcagtttttccattttctttttggcagtaccctccctgttgcctggaatagggagggtattgccagaaagattttcagttgttagcctacccttttcctggtcttttggctgaaagaacaggtttttcttggagctattttttttttatttgtctatcggtgccaggttgaaggcttttgaagcaccttattgggcatatatgggagacaataaggaaacccaggaacttgcctctcaagtgccgaagtccctatgcagtgtgccatcttctttccatcttggcttcctatgtacgtttttgtgtcacggtcaaggatttttagtcttaaggaagaggacctggaaggagtggggctgctccatcttgaccagaatgagaagtctgtgtgtgcatgtgtttaatatataatgaaaattctaaaatctgttaacaccgttttgtataatagtaacatattttaatatttaaagaataaacaataatttattcttcaaatatactatgtatcaggcacagtgattgacccttgggtctgcagataggactgagacataatccttactttcaaatagctgatagttttgtagagttcaaagacctgtggaatcaattttaatttgccccattatactcagatggaaaccactcacaattcttttagaaataaaaacagaatctagcttcatactacctggctggtagtattgtgggagtttcctcccctctcattggttgagataagcctcctttggtttatgaggtactaggcaaatgaggaagtggtctagtgcttagtgccttgttgttactctggttacaattaaaccctttgccaggagctgccatccagtgggtagtgcttccctggccccaactctccaggctatggtgcttagtaatcagacaggtggaatctccgcaagtaccacaactgtcagaagtcctgaacacccctctctgcctcatgcagaagctgtggtcccatgatcctcccactcctggaggaaccttaactctattggatgggaagttcagctctactgcctttgtgagtctgggctttataatcataagggctgttagttctctccatgggcaggagaaactagatctcagggatacaaccccatgatctctgagttcctttggaaatttggttttgatgatttgggaatgcccaaaagtagaacatttctgaactttctccttgatggtagtgggtgataatggtgatactgtttttttaactcatgtgtgttctaagcattttacttgtatcttctcatttaatcctaatagcaacctcaggaataagtgatattattatatctgattttctccggaggaaattgaggcacagagaagttaaggaacttccctaaggccactcaggtagtaggtggtagagccaggattcaaatgcaggcagtctagctcagagctgaagttcttcttacccttctttcagcgacgtgacaacctttgagttttactttgcttttctattatttgcttgaaattaagattgatgtatctaaaataagtgttctaggcttctaaaaagtgtcacacaattaaatgttactaaagtacgtttctaattagaaaagtttttgttttctttcttattaaaccacatagatttggcaagaagagtataaaaaataaccagtaataggttacatttacaactgtttggagtatagtcctttaataatcagatttttttgttcgtttttgtaagtaggaaacaatgattttgttagaaatctctgcttttggccaagtgcagtggctcacacctgtaatcccagcactgtgggaggccaaggcgggaggattgcttgagcctatgagttagagaccagcctggtcaacatagggagaccctgtctctacaaacagtacaaaaattagccttgtgtggtggcacacagatagtagcctgtagtcccagctactcagaggataaggtgggaggatcacctgagcctggggatgtcgaggctgcagtgagccatgatcgagccactgcactcccgcctgggtgacagagtgcaactctgtctcaaataataataataataaagaaaaataaaaggaaatctctgcttttttgtttggttgcttagggctcaataaaaaatttaaccagattatttctgattatgtatatctattatatatcacattttgttatacatttgtgatcatttctattgtttttacatgtctttgtgtttaaatacaggtagtagaataactagaaggatgtgactcacacgtcattatgtaaatattatccatgccagtacatttaaattctatagggacttaattgtaaagcagttataatatagccgtgttcctctgttgagaaaagattcatactgccctttaccttgctttttcagtgaaaatgtttaagttttttcgttcatttgaaatgtagaatcaaagtttcatttacatgcatattctatgtacttggtactataatcttagagtttgttctattctttgtaaacacagaatgtgaatataaattttctgccatgttttgttaggaataatgtatctctccattaatttgcatgttttcataccattgactcttaaatttccatgaacactagcccacaatgtgatttatctgaggcagattttttttcaaattcatattgatttatcttccatgccacttgaatacattttgttgatataataagattctttgctagttctagctcaagagaaaccacaggagtgaactttagaacttccgattagttcattaaatagacatttggtaacacacctactctagtgagtcctgttggttgtttggggtaaagggtgagaagggcatgatcagtgattacagagtgaccacactccagaaaggaaaggcttattatggtggcacagaaattggggtgtactctctgccctggaggtattcatggctgtcagagcatgaaaatgtaaaaaaacaggttatccgtttgaaaactcaggtggttggttcttttaacaagataatatttgtttttactttctgccatgtttaagttacatatcttctacttcttcttttttttttttttttttttgagacagagtttccctcttgtcgcccaagctggagtgcaatggtgcaatctctgctcactgcaatctccgcctcccaggttcaaatgattcttctgtctcagcctccctagtagctgggattacaggcgcccgccaccacacctggctaatttttgtatttttagtagagatggggtttcaccatgttggccaggctggtctcggacctcctgacctcaggtgatccacctgcctcagcctcccaaagtgctggattacaggcgtgagccattgcacccaaacaagttacatatcttctttctttgcccagcatgtcccttgtctcatttcttattggtcactgtaagtttcatcagaggtatttagaacagctgaactgcctaacccatccatcacatccttttggtgggggcctttctgctaggtctcaggggcacagagttaagtgaggtacctaccctcatggatcttaatcaccgtctggctgggaagtgaggccgcatggcaaagcatagattccagtgcagttgtggtgagtggtttgctggaggtgtgaatagggtcttgggatcacgaaaagaggagtacacaaaacaagctggggggatcctgcagtgcttcctgcaggagggttttgaaggagtaaaaggagtgaactagaagtagaagggctggcttcttgtcatttcagtaaagctaaaacatcacctccttaggtactgcaccagtactctattgaattgtctgttttgttaccataatcttgttctgttatttgtttccttgttatatgtctcttccctccagaatgtaacttctttgtattcccagtgcctgttacatagtaggggcttgaaaaatgtttattggttgaataaatgaatgaatgaatgaagaatgaatgcttgaggcagagtgtgagcagataaaagcaagtgtatgtgaaggcttagttgagaaactaactgcaaatgattaggtgtgacatgagcaagggagcttttccttacaaattaggaggtaaagcatggaattagaatgttatcctgaaagcctccaggctgcatgatatgtaatgcagcattcttttcctgaattcctctgattaacagctgtgaatattttaaattttcattatgtgcaaaactgatgatcttactgaggccttttagagaatattatttaaagaggattttaactagagtgcttcagtgatgttcttgacatcaagtaaccagacacaaacattttattcaggtttacagtgttctttggctaattctcttgaaacattgaattgcttgagacttacgtgccactcttgtttcaagacaacagacaaaacttttggtagttttgtctcttcctccttttgctttagtgctcaaggtgtggtgtacattggtcatcaggccaatatgatggtgataaacagttcctcttccaggcctgtgtgataatacagtttaattgagcagacttttagttacatacgtaagataaaatgctagatacttggatgtaagacaaactagacacatgttaggaataacacttaatatcttaaggaaattgaacacttgaacaaaaggatttttagcaaagcaattttgtttttgcgcagaggggtgcctcttcggccagttgtcatgagaatatacttgaacaaagggcacgagagtttttatttttgacgcgagttttgtttttgtatttttttattggccggggttgggttgtataatttaaattaaatttggttggctaaacatttgattttttgttttttagatagggtgggcacttaaaagaaagtagaggaaagggaaggggtgtttgtaatgagctagaaagttttttttttttttaaataagggaaggaatgtgagctggtattgataacgcttggtattgaggcgtgcctgggcatttaacaaaggcaaaaaggaaaaaggagaaaaaagggagggatactatgaattaaagaataaaagattgaccagattatctgaagagaaaccttattatattttacacatagctctttgaaaaataccatgggctgctgatatatatctaatagccttctctttctctgctaagagaaagtaaatctggcattttctagttttctccacaatgtataataagatatgaggagttattacaagcttaactagatgctttgaaaatcagattttaggaaaagaaaataaaaattgttactacctatgttgaatgtatttttcacttttctctgtagatatggttatggcaaaacgctgtgacttggaacctttttcagatttcagttgtcctattctgcttccttgcctgctttgtgagcacatctatcagaaagtgtggtcacaggatttctagagataacccagcgcagtgcttgaatagggagtttctgtgtttctgttctatacgtcacagtctttcacatcttagcagtgttgtagccattgcgcacctgagcaccttgtgcctaggtagcccgaagatgttatacagaaacaaattgctgtttgctttctttgaacttcagtgttttgttaagctcgtgcctgttctaaagcagccatatctctcatgaattggaaaaaattaaaccttggtgcattggctttatttgcgattttagtattctcattttcttattttataagaaaatgtaaaattaggatattgtatttgccagaattcaagacttatagattttatatacatgcatgcacaattcatcagtgtgttgatgaataaaaacaaaacagaatcaagcatttttttattgagcactaatttattaccatttttgctctactgtctctaacgtcagcagaaggtatgagtatatacgcatgggtctggcttttgttcaggctctgagtaagcagtgagcaacttgctctgtagtagctatgctattgttaactacctgtacattgtttatacatgaataattgcaaaaattaagtatactgacttcgatggtctctacataacttactgaaacaattggtcataagaaaggcacagtcagtccctcccttgataaaggaatctctagcaagctctgtcactcattcaacagagcaatagatttttctcttcatttggaccatgcatttttatgctgatcatcagtccataattttaaactttgttttttattctgtcaatattcttgaatctttatttagcagggataatacttttggaatacctgatgatgtatctttggtcaataaattggtttttgtcttctgatcttttcttttatcatgtccccaggaaagagagcaggatgaatgccactttgtagggtaaattccttgagtattaaaggagaaatgaaggacagcccattcaagtgtcaaaggaatgtgggaagaacaggcagagttagagcaggcaggtggtcaggtatatatttcttgtcattccccgcccccatcaccttagggaactgaaattcaaggtttagggggtgggtaggttgaaggtaagccaaaagtgaaggaagcttatgccccatccccctcttgtaactcagggaagaaacagtctttcaaggctgctttaacacaatgtaagcagccacagcagaagaaaatgtagcatgctgtggttaggtaaagaggactgccaggcctcctttagctggtgagtggcttctgaggaatcccaaagttacttcacactccaggtagctgggttgagagccagtgaacctgtcagtgggaaagatgtgttgaggggcaagctgatacccacgctgtagctgacagccacgctgtagctgacactgattgagctaggtcttgggtgtaaatgagattaaggagtctagatgtcttcggcaccaattagagacagatcaactggggtagatccctgggctctgggccaagagagcacacctgagtctacagcctccttgagctccaacagcagcctcaggccagtgtctggggtccacgcgtataaggaaccttgtcttggagacctgagaacctctaccttactacggtgaagttctgtaaccccacccacatccatacccacagctgccatcttggtagaagcagggagaaaatggaaaaacttaacatttacctgaacaagactataaaccagaagggactgcactaccatataatgcaagttaaagtcaagtgtgggggcttgaaaagcaaggttaaaacagttacagaaaatttaaaagctacattttcttggcacgggttaaatttagtgagctataaattactgttcctgccgcagcaagatagtctttgaggatatatttcctgcatttaaatttaaattttgtattcttcattcacagtggaacatagcttttaagtccaatgattatctgaggtttagattgcctgcagttggcatgcctaatgccatcttggtctcagttacttgatcactagaagtgaaattttcattttctcgcctcagtgttataaaataaggacaaaatgaaatagtaacacaattgcacaataactgcagtatagacgtgatggttaatactaaactgaaaggctgtctgacaggcatcactgccatgtagtcttcaaaattctcattcatttgcagacaatttggtgtgaatttggtgtagacaaggtggtttgagggtatctacatataatgtttgaagatgtgggttttaaataaaaatgagatgcatctcaaattttatatgatctataagtatggagctagactgttttgaaagttcacctttctctctttccattgaaaattgttggtattttctgccagagggattaaggaaaattgttctctgaatgtctcatttttcattttgataactatattttactttttgaacattttattaattaccgaatctataatatgaacatagggtagtaaatttatattagtcctggaactatgaggtaaattatttttaagtgattcatcttgaattacccacttatatacaataagatgtacccatttttagtgtatagttctgtgtaaactagccctcttagttcattctttggcattatcagccagcgtcccttcaggctgatactataatagttacaatggagcatattacaagtacttacaaaggatttctggatatgtgggtttgtttgcatttatcaattaagtggtccaaggcttttaatatggttttgttctcacatttgcggcactcaaatatcagccatccaaggtggccccaagtctcatagccttactagataccttgacattattattattattattattattattattattattattattatttgagacagagtctcactgttgctcaggctggagcacagttgcagcgtctcggctcactgcagcctcaaccttcctggcccaaaggatcctcctacctcagcctcccaggtagctgggactataggtgtgcaccaccacacccagctaatcttttgtagtgtgtgtgtgtgcagagacagggtttcaccatgttgcccaggctagtattgaactcctgggctcaagcgatttgcctgcctcggcctccaaaagtgctgagattataggcgtgagccaccacacccttccgaaactttctaaagcatagaaaagcagatctaatatgtctcctagggaatctgtccttaaaaaaaccgaaatgtggccagcttacgactgtaatcccagcactttgggaggccgaggcgggtggatcacaaggtcaggagtttgagacaagcctggccaacatggtgaaaccccgtctctactaaaaatacaaaaattagccgggcatggtggcgtgtgcctgtaatctcagctactcaggaggctgaggcaagagaattgcttgaacctgggaggcggaggttgcagtgagccgagattgtgccattgcactccagcctgggcaacagagtgagactccgtctcaaaaaaaaaaaaaaaagaaagaaagaaagaaagaaaaaacccaaaatgtatatatttgcattctgtgttcttggctggttggtttttccttatgtaccaaggaatgtctttttcttttaaaattatgggaggaaaaagtgttaggctatggtagaattagtaactgatatccaaagagaagaatgagccaggccaacaggatatatgttttacattggcaacacaatacagtaagatgtttggactagctgttctccttttttgctgagcacattttggaccagttgcatttatttctcaactacaagcttgcagtctagtagtagagtcagaccttgatcaagtgatcatgtaaatctgtaaaggtggaactttaatgcaagttataaagaagaggcgcttgctgagagaacaccacagggccttcagatctcatcgaggagccgtgggaaggctcctctgaggaagtgaggattgattgagccaggatctgggggatgagagagggttgagtgggcaagggagggcaaagcttgcaagaacaaagggaatagaccctaaggcagtagagaacatggcaaggagagatgtgactcagcaagcaaaggagacctagggagaggaggtggaagagctacctggcctgccatgtggagcagctgcgacggagttgtcaggttagtggagttagggagaattttaaggggaatggtggagcttgaaatcagatttcctttcccaaggaagaacctggttgctgaggggatgaacatatcagaagggctgtggcagtactgaaggtgaaagtaccaaaggcttgaccaggggtaggaggagcattcaggtacaggacagtggacccatttgaaaacaatgtaggaggcaaaacccaacagcacttagtgatagactggatggatttggtggtgcagacaagggagatgtcaacagtgatcccaaatttctggctagtgtttactgagatatatgggacaggagacaggcccaggttttgtaggggaagatgcagaaatggttaggcattctgtctgaatattttacactcatacattctcattttacatctcaataaaagattcatggagggcagatccagcgcagagatggtagaagagattttatgtcttattggaaataatgagaaaacagagttgttgtgttggaaatttatcactgacttggcttgaaggcagttgtgtgtgtgtgcgtgtgtgtgtgtgtgtgtgtgtgtgtgtgtgtgtgtgttttggagacagagtctcactctgtctgcccggtggctggagtgcagtggcgtgatcttggctcactgcaacctccgcctcctggattcaagcgattctcacgtctcagcctcccgagtagctgggactacaggcgtgtgctaccacgctgggctaatttttttgtatttttagtagagatggggttttaccatgttggccaggctgttctcgaactcctaacctcaagtgatccgcctggaaggcagtcattatctgtacaaagtctctttgtgagatcccacttcccatgtcttcctttttggctacctgctgtctcatgttcttgataaagtattagtattttcataagactatcctctttttagaaacggtacatgaagtaaatacacagtttttcttgtaatgctttctaaattataagagttttcttaaagtactcttagcgtaccatttaattctaattttgagcaggttagagtttacatcaatgtttcctgtaataatagctccatcatgtcaaccttaataggcagttttgccaggtatttatatatatatatttttttttttctattatacttttaagttctagggtacatgtgcacaatgtgcaggtttgttacatatgtatacatgtgccatgttggtgtgctgtacccattaactcgtcatttacattaggtatatctcctaatgctatccctcccccttccccccatcccatgacaggccccggtgtgtgatgttcccctccctgtgtccaagtgttctcattttgccaggtattggtatagacttggtgggactccgctaaattgtttttggcctaatgaaaaccattcctgaaatttttaggaaaaaaaaaaaggatatatgttttcagtataccttttggtatatttcactgtctttttttttttttttttgtgagacagagtctcactctgtcgcccaggctggagtacagtggcgtgatctcagctcagtgcaacctccaccttgcgggttcaagtaattcttctgcctcagcctcccaagtagctgggattacaggccctcaccaccacgccaggctaatttttgtatttttagtagagatgaggttttgccatgttggccaggctggtctcgaactcctgacctcaggtgatccgtccgcttcggcctcccaaagtgctgggattacaggcatgagccactgcgcctggccatttcacggtataatattttaatggaaccgtattacaaaagttattataaaactaatcattgttttataaaaatgagtgtagacattttagtgttgtgataattttaataatttttggagaatggatcttttaatcttctttttcaattaaaattttctttcatagcatattaatcttttcagtaaagctttacctgatctcttcaacaagtgatcattctcaaatttttttttattatcatactttaagttctggggtacatgtgcataacgcgtaggtttgttacgtaggtatacacgtgccatggcattctcacatttttaagggggaatgtttgtacggaaataccacaaaatggttaaaatgaataaactcgagcagagtttcttacccttagcacttttgacatttggggctaggactgttgtagggactgtcccgtgcattgtaggatgtttagtggcactcttggtctctactcactcgatcccagtagcgcccccagcctatgtgacaaccgaaagtgtccccagatgtcttggggggagcacagtcaccccccaagggagaactattgaactagatttagtttttaatgtcagatacagattgtattttttttaagtgtttgaaaaaagatacatgcaatagcatatgctagttacatgatttttagtgcacaaaacgatacaatttatgggcagattcattcgtagtgataaaaatgtgtgggaatgatactatcaacttcaggatagaaattacctctgggtagagggaatgggaatgaatgaagttttatttttggcattttacatttcaaaaggcaggagatccacagcaaataagccaaaatattatcaactgttaaatctgaaggggatatacatttttttctgtatatttgcatgatcttttttgaactcctgtggcatatcatataacacttgttatactttttagcttttgtcatgcatttttaacttactgtcatgcgttattacataccaggttgtagacttctatgtatataagacagcttcatttactcactcatgtcaaacacaggatacaaaagaaaaccttacataaagcagaggtccaataaacatttgttagttgactgattgaaacgctctttttctttggtatagattttttgtgtgtgtgatttggtctgaagtattgaaatttagcagtaaatctaacttttagtattgacaagctatggtagttttcaaataacaaataatataagtcaagatctctaaggaatttcctggagaaatctagcttttatcactgaatatcatggatggtattttatatttctatagtacttggcaaatgcatattagctctgacctgctatagaatgtatcctgtgcttgaatttcctcccattttataattttacttataatgtaaaaataaatacttttggactaagttattttggaaggtttctacacagtaaaaaagataaagatggaagtaatgaaatacttgcctgtacttttcagtgtataaatattataacatattattagaaaactattttgaaatgttcattggtgctaacatttctcttcagtgatgtgtgtgtgtgtgtgtgtttcagaatcactttctacaacaaaatttacatacacatggcttgcaaagacagtatagcatgattatggttgagaaatggcattcagaatcagtcttcctgggtttaaaatctcagctctgctacatcttagctgtgtgatcatgggacaaattatggaacttcattaaaactcagtatcctcatctgtaaaatgagcatgagatctcctcagaatgatgatttgagaattaagtgagataatccacgggaagcacttagggtggggcttggtgcaagagtacttaaaaacaataacttaaaatgaagcttactttttctgggaccatactggtctataaagtagtagtttcccagcctggccaacatggcgaaaccctgtctctactaaaaatacagaaattagctgggcgtggtggcgtgtgcctacaatcccaactactcagaagactgaggcaggagaatcgcttgaatctgggaggcggaggttgaagtgagccgagaccacgccactgcactccagcctgggaaacagagcaagactccgtctcaaaaaaaaaaaaaaaaaaaaaaaagtatcagtttcacttgatcttagccagaaggctgagaagcgataaagtagtaatttctgtgtttgtagggttttacttatgctcagggagcagacaggatatttgcaaataaaacgtgaacagaaatatttaaaatactttagttatgaagttatattccctgctatttggatgatgaaatgaagaatttctcccaagaaagcacttcctcagagagcaattagaaaatgaattgtagactatagatggccctccgtatcagcaggttccacatcgatgaattcaaccatctgaggatcgaaaatattcagaaaagcagacaaacaaaaacaactaaaaatacaacaataaaaaatacaaataaaaataacagtattacaactatttatttgcatggcatttacattgtactaggtagtataagtaatcaaaagataatttaaagtatataggcgaatgtgcataggttatatgcaaatactgtgccattttatgtcagggatgagcatccatggattttggtatcctcggggatcctggaaccagtggccccctctatatcctcgtagatactgaggaataactgttataaccttttgaaatggcttaatccgtgaatagtagaataaaagagtattttattctgttctgtttcatgatacctgttggatattttaacttagcaaaacatttgaaaaataatgactcctgcgacttccttatacagtatatgatcagtttaaagacttcactgttccagagcataattaagttatataactgcattttaaaatgacttagtaaattgtatggctgttaataccaattagttgctttgccagaatcttaagtaaggcacaattaatactgggaataaaacaatgacccagagctttagacagtcagcaacgcaagtgagttgatgattataagtctgtctagtatgattctctagtgattgaggcttgatttttatggggtagagatcttgagaatattgaaggaactgtaggctctccagatatttgtatttgttagtactcataacatttattttttattctctttctgattttttttttccagctggggaaatttattctgggaaatgtgaaatgccttgatatagtttgtttactcatggagacagtagtacaattcaggaacctttatctaaagttacctagtctctctgtttgtgttccaaagtacataatacaattctaattttaaggtagaattaagggtgaggcatggaattatcattaataaattactgatatatttgatcacattcttagtttattgcttaagatgtcggcttttaaatacttcatattttaaataaagacactgaaacaagtaacaaactatgcctatcttgctaactacagctggtgacattctgttgcagacgttgtgggggcaatggtatgcttttatgaataaattaaattcaaaacaagtttttcagagttattttttgtatgtttttctctttgtctacacctttattatatatcgcatctcagggtggtggtagaataagtaataaagcttggcgtgttacttcctacctctccattaaatacccacgaagatgttaaatacccatgaagttctgcagattaagaaactaaacatcgaagattgctagcaaagtccagggagaattaattttattagcaggactgggttgaaaacatagtcttgaacatcatgctgttcatcctactttgtgaacccaaatcaggccagatatccaaagggagtaggaaatgccttggacccatgctcacaggaactgaaaaataagcaaccatctcactgaggttaactataatctgacactgctagagctggagttctcactcccctactagcctgcattaacatctgcatttccagatctttgcagagactaaaatgtcctaaatatagtaagggaagaagcaaagaaggattggaaaaagcatgtaccatcctaggattcggagtccccgtggcaaagtgtggtgaaggtaaagggaagggaacaggctgtgcttggaaatgtggtctccagaatgccacgaggtaaacagctaatgaatggcatgtgctcttctggcttactcagagaaccctgcccaggcagtttagtctcagaccagccaaccccaatgagaaggatgtgtgctagcaagccaggttctaaaatcaggctggggtgcatcagttcatatttgaagttcaagttgaggccaaatgccagtcctggtggatctctttccatcttagtaaggatgaggttttttgttttgttttgttttgttttttgggagatggagtctcgctctgtcatcacgctggagtgcagtggcgtggtctcggctcactgcaacctctgcctcctgggttccagcgattctcctgcctcagcctcccaagtagctgggattataggcacgcgccaccatgccgggctaatttttgtatttgtagtagagatggggtttcaccatgttggccaggctggtcttgaactcatgacctcgtgatccgcccacctcggcctctcagagtgctgggattacaggcatgagccactgcacctggccgtaaggatgagttttaaagggtggagcagagaatacactgaaaagatatgggaagagaaaacatggctgtgaagatttacaagcaacacatggttctgaaaatgaccttttctttttttttttttttctttttattattattatactttaagttttagggtacatgtgcacaatgtgcaggttagttacatatgtatacatgtgccatgctggtgtgctgcgcccattaactcgtcatttagcattaggtatatctcctaatgctatcccttccccctccccccaccccacaacagtccccagagtgtgatgttccccttcctgtgtccatgtgttctcattgttcagttcccatctatgagtgagaacatgcggtgtttggttttttgttcttgcgatagtttgctgagaatgatggtttccagcttcatccatgtccctacaaaggacatgaactcatccttttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatttatagtcctttgggtatatgcccagtaatggatggctgggtcaaatggtatttctagttctagatccctaaggaatcgccacactaacttccacaatggttgaactagtttacagtcccaccaacagtgtaaaagtgttcctatttctccacatcctctccagcacctgttgtttcctgactttttaacaattgccaaaaatgaccttttctaacaaaccaataaagttaaggcatctgcttagtctcccaaaagaaagccaggaagatatgacctctacagagagtgaataagctaaaacaaggcaaaaaatgcagaagttggctgagataaggacaagtgaaagaagcctaaaatggataaaacaaaattgtttagcactttcgaactgattaatgttcgtttactaaatgtttattgaacacctactatgtgcctgctattctaggtgctgatgatgcaattgtgaactttgcatactaagtacaaaaacttagtacaagactaagcaattatgaaagatccaacctagaagttgtaaggtttgtggtggaaaataatagaaaaataggagtaggaacaacgtttaaggttgctataagaagactttcctaatttcattgatttccaggtattattgattcaaaaaatacacacacacacacacacacacactcctctaaatatattccaaataatttaaaatttttatttcaaagaaaaggaaaagtcctaacagtatttaggcagaaaaaaagaagtgatctatattggaacaaaatccaaataggcctcatacttcttttctactacaaataccagagactgtcaggtcattgttccccatttgatgccttatgtgatagtattataatttctttatgttagaaaatggcagcccttctttttagacccttaattttcttcttcttggaaaaatatcctagtatatagattttgttacaagaagacactttattcctacctgcattaagttgctttaataagcatacagactctggtgtctgtgatgtgaatggcattttccagggctttatggtgcacttaagcttccagtgactctgaagaataaaaggttgccttcccaagaattctgtgcctatcaagttgccatgtatacgtgaagatgttcaaaaatgcaaagacttgaaaaataggacactttgtcagaaaacctttcaaagatgtgctctggctgagctaaacatgaatgcaaatcaatcactcaaatatgtataaaccatacaagaaaaggactggtggtaaacagtgaaggaaactgaatatgtaaaaaaaaaaaaaattatagctcatgtatctataattacaaattaaattcaacagtcaaaccctcctctcaaaaataaatatatttaacaaaatggtataagaagaatcagtgtcaataacctcagattaatttaaaacagtttaaggtcacaatactttaaaaactggttctgacataagaacaaatcagtagcctatactagactaggctagagtccactagaaatctctgaaagcacatctagtatctatatgtgaggatgctaagatgtaacaactaaaaatttctggtaaagggtattgggaaaattgatttagtgtttagaaattatattaaatctggattccctcaacatgtcatatattaaaataaattacaagtgaataaagatttaaggaaagaaataattaaaatatcaagatacataaatgcagatgaatattaaccatgctcaggctaagtaaggactttgagcacaaaagtaatggacataattacaaaggcctatatcagtaaacttgactatgtaataatttatattcaacaacaacaaaactctagtgatcacaacaatctggggaaaagatttgtaacagaatttgtcaacaagttctcatccatgaatcaacaagaaaatattaaccctagtggacccgatttcacttattaaaagaaagcttctctaatctcattgaatgccagagaggtttttttaaatgattttattttgctttggcagtgggtgtagagtaaatattcttatacactgctgaagggaactgtgacatgactttttttggatgtcagtttgtcattatatattgggagcctttaacattcataccctttgaaccaattatatcacttatagaatttactctgtggaaataaagatgcagatgttgaagtatgttcattaatagacttgttaaatagccatccatgaaaaatggtggttttaaaaataacagcttgaaatgttgcttacataatatcaagtgaaataaaaacaacatacaataagatgtccaatattactactaccatttgagaaaaatttactggaagaaaatataccaaaatattaacaagggttaattttgtaaatgtcttctctatatcctttttgtaccctttgtattctttttgtgttttctgtaatgagtttatattatttttataagcagtttgaatacatgtgaaatgttaaattctttccagtatcttctcttaattgcatgtgtttttcactaaacactgaattggtttaatgtagaaaacttcatctgttcgatttcattctttaagtaaatacataaaccatatcgggggaggcagagaaagtgagttttgaggagagaggattttcatggtattcttgaaaggataaataaaagaatacacattttatttgacccccattagccatctgctttatacagtaaattgtgtttatgagatgccagagaaaaataactaatgaatttattcaaggtggtataaatgtgccagttacaaatttaaatttgtagtcatatcagtggacagttttgaactgagtaagatcttttataaaatcagacaaagttttaacgcttaggatgcaatgaaagaaatgtatgtgggagtctttcagttagaatagaatataagatggaacactacctggaacaatattcatttgagatgtgcgcagtttttctctattcctggaagctacatctttgttctgtgagaaaagcaagaggaggttcctgatatggtctgtcctttcagttatgctgtaggtagattgctagctagagccatttgaaaaggagcagggtaagaacatgatatcaatgtattatgggagagtagcatacatgaaagagtcacctttgtactacgtgggataatattccagctgataatctcctgcattacttaaaattggcagttcttccttcccaataataaaatacctggaagaaggagtttctttaagtcagaagatccattaatgtacaaataagttgtaccctatacatacaagtaagttgtctctaccctacaatcctgttccttcattaaaaacaaaaacacagtacctttaagaagtatctttttcctccataatttatagcacttgcctggtattgtgtttaattttaaagtttttgttttgatgcagggacaacgttttattaaatattaaaagatttgatctgaaagtgtccccacttaaagtaaaaaagaacaggcctgagtcattcagaaggcttttatatgacatgttggctttgaagaatttgtattaattattttgccaaaagcttttttattccttttatagaccagaattgaataaaaattgtttagtttagtggtacttagttcttagcatttccatttcctttccagcccttgttttctttcctcccaaccaaaaacaacaaaaaagattttcatattttcttttaaagcagaattctgttatttcttctgttcagaagagataagggcaggacgaaggtgatgattggtatttggtgatggaatgtttatctcactttggatttgcagtggccatcaataggggcgagctggtgaaaattagatatgcttgttagcattctgctaccagcaactactgtgtattggagaggccctttcttggtcttagaaggccaattaaaatgtgtctctggacttcagagggcagtacagatgacagtctgacactcatcctggcacttttgagtatcctcaagacattgacactaatgatttatgagttacgcatattctgtcaccatatctgctctttgctccacaccctctccctttctcctttcccttccttgacaatgtttgtggggtgataagaaagagattttggaaccaagaaatgagaggtggcgggggagaggaagatgatatatttttaacactctggcttcttgctactctgtcccagaatatacccccaggcaactggaatccccagtcggaaaaacactggagaatgactttccttctgcttcttttcccttgcaggaaacacatgaaattgtggcgatcaagaaattcaaggacagtgaaggtagatatatatatatatatatatatatctgtatatatgtatttttccttctgtataaagtttttatacatagagtgtggaagaagtgggatctagctggtcagacactgtctattcctgatattttgaagtcacaatctcagaaagtgaatatagcttatttcttatgctttgctttcaaacatttagttccttttatgtgaatcttttcaaatctcatgatattagaaaattcatctttttattttaaggttgcaagcagcattggaaatcttgctccaaaggctggttagaaggcatgttgtttatgctgtttctaaatattattaaaataaaaaaactggcttcaagtaaatacttctgtgggtccacataaatagcaagtactacatgaaagatttcagtattggttacggtgatctccagctcctagtcagagttagaaatacaaggatatattgagggattgattttatatttagaataatgcattgagagaataaaagctttttaagaagaaatactatgcttaggggccttcatcacatccagaccatttcagacagagttgtaaaattaccccatgctgggcaagaaagtttaaaataatgcatttcagtagttcattagttttaaaatctagactgttggccatccaaagatagccaaatagagaaactgataacaaaaataggtatggcctttaaggtgctctagacaacatttttttcagactttttggactgagacccacagtagaaatatatttcatatcctaacccagtgtccgcacacatatgtaacactatatgtaaatgaagcaaaaatgtcacgaacttcatcttatgaatgtgaagctctctactttctgttctttcctgttcatgtaaatgcctattgtgacatcaaatggattgatttcactactagtaagtcagagcctgctatttgaaaaactatggtctaagagtaagaagtaccaacacagcatcaatcttcatatctaattagaagtgtggaaatagcagtcatagcttaccttcatcagcacacatcccctaagtgatgtaagacaccagcctctatatttatgaacagtttcatcaccctcacctcaaagacttagcaaacattaaataacaaaaagggacttgctccaggatagatgtagtagtatttgatgtaatccatctctgatgtgctagttatatgaaacacatgcatatcagctgggaactttagcagtcattgtatgggcaggcttaaagggaaggtaaaaagtggaaggtaaaaaagaactttttgcttgttctggggggacaaaaaaatcttgcttcaaatgggatatttgtggtctagcaggaagcagtagctccaggctatcccactgtgataccattggaaatgagctctttgagcagtgactttgggtcagcaggtggctgagagacaaatggtgatttcctaaaaagaatggttgcaacagtagatcaaagcacaaccttcgcatgcatgtaaaggcttctggctgtgcattcatctttcagggcatattggcaagcatcagttaccaccaaaaataataactgtcatcaaattttgtaaaaagtacaatctaggccatgtatgccacctttttttgtttatgagacagggtctcacactgtcacccaggctggagtgcagtggcgcaatcttggctcactgcaacctccactccccgggctcaagtgattctacagccacagcctcctgagtagctgggattacaggtgtgcgccaccatgcccagctaattttttgtattttatttgtagagacagggtttcgccatgttgcccaggctggtctcaaactgctgagctcaaagtgatccgcctgccttggcctcccaaagtactgggattacaggcgtgagccaccttgtccagccccattactttctttttaagtaaataccatgttctttataatctctgtcttgtgcataccaattcttagcttcaattatatatttttacctgtgttaatgatacctttagagtggaaatctagtgtatccgttgaaattcattgagcactgagtgaagtgctgtaagagttgaggtgtggatactttcaagaagcatatgacctattaggagaattaagacctgcaaataaataacaataaaacacagtagaaaacagttattgcctgaatggagacatggaacttggatcattttgaggtgagagaaactgtttctggacgtggtattgggagttcatgaatagtctagacgtggaagacatttgatctgcccttattttattgaaccaacaaaacattaatctgctctgccctcatctctgccagacccttatcactcaccatccctcagaggcatgcagccttatcacccaccccaccttgtcaatgacacctacgtaccacctacacatacttctagagggatacttccaaaacatttctgtgctagaacccaaaaacataaccaattattcataaactttttcattccagtctggcccacttacctactgtttacatttctcccagggagatactagtactctcttttttctgtctttacccttttcctctggctggagtagtgtcttgcttaatggaaaaaagggtacatgtttggtgaacaactcttttggagtgtgaagtgtatatagatagtctcattcaggtaaggatgtctattcaacccctgggtaaaccatttaattctcaatcagtttattaaattttagccaattataataaaaaacagtgtcgtgataatattgccctcattgtcatgtagctctcattaatcccctttattagttattcttgaaatattcatttgatattatggcagtgattatctagatctaatgtttaaaagtcttagtgaagataacgaaataatcctgtaaaaatattgttaactgaaataggatctgcacttggtctgagccatgttcaaggtaatccagtgcagatgctccttgacttgtgatgaggccacatcccagtaacccatcataagtggaaaaaattgttacgtacaaaatgctttggctgggtgtggtggctcacacttgtaatcccagcactttgggaagccgaggcaggaggattgcttgagccaggagtttgagaccagcctgggcaacatggcgagaccctgtttctacaaaaaatttttaaaaaaattagccaggcatggtggtgtgtgcctgtaatcctagctactcagtaggctgatgtaggaggctcgcttgagcccagaaggttgaggctgcagtgagccgtgatcatgccactgcactccagcctaggcaacagagtgagactctgtctccaaaaaaaggctttactacacccaacttaccacacatcatagctttagcctagcctcctttaaacatgctcagaacacttatgttagcctatagttgggcaaaatcatataacaaagcctattttatagtaaggtgttgaatatctcatgtaatttattgaatactgtagtgaaagtgaaaaccagaatgattttatgggtattcaaagtatggtttctcatgaacgcatatggctttcatgccattataaagtcaaaaaatcgaagtcaaaccattgtaagtcgggaccatctattctctcactgatatcacggaatattttgtgagaatatatgttaatttctggtagctttaaaagattatgctaatgtcctactttcttgttaaattcatatatattcacaaatttataaaaaatgtttgtgaaactatattttgttagactactatttagttcaagaagtctttattatcccaggatgatagatcactatttaaaatgggaatcaaaatttcatagtaaataaaagtttattttgggactttaagtggataaaatgaaactaaaattatgaaaataagtttatagttaacacaagttaggttatagtagtaactaatatgctatttcaagaaagaatgaagtgttaacctttttgggaggaggaacagtttttacagtaaaattgtaggctaggccaatgaatagcttctatagtaaagagggtcattaagaaatatacaaaaagctttgtcagttttctcttcttcttcttcttctttttttattcctgtctatgtgtcttctttttcaggctgtgtgtgtgtgacagggtcttgctttgtatcccagggtagagtacagtagcatggtcatggctcagtgcagccttgaactcctgggctcaagcagtcttcctgtctcagcctcccaaagtagctgggactacaggtgcgcaccaccactcccagctaattttttcattttttgtagaggcaaggtctcgctatgttgctcaggctggtctcaaactcctgggatcaagagatcctcctgcctcagcctcccaaaatgctgcgattacaggcatgagccaccaagccttgccttttcgaggtttttattttctagttgttagcagatacaattctatcagacaatttatcagtgtctttgcctgtgattctctctgaaagactttgacaccctgacttggggatatagactcctattaaaaaggaagaatgtttgagtaatgaaaaattttgtctgagcttacttcattagttaattttttcttgttttgatgacttctgtttgttgacccttcataaatttggagtctgtgataatgagttctttaagataaccctaaatgatggtattataagtttggctattaagttcctgcagagaaattttatctagtaaacacctgaccaaccagaagtctccattgtattcgttctgctcattgtaatagttctgctcattatttggattttctgagaagggaaaaaatgaccatagatcataaagatactagagattatttagttaaaaggtacttttcagactatgtataaattataaatttagtccagttcttctaccctttctatgactcccatcttctacagtgagatttgatgttcagatgataatgtatcactgttgttttgtcaagacaagtacaagtgtctgctgtcctcaatttattaaataacccaagagcgctgatttagattatatagctttggaccagcaagaattcaaaatattgtctgtccagcctttactttaggaaaacctattgtctagaatttatttttgacatacatttggaccttctttttgcttctttagacttttccatctttccttaaatgtaaggtgatggagtgaggggagagcctctctgcttgtcactgggcctctgtgcatggcaaggaggctgactccagggagctatacactagtctacatttaagatgaaacttaggttgtgtctctgcttttatataaaataaaattacttgcatttcgtattctgctgaatgttttctatagagaactattttcctcttggaatggacatattcttcttaattattagaaaacatttaattgatcatctgttctgtcttctaatttattttattcttctgtttacccagacactggaaagctctatactgatctctggatcaggagtactctggtctcttattttatataatggtacaaaaccagagttcgtaatctggagtccttaaattcaagagcctgatttctgtgtgaaagaggccttgaaacaaaaagtccaacccttgattaaacaaataatttgattaactgagcttgagcattctggctagtcatgattttaccacacttccttttcatgttcaacatggacctccttcagacttcagggattcttctaggatttggtgatcattttgcatcttctgtgatttaataaatttctactgtgcttttacctgttcttcatctctaaagattggagggtcctcatctttcttggtgtatgtaacagtagcactagcattcaaactccctcagccacattgtctgtctattgatgtcccttcttcaataagagcaaccagactcaaatatggtacccccgtggttttgatcaaggatgggttgatttttctttatcagtttatctgtgtaaaggtccatttggggtggggggctctttggctatacaaaaatgtcaggtttgtgatttcacaaagtaggttacagctattcctggatttcctttctaagcccacagttctttaaaaatagagttacaatagagtttctgctcatctttagatttttctcttttcatcagttatctttgaatctcctttgctcctgtgatctttcttcttaagaattgttctctttagcaaatcgctcttgatttttaggtgtgttaacttgccttactggtaagtttagaagtaggacagtttttgggttgtttttacttaacatcctttttccaccctgccattttgtcctcactcagtggggtttctatatatctgcacataactttgtcagagttgatcctgcattcagctaaaccccctcagtggtaactgatgacaagatgggtcagcatgcacataagcagttatcacatagaagtatggactcgggaagagtccttctgaataatccagtataactcagccccagtatacagatgatggacctcaggctcaaagttgcatagcgtgtatgtgaataattgcaactaaaatgctgacccaggatctttgttgagtttttcttccacccatactatgccgccttgccgttcagctaaatggtagcatagttatacctgaacctgggtactgtgactcactttccaaaactcactgtattgtatactatgccacctttgtgcctgtgttctactcagactatgaggttgaatatgaccctccattcatgcaccctgagaaagttatcctttctagacttgatttcttcatttgtaaactggagcccagccttgataaagaatcctagcctagacaaagaatccacggggattatttcaactagatggcagtgatttttgtgctcatttcagtgggctgtgctaccaccctttgaaaatgccttactgaatgctttttgtaaggcattttgtaatgccttgcaaaatgctttcctactttgtgtacctctgagaagagaagcctgtgtaattggaatgtgccttccttctcccctcatctgataatttagttgacagttttcatcataaagtgcagggcaggccaggaaccttcaaagtacttagaaaaacaaaattataggatgtacccagtaataatgaagagtgcccattttgcttgaatttagggaattaactccactttctgcctgttcccattcattgcaatcttagtgctcaagtgtttacctcaacttttaatactatgactggcataaagtagaaaagcctttatttcctaaaaacagctgctccaatgaggttgtttgggcactacattctaggtaattttgtgtgctgctttttgatgattcatttatcttctctaaccattgttaagtggagtcaatacagattcgaataatgtatgtataacaaagcagccaagttccatgaggtttaggctcataatcaatacaattttaatgaaaagaaataatagattattagacttgaaaaaggcaataggatttttgggagatggaggcatttatttgtttcttttactgatgaaaagttaagtggcttgcctaaagttgcatggtgtactgttagttgattaaaagaccgagtccagaatctaggtctccctagttagtcctggtccactgttccttctactaaaaccatcctgatgcagccattctgaagagggtttattcattagcaaagtgaaactgccacaagttggtaataaataatagtacgatgttttttcatttgcatttccagtaccaagaattcacaaagcatcatagtttatggacgctcttaatgattttatttttatttaggtatttgtgtgcatgtacttgtgtgtgttcttgaccctgagcactgtcagtgttctgtatcctccatcatttctaatcacatactgtagaagacacctagggacagaggtgaatagggagaagagaaaattcagtttatcgtactgcctgataagcggtgcttgaggaaattgacagtgctgtaagaaaactgagaggcaaagtgcctattgtttgccctcccgttgctgtggctgaagtgaggaagagttacgcatgtatgggcagagatttccttatggccacaggtgaagcattcatgtaggaagaatgtattgatcacctctccttgtgtcaggtacagtcctggtgtatattgttgaacagaagaattgagtcctgtcctccatgagctcttgatttagcagggatggctgcatagattgcataccactaagcaaacaaatatatcaagaaaaatggtaagaagttctgtgaaagaaaagtccagaactgtgataaggaataatggggatggaggcctacttgcttttgtggtctgggaaaggctctagaggagtgatatttaaactaaaacctgaaggagcaagccctgtcaagagcctatgtagtagactgagcattgtaggcagagggagcaagtctgaaggccattaaggtggaaaaatgaagtttggggctattttgggaactgaaagatggaggtgagggagagggacatgagatggggatggaaaggcaggcacagaccaggtcatgagtaatcagtagacttgtctcttgttaaattagtcccttgttagatcatttgtttcttatttgagatctgtgtgttattctgtttcttagagatagatggattttagtttgattaccccaaccttgagtaactcagaggggatattagagaagcatgttctcgatcttgcttctttaggaaactgccggtgttcctgtgcttcagcagctgcagctaccttagcattctaacagtcacagaacaccactgttctggctcacccccaacttgcagaacacctggacctttgtcccctcccaatgctctaagctactttgggatgtccccgattgcatctcagacattcccccactgccaggtgacatccactgtcatgctcttttccctgtaagtacccagttccctgttgactgccttggtgtgatccaggtaattcgctgcttatgccacagttggcctttcctactgctggttcttgtcttctcataggcagtatctctcttggtcctaatctgtgttccagtgttctccaacagctttctggctaaagtagaatacttcatttatgtaaccagttcacaagggagtgttgactccgtgttcccagtttgttatggatactcgggtgctacaaagcccttgcttttatgtcattcccttttctttaaactcagtttgagttgggggttgggaaagggggctgggatagaaaataatctgaggaaacattcctgggtctgcatttagaatcttccctctccctttggaatccattcagcctttttcctcctgcgtgccttggttagagagcctttcttctagagggcatatcaagtaggcttccgtgcccctatctccacactccattttcctccttctcacactgaaagatgtgtctaatcctgagggtcacacagctctcaagctaggattctggcccttacccaaaagcttgtggctacatgtgttttagacttcataatttttggattttagaatggacgtgtggcatgttataatgcacagcactcagtaatcaagtagtatttctatagcacaacatatgaatgttcatattagattggataaacaaagactttatgtagtctcctgtcagttcaggtgttacctctcagtgaatttgccccaaacttagaaaaagctttcagtttttagactgtgttttggattttggacttgcagatgagggattatgaacctgtatcctggtacatacatgcaaaaacatggtagttaggatttcccgggtaaatctaaaggtataataaaaactaatttaaatagaaatattattttcatcactcccctgccaattaatctattagagttaatatgacttctgtccttcctccataaccacggagattatcatgaatgaagttgatggtatggaagagggtctattggttcagcataagttctccatcccagaacagctacaccatctgggatggacagatggacatgccacagggaggacagcaggaacctacagcagctgctgttcagagagaagattagacactctcagaattccctgcaacttggctgtgacttgaattgtggatgcttggcgcatgacctctgctccctgaggtgactcatgcagcctgaggaataaaatgtttttttaggccaaagtttcaggccatccttaaaaacatcagctactacagatgccggctgcatagaggttcttctgcacactgacagttttgattccttatggcccttttaatctctttccttccttgtatagagtgttatagttcagatgacaatggaggcatatgttgtatctataagtgtgtttttatacatacacgtagtaaaagaagtataagaaaatttttatacatacacatagtaaaaggagtataagaaaatataagcaggaagtcaagtttgtgctgatcaagtaaaccctttcttcgattttcttattcttgatcctttcaacaagaaaacgtgttatttaatattccattcttgtacttcttatgcagaagtactcaaagcagaaggtgaaattgggatgttttcagtgttcttggaattctttgaatagtagcttgaaagttttcattttagtctcttcaccattgtttacattctagaaaatgaagaagtcaaagaaacgactttacgagagcttaaaatgcttcggactctcaagcaggaaaacattgtggagttgaaggaagcatttcgtcggaggggaaagttgtacttggtgtttgagtatgttgaaaaagtaagtcattaattgccaatgtgcacatttgcccgattcttttatttaaggctgtttctgacattatttaagaaagtactgttatctaatatggcttatcaatgtactcataatctgaggactttaaaaatgaaagtgttgttaataatcattagaaattctgaaatatatttaagaattttgtacaattaaactgtatagagataatcgtaagtttaaacaatatactgatttggcttctgaagtcttaaactctatgttcaacaagtaatttttagacttgacttaactaagcctaaactgagggagaaactggtaaactgacagtgatggtacaggctggaagaggctgtataagataccacactgaatcagacctaggctggggaatgagtgggcccaggaagcagcttatgtgaactgccaatgctttggctttatttgagggaaggagctgtgccaggaggcctaaggtgaggcttgaggtggtagatgagaccgtaaaagaaaagcatgcattgtttgagctgtctacacttgccttagcttgtattaaaaaatgttcaacttgttggagacaattttaataacatgacctaagggcaaatgtatgttacagtaatcaataatgtgtgcctagaaatttcttggagaggggcctggtgcagtggctcacacctgtaatcccagcactttgggaggctgaggcaggcggatcgcttgagcctcaggagtttgagaatagcctgagcaacatagtgagaccctgtctctaaagaaaaagaaaaagagaaatttcttggagagcagctgacctacagcagttgttatggtcaaaaacttaaacagataaacactttaacagtagtagaagaaactggagtggggcaaacctttaagcaagttttcttgatgagtaaataggtggctcctgccgattcctatgctgttgtccaaagaaggttgaagtgggagaagtttatgtttgctgcaggtctatacccaggtgcttgctataccataaatgacagagtatcaacattgtcataaccaaatggaaagcagtattgccagggtaactgaccagtaatgtggctttgaatgcattcagcctttacaaattgttttttgaaataaaaaaaaaaaatacatgtaataatttccttactagaaaaactggaacggtactagcaggttgtttgtaatcttaaaccactgctttatgttccttttccagaatctgttttaagtttctttttctgtgtcaacttatacattcctctaaggtaccttccacaccaaaataaaactaaaagttttttttttttttttaaagttctattaaaaaaaaaggattgctgtattaggattccaggggaaaccagatgctctttattttttaaaaactttttagagatggtgtctcactatgttgcctaggctggagtgtagtggctattcacaggtatgattatagcacactgcagcctcaaactcctgggctcaagcaaatctttcacatcagcctcctgagtcgctaggactacaggtgcgcgccaccatgcctggctgctttttattttttcattatcataaataatcatgcagtttgtagttttcactaccaaataagaaaattttgacatctcttagtttatcctttttatttttgttctattcatggtggttgttcattattaataataatttaatataacaaatggagaagtcacttctgtgtatctgtttcctcactgggagaggcaattttgtgtgtctgagatctccctgctggtaaatggctgagctgctactagaactccagtcttctgacagtcaggcctgagattcttcccccgatcctgtggttcttaggtagaatgtgactgtcacacctgccacattagtggcagtgcgtcataattgacagtgagtctcaggagagcaaggagaaagttctctaagggataagggactggtaacagagacccaggattgcagaggcttaaaatagaagtttctttcaccctcacatataaatacaaaggtagggcagtacaggactagtgtggcagctctgctccaccacagcgaggtgtgacccttgtcctcaaggtcaggatagagttccagctgtcatatcccattggccaggacatagttgcatgaccacattagctgcaaggcagaagagaactgtactcttcgttctgggcagcacttgaaaattgtgttcctgcggagtaagggaagactggatactggaggacaatatgtctgccactgaggaatttagaatagaatgtgaaacaagagatacaatttgttttctatattacaaagccttcttattccacctgtgcatttgggaccatctatgaatttgttaattgaaaaagagaattcaaatggagaatcaaaaaatgatgcatacatacttaaaatgtttattttaattggaaacataaatactgtatgtattcatttaccacgctataaaggtagggtcaaggccttttgcctatcgctcttctgaagttctgattggtcttttttacatacatcatactcgtaatgcatctttaaggtaaagcaaatgtgcaaaaacatctgcaaaggaatctcagtgcagaatccttcaattggacatgcttatccccactagcacccattccttgccagtgttttgtagttgtctcacatttgattagatggcaataagtttagtggcttttcatttattaagcctttctaaagtattcaactttgttttcttataaacaacaactctttttttaaaaaaacattatttcatttgtttatatggtatttaattatattaaaataacaagtgcatcttttataaataggcatgggagtaaatacaactgattcttgataggtatacaacttgactggtgggaacaaaactgtgaggccaaattagagcagtgattttctgactggtcttatggccccttcacactctgaaaattattgggaaccctaagaactttttatttatgtgtattttatctattagtgtttctcatattagtcatgactgagcaatataaaaatattagttcattttaaaataacaataaacgtattgcatgttaacatagataagtttgtatgtcagttattctttcaagtgaaaaatggcattccacataaaaagcagctcattcagcttgcatctcaatcctctaagtgcttttcctcaggacaaccattggacagatggtgcatgtgcagcagaagggctttatgtgcagtctgccattttatcatgcagattccaaaaaagacatgtactcaagaattgaaatttagtcaaagtaatattttgtactgcttcatcaaagatgtccttaactaaaacgtctgttttcttttttaaaggcaaggtttaattggattaaagaatccaatgccttgattcatgctgaggtgccagcagtttacccattgttgctttgtaccattagtgtaaatgccaacacagtgaaaaaggcaaacatcacagtcttattatgaatatagttttgacttcatgggccctccgcaagatctgagaccccacagatccacatgttacactttgagaactgctgtcctagatggttgcttacaaacaataagctgtgattgtaccacgggccttgtactttacagtgagaaaggagaatggttaatctggaaattcagtagagaccggctaagtggaatttctacataataaaaaattttgcatgaattttagttataatggtctctgactccaaattaaggtttttgaatattgaattgtagggggtctgtgactctttatttcaatagtattttctggcctgtttgaatttttgtactaaatgtattgatcatttttaattttggacatttttttttctactaagaatatttcgtggatcttccaggtgtattttcaaggcttgatttttatcacaagattctgttgcagagatacagcacactgtgtttaaaaaggctctttcccccctttatacattacagtgtcatatttctactttgtattgcttttctcttctaattattctaaaataatgcctgaaaacctttagggagagtgaaaagtatacagggttattatttggggtagcattagggaatagtaaaaatggaattcctcataaaagaaagccccaattttaatgctgattcagcatgagaaagttgtagatagaaagcaaaacaattaaaaaaaaaagctctgtattggatgaattattctagatgctttgtaaaattgttaatacataatttacgggcctacctaatttgggaaataatgactctatttaatttttagaatatgctcgaattgctggaagaaatgccaaatggagttccacctgagaaagtaaaaagctacatctatcagctaatcaaggctattcactggtgccataagaatgatattgtccatcgaggtgagtatgagatttttaaaatggaaaatattaaaacatcaaataaagttaagagtatttcacatgttactgtctttaagaatattttcataagcattggcattgccatttaaattaaatatattttgaaagtgcaagacatgagaaatatttgctctccatatctccttttctatcaccaaaaggatggattacaaatttatttggatattgtggtgagatctttacatttgtataactattatagatccactcccaattgtagaaatgcctagtgatataagagaactcaacaaatgtgaactttgaaacttacttggggataggagaagagcaaaatgttgatctctatagccttggtcctgcaggtagaccaggtaatgtgaaacaactctgaatcaggctttatataggtggttcctaagtcactggcccctattggcactcatgtctcattccttcttacaccaacaatctccagtatgtatcttcacctcctaattttctctaccccttagtgaaaagtgcccgttgtctgcagttgcaggcatgatcaaccttgcataaaggtcataattatactcccataaactgttttgtcctttactgccatgaagtgggtggtttatagcaatgaaagggaaattacttgctcagcatcaactttgtctcttctcctgataatctttcttgcactggagagttttacagtagtgggacacaaattgatacaacaatgaccctaaatatttatttaaaaaattgcagtatttactttttgtctttagattagcagataaaagaatgctacattttaatttacctatacacaaatgcacaaggatatcactttaaaaatattctcacttgtgagaatagtttaaaggtcatatgaagaatgccatcgtcttttattcctagaaacagtttatatttctcttgcatttgactctcatagcagttaccttatcaagattgttggtagcatgggtagatctccacgtcaactggacatccagtgtctagggtaatgattctagtaacagtctatactgtagtttggggatattaatgaggagccgagttaggtgcatttccatcatgatactgtgatttgattatgtgcatagtgaatcattggttgcaaattaatggtagaaaccatgatttgaaatctacagatttcactacctctgccctttctccatttgcatctctaccatatgatatagatcatgggtattctactctaaaaatacaattgcgagatgcctcccaaggagagaattcaactgcattttctgtgaatttctacttaactcccaccacatcttcataacatccatggaaaaaattagaaatcttaatttgactcatccagtatggcttcagcattagacattgataattgtgaaccatgcagaaaagctaaagagacgtaaatatagaaattatgtagaagaatgtaacagaaagcatgtcttgtatgtcttctccagtaaatataatgctagctacttattctcatgtatttttaaagtatcttgtgggtgtaaacattttatatttctatctccaaaaatttgtattactagtattttatgaagtaataataggtttttgaaatgtgttggcctatatttaattattcttaaaattctttcagagatccaactaatccttttaatacttaaagaggaaaaaaatatttttgaagttgtggtctgcatgtttctgagaaagaaattcattgaaacttttatgtaccagcataaaatgtgttactttatttttgctgccacagttttctattcaaattactctagatatttctaattagatgctattacagtgatctaacagtgtcaatcaggagaacatagaacatttttactaattttttttttatcttgacactccagatataaaaccagaaaatctcttaatcagccacaatgatgtcctaaaactgtgtgactttggtaagttaaaaagaaattaagtcctggtacttacagaattaatttattgtaacacataggtagcttttaaaggaatattaaaagtaattgttatgttttgacttaaattggtagaggaacattcttttgagtcacatgttgaaaaattgattgctggaggagtactgctctcttcagagtattgtctatttttaaaattttatcatggtttttgtttaatcagaactaattcaaagcaaatacacccatatgcccaatatctaatgacttcacaaaaattttttttgaatgttgatagttgttccaggtttaatcatgaacactaaaatatccctctgtaaatacacataagtattttgtatatgcaattgttatatatctataaagtcaaaagacatttttagaacattttcatttgttccctctaaatgttcaatgaatggggttagtcatgtataatattacagcttttgattgaatgtatagggaaatttttttagttgtactctctcctagtagaaaattgtctgtgtctcccatgtagataactctgtattaagctctattaaacatttaaattaaaataattcagaaaaaattttagattgtatgttagggtcatgggtcactttttaaaataatagttttgcctaacctgtatgctgaaaaatgaacacttgattttttaaatgtcttttttcatatatttaaatataatcacaaatacaatgtaaacctccacatataactaagaatccatctccttataaggaaaaattagattagattagtgcataggagatgaattacacaagcaagaaatagaggcattgtcaaaatttgcttcgtagaatgacccattttgtccagtgtagcaaatggaagcatgtgtagctcttgtcactcagtattttcaaagattttgaatattattaacctgtttgtctgagaaaaaatgttttacaggacttaattttcttcatattttatgataaggaatgatatgtaaaagagtctgtgtcctaaatttataaagaatgtacttaggaaaaaggaaatattgaatactggatctgaaagattttaattgtggcatttttagcattttgttagcattatgattttcaggaacaacatctgtttctgatttcctgtccgtgattgtgattactacccaaaacagagacttaagttactgaaaatataaagcaagttataaatataaaagaatgcccatagaatggttagtagtaggaagagtactcctggtctggcatttctcagagaaaagactgttgtaaatggtcaggaagttcctcctggcagcaccacatgcggtatcctgtgtcctgtgtatccctagcaaggacttcctaattgcttcccctcccagagtacgcactccttggtctgacttgaagaaccccattcaaaaatacaaatatttcttcaaagcgtgtcttatgaagaaacattgattatctgaagttaggggttttgttttacgctgggattgtttttattttttaccgtttcattttaagaaacagtattttccatgtctcaaaactgacgtacaccttgatttttactcttaattttaatgttctgattctctataactattcacagtgaacctatgttgtgtttggtgagttagatgggtgattaacttatcctcctgccttattttgtggctatgcagtagccctaaaaccttttcaaagggtgggggtaaaagtagtggtagagtctgtaattggtaactaagatacccctaatattctcagtcattaggagatgatagtaattttggcctgctttgtttccatcactgtttatgtaaaggctagaattgctcagcaacagtacatatgcaaatactgtgtaagtgccacatagcaaaattaatgaccgtctacaatatgctagtttgactttgattttgatttctagcttttgtggggactttatttcatttttttcctaaggtttgcatttattgggagagctgatttaaaagtatgctctgaataattataaaagcatgggatgacttcgaaaacccggttttctttagcatagtgaagagactggttttgtagtgaatacattgtatgtctttcaattgacatggaacactctactaactttttaagataacaaggatattattaataaatagcccatgcgagaacagtcattacattcttttgatgttgtttaaagtattactagcgctgaaatattttgcccacatgaattattatttctttttcaaagttacaactttggactttgctatctttcaggttttgctcgtaatctgtcagaaggcaataatgctaattacacagagtacgttgccaccagatggtatcggtccccagaactcttacttgggtgagttaccgtcccaaaatagaatgacatttccacatctgctgattctattgtcatttgctttgagttcatctatggaaaataagaacttcagttaattaaatgtgtcagttacatattgcagtataacaaactacctaaaacttaatggtatgaaacaagcacctttttgtttgctcagaattctgggtgtgggggaatcaccagtttgagttcagctggatggttcttctactggtctctcttggagtcactcacgaagttatagtcagctggtaggtcttctgggagctggttagtttaggggtctcagctggatcagaccatctctgatccctggaaacttatcctccagtaagctattccaagtttctaagtgtgatagttggagaattctgtgctattaagagggtaagccccaaagcaacagcagctttcaagcctttttttgtatggcttttgcctcgttggccaaagcatgttacatgaccaacccctgattcatggtatggagaaataaattccatctcttgatggggcaagtggcagagccatattataaaatggtatatgtatggaaatggaagaaattaattgtagccatctttgctaataaacttccacattaagaatgtgaatatccacacagtttgacattctggcttatctatttgttcatttattaattcttcaagtacttatcaagtatctcttatgtccaaccactttgccaggcacatagagtaaatattgaaccagactgagcacagtggctcacgcctgtaatcccagcactttgggaggccaaagccagcagatcgcttgagctcaggagttcaagaccagcccgggcaacatggtgaaaccccgtctctacaaaaaaatacaaaaattagccaggcatggtgatacctgcctgtagtcccatctacttgggaggctaaggcaggagagtcacttgagtccaggaggcagaggtcgcagtgggctgatatcccaccactgcactccaacctgggcgtcagagcaagactccatcacacacacacaaaaaaaccccaaaaaacaaaaaaatggaccaattgccatttttgttctgaacagtgtaaatcctgtttgatgataaatggctattcaaactagcactgcattgatgattttctcagtaacatctctacattgatctactttgtggccaccctttaactttcaatgctctttcattcatctgttaacaccagaaaaaggtcttctgataaggttcttttctttttagtacattttaactttaaagcctaagaaggagcctgtagttctcattaataattctctacctaccctagttgtaggattattttccttagattgtatttccttctttgggaccacccaaaaacagataatttatactccacaaataaaattagatatagtgataatgatgacaagtgcgcaaattgtaggtctcatttctttaatttagcatgccatacgtgtatctgggggacatgaggaatttaatttttaaaaatgttttttatataatagcaatataagtttctggattttttttctgaagagcatgatgacgacatgtttaagttactcactgagggtttattttgatattaactacttattttccagtgtctaccaaccgtctagtagtaattcttgattcattgctgacctaaagcctgtaagaatcattgacattagtttttgaaagctttactattttttttaaatcaaaagcttgctttatcctgaaaaacaaagatgcttagtcactttattatctcttccattgtgtaggcagagtttagagtttttatgctaatttttaatcttagaattaggattgattttctttgtgtttgtctatatttcttccgtgtaccttttggactcattgggatgcatagtccattttcttttgggagaattgaatttactggacactttaccaatggagaaatgagtatgaagtagatcattcttagaaccccatctgaggactcaagtgtagtagaagggcttgttataatatggtggtgtctgtaacatggccccaaaaagtttattttgaggacagccttattgtgaatcttcagagagtatctgctgcttaataatacctgtagaaaaactggagttatgtttagagatgtgtgctagctgctaaaagtatggggacaatgtaactaaattagtgctgaaatgaatattgctaattaagtgattgtcaagtactagttgaagagccatatttgtaaaaatccttttgaaatcaggtatttggttatacattaagaatttaagttttatatattctcaaggctttgtccttgacattcagaatcattccagctgcataaattattcaaatcagatgacagaagaaaaatagcttgtagtgagtatgtgaaaattttccataagtttctccatctagcactatggaacaaattttctctttctcaaacagatacgaaagaaagatcagtatcttgccctgcccaacaaacttaccaaaaagatctaaatgaagtttccttgtgtagttcttaggttgatatgggaaggaaatgagataaatgaaatattgacttattattgcaatgatttgttatcctagaaatttgttctgtataatgttaacagtcctttgatttaaaagttttgtttcactactgtatcattttagcattccaaaatttctttccatattctttttcagatattttcttttggctttcccttcttaaagcttggattatttatgttggaaatgtgtgtgagcgtgcacgcgtgtgtgtgtggtttcttaatttgctgtaaatttaacactctagatataaagctgttttgaggatacctagattttcatatacaacctccatttattaataacagcaacactcctaaagccctctggtaaactcacaccctagaagaagctataaacccctaaataaactggaaaatgttttgagggaaatagctaccataaagctctatatacataggttacatatattatattcaaataaataatatagtagatcttagcacaatcttagtcatcagaaactgtgatgctgagcgatggaaggttaaataatattcagtgttaaggaaacacataaatcagtacatagtaaattttaatagactgaactcataaaatggataagatgtatctttttgacatttagagagctaaaggataattatttgtcttagaaaatacaattatttggaagcatttcattccccaagtgaggtgttacttgccagatatgtatactgtattagggtttattaagccgttcacatttaagatacatatctatttatgtgaataaatttcaaattagtgtatactaactaaattgttattaaattgatggctttattagcataggtttattcacttgtgttctgatgatttgcttttcagccttcttttcacatggaactttttaatttcataaatatacaagtgtgctgcacataaatttgttcacaataatttggaaattatcaaaacattatattttttcagttgccaaaataatctcttcctttatttttcagcgctccctatggaaagtccgtggacatgtggtcggtgggctgtattcttggggagcttagcgatggacagcctttatttcctggagaaagtgaaattgaccaactttttactattcagaaggtgctaggaccacttccatctgagcagatgaagcttttctacagtaatcctcgcttccatgggctccgggtaagaggttttgctgaaacccaaaatggaatcaatactgcagtatttgagtcattgttcattgcacaatggaatgctaaactatcctttgaatactatttcttttcccattacagtgtttataatccctattataatattttatttccgaattttttaatagtacttgtggatttaaaaagtggttagaattcaaattctaatcttttttctaatttttaagttccagtttttcaaaatcttttttagtgtatacatttttacacactaaactttggttatcttatattgtttctttatccaaaatattaagcatcccccaaatataccaaatgtatgaatgttgaacaaacatatttgtagtgatttgaggaaagccctgaaaacttggattccccagatttgaaggttcttgttttagtagatgtttctggtccactgacggtgaaacatcaaatcttcttttcaaattagtgtattgtcttgggtccgtgcatggtggctcactcctgtaatcccagcactttaggaggccaagttgggcagaacacttaaggccaggagttcgagaccagcctggccaactttgtgaaaccccatctctacaaaaaaatacaaaaattagccaggcatggaggtgcacacctgtagtcccagctactcgggaggcagaggcaggagaattgcttgaacccaagaggcagaggttgcagtgagccgacatcatgccactgcactccagcctgggtgacagagtgagattctgtctcaaaaaaaaaaacaaaaacaaaaaaaaaacaacaactagtgtattgtcttgggcagcctttcctagacttgacaactttgtacaaaacttttctgagaatatgtgaaatagcgtcttagaaagtataaactttccccaaatgaggaggagtcaccttattagagtgcccagtgagttataggctacttcttccacctaccccaaaaacaactttttaagttttcagccagttttttttttttattatactttaagttctagggtacatgtgcacaacatgcaagtttgttacatatgtatacatgtgccatgttggtgtgctgcacccattaacttgtcatttacattaggtatatctcctaatgctattttcccccctcccccaaccccatgacaggccccagtgtgtgatgttccccatcctgtgtccaagtgttctcattgttcatttcccacctatgagtgagaacatgcagtatttggttttctgtccttgggatagtttgctgagaatgatggtttccagctttatccatgtccctacaaaggacatgaactcatccttttttatggctgcatagtattccatggtgtatatgtgccacatttttttaatccagtctatcattgatggacatttgggttgggtccaagtctttgctattgtgaatagtgccgcagtaaacatatgtgtgcatgtgtctttatagcagcatgatttataatcctttatatacctggtaatgggatggctgggtcaaatggtatttctagttctagatccttgaggaatcaccacactgacttccacaatggttgaactagtttacagtcccaccaacagtgtaaaagtgttcctatttctccacatcctctccagcacctgttgtttcctgactttttaatgatcaccattctaactggtgtgagatggtatctcattgtggttttgatttccatttctctgatggccagtgatgatgagcattttttcatgtgtctgttggctgcataaatgtcttcttttgagaagtgtctgttcatatccttcacccactttttgatggagtagtttgattttttcttgtaaatttgtttaagttctttgtagattctggatattagccctttgtcagatgggtagattgcaaaaattttctcccattctgtaggttgcctgttcactctgatggtattttcttttgctgtgcagaagctctttagtttaattagatcccatttgtcaattttggcttttgttgccattgcttttggtgttttagtcatgaagtccttgcccatgcctgtgtcctgaatggtattgcctaggttttcttctagggtttatggttttaggtctaacattaagtgtttaatccatcttcagccacttttttgggccagcatggcaattgctggtcattgtgggagctataaaataatctccccaccatttctttcctttctctgaaatgcgtagttctcaaaccatgttaccttgccatttacaaagcactttgtttttttcttttgattttctggcccccagttaatttccctttagagaccaccactgctcaaacctgagtgcccaaccgtccagatccttctaggctcagtgaatgtgggcgaaatgaatggacagaggcatgccagtatcttttttatctcctgctttttgtctgtctttcacatctgtctgagttacctcaggcaagtttgttgtttctccttttatttttgcttttgtaagccagaaatttgccagctatgaccagtaattggggtgccaacagcatatgtggttcagcaggttagctcaacatttttgaacatttgtcatactaggtgttggaaatatgacaataaataggacttgtccccagtctagaagaaagaaaaatctattatactcagaaataaagttagtcataattaatgaattgcattttcactgaaaatcaatctaaactccttgccgtagcctatgagaccttgcctgacctcatctcgtacctatctccattccccccattctccagattctcagcacacttgccttttttgttctttggcttccataaacattccagggtttttccagtttcatcaacttgggacccatggctgcttctcctggcaaggtgcttccctcgtgtggtcccttctcattctgtcaatctcaaagagtgcctctttctctggccacccaacgtaccaccctcacctccatcctagtctttctctcccacagcatcctttttctatcatagaacttaccacagtatggaattattttgtctgtttctttacttgttaattgttaactatctagtcctctcacactggaatatgtttctcaagggcagaaatcaactgttttatcacatcacagatgtgtttccagcatttaacacagtatctaccatatccagtgagtattcactacatatctgagaagtgattaaccagtctgtggcatcagcattgaaactcaactgtatttcttttctctccatctctcatgcttcttttacccttttacctttacctaacctttgaccaccacccccaaatagatcccccgatctttctcttttcactttagccttctcacatttctcaaaccacacaattctcttttttgtttagaaacctctacaaggttactgataaagtttaaactctttagggtagctttaaaaaccccttcttagttctccagcttcatttctgcctccccgctagcccagtttgtgctctttggccacattgaacctctcaccatttccttgacatattgcttttatagtctgcatttccatctctataatgctcccaacactcacctgtctttcttctcctcctccttcctcccctagactcaggccaaatgtcctccctccgtgaagaccttctagactattcgaggggaaactggtgaccctataacactctggttatacctcttttgtagcacccattgcattctcctttaagtagctgtttgcaaatatgtatcctcactggactgaggaaatgaactgttatgttcaccattatatttgcagcacacctagaatagtgcctgctaggctgaatagtgttgaatgattaaatatttgacctcaggattttaacattaactgctggaacattaagcctggtttgctggctgacttgttcttggcctggttaatggggctgtatgccggattctctgaagagagtatgaacagatctgacatgctgcttggccttaataacttacaaactagctgaagaattaagactttcatccatgaaataattagaaaacaatacaatttataagaaagcgtggtatataataaagtactgcattgtttacctcattgtacggttttctaatgtatctccatatggtttagaccatgagagtgtcaaatattctggaaagttagaaatcatcattggggattcattagagaatgctttatgaagcatttgacatttgaaatggatattgaagaacgaggagcatttggattagataggccacacaaaggattatctctttctcatttgtctgtggtcctgtttgttcatagtcttcttccctaaacaatactgtctataaaattctagacagcgtgtgataatgctgcttacaaacatccttcagggaaattgctgcctccatcacactttgacttttataaaccttaatactttacattttagtctgaaagtgtttgtggtgttttaactaaattagtttaatctctttggaggcttgacaatatcttttgagggagaaattttctttcatgatgttatttgaaaatgtctatgacagatagctaagcacatgggacatgtaaactgcatctgctgtgcaccatggactcaccagtaaccagtccagtgtgatgtgcatttgaagttagttgtgtagagacaggaaaatctacaagatgttgctatagtggtttgcattattgggataaagtaacaattgatgccccatagtatagggcctaggctctggagttagattgctgtggttcaaggcctggttccgtatttactattttgaatgatgccaggaagttatttcaccatcctgtgcctctgtttcttcttgtgtaaaatgatgataaccaaaagactgcctgattggattggtgtaaagatgaaatattatttgtaaaatgtctagaccagaacctcacgcatagtgctcagcaaagaggcattctcattggattgtattggattggccaagtgattcagaaagagacaagactgattgagatatactttaaacttctatgcatgagttttggctatttgttgaattatttcatattagaatggtaggtctcactcaaacgcatgtaaattaattctttgaagttaggagtttgcttggtcattttttattataatatttctaatacctttcgactttcagcattaattttcttatcaatgaaatttcactcctagaaaaaataagggggtatctggtagcataagatagacctcatacacaaaatattaacatgtactggtatagggtcttttatcacagcatggtaggtgtctttctatttgggctgatatttaatgctccagtaacatcgaagggagcctctgtacttcccttaggagaggcacctaggtttagaaagagtgtgggtttggatcacaagactgggtgcaaatactagttctactgctgtttaattatgtaacttgccttgaaccagttatttgaactttctgattgtcaccttcttcatctctaaaataagaataatatatccaaaatgcctcgcataacatcacttccctcagaaatcagttttaggttattgcctgtgcatctgtattgagttcatgttattccttctactcctctatctggaaggtgctgtcctacttttctctgtcttcacatttttcatatttttcaaaacccaattcagatattacctatgggttctttcttccacagccataaaccatcttggtctttcctttctctgagcttcaattagaatttatggttgcacagtttaacattgattgctttcccaaccagacagcagattcctcaagagcagggtttgggtcttacctgtattttttgtctcctgctatccagagcatggtgtggagatgatgtcataatcactccttaaatatcttgtttgaaattttactgtataattagtcctcccatttacttatttagcatgtttagggatttcggtacttagaaatgcttgtatgttggtatagaggaaataatgtatggaagcagactagccctgacatttggaagggagtacatggcattgggctctgccagtcatattacccaatactttaacatccactagatattgcagaatgtgagttggcagaggaaagaacaaaaagcacatctaaataaacttgaccccttcccctcattttatttaaaaatgcatttgttaatctaggaacctgtttgtcttcggttccaactttaaaaaaggaagaatttgaaaacaggtcattgtaagagcatattaaaagcgatgacagaatgtgtgtctgaattcactctctacttctgtgaccttttaggtactggccacttactttctctctatttttacttctatgttttcaaaagtaaatggtatgttgttgttaaaaagctataaggattctatctaatgtcttatcatatcctttctgctagaccctcaattactatcagtaattaagaatcatgtgtataagcagacaaattatgtatacactgtattaaaactgaattgtttataatcagatgatattctattttactgcataattagttcaaatttttatattttagtttgtttcacatgccttagtattgtctgcctagatttaagtatcatctttcacctgtgagttttcctattatttgacacccagtcgtagtaatccatataaaaatacatagacggccgggtgtggtggctcacgcctgtaatcccagcactttgggaggctgaggcgggcagatcacaaggtcaggagttcgatgccagcctggccaatgtagtgaaaccccagctctactaaaaatacaaaaaattagccaggcgtggtggcaggtgcctgtaatcccagctactcaggaggctgaagcaggagaatcgcatgaacccgggaggcagaggttgcagtgagcccagatcgcaccattgcattccagcctgggcaacagcatgaaactctgtctcaaaaacaaacaaaaaaaaatacatagacaacaaaagtaatatacaagtatgaatttgactgggattggcatttttgcttatctgctcccttctgcaacactcacaagcacgtgcacacacatgtccttccccaaatgttaacattccctttgtgtatgtctcacagtttccagctgttaaccatcctcagtccttggaaagaagataccttggaattttgaatagtgttctacttgacctaatgaaggtaaggccaattgatattatctctataaaatgtcttttggtttgtggattcttttgtgtctacatgtgaccatagcctgcttttatgaatgaaattttaggagatgtggaatggcaaataatggggaactatgtcatattaaaaggcatgtaacttatttaaaattacaatgggatctggtattgtcacagtccatctagacagaatcatgagacccctaaatgacattcttaaaatggacagaataataaaaatctgttagcatgcaagagctgttcaagcataaggttttaaaacaaatcttaaaatcaatgttgaaagaagaaattcaacaattttttctgacatggtatttgaagcctcccatcgcctacacagatttgatcagtgaatctaatttttctctttttctaacttggtctcttctctcccagactctttctggctctactttagacgtatcaggatcattgctaatgctgtggcctgagtgttcttccttatgctaccctccctgtccagaagtcttcctgctctatactctaaaagcattctcaaatttctttattcaagtttatttttttttctccagtagacagtcggctccttgagtgggaactgtttttcatatttctccagctttcactgcagccagaagtgcataagcaagtgttggttgtttgatagtagaccttcaaagaacacttattaatggatcaattttattttatgcccagtcagtcaactgtcaaaatcagtagaggttacactgtgcatagagcctttaaaaggcatacttagcacagtcggaaatttctgagtggcattctcagaactttgccgtgctttaaactatgttaatctgtgttccagggaacatagtgtacataggtgtgggggtggaggtgggggaggagggtgtgacgtttcggaaaggccacataccatacaaccttttgtagagatgcacaatattcattaatccataaaggctttcagaaatatcacaataaagaggcatttctgtcttacccaatattttccaaatttaattaaatactgaatactgttttttataaaactctaaagctctagtgttcttctgaatacagattgagaaatgctactggcaaaaaagaacccttaaagccttttgtttaattagtcataaattatcacttaaatcaggtaggttttgtcaatacactttttcacacagtcagtcctcatggattgggacctcaataatttggtaacttctaaaatgtgaatagaataaagtaggaacatggaattaaatacaatttcatgttttctgcctttcatctttctttagttaaaaataattgaatgtttttgttaaatcattaccaaatataattgccaagcatcagtgtggtaccagattaaaagctagcacaaataaaagtagaaagattacccgaatcatcctgtgcttctgccagtttagaagttaaacattcaaattcctatttatttaatatctttaccatcagatttctttaagtaaatatttttattgacatgtcctttcagaaggtgcgcaaattgtatctatatgtcagttactttttataatgtaaacatattagtgtaactctacccagatgtagatagagaaaattactaacaccctggaagccttcttatgcccccttccaggctttatgccaccccacccccctcagaaaccagttccgacttctgtcaccaaagattagtattgccttattatcaaatgttatataaatagaatcattccttttgttttttagctttttttgaaaatgaatttgaaaaatgaaaaataccaattatcccttctttgaatatttcaaagagaaatattctctttgccattctctaaagctgccgtgttaattttgtccacatctaagtacctaaaatggccatctcatcctgtcagccaatttagtgggggtacaggtcaccaaaattaattcaagcccctaataaccttaagactagctgtagtaattatattggctctattttagtcttaaaaaacgttttccctccaagtactgaacttaaaagtttatgaaacttttaaaaaaatgtaaaagaagaaactttaaaaccaaaaaattagagttgaggctctttgctgctacagaatgatttttttttttttttttttttttttgagacagagtttcactcttgtgcagactggagtgcaatggtgtgatctcagctcactgcaacctccacctcccaggttcaggcaattctcctacctcagcctcctgagtagctgggattacgggcatgagccaccacgcccagctaattttgtatttttagtagagacgggttttcaccgtgctggtcaggctggtctcgaactcctgacgtcagatgatcctcctgcctcggcctcccaaagtgctgggattacaggcgtgagccaccacacctggccccgaattatttcttaggatcttatgtcaagtgggaagaaagctaaattcaggcaattatgtgtatactactatgtgggtaaaataaaaggaacaggtagagatatgtatagggaatatctatggaaggatgcctaagaaactggtaacctaggctgcctccagaaaagggaactgggtatctgggggataagagaaagattaagaatgtatattctttcaagtgaatatctacttaattaaaagtgtactttaaattttttaattatattgtaaaagtgattttgattaatgataagtgcaggatacaaaactgtgtatattttgtaaaagaaaatatgtatataggatattcaaaaaagggctgggatcatatatacaaagaggaaaatgatgatgagattataggtgatttagatagtctttttttttttatttcctgaactgtgtttacttgatattctgcaatgactgtgtatttcttttataaggaaaaaaataaggtttttattagaacttaaatttgactttgtaatgttcttaacgatcctaaattttatttcctaagaatttactgaagttggacccagctgacagatacttgacagaacagtgtttgaatcaccctacatttcaaacccagagacttctggatcgttctccttcaaggtcagcaaaaagaaaaccttaccatgtggaaagcagcacattgtctaataggtaaatattcccttttaaggaaatacagatgcagtgttggtcttacaagtaggtggaggaggtggctgcttaaatgatgcaattagagaaaagaaggaaagccctctttattcaaaaatatcttccttatgcttattgcatgattcagaaccacaattaaggagttgtgtgggtcttaaagactttcttatctttaactagtatatgatggaaacctatgcattccctgggaaaggtagcattgggttagcaactaagggggtttacagcctcaagagctagaatattctgtgtgaatgaaacccatcagtgatacccggaggaagaaagctgggtgaaggcaaggggattcctggagagagaagaggatgccaaacacagatggtggatggaaatgtacctagtgtaatctttgtgactggaccaaataggtctggctctacagagaggtcttgtgtttttgttgctcttgtcttctaatcattgagttgagaaattaatttttcataagaataagaatatggaaatagtaaagtcagtgattaaaattgttgctctttaaatattatttttcagcataattttttcaaagcctgtttcctgaaaaacacacacacaggatttgggccatacaatcaggttgtctttcagacctgacattcctcaattctgttggttgcatgtccaagaggacagtgtcctagtcatggtctccctgttttccttcatctcccaagaggctgatcttgtcatctggggtcgttggattatggaagataggaaatagtttctctcatctactattacaagataaatagaaaacaatgattctttatttttattttttagtttttttagagacagggcctttgctctgtcgcctaggctggagagcagtggcatgattataactcactgcagccttgaactcccaggctcaagcctccctcccacctcatcctcctgagtagctgggactataggagcatgccatcatgcctggctaattttttaaattttctgtagagatggggtctcactgtgttgctcatgatggtctcaaactcctggcctcaaacaggcctcctgcctcagtctccccatgtgctggagttacaggcatgagccatagcatctggctgaaaacaataattcctaatatgaaggttttttaatataaattttcttcccacctgcaaccccaaattttccatccatatagaaccattgttcttttttgagacagtgtcttgctcgattgctcaggctggaatgcagtggtgcaatcatggcccactgcagcctctgccttcctggcaagcgatcctcccaccttagcctcctgagtagctgggacaacaggcatgtgccaccatggctggctaattttttatcttttgtagagaattcctgggctcaagcgattcgcctgcctcagccttcctaagtgctgggactacaggggtgagccaccacacctggccaatcagttgttcttaatagatcagatttttaaaagctcaagatctggtactatttaggtctgggagagcatccataaactgatgatgaccatttatcgtatgttttctctgcttaactgtgatagtataattgtgttttagagctgtttactcttcttgaaaatgactggtttcagtttgtttcccctcacatcttatagacctttcttagctggctttctttgtttgttgccatgaaatttttaggacactaagtcaaggaatagtagtcatcatttggttgctcctttgcatttagggggtgcaaattagtcctgtgtcttctttggggttactctcagttcaggtgcttttatctcctttttaccttaattgtctcttagctcctttagtttacaccgaaaaattatcccaatgatataaagtccagtagactgataataagtttttgatttgtgctatagtgattagtgatataacccatactgtgaaaagaggctgtgtatttgtcttctagtgactcacttgagagacagagttcttggaattaaccagtggggacctgaggctctcctcgggaacctctttagggatctgttaaggaggatgtgcttggtgatgatgttttcagcagatacagaagatatgatttgtttgggtccttgaggagtcctcccaagtccccttttgaaatagaggagaatagaaattataagtgaatttaaaatctctggaagaatcattttcaggtcttgacactgtattgaatatattaaagaaaaagtcttacatgatttttctaggaatgatcttaccacattttacatatatctgagggcttttgctccacactggtctatggtccatacttattccatggatgcttttttggttagagacattaattctagcttgaatctcaacacaaacgatggctccctaagacttctcaggaccattttagagatgctcacagcaccatatcacattggttgccacgtacaaactcccctgccttgtctctggagacacaaacatgctgttgcataccttgtcttctaaattttttctctctaggagaggcagtggactcttgtgttacttagcccctggctatctccctcaggctctcctgaggttctgcccaccatggacacggtgcaatggtgcatcagctgccccatactgccactctcctggtccttcaccagccttctccatcaaagtgtagctttgcaccttcgacatttgcttttaaaacttactttaactaaatcgttatctatccatccatccatccatccattctgcaaccatttaagaagagtttgtatgtaaaatttttttaactagttggcagtttaacacagattccttacagttgtgtgtcgaagagatctatggaattttcaaagctgttttttattgttgcactttggcagagctccgatgcaaagggagtatgatgccctttccacataggcgttatgtgcaaagctcagtggtttccaactaatcctaagacacaaacactcagaatggcagtttaggctctttgtacacttatggaaaacctaaagctttgacacgttttaccttaactggataacctctcttttcatgttagaattgtctcttacgttgctctgaatgtgttctttctaagatccacatgtacgtttctgcttaacgtcgctaacagtgtttctaagagttccaaaggctcaagcagctgcctttgctgttctctgtccctttatggtctttgtgagctgaggacgtttcccaatatctgtacatgttatctgtctacgattactatttctaggcctgaaggggaatggggatgaaatagggttctgagagtccagggagagctggacctgggtaggaagagccaccctgtagaagctgtcatctagaaggacacagccacgatctgagtcagggtgcagatgcctgcagggaaggagcagggaagacatcccccagcccctctctcctcttgtcttgtgatgccttccactgctaagcccaaccagaagctagctggctaggaagcgtgggtgacaatctgcagcattgggttcctgaggcccagggccgggctcatgggggtggaggacggattggaggttgggcaaatggagaataaccaacacacttagatctatttgtggatgagacagtctatcactatttaggtttgaaaagtcgctgagatatttcagttaccaagatataagttggcaaacaactcaatggtttaaaacctgatgcctttaggatatagggactttattgatctggggatagactctgttaatataatttaacagaaagtgaaacttagcatttttttctttgtaattcctttctaggtctgggctttgccattttagtgctcatatttaggagtccttttatttaatgctgtaattctaatgacctaactggaagagattagtgagtacattcaagagatgaggccccccacactgtcacaggcttgctcgatatcagatttttttttcttttttgacactctcaggtagctttctggcagagattactgactgaaaggtagactaggaaatgggtccttatgttatttaatggctgagcatgcaggttctcatggggaaaattggaagtcagagcttcacagactaccattctacatgaacaaaaaaaagtgacttccaattagtgtgtcatgggaacaaaactctcccaaatcaaaccatctgtagcaatagcaatatttgcagcaaaattttttgaatgcatagtaaaaccagaattgtgtaaatcattattcatttttaaacattctagtctgtcccaaactacaattagatcctttcaatagttacagtagcacaaactggccttgctatggtgtcagtttcagctttcaaatagaggacaagattttcctctggatttatattttgtattttaaaccaagtgtgaaatgaagctttaagtcctaaaggagggctcagtcggtctaggataatgaaatgttaaataaaaaagagaataattgtgtcttttggagagaaacgaactctttcagatctctgtaatccggtatagtacaggattcctgtttactgtacaaagagatatctgaagagccccaagtaattgccacttctccaagacataaacattgatcatcatgttttccaacaaacctcactggacagtttacatttctttttagagggtcattttcttttattaagtacattgctagaattctcattctttgattatgcaggcagaagagacattggtgtctgtgtatgtgctgtgagtatgtatctctgaggcaggctacaagttttacaaataaaaatgaagttcaagaaacatagtaacctttaagtctaaatgttgtcttctgacattcaagcagacaaaagagttataaagagtttatagctcagctctcttcttagcagtcattctatcacaaacactcatatgagtaccaatataatgagagtatgttttaccagattatcatttagaaactgttttgacagcaagttagctgagcatttagcagtgccagaataatttcatcaaggccagtgctttgttacagagtgagttggtctaagaaacttaattgctgttgataggttacttgttattcgaaggcacatgcttgagagaattaatgtttttagtcttccaggtgttttgagtatttgttctttctttttaacaatactttttgtgtgtcagctattgagggaaactgatatacttcttttgtttttaacatagaaaccaagccggcaaaagtactgctttgcagtctcaccacagatctaacagcaaggacatccagaacctgagtgtaggcctgccccgggctgacgaaggtctccctgccaatgaaagcttcctaaatggaaaccttgctggagctagtcttagtccactgcacaccaaaacctaccaagcaagcagccagcctgggtctaccagcaaagatctcaccaacaacaacataccacaccttcttagcccaaaagaagccaagtcaaaaacagagtttgattttaatattgacccaaagccttcagaaggcccagggacaaagtacctcaagtcaaacagcagatctcagcagaaccgccactcattcatggaaagctctcaaagcaaagctgggacactgcagcccaatgaaaagcagagtcggcatagctatattgacacaattccccagtcctctaggagtccctcctacaggaccaaggccaaaagccatggggcactgagtgactccaagtctgtgagcaacctttctgaagccagggcccaaattgcggagcccagtaccagtaggtacttcccatctagctgcttagacttgaattctcccaccagcccaacccccaccagacacagtgacacgagaactttgctcagcccttctggaagaaataaccgaaatgagggaacgctggactcacgtcgaaccacaaccagacattctaagacgatggaggaattgaagctgccggagcacatggacagtagccattcccattcactgtctgcacctcacgaatctttttcttatggactgggctacaccagccccttttcttcccagcaacgtcctcataggcattctatgtatgtgacccgtgacaaagtgagagccaagggcttggatggaagcttgagcatagggcaagggatggcagctagagccaacagcctgcaactcttgtcaccccaggtacagttgagcaccttgactgaatctggtggcccttcaggggaaggtggtacgagggatgtgatgagggtccatctactattttccctactacaggaggttgtgcttttcttgataggatgcatttagggaagcaatacttggcctaatctctgtttttttgttttttgttttttaaatctatttagatcaaccgttgagtactcaagaaaagtcaaattttgtttttagtgatctttttttttttcttaaatgttcttttctggaatattttgttgagagaatcctattttgatttattacagaattcatcagctgtatcagttaggttttagtttttcttaaaatacagtgtgaattcatgggtattttctctgatctctccaaaccacatttgcttaaatcaaaagcttttgctagtaccttactcaatattttaactgaatttaaaagttttaaatttgtccagaactacagataaatttaacttcataccaggataaatgttagttttcagtcttttggattgtttttaaatcttaaaacagcatttttagcataatgcttcctccatcttattcatcgtcaaactctagaactgacctaacctgcttaaaagaagtagcattccttcacttgaacctgggaggcagaggctgcagtgagccaagatcacaccactgcactccagcctgggcaatagaacgagactctgtctcaaaaacaaaaacagaaacaaaaacaaaaaaaacaagaagtagcattcttacagtagagcatgttttaaaaataatgttatcatgatttcatctataaagtactgtgcccagtgcctggcacaaagtaagtgtctaacaaattttagttattcttgctgcttctgtgattgtggaggctgatatttggacattgaacaccttttctatgctgggtgttcccaggcactcaaaagagtctgagagagctcttgcacttgagaaacttacctgctcttggggaagataaactgatacatgataacaatgaaataagtagccaggtgcagtggctcacgcctgtaatcccagcactttgggaggccgaggcaggcagatcacgaggtcaggagatcgagactatcctggccaacatggtgaaaccccgtctctactaaaatacaaaaattggctgggcgtggtggcgtgtgcctgtaattccagctactcaggaggccgaggcactagaatcgcttgaacccaggaggtggaggttgcagtgagccgagatcgtgccactgcacttcagcctggtgacagagcaagactgtcacacacacacacacacacacacacacacacacacaaacacacaatgaaataagtaagacctaagtcaatatggcactggctataaataggaactgagaatagagagaggtcattgtgagcagaagcagttagaaatggctttacaggcaactgaaggtctttctctgggctaggatgtatagacaagctttgaattggctgaagagtgaaggtatgttcaggtacgtcctgagctaggcaacatgaaaagctctagctagaaagatgaaaagaataggttccctgtcgtcttaagtgtgtgggctggcaggggacacttgtcaacagataagttgttccactactgtgaggttacattctggctactgtgctagaggcatgccagtgtggcaagggagcgagacagtccaagttgtgagttgtgggagctcctagaacaggtggcacctgagcagagacttccagaaaggttgggaagaaagtgacagtgacctcaggaaagagggaagaaaagagcattggaaggagaaggaaggtaacagatgttacatagcatggtatgctttgggcattgcaacttgttccactttgctggagtgaaaaatgcaaaatttggagtggcttttgcaataattcaagcacgaggtgaagagaatatgtttgggattaagtcagtgccagtgggaaacggagtggatcttctactcctcagaagtagaaacaataggatttgtgatttgaaggattgaatataggaaaaaggaagacttcatggtttcttttctaggacctcctttttggagtgaaagagagtagttttgaagtcacctaattcaaccccttcatttcacagatgagcatgtcgaagctcagagaagttgggtgagttgctccaagtttacccaaccagctcaggatggagctgggattatgaggcaagctccaggtgctgaggccagctgcttgccactggtgtcttgcggacatgttgaatttgaagtgaccttggcctctaagcagaagtgtgctctaagaggctaaaaagatggtctggcacccaggtgaaaggagaaagcaagaggtgcccatttgcagaggctggaagtggagtcagaggaatggtcagaggagccctgaggagatgctgtcgggagaaagaacctccagagcctagaaagatctggcagcttcctgcagaggagacatggaagggaaaattgggtaaaatgtgctagcattcagcatggtataaaatggagaagaaatcggaaaaacaaatagctttttaacttagaaaaagtaattgctctctgagaattccaggaaaagaatttttgtgaacatggtggtcataaacgaattataaacagttactgtgggctaagcacagatctgttacagactgtgaaggccagttcaggaggtacagtgcccagctgcaagaaagtacaagtttaaaagcacaaagataccagaaggctggaaaagtaacttaagctgtgagtgaatcctaggaatcactcccatgcaaagtatcgggccaccttgaaaagcacagagactcttactgagtttatattagatgttaataatttgttttcttaaaataatttttgtagaggcctttgtaaacagtacaggtggtaaaagtcaaatgagacattttcataaaatagaaagaaggaaggctatgttggatgaattcctgcccagaatcctcagagtacatttggagaatgagagggagaaaaataatcatattttaaatcttaaataaaatgtttttgatatgtcacataggcttaaggtaatgcccttttctgtgcataatatacagatatacgatgcagcgaactccttctaatgacttggtaattttcttccttaatctttttttctgatgatagaaaatgctgtgttttttcccctcggtgaacaccattgtggaccgagtactgttcttagcttgtgactcacttccttgagagagaaagatagtggtatgtctttggagatgagcactatcatgatttggcttcagaaaatacatgaaacataagtgctgttatcctagagaagattaagacaagaatttaagcacataaactatagtagttaagaggattttaacacaaaaaattattaaaaggacttactctattccttgatatattcaaaaatcatttattttcatctgactttgccatataagtcctgcatgaaatatacttttggaactgcacagttcattttggagaactcagacttaaaatctgctagagaaatttcagataaactaatagaattcctaatcagagggccgctcagaaccatgactgtctagatattagaatggtaattttttttgtttttaataattaattgaactattttcagactaatttgttctctgcttgccttaactttaatgagaattttactttccatctgtgtgaaatttgacttatattacattcatcagattattcacttttatgggactatttgtattttagccaactaacattttttattttagctggttatggtcctagttctaccaaataaaggccatgatgagttccatccctaggaacaggatgctcttataaatccttttaaattttacttccagcctggagaacagctccctccagagatgactgtggcaagatcttcggtcaaagagacctccagagaaggcacctcttccttccatacacgccagaagtctgaggtatgtcacaataaaatatgcctgtaaacatttgttcaacatcattactgcctagcttttaaaatgtattaatacccagtctcccacaaataagttgaagtggcttataaagtaagtagttttccttgtggcataattctgagttttctttcaaaaagatcattaagtcaattatagattgattaggtacggttctaaatttgggccaggtggctcacacatgtaatcccagcactttgggaggctgaggtgggaggattgcttgtgtccaggagttcaagaccagcctgggcaacatagcaagaccccatctctacaaaaagtttaaaaaattagctgggtgtagcagcgtgtgcctgtagtcccagctactcgggaggctgaggcaggaggattgcttgaactggggcagtcaaggctacagtaagccatgatcctactactgcactacagcctgggcaatagagtgagaccctgtctcaagaaaaaagtcataggcaatattgtcatcaatgtgtggcttaacttttataaatttctttcctgcctcagggtggagtgtatcatgacccacactctgatgatggcacagcccccaaagaaaatagacacctatacaatgatcctgtgccaaggagagttggtagcttttacagaggtaagcccacccccggcattcaacaggttcccctctcctccctctctcactttatgtgcacactgctttcaccgactcaggccagcggccttctcacctacactgtcgccttccagcggttctccctgcctctgctcctgctaagtcaggccctcctggcttatgaattggcctccttaggtagcctcttaactggtctccctatctccaaggtacccatcaatatagagactagagtgatccttctgaagctgtgttctgaccataccactcattttgttctgtcaagccataacatacttattgatgttacctgtgtgtctggcactgttctggcttagaacttgttggtgaacaagatagtcaaagatcttcaccatcacggaactcacttcctcgggaggagagatggacactaaacataataattatatagagcagtaaaagatattaagtgctacaaggggggaaaaaatagagcaaggcatcccattgcccaccccaccccaccctactcctaatcccctatcactcacctgttgagagtcttttggtggcttcccattggcatcaggacaaaatctgaattctctaggatgtcattccagacttcccatgatctggcccttgccatgctctccagccactttctcccccaccccccaggtctctctcgtacccagcctatgggactgcacaggctgtgccctcctctggcctgtaatgtactcttcctcctgctggaacagcttgtttctgtccctttctttaaggtcctcttcagtataatatcttcccacagtttgttccagatggactgaaacattttcttctccgttctgtctgtcgtaccttgcctgtaactctgatgtaacactgaccacattgcactgattctttgtctgagttctctctcacaaggttgtgagacattcagttctcttcgtgttctcttctttttattctcattgactagtacactgcctcgcacagtttcataaatatttgtcaattgaattaaagaaaaatttcaagtgtacttgcacgggctaaaatgtactttgttatttagcagacaactaaaacagatgcttttggggttgtacaaacttaggagacattgaatgacaaaggcaatcccttttagtaactatgcagtaatagattgtaaagcccttgggcattccaacaccctggtggagaaaatggacagcaagcccacagggccaagagcaaggccttgggtcaggaggcctgtaaagccttcaagagtcaccacagctttctaaagcctcctatgcccatgttgcctaacttcccactatttctgttgttttaagaggatagttggaaaggggcaggatttggggcgggggcatggagaactgcttagtcattttaattaggaaccccagctaaataaatgcacagaagtgttatttaggactaaatgtatatttaatgattaggctactctgttccttcccttccagccccacctttggaaaagcataaggtattgattgaatatgccatttttcctgataccatgattacgctttagtattttatgggactggccgggcgcagtggctcacgcctgtaatcctagcactttgggaggccaaggcaggaggatcacgaggtcaggaaatcgagaccatcctggctaacatggcaaaaccccgtctctactaaaaaaaataaaaaataaaatagccgggtgtggtggtgggtgcctgtagtcccagctacttgggaggctgaggcagaagaatggcgtgaacccgggaggcggagcttgcagtgagccaaaaccgcgccactgcaccccagcctaggcgacagagcaagactccgtctcaaaacaaaaaaaaaaaaaaaaagaattttatgggactaagcttttaattaagatttaatttaattaaaatattgtaacatacatgtgcaaaagccttttcttctatcaccaaagcattacctccaaaatgtagcataggtgtgttatttctatagatgtctggagaatatacattaatataaaatgctaatggagatttaagttagttagtctttgacctctggaaacacggttttattttgattgcaaaaaaaaataaattggttaattcagagaaatacttcatatgtctctacctcattagtagagagggtagtgagagcttggcaggtggaatgttttaattttaaaaatttcagatatagaaggaaaatatttaactagatgaaacatctgaagacatctgtcatttcaatgatactactaagtcctagaggaagatttggtggtatcattgaaataacagatgtttccagaatgcttcctgttttcattcctattggtcaagagtcaagtgaaattgtgtcatttatctttatatacagtctgtatattccttttgtggtaaaatttccagtatatttttattataaccattcttagaaattgacagaaaaagttaataactatccccccaaaagcagaaaagtatttattcacatacattatattttatctttttcttttcatttagaatttagagaaaaataatatttttgtagaaatagctaaatttctgtgtaattttgtttaaaaacgagtgatactacctcccaagtgtcaaggcttaaactgtagtttgtctgtttcagcacacatattaattacttcaaactaagaatagattttacattgttggtctatgataagaaagctttaacttcaaagaatgccaaaacggtggcagggaatggtggtaggggctacaagattcacacttgaaaataccctggccgggcgcggtggttcatgtctgtaatcccagcactttgggaggctgaagtgagcagatcacttgagctcgagagttcgagaccagcctgggcaacgtggtgaaaccttgtctctacaaaaaattagccaggtgtggtggtgtgcacctgtggtcccagctacccaggaggctaaggtgggaggatcacctgagcctgggaggtggagtttgcagtgaaccatgattgtgccactgcactccagcatgagtaacagtctcttatttaaaaaaaaaaaaaaagagagagagaaaaaaaatataatgttcttcactttatcagctggcaggtcagtttactgttttcaatacacattacttggtgttaactaacccttgcaaattagtgtcataagcagtggatggagggacaaggttccctggaatgccttcaccctcagaaaacacaaaagttatgtgaagagctgatgaggatttttatatgtttgtttgttgttttatttgtgttagagaaaatgcagtaggataacgtgaaaactgctttgaccaaaagagaacatcagccgtctgtggtggttcatgtctgtaatctcatcactttgggaggctcaggcaggaggattgcttgagcctgggaggtcaaggctgcactgagccgagatcacgccactgcactccagcctgggtgacagagcgagactctgtctaaaaaaaaaaaaaaaaaaaaagaaaagtccatcagtgacttactttttctttattcagtgccatctccacgtccagacaattctttccatgaaaataatgtgtcaactagagtttcttctctaccatcagagagcagttctggaaccaaccactcaaaaagacaaccagcattcgatccatggtgagcattttggtttgtttttactcttcctttttttaattgtagatttaagagttgaaataaattctggatgagctttttagtgtcctttctcctgctaggcctttttttctctagataaattattgaataaggaaaatgtgatttttcattattggtaacttttttccagtttggcatttagattaaatatcatgtaagggaaaaaaaatctcctggattattaaatacctgatacgctttccactgtgttgttctgatatgaatgatgacttttgcggtctccttttgttgacattgagccaggtacactttgcttagcatttgatgtgcatcgtctcagtcagttctcatagtcacactgtgcttccatgctagtggcagggacactgaagcttggaaaagtcgaggaactggcccggtgttggacagccagtaacatggagaagggagccagggttcaaacttaaatgggctccgactccagagctcatggttgttacctctgtgctacctgtctgtcattcagggtaaaaagaaataggggaacagtcctttatgctaccataaaagcataatggtaatgaaaggcacaaatgatgtggcaacttttcttattcttttatcttttttgtgtcgcatctaataaatatttagggagagaattacagttttatcaagatccattagcaaatctgtctgaggagtaaggactttaagaaaaataataatgtagacttcttctcaactaccctgaaagactgcccaggttctctaccaagagcataaaatgggacatcactgtaagacactggatttggaacaagaccagtctgtcagagagtccctctctggtgtttgttgccagaagtaacagaagggccttatgtcagtactcctgactccatgtgatgtcacaatttggaccctgttgataaagttacatcaaggtttcagtgttgttgtgccctatagtgaaaattacttaattattcttaaaacaatataaaaaatgacttcttaaaagctataaatacacttttgctgtataagcacaatttacatccattgcctatttataaaatgacagtcttaatgttcgtgactaagagtttagactctggaaataggatatcttggttgatggcaacttgtctatcaatcagaggactgtgtctatttgtctcttggtttcctcatgtgtaaaatagggctaagaatggcacctccctcatagggttcatgtgataattaaatgaggcaatgcattaaaagcacctagaataatgcctggctccgtaagcattcattaatgttagtgactgcagttactatcgttgtcatctaacttcaacatcaggtgtttcccctccattttgatgataaactttggtgttctttctccatgtgactgttttaagctccctagtatatagaaaagatctgcgaattaacgtgagaacacaagtataacttctttacttaccagtgttgaccattttctggtgtggctttgataagtcatgacaaaattgtctaaatggtgagaatacagaagtgcagaaggaattggattctcttgattattacataatgaagtggtgatgatttaaaagagtaacaattacagattaccttagtcctgtgaaaattaggtcagatcaaaattaaatccaaatttgagatagacagtgttagtaatgtattatttctgtcttttgataatcagtttaagtagaacttgttttacgcgtggatatgtacagaaacctaaaaagagttgttttaaaaagaatgagaggctcaattgggatgttgaactttagttgagtcttcatcaggtcatccttattctagtattgctgttatgagacttgagagttccagaattgccagtgatgaactggctctattcttttgtttctgttaactcttcgtgataatgctgctatgacgtatttccttccttcatcgcatctcacttagtctgtcattagttcaacttgactcatcttgattttttttcttgaacaagctctcgaattggttcatcagattcttcatatttgagagaaatgcacatttggtaacttacaaaaaacatcaaagagccttgttatggtaatatagtgaattgctattctttgttgcgaggggatggagacagggtctggctctgttgcccaggctgtaatgcagtggtgcaatcttggctaactgcaacctctgcttcctgggctcaagctatcctcctacctcagcctcctgagtagcccagactgtgggtacatgccaccatgtctggctaatttttgtatcttttgtaaacatggggtctcactatgctgctcaggctggactccagctcctgagctcaagtgactgactgcctcagcctcccaaagtcctgggattacaggcatgagccactgtgcctggccgtgaattgctattcctaaataatctcttacctaaggtcagtctgtttttccttggtagttgtacttcagatttacttcaggaagagaatatttgtacagtgtacccctttcttgcaatggaaaagtcaagctactatgttatattttaaagcaataaatagatattgcagtatgatatccagagctgttattctggccatctcagttatgtagaacccacttaagaatcaggagatagccaaaatatctcagaacaagcaaaatagagttaatatggtgggattaatcatctttactaataggataacacccctaccctcatttggagtctgttcttcatttatgctcagttctagcaggcagcactgaggttgtcagggcaagaaatagttcaaggtaatactacagtatgcagagggaaaaggatccaagcaatagctatggagagaagcaggttggaaaatcatacatatcatagatctctatggagtgtgtgtttataaaacaggcagcttcactttgctttgaaagacaaaatgtataaatatgtttagaaagactgctgtcaattgggttaaaaattgatgtttaaagagtaaaccaaattacttagaaatcccactagttggccaggcacggtggctcactcctgtaatcccagcacttagggaggccaaggcgggcagatcacctgaggttgggagttcgagaccagcttgaccaacatgggaaaaccccgtctctactaaaaatacaaaattagctgggcatggtggcgcatgctggtaatcccagctactcgggaggctgaggcaggagaatcatttgaacccaggaggtggaggttgcggtgagccgacattacgccattgcactcgagcctgggcaacaagagcgaaactccgtctaaaaaaaaaaaaaagaaagaaatcccactagttaaatgaagaattgctgtaacttgcacaattccagccttctttttctcgtaaggttatgaatatattgatatccattagtgcttgtcatcataactttcagagttactcccgtagaattattcactgactctctcttctcacacattagctaaccacgcttatcacatcgccaggggaggggcaggtggcagagaaagtgtcacagagtaatgctcctcaccacttcagctcaccttccatgctgctctcagagggattatactgaagtcccataagcctgaccatgatgctcccccgccccattccctagctgtcaaacctgtcccctacccccaacaagagtctgtgagcagcttgagtgagatcagattcgttcttttatttttctctgtttcttcaacacctaacacagggcctgacatgtataaagtacttgctgaatgttggttgagtgattcattggattttaattccttcctttctttaggtgaatctttggaattgtgtctcctcttggacccttatggaaatagctgtcatgttagataacgttagagtcccatgcctgtgtgcctgcttaccacttgtctcattgccctcctcccgtactgttttggtcccaactgctgctctggagaaggtgccaggtgactggatgaatagtccttctcaaagcttctgtctctgagattgatgtgaaccccctatttacccttcttttgtgctgctcctctttaccccactcagcacgaagctgctgtcttccaggtggaatcacaggggccagaatgcgcaaatgagggaaatgaccaaccacacccttacccatatggctcagttccagctgtcaatgtataactcattctgcattcctttatacaacacagcttttcaagtgcctttgttccagccagcctctttccatctgtctctgagtcactctgtcagccttttctcccttccctttctgtgttaattctttgggtatgtatgtttctgcatagcttctcgcttgttttgtttttcctctctgacatccttctttctgtctttggtgatgcaaacacacgcttcgctcctagttttcacccaccagttcaagggtaatttatttctttttttcatttggcctctgggatctttctctgcctggatctttgaaaatgtcccaatcattcctctatccccacctgggctgtggtttatccagtgcctcttgaaaagcccctgtagagggtctttggcccatcttccctgtgtcctggggacccaacgatgcaacatgcaaactgcaaacattgagctttccttttattaccctccccttctcactttcatcttattcaccgtttcatcctgcatagattctcctcttaccatgcaagatcctacttcctcctaggactggtgtctcaagccttcatttcctcttgtgccagcattaacattcttacagtaatgcccattcacattctgagatggcagtcatgatgaatatgtcttccttaaagatttgctggattggcagaaagcacttttaccctcaacacacctgtggtattttgtgagactttcattctgcttggtaaaaacttctacccattaatctgaatattctgttgtgcttctaggttgtgtttttgcagatagtattgtggaacgacatagctttttcataaacgtataattctttaacctctagaagttacagaacgttaaaaatagtattgccatttctactagatgctctctgaggctcctttccatccagagtcatgcttttgtgattccagaaaaccccactcttctgcagtgttccttaccaatggcaagtgactgaatgctgtgtcttggagtttagcttacgacagtctgtctttaagccccatgcaagagggtttcatctccttaattgcaaaagaacttgtcacaagaaacttttaccaaattcccagggcctaggcccagtctgtcattgggtttagaatgtttttcgcaacaatacaacactacatttaaagactcttttggctggccgcggtggctcacacctgtaattccagcactttgggaggctgaggtgggcagatcacttgaggtcaggagttcgagaccagcctgggtaacatggtaaaaccctgtctctactgaaagtaaaaaaattatccaggcctggtggtgcatgcctataatttcagctacttgggaggctgaggcaggagaatcacttgaacccggtaggtggaggttgcagtgagccaaaatcgcaccattttactccagcctgggcaacagagcaagacactgtctcaaaaataaataaataaaaataaagactcttaagttttcaacacttacccatttcatcatgtctgaagttttctggctttcaaaattataaatgtatcattctgagttcagaatacctggtggtgtcagtggtatcaagcttaatgtcagtattttcagttagaagcttttccccccgccccgtgaaagcttttttttttttttttttaaagaaacagggtcttgccgtgttgcccacactggtctaaaactcctgacctcaagcgatcctgtcccagcctcccaaagtgctaggattacaggtgtgagccactgcacctgtccctacatttttttcttaactatttttatttagttttaataaatacataaaaggtttaataagtaggatatttccagtttctggcaaatttttactttcattcaagatgtttttatagctgtattgatctttatgttcagtatcttgacaagtcgctaataataaacttgtcgagctggtttttaaaaggtaaatagaaaaatgaaggtaggtgttgaaaatgttttgctctttcccttgtagagttacagaaaagccatcctttaagctgtgtacttttcataatctcaaactctgaggtcttcaacagcatggaaatagtcttgcagcaacagttacaggtcatataatgctcaaattgctcttttgagtgagcctgtgccagaggataatcactaaccatggttgattaaatttagttcctcctgtgcttttttagaggctctttacccaagtgtttgattcttcccggctataggaacctagtgtcatgcattttcagtccttattatatttgtcacacaatggcaagaaaatgattgaaaaatcaatatgataaaaatgtcttctcatttaggaaaagtcctgaaaatattagtcattcagagcaactcaaggaaaaagagaagcaaggatttttcaggtcaatgaaaaagaaaaagaagaaatctcaaacagtaagtagatgaccagtttctatatataataacatgtttctgcattattcaatggatactttacactttgcacttggcaatcaaagttgattgttttcttattgagacttgacatttttgcactgtattatgtctctttctgaaattctttacaactatcctctcaacagagccttttctacattcaacagaatctccaggaatagaagaaatttaatttggatgacagagaacactttaagcctttctcaatatacttcttatctatgtgggcttatattaatgtaaaaactttgaagacacaggatttgtttctctctggggatttaaagatatgcataaacttaggaaatgggttttggtttacttttaaatgttgaaatttgtaaataaccatcattccttattctctcctggctggttacagaattcctacgttgccaggtgtgtttctgagttatatagtcacaaagatcgtatctgggattttagggcttgcgttagaaggaaaatatgtttgccttttgatcgcgctgtgggttggaatgcaccttatctcctgggagccctttgcctgaacaaagagctggctccatgggaccgttcacatcacttcactgaaccacccaagcaaggatcctgctggtttagtgacatgagaaccttggggaaacccggcctgtaggacagcagcaggagtagttcttcccctagatgaggctgcatcccccttttctttatgacaacttcaaggctaaacaaggtagagttagccgtttttatttatttatttattttagagacagggtctcaccctgttgcccaggctggagtgcagtggcatgatctcagctccctgcaacctctacctcctgggctcaagtgatctcccacctcagcctcccaaataactgggtgcacgccatcacacccagctaattttttgtatttcttgtagagacagggtttcaccatgttgcccaggctggtctcgaactcctgagctcaagcaatctgcccacttaggcctcccaaagtgctaggcatgagccactgtgcctggcctagttagccattttgaatggttttggttctagttttacttcatacgtaatttattcttatttatttgaagaggaaaaagacacaatcaaaatggcctgttcagatggacttcactgatttcatctataagtttagtagattagacccagtgtttctgaggccctttctattatgaaaattatagaattatgactcaatgggaagtagattaggtagatgttcatagcaatgtgtataaataacctgaagtaagcatttttatctcacagatgttctagaaatgttaacaaataccttcctagataatctttctagatcattctttcacttgcttgcttgttaaatttatgtatttccttataaaataaatatgagttcattatagaaaatttgagaaaaagaaaaagatcgttttaaatcttaataccctaccacaactagtattaggattttggtatattttcctccagctgtttagcctatgcatatgtttgtggcaagaaggtggggtttttttttgtttgtttgttttttaagttttaaattagagcaatccttttagtacgattttgtattctggcttttaacagtttatctatctatatctacatgcacagaatatgtatgttactacaaatactttattatcttcaatcctaatggctgcataatatttctgaagtagtcattaaaaaaactgcccatatttttaactgaagcttacttttaaagtgtcaaatcaaaatgccactcagtcagatactactataattgttacttaaactgggtgaacaaatagacctgatttaacataggaatacttaaaatgtttaaagtgttaataaaacttttatcattgtctgtagaacatgtttctctatcatgagcgttaaactttggctacctcctgaccactgttatttttattttgtggtttttgttctaaaccacaggtctcctggcattgtggggtgattaagtggtagaaagtaggaaagattaaggaattgaaggtgtttttgtatatagatttagattttgatgtttactgtagagcaacattaaacctaaagtccctggctcactgtggcacaagtagagtatacatgttggctgactttattattcagaatttagttaaattttagatattttagtaatatagattagagtaaaaaggaaaataaccattctctaacatcctctcgacttaaactttttattaggttttcataagtttcctttttgatattaaagtaactgtagaatatctctgcataggccataatgccttaagctttaccaacccaaaagttgtttgtatctctgcatcttttaattaaatgaaacataaaatttaagggctttgggatttccaaagagcgctcagtacagccttccaaacctcagagtcctacgcctgacattgggttaactctgcctactttgaatgagcatttaaactgttaatagtttttcactttctagaactcagcaaaaagaaactacatagaataagcttcaaaagatttaaggcattgtggcctttgcataagattccaaaagaatgaaaatctgatgcccagtgtacatagagacgcatgacatgttaaagctgaggtggatcctaaatctagttgaatttttttattcactggtataggaactgagcccaagcaagttgtgggcttgcttcaaagcccaaaaatcacataatcaactgggagaaccagaactgcgttctcctaaataccaagtccaggctcaattcataccatggacccgcctctgtggggagcctctaggagctctcctctggcctcttcagcgatgcaagttaaactcttcctcgaggttcctgtcattggaacaagaaaatttgtgggatgttttactcaaatccctttttacatatacccttaaaagattacctaaatacttgaataccttcatagacattctagttctctgacaattgagatatccaaaacagggaaaagtggtgacaaaaaaaaataattctgtattgtaaaggtgcctgcttcgactcaagcaaatctggaagctgccttgggaaatctggctttggttacatatccagagttacataagtcctcagagcatatggtgactttgccaacttggtaattgtatcctagttagttagtatctcaacttgtgatgatgcttccatttaaatattgaaatttctgtttcttctctttgaaaaccagtatctgaattgtgctagatgttttccattgggtaaatatttctagcagtacagaacaaggcctcttactcaacattagtatcccaccacagtgatcaatacctcttcctagtgatgttttcaggcttaaaagttgaccaaattcgaaagggtttccagtatgttgggattttttttctcctaataggcaaattacatggtagattttttacttgctgaagtcctctctagcaattaggagaagattgaagtttatcagtagctctttaacacagttctttataaccatatttctgatagtaagtaaaaattatttaacgttttataagcttaatgtgagtaggtgtgtctaggtctcttggcattcctactagaggtattgatcatgatctcacattatatacttagaagaagtttgtgcttgtcttgaatttgcattattgacatcttcacatccaggtgagaattggcacagaagctctagatgcacagcaccgagattctttcagtgactgttaatatttagcaatttgagggcttccaagggctagtagtttcaataagagcacttttttttttttttgcaattagtttatttgtatcttatattgcagacagattccaccaacggggagaatccaagcatcaagaaatccctctttcctctttttaattcaaagaatcatttaaagcatagttcttctttgaaaaagcttcctgtagtcactccacccatggtacccgtttttatgtatggtagccctgaaaactgctccagtaaacttgttttactgatgacaacagcatgtcttattttcatgaggtcatattctctttatgctagttaagtacgtgagccagttccataaattcactgggatataaattcattgccattcttctgaatcagttaagaaagttgaagcacaaagtctattaagcaaacaaactagtgaaaggctagtttgtcatgtctgattagccagttatgggcagataacatttataaaagcctgtattttatgtaaggaattctgttaacatttacagttaacaaatatctttgcatttgactcacagagtttgttaacacttgattggcaatttgtctttttgaagccaagttgaattgaccaaattgaatgagctaacaggctccatgaaaaaacagcttgtttccttgtctggcttgagcttttgctggtcagtttaaaaccagggcttttgcttggcatttgacattactcttctgtgttcaccaaaactggtgaatagagcaattgcattcatctggaatttgtggcacagatttccagcatttctctagtacataatgatagatccagatatatcagacagtggtttgggaatatgatccaaaccatactttctcactttgctatccttgaaagcctaccagacttctttggcactaccatatacagtgtttggatcattttcccagcaggaaaaaatttctgttttattgaactggttcacaacctaactgcaatatggaatgaggatacgacagcaattcctggtacagccctatttaactgctctctcttacagcgactaaaactaacagcatgggaatgctttaagggttgaggtttaacaaagctgcatgacatctgccaatttttcctaatgcagggaaaattattaagagggcagaagaatttaactagcatcacttgcattgtgaacattgggagagattggggttctatttttactgggttatttgagttttggtttggtttgctttttagtttggttctcctcttgggtgtggttgcatatcttaattaggcttctcagtgtgcttattgaatgcttgtccatattttgctctaggtacccaattccgacagccctgatcttctgacgttgcagaaatccattcattctgctagcactccaagcagcagaccaaaggagtggcgccccgagaagatctcagatctgcagacccaagtgagtggatcctgcaccactgctagactctccaactctccagtaactgtcctgaggagcggggagggcatgctagagaaaacttagcctctcaatgttacagtaaggctgagcacctcctcaaaatagaccctcagttatagccagatgcatctcgtgagccaggatgaatcttgcttcagtgacccatgttctactgggaaagatgcaagcttctgttagccttcacctagctggaggcaactgaagatgtagtcccagcccataaatacagcccaggaaagagctgagctgtgttaaagaaccataattcatggtaaaaaatgaggcatgccataacatttcaggcaggatgaacacagatggtgggaagattaaggtttcattaaaaataatagcatacaaattgaaagacaggtatgataagttttcttgaaagaatatttcaactcctgaaatccatactgtttttgacaggaaacaggcaaacagttgcattaggaactacatattagactgtattatatagtcacatttatcttccgtaatggaggaataagcagaaactgaatcagtaaatttttcaggtatctgaggtttatctcctttaaacaactattttggttggaaattttgtaatgtatcttttcagtatcccataatgagcattttgttttttgatattgagtattttataaatcctttattcttctgcactataatttctgacaatcctcccgagcttttgaggctataggattacttgtgtctgtgatttcttgtgtcacagatttctgtgattgggagagcggactactgtttttttttttttttttgagacagggcctcaatcccattgcccaggctagggtgcaatggcacaaactcggttcactgcatccttaacctccctgtgctcaggcaatcctcccacctcagcctcccaagtagctgtgactataggtgtgcaccaccacacctggctaatttttcgaatttttggtagagacggggttttgccatgttgcccaggctggtctcgaactcctgggctcaagcaagccacctgcctctgcctcccaaagtgctgggattacagggatgagccaccatgcccagcctctgtttactctttttaactgtaagctgttgcatagaactgctggcagaagttccccatattcccattctatttgccccagccatttatattttctgcttctaacataatataagctggggatggtggaagcatagagaaccagatatccaagtttattggatatgtatgcaaactaaagagacaagcctctgagtgagggcctgcttctctattcccaatttcaaaacaaaacaaaaagaatagagagctttagaactttctttgtgaaaccatttcttttaccaagaagccctctctctctctctctctctctctctctctctctctctctctctctctctctctctctctctcccccctctctccccccccctccccccccttctctctttctttctggcagggtcttactcaatcactcaggctggagtgcagtggcaagattatggctcactgcagccttgacctcctgggctcaagccattctcccatctcagcctccagagtaactggaactacaggcacacgccaccatacatggccagttttttaatttttttatagagacggggtctcgccttgttgcccaggctagaagctcttttcaaataactttatagctcttgctgaatgcagcttattgtaattgcttgatagttacatgtggtcaaggctataaaaatcaccaggagtctcatcgtgttataccaatttaattatttttaaaaagccacttttgagcacttagagtgtacagtgtgctctgctacttcctgtagggagcacaaagctttcttgggaagactttgaaatgatgatggagaatactttcccctgaaacaatatctacttgagtcagttctgaagccatttaccttgggtttcagtgcctagttccttcaaatcttgtaatgttccttgagttcgtcaacattttattcaaactttactgagcccttaaatgcatgtcccttataccatgacatttacagcaaaggtactctgagaattggccccagaggggtcccaaggctagggttgtagcccaagtggccaaatccagcagtcatgattggctgtgaatttccaagtgctttccatgtctcttccgagatcgaggaagaggagattgagccatctttcatcgttcaggagcatgaggctcaggaattgtccagtgagcagacggctctgaggctcctcccctctgccctgaagtcagtctccctccttgatgcagcacctggggatgtctagctgcacagtagacagacaggcagggcggaccactgtgagcccatgttaggaattgaaggcctcctgtgaattaattctttagatagttctgatggggttttgcatatttctttgtgctttgcattttcaatgcccaaatgttaccctccccctttcaaaaaaaaagcaaaaaaaaaaaaaaaaaagtgcagcaagggaacatttgaattttgcaatatcgagagagggaaattggggagataagaacgaaaagggctatacgacttgtagttgagtacattgctaactaaaacattccatattttcagcttctcttgctgctagatatggctgtgtacctaagttctagctggtaaaatataagtggaagcattttgtggagcctttgggaagtcttctcaaaacagagaaacatacaccttttgctttctccttcctgctggttgaagcatgagatcccctgattagagataggatgcaaccaggtagatgagcctgggcctttgattggctgccgtaccagctctatatgtcttatctagatttctaggcttttccattaaataataatacagtcttgtttgaaaaaacccgaagaacagatatggctggaccggctcctccttgcacatgcttgcccttcctggccacacccagtcacctcacctctaagcccccttccctccccagccttatggtcgctctaacttgaatcctgtgtgcattctcatcctttctttcagagccagccattaaaatcactgcgcaagttgttacatctctcttcggcctcaaatcacccggcttcctcagatccccgcttccagcccttaacagctcaacaaaccaaaaattccttctcagaaattcggattcaccccctgagccaggcctctggcgggagcagcaacatccggcaggaacccgcaccgaagggcaggccagccctccagctgccaggtcagatggatcctggttggcatgtgtcctctgtgaccaggagtgccacagagggcccttcctactctgaacagctgggtgccaaaagtgggccaaatgggcacccctataacagaacaaatcgctcacgaatgcca

SEQ ID NO: 181 - DNA, 5672 bp, mus musculus
gagaaaccagaaatggtccctgctccctggaagctgtagtcgatggggggaagggtagataaatcaggcgaggacaggctggctcctggaggcatactccagcctcctgctctgagggccactgccagcaggatccagggagtggccagaaaaggggcagcagtggcgctgagccccgagcccaggcactgctacggtcacccttggttactcggtgattgattgatagggctgcatctgtcctctcactggtggttgcctgcctgtccctttggtagatgaccccgcatgagatcaagtttgctgtccatgtcgaatcggtgctgaaccgcgtgccgcagcccgagtaccggcagctgctggtggaagccatcatggtgctgacgctgctctcggacacggagatgaccagcatcgggggcatcatccacgtggaccagatcgtgcagatggccagtcagctgttcttgcaggaccaggtgggggtgccagggagctgggttggctggcatttatctctgttgaggctggagattctgtgtccaataggaaagaatatactcgaaccaagaaaatgtcatcacagatgatggggaaaaaatgtcaaccacttgcttagaaaatggtacagtggccacttgggaaatctcaagacctttggggatggataggcctgtctcaatgcaggttttcgtccaaacaccaccacttgcaacacatgtgaccatgggtgaaccccttaccctgtacacaaagtcaagttcaacagagtagtcctcattatagtcaggagctacaaactagggtgcgtgataacagagtgcagtgcccagagaggtagggcattccccctggcagcgctggcttcgtgccctcatgccctcagaattggagcctctcagaaggccaaggctctactagagcaaccctcacccctgcccatgttgacccgctgccaccaccacgcagaagcgtgacggggagtgggggctccgcttattgtcccctctgccctttcctactgcaggtgtcaattggtgccatggacaccctggagaaagaccaagccacaggaatctgccacttcttttatgacagcgctccgagtggggcttatgggacgatgacctacctaacaagagcagtggcttcttatttgcaggaattgttgcccaattcgggctgccagatgcaatagggtctcacctggaaacatgatcacactctcaatctgtcacgtgccccctagccttactgggaaccttctgtcccccaagatcccctgtgctatcaggaaagcatgtcccatcagaaacactctcggggggcaatggtagcactcaccctgaaactgatgtatgttaaagccacagagatagagctgaggagtcctgtgttcccccgcaaggagcaccccgggatcattttctaggttcatttctctggaacatttgctgtagcatctggtctcacggactctgaggaggaattggaaattggtctcttttgagtgcagagggaactgagacgccagcttaaattggctcttgcagagagttacagaaatagtttcgatgagctagtgacacatcctaaagatgcaaagatcctcctggcggcagtagccttgacaagggccacctcttcacaggatgcagtctgtctgtgcaccaaactcttcaccaaatagaacacttgtgtctctctgtggaatgggggttttcttgtgccttgcttgctttcatagccttccattttattggcatggctgccttgatgtaacataattctctgtccccaagatttagaaaattcctcttcgttcaccttggctcatggtcttccagggtttttatcctggctgtctatgaactagggttttctcctgccttaggaaaaatactgcatcttctggaatctagaaaaaaaaaaaaaaaaagacaaggctcctcttatagccaggcaagcagttgtttagggctagacctgttgtccccgctcgcgtggggtgaacgccccgcagtggatactgtcctcctgtgctctgggcgaggcgtcatagggtgagcacaagtcagcagtgccatggaagtgaacaggcatgtccccgcagaaacaatgcttccctctgaaaaatagagccaggctaggaacctgtaccctcttggtagaagcactttggtcttcactctcttgggtgggtgcagttggaggcaccgattggaggagagcaaggttgagtcaggtgtcagggtctggcaaatcttttgccaatgccctagcaatggagtttctctccgggcattgtcttaccttgggggaaggaaacaaaaccaatgggaaaacagtttctgtaaataataaaccttgaaagacaaatgctcacctagtggccaggaggtgcgctctgtctggttgagagcaatgggctagattatggtggactctgcctctgcctctgaaacagagatgaggctatgggatcatttcctcggacatctgtatggagatgcagagatcaacgtgccctagctgcttcgagtgggcatcgtgatgcccagtgcccctcagagccaagatgcagtactgatggttattcctgaagcggaggagaggcaggtggcctcaggtgcctgacagcttcctggcagagtcctctttgggctgagtcaaaccctttgcagtctagaagggtttggtgtgcaggctctgcccacatgggacttccatgccgtttccatttcttccaaaccataatgctctcccttgcagaggtgcagagtagttaggtaaaggaaaatcccccggagtctctccatatctgctacagtgggcttacgcgtttcttgcattttgggggcagatcccagagacaaggagggcggcacatgagcagacatggcaccaggcccctgcccccttgggtcaccctgttccctccccatcccacaacagccgctgaccagagcagctcttccctcacaagccagtttgctccctttgcccctgaggctccacgggctgcagcttcccaggtctggggggtcgcattttcatagcctttgcatgtgtgtgtgtctttaagacatgcccgacagaaacaagagtcttggagatgacacgtaattcacctgccccgtggatcatttcaaacagataacgtgggaaaggtataagaaggtataagtcatgaaagttgttcttggaaaaagctcaggaagagttagagccctccagaatgagccaggtgctaatttagaacagtcacctgcctgccaatgatgatgacgtgctcagccaccaagctgcgggccgggagaggagccgtaataagcgattccaccaagccttccagccactcctttgaaacctctttaaaatgaaatcctgaaataggaccgcatttccacaggcatcaagctgtcagcttcaaaggagaacaggcttctgaggcctggccccttcagcgcgcagctgaggcccccctccccgaggagaggagcagatgtttgagggcagagggcctgtcctgacagcacctgcgtggaggtggcaggaggggattgtttctaggccaggcgagaggagcctggcagcccctggagcctcgagccgggggtggcgggggcaggaacttctacctccctgctcagagccaagaagtcaatttgaacctttgctggggctcggtattaacacgttctgccttggagggcaagccggtggggccaggaataagcattccttttaacaacttcagttgaaaagcagccaccgccccacccgctgctgtccctggctctcatcaggtgaattcagcattcctgccaccctgccagtgcctctgtgatcctgggcatgagttgaccactatgtacctcagtttacccatccacaaaaaatgcaaaaggccaggactaagcatgggggcgtgacgtgaactcccgctcctcctctggtcaagggcttcatgcttagaggaaaccagataagccctattgcaaccccacctggagtggagtgggggaggatgaggaggagggggagaccctaccttccacaggcccagggactcgaggggtggggctccattaggagatcagtcggggcatggtgaaggggaggagaggttgtcaaggctcagctgcctggacagagaggatggaaatactccctgtgtgaaaaaagaaaaggaaaagaccccagatcaggaggcaggaaatgcagtttggcagagttggttgatgccacttacttctggacaagaagactggaggcttggccacccttgatggaaattgcagcagaaccatctctctattctgttgattcccgcaccaggctggcaaatagcttttgtcttttctgcttccttgttgcaaaagggtacaaaagcctcccacccaccccacccccaatcgccctttgtgccattatctttcaaggtgacttagcttttgaagtccctgccatctgctctgcaggcctgtactttgcaggatgtgagagcaccgcgttcccagaatgccttctgttctacccgacgtggctactgatagctctgcctgtgaggggaaaagaaagctgcgctgtggcccccttaaagcccagtccctgctgtctccctcaaaaagccacttaggaaagccacggccttgaggtaccaagagagttctttgagaaatgagagtggaaactgtgagagaggctgctctgcagtcgagtgctgggcacgtctgacgatgcctgggagaggaaaaaattccatcaaaaaactaccatggttttctttagaggaacatatgtgcacttttggcaaaacatgccttctcaggagagctggaatagttggaaccaatgaactctgaagtcatgtgattcgtccctctgtcttcgtgcagtccttaaactattctgaaaaatgcatgaatccaacacgaatcctagcatttctgccatgcccactgagggccaggcaggcatacagcctggttggggggtgggagggtgaaaagtatctctttttgtgcttgaaggcccctgaggaagcccctaggctcccgtggtgagtgttccctgcgctggcctagcagggtgttggtgtcttgagcccgaatcctgtgcagcattggcccaacccttgcaggtggccgccacccctttcccctgcagctggcatagccaaggtgccaggctctgcaaagggtaagctgcatctgaattgggcacgaggggatggttgtgccttccacatctccttttgtgaaagatcttcccagatgcaaacccaggatggacttgccaaagagaaatcccagtaactggctctaatctctgtgccaccagctgccattgtctcgaagttcatttgcaaacaacagaaaccaactgtggctgggttaagtgggaagtttattaaacaatattggataggtcacatggtcaccaggctaagcggctccctagccaggaccaagatcccatgtcattctccagtactcccaggttcataccccaggacttacaccacagacacccccaatgctgggcactgtcactgggaccactgcctctgctcttttggaaactaaatgtagaggcttctacttgtcaccaaaagggattttaaacagccactagctgccacttcaaggtctcaggcaagcatactg

SEQ ID NO: 182 - DNA, 10646 bp, mus musculus
aggaccacttccggccagggagggggataggctcagacacaaggagaggcttggagagagcagacgccttctggattcaagaagacgaggtgagctgaggtacctggctttagtgaagaccctgtgggggcttcctggctgcggcttcgacgtgcctgactccacacgcccctaaggtttgaagaaaacctgctggaggtttgggacctaaccgcatcaaagtcgcctttagcggtgcctggacccagttcgcacgggaggaagtaggaggcagaatcccctttgggccacagaaagtaacgatctggactcggttcgggccgtgaaagggagggatgcagacctagttgggaccgcagaaaggaaggatcgagaaatccttcagacggtagcaagaggggaggaggatacacacagttcgggagggagataggagacggcaggactccgtttaggctggagaaagggggcagtaccccgtttgggccacagaatggagggatcgggacccagagataagagtgggcagcatcccttttgagcaacggaaaggaccagactcagacaggagaaaggaggggatatgacccggttggttccggtttgaaagggaagagacaggacctggtagggtttgagaacaggaatacacagaaggttcatacagttggatttgggggtgaggtattcatgttgcagaaagggcggagctgcacacttgcagacgtggaaagaggggggagtggtgttggttggggaaggggtggtgcagagacgtaccgcagagcggagggagggggcttattaaaggaagggaagatgaagagaaatgctgcagagcggagggaggggggtgtattgggaaggggcggtgcgtggcagtaccgcagaggagagatgggcggtgttggggtaggggcggtgcggagtggtactgcagagcggagggagggggctagtgttgggggaagggttggatcgagatgtgatgcagttagaaagagtgggtcggggtggcgccaagatgttctgttgctctgagagcagggggcagatgtgggattgagctggttagaaactgtccggtttaccaaggcgcatgcgcgcggagggcattgaagaatggttcttttgggatagaggtgggcctaagatggggggtgggggcgcctctagtcggtgcgcatgcgcactatcgagttgcggagggggcgtgtaaaggggtggggtcgtagaactgactctctcggaggcaaaaggagctgggccttggaaaccagatggcctgggttttttaggtatgaaaacccaggagttgaagggattagggcccaaggttacatgagactcccctaagtcaggataggtgagatgtctgatgaatctccccctccctctcattctctaactcaggcccattcccctcaggctcacctgttactcggcctcccagaaagatggataggagaaatgactacggatatagggtgcctctatttcaggtgaggcctctctgcattctctctaggccatctgccccatcctgagttcacttactgctcttcagaccccttccaccgtgtagtttcataattccctgcctaactcgtctcagtcctcccttacatggtgaaggagaggagaggaaaacctgcctgactctattccttccttgctccctaccccattttaattaaccactgctcagaggaagggaaggcctttgtggaaagggatgggctttagcgaggccaaatggcccagaggatggtaatcctaagtgtgtagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaacctgccagtcattacccagatcagccaggctttacctaccactgaggtaaccaatactcaggcttcttcagtcactgctcagcctaagaaagccaacaagatgaagagagttactgccaaggcagcccaaggctcccaatccccaactggccatgagggtggcactatacagctgaagtcacccttgcaggtcctaaagctaccagtcatctcacagaatattcacgctccaattgccaatgagtcagccagttcccaagccttgataacctctatcaagcctaagaaagcttccaaggctaagaaggctgcaaataaggccatagctagtgccaccgaggtctcgctggctgcaactgccacccatacagctaccacccaaggccaaattaccaatgagacagccagtatccacaccacagcagcctccatccgaaccaagaaagcctccaaagccaggaagacaattgctaaggtcataaatactgacactgagcatatagaggctctaaatgtcactgacgcagctaccaggcagattgaggcctcagtagtggctatcaggcccaaaaaatccaagggcaagaaggctgccagcaggggcccaaattctgtctctgagatctctgaggccccacttgccactcagatagtcacaaaccaagccctggcagccaccctgcgggtcaagagagggtctagggctcggaaggctgccactaaggctcgggcaactgaaagccagactccaaatgctgaccaaggggcccaggccaagatagcctctgctcagaccaacgtaagtgcccttgagactcaggttgctgctgctgtccaggccctggcagatgactatctggctcagttgagcctggagcccacaaccaggacccggggcaaaagaaaccgaaaggtgagatctctgacattgccatccttaactttgtgcttcttttccatttctacccttctagtttgttcatttcttctataaaagttttactttgagctagtccctgtgttcagataggctgtggaagatgctgagaagaaggtgatatagtttctgctccctagcagttcacagattggtgaggaaataagacatccatacactcagctacaacctgtatgtaatactacttgtatttaaatagtagttaccacgtgccaggctttgtgttgggtacagttacacagggtatgtctgaatgtcttgaaagtaactcttaccaacaagggatcataggtcccagttttacacttaagaaaactgagtctcagagaaatgaagtgacttgtccaagaggtaccagccagcataattggtggtagccagaggaagagaaagacccttaggctcttatcttgagttgttcctggcctggcagaggaacgaaactccttcctggaagacagtgaaagataagctcaggactcagggtggccaatggcaaggtcaggatcaggctccactacagcaaggctgagggagggggttagagggactttctgtctggagcaggcaaggtgaggagacagagccatctctttcacctggtgactctggaccttccttctttctgatgatgaagtccaagcatctgaatggggatgagagaagtggcagtaattacaggcggatcccatggggccggaggcctgcaccaccgcgagatgtggccattttacaagaaagggtaagaatccaatgctgtccagtctcttctcttcttcacttgccctcttctctgcctccttccaagttttctgcaagcatgttaagatctctccatctattcctctcctcccaggctaataagttggtgaaatacctgttggttaaggaccagacaaagatccccatcaaacgctcaggtagtgtcctaccaaccctcctccttgagctctcctctccactcccctctcctcccatagtctgggagtaacactttatggcctctttgttctgtcatatctccacacctgccctccttgcactctgccatggctggcatctcccattaactcacttcaggtctctgattgcactgacccaacaggactggcaaaagggctgcagctctgtggcccctgctaagctcagctactctcacctctccttttctacagacatgctgagggatgtcatccaagaatatgatgaatatttcccagaaatcattgaacgagcaagctacactctggagaaggtgaaggggcagtgctggcggatgggcgcaatggggaagctttgaatcgagcaaagacatacatgtcccttttggagagaatcacagaaacatgctaatccagccccattactgtgtgaatgggcagacagtggcctagggagaggtgtagatttgccatgggtcacacagcatgtcagtgatgaaaacatggctaggacagaagccactcaaattagtctcagcttctattcatagttggacatattctgcatgtatttcagatctcacctctcccttgtatccccattttctgtctccctagattcctgctcatcacaaagatgatgttgatgacaatagtacatttgctgtgtgtttactgggtgccaggcacttggctatgtgctttatgtgcattatctcactgacttcttacacatgcagaccccctaagtacactgggagttttaggatgcccggaaagttcactgatacctaagctgaattttgtgatctcacaggctattcttttacttggcagatgtttcgagtcaatctgaaagaaattgataagcaaagtagcttgtatattctcatcagcactcaggaatcctctgcaggcatactgggaacgtaagctgggaaagggctggagtgggaaggaagcttctgcttttatctgtgctgctaccccttctttgtcctacttcccccatcctcttagagagtcaggaaaaacagggtctcaaaagccctgtctcagcacctgcacatagttggagccctgctcacagtagtggcacctgattatgattgactgaagggtataggagcctagggtgggacattcctgctgtcaggtttgctgtctctgtagaagcttcccaggaaagcaggcctgtcattgcttgcctcttccgatggagtgcctggcctggctttgacagagtggttctcaaggagggcttcctggtgtggctggatcagtatgcatgaagcgcaagagtgtcagtggggctgaaggttctgggagagaaagaagggactcacattgactgagtgcttgtgttgtaccaggttgacagccattcttccatcttcttggcaacctgaggaagggagaatatgattttcccattttactgaataatagaccaaggcttgcaaggtctaagtgccttgcccagggtggcatagagctggaagcagagactgggcagaattctgtatctgaggaatctgggagaggttagcctggtgagctggctggtgtatcttttgcggatggctgctgaaacataaaccttctttctgtcctgttgaaacataaaccttctttctgtcctgttattcccttaggaccaaggacacacccaagctgggtctcctcatggtgattctgagtgtcatttttatgaatggcaacaaggccagtgagggtgagtggctgggcatgcagctgaatgggcggccatggtctggattccatgtgttcaatttctgtccctgtctcctcttgcctcccctcacagctgtcatctgggaggtgctgcgcaagttggggctgcgccctgggtatgactgggctctctcagcgcttgctgtccgtgttgtcctttggcaagagaggatggtcctaggattgcatcagtctggtggtctggtggagcgggtggggtgctggactgggtagagggcccagggttctgacctgggtggatgacgggcaaatggtcctgaactctctgctgtctctctccttaatgtcctctgtctgttctaagctgagatgttagatagaccttcagggatccctgacaaagaggcatctggtcttaactgcttgcttctagtggccatgtgctcattactttcttcacttcattgagactgccccatgtgctagagaggtctcttccatgttgggaaatgcctctgccctcatctgggcagttctgatctgtgttcatgggttatttttcccattgtcagggtgaggcattcactctttggggaagtgaggaagctcatcacagacgagtttgtgaagcagaagtaagtggtgtttggggctttgtctggccctgaagtgttctgggtatactgatctggttcagaaagtgcttagtcagtgcctttcttatactagctttagagggatgggcatcctgtgtcctagaactgatactgtctaaaattcccatgggcagacctttccaggactgggccagactcaacacaaggcccttgcagtggggtgcgctcagagcagagggccttaagaatggctcctctgtttacaacacacccaacaggaatctgggcttactcctcacaggtggcatgatactttggccttcctgtgacatcatgccctatacatgtctcccctggagaagcccaagggactgctttgcacagggccagtgggaaatggctcagtattggaggccaagaccataaactgtgtttggtagtgagtctggggctggagggtcttagaaatccctctccaggggctgtttgtatttgtttggaggaggttgccacctggtgtctagtgcttagacagcagggttgcttggttagaaacaagtttcatttcctttttccaaggtacctggagtacaagagggtccctaacagcagaccacctgaatatgagttcttctggggcttgcgctcctaccacgagactagcaagatgaaagtcctcaagtttgcatgcagggtaagaggagagctgcccgagcttggcatattaaggcaatgggatacccttggctggggcaggcaatgcacagggatgggcaggtacagagcagcctgcagctcatatataaacatgtggagcctcctttatgtcccagggtgctgctagatatatagtttacatcatctcattcattcttcatactttgtattaatcagcatgggctgccataacaaaataccatagactgggtggattaaaaaacaaatttattttctcatagttcttgagggcgagaatcctaggtcagggtccacgagggtcagttcctgttgaaggctctcttcctggcttgcagatggctgccttcttgctgtgtcctcacatggctttgtgtgtgagagagaagagagcaagctttctggtgtctcttcttataaggacactaatcctgttgatcaggaccccacccttatggcctcatttaaccttaattatctccataaaggccctatctccaagtacaatcacactgggtgttagggattcaacatacgaatttgggggcgggcacaacccttcagttcataacatatttacgctctatcatttcctgtaattataaagacacttaggctaagtgaggttaagtaacttgtccaaggtcatatagcacgtaagtcagcagagctgaaactggagttcagaactgacccatgatagagccccaataactgagaagtttaaaaaagtattgctactagtttaatacaaagcccgtaggttaatacatgattactagggttgttttcttattatgattatcatccccatttcaggtgcagaagaaagaccccaaggactgggctgtgcagtaccgcgaggcagtggagatggaagtccaagctgcagctgtggctgtggctgaggctgaagccagggctgaggcaagagcccaaatggggattggagaggaagctgtggctgggccctggaattgggatgacatggatatcgactgcctaacaagggaagagttaggcgatgatgctcaggcctggagcagattttcatttgaaattgaggccagagcccaagaaaatgcagatgccagcaccaacgtcaacttcagcagaggagctagtaccagggctggcttcagcgatggtgctagtattagcttcaatggtgcacccagctccagtggtggcttcagtggtggacctggcattacctttggtgttgcacccagcaccagtgccagcttcagcaatacagccagcattagctttggtggtacactgagcactagctccagcttcagcagcgcagccagcattagctttggttgtgcacacagcaccagcactagtttcagcagtgaagccagcattagctttggtggcatgccttgtaccagtgccagctttagtggtggagtcagctctagttttagtggcccactcagcaccagtgccactttcagtggtggagccagctctggctttggaggcacactcagcaccacggctggctttagtggtgtactcagcactagcaccagctttggcagtgcacccacaacgagcacagtcttcagtagtgcgcttagcaccagcactggctttggaggcatactcagcaccagtgtctgttttggtggctctcccagctccagtggtagctttggtggtacactcagtaccagtatctgcttcggtggctctccctgcaccagcactggctttggaggcacacttagcaccagtgtctcctttggtggctcttccagcaccagtgccaattttggtggtacactaagtaccagcatctgctttgatggctctcccagcactggtgctggctttggtggtgctctcaacaccagtgccagctttggcagtgtgctcaacaccagtactggttttggtggtgctatgagcaccagtgctgactttggcggtacactaagcaccagtgtctgctttggtggctctcctggcaccagtgtcagctttggcagtgcactcaacaccaatgctggttatggtggtgctgtcagcaccaacactgactttggtggtacactaagcaccagcgtctgttttggtggctctcccagcaccagtgctggctttggtggtgcactcaacaccaatgccagctttggctgtgccgtcagcaccagtgccagcttcagtggtgctgtcagcaccagtgcttgcttcagtggtgcaccaatcaccaaccctggctttggcggtgcatttagcaccagtgctggcttcggtggggcacttagtaccgctgctgacttcggtggtactcccagcaacagcattggctttggtgctgctcccagcaccagtgtcagctttggtggtgctcatggcaccagcctctgttttggtggagctcccagcaccagcctctgctttggcagtgcatctaatactaacctatgctttggtggccctcctagcaccagtgcctgctttagtggtgctaccagccctagtttttgtgatggacccagcaccagtaccggtttcagctttggcaatgggttaagcaccaatgctggatttggtggtggactgaacaccagtgctggctttggtggtggcctaggcaccagtgctggcttcagtggtggcctaagcacaagttctggctttgatggtgggctaggtaccagcgctggcttcggtggaggaccaggcaccagcactggttttggtggtggactgggcaccagtgctggcttcagtggcggactgggcaccagtgctggctttggtggtggactggtcactagtgatggctttggtggtggactgggcaccaatgctagtttcggcagcacacttggcaccagtgctggctttagtggtggcctcagcaccagcgatggctttggcagtaggcctaatgccagcttcgacagaggactgagtaccatcattggctttggcagtggttccaacaccagcactggctttactggcgaacccagcaccagcacgggcttcagtagtggacccagttctattgttggcttcagcggtggaccaagcactggtgttggcttctgcagtggaccaagcaccagtggcttcagcggtggaccgagcacaggagctggcttcggcggtggaccaaacactggtgctggctttggtggtggaccgagcaccagtgctggctttggcagtggagccgccagtcttggtgcctgtggcttctcgtatggctagtgaggtttcaggtaactgcaatatttccatagccaggacccacagggatgggtacaagagctgggagatgttgtaagaaacactaaggcaggacagcagggtggaaaggtgagggcaattaaggaattatgagaagacagtgtatttggtgctaaaatgtgttcctatttgttttgttttcagatttattccccatgtttacagataccgctaataaattgcagtagtccttcccatggagccaaagtacatccttggaatctttgtccacacagcagtcaaggcagttatggccaatcagctgagggtgtcatgtgatggaaaaatctgtttgctgttcctgctttattgtttgctttctgtgtgctgtcatattttggtatcagagttacattaaatttgcaaaatgaattgg

SEQ ID NO: 183 - DNA, 3979 bp, mus musculus; identical to SEQ ID NO: 176

SEQ ID NO: 184 - DNA, 3449 bp, mus musculus
cccaggctcgccctcctccccacgccccctgctcgggctgcagttcctataggaagggcattaccatcccttccccaccctccccgactctacgctctttcccctccccctcctgtaacttcctcttcttccccggttgggccctctgctcctctgcactctcctccccagttcgcagatttccgcccaccttccgcctcgtctagccgcgccacagctagcggggtgatctttccccccctctggtaggagttggtgaaggtgagactcatgagggaatacaaggtagtggtgttagggagtggaggggttggcaaatctgcccttactgtgcagtttgtcactgggactttcattgagaaatatgaccccaccattgaagatttctaccgcaaagagatcgaagtggactcttccccctccgtgctggaaattctggacaccgcaggaactgagcagtttgcctccatgagagatctctacatcaaaaacggccaaggtttcatcctggtttatagcctggttaatcaacagtcttttcaggtaaccaaaccaagtcttgtaatttgttagaagggggtgtggtaatccgacatcgacttctgggttgcttgaaccgtgcattaatgactgtgctttgcttttgaaagttagacatgacgcatttttgaggttactcctgccatggaagactatcgggttgtttctatagagcgtagtaaaaagtaacaagcgtcaacaaatattttaaagctatttttaagtgaaagaaaagtgaaaaagaaatgtcagtctgtgtatatttcgcctggaatataaccttctgaagttgcttgctcaattcaacaagtattgattaacttacacgacaaaacatctaacaaataatctcgggtaaatagagcactttgaaaaaattatttggagccgattatctgttgcacagataagtcctctgtgtctgtcccacccacaccttcccctcccaccccccaacaccccctcccgccgccctccccttctctctcaagtttctcaactagattcataaatcttagtgttgcaagacgaagaactcaagacctgccttctaggcattttacttaattacttggggcgtgtagtaggaagaaaagttactaatagaaaagactagtacctagaattaataaccaacaaaaatcaggaatgactctttttctgcagttgatccaaattgtttctggtaacattgcctgtatttacagaaaatacgtgggtctgggaacactgaacaagtgcagatttcttactccggctgggtggccaaactggatgtggtccaatctcttagaaaatctgtcctgtccttcactgggaaacagactgaaggtttaacgttattttaggatatgcaatgtatgtttctatttatcccttgaaaatgaataacctcatattgacccattatattgacctccattgatttaggaaatggatatattttttctgcatttaaaggtatgcacttaatgtagcttacttaagagaccttaagtgctttagccaatacaatgtgctaattccactttctttagtattttaaattaaagtactatagtgaactttcccagtaacctgatagaacaacttcagggattttttttttttaagatgataaattctggggaaataaatcaaagctattgagaccaaactaaattcattttatgtaggcataaattcccaaacaatagtatcataaaagcattttcccccagaaagtaccaaagtactgaaggtgctgtttgacaggcattttttccctaaaggatcctcaggagatttgttattctatcagcttactctctggaggctgagagtcttttgaagggtgtttcataagatttctgttatatccatttgtgttatagacatgaattgggagtgaaaaactgtgccgttatttcagtggaggtgtaaactcttttgagcccaaatgccctaagtttggattttcagctgaacttatgtttccataaagacaatgggaaataagcgtaacctagaaatctgagttgatatattatcaaaccaaattgatgcaaatatcaaataactatatttttatagattttcatagtcccttgcttttccgtaggcccacatgtgaatattctgtacttactatgacttccaattaagcatacattttctatttaaggcaaacttttaaaattatgaaatattaccgaaaatggtgatttttataattaagtctataatattgtattaaatcaatacttgcccccacctcccaaaactgatgctactggagaattgctaacgctcttatcttttgtaattcgttgtaactacttggaaaaagtaatacgcatggggaaacaagtagtaaaaacaaacacaggcaaaaaaaaaaaaaatgacttcttcccacccagactccccttgcactgtccttcccaggagttgctcactgttacagtagtttctagtgaatttaagtgtattgtaaggtgtttgattttactggaataaatgcataccattcaatttaaaataaaacatttaagtgtatccatctggttgtaactcttttattctaggcattacaaagtggttttttttcccacttaaaacactttcactcaagccctcttgctacatggctaggaatgcatagatgctgcaatcctgtgctaggataacaggtgttacaaggagtgatgacaagcaggcaggtttagggagatggccaaacatccttatgtacgaatggattaatcatttggaaacttgcttttttaatcagtatagactgggggtgggtaaaagtgattatatgagtcaaggttagtgtgcaacccatgttttatattcttgacaaacccagcaggtagggtctctggaaattatctagttcttacttcagtggacaaaatgatgacgatttctctgtttaggtgtgatttcattttggattcagctttgtatactcactgaggtatgactttttgtaatactgtaatatttctgttatggttatacaaacagcataatgtttttctttctctttgtgattgcttgaataggatatcaagccaatgagagatcaaattgtcagagtgaagagatatgaaaaagtcccactaatcctagtaggaaataaagtggatctggaaccagaaagagaggttatgtcttcagaaggcagagctctggctcaagaatggggctgtcctttcatggagacatcggcaaaaagtaaatcaatggtggatgaactttttgctgagatcgtcaggcaaatgaactattcatccctgccggagaagcaagatcagtgttgtacaacttgtgtcgtccagtaaagaagataacctcaatcatggccataccgagcaggttagtttttgatggaactgtatgaatcaggtagtgttttgttt

SEQ ID NO: 185 - DNA, 5218 bp, mus musculus
tcatcgccttctgcatctgcatctgcattctcctccccattttcctgcccctgaaattcggagctctgggccctggccatgcagggcagttcacatgatccacagagaacaaggcactttctctttctctgtctttccttcttgcttccctccttctggactttggggattttccatgaaaccaaagtaactatgtaagtggcagtggccttcctgtctatagtctcccacactggagtggaaccagaagggaagagagaagataagcgagaagcaaggacaaattaaaccatggcatttcagcctccttattcctccagcctcttcagaaaaagggacaagtaagtaattagaactagacagtgcttcagatggagggggcccgtagtggaggagtaagtggggagggatgtttttcaaccatcccattaacactgtgttaacgctctagtgctcaatatcctttttgtatttccttttccagctcctaacccagtgtttgctttgtggcttctcccgcacctctcgcatcatgtctttttccgcttctcctgacacaggaccctgtgttttgctggcaacattgccgaacctttgggtggaacattccctgtagaaaataaggaagacttacctataaatagtttccttctggctgtgtggtacacagtgcttcaagtgtaacaaaaagggaagtgagatgttccccctcatcaccacccccaacctaccgcacccgccctgaatctgctgtccaacgccatcagggctctgagatcctgcccggggttatgctgcccagactttgcccagtctctgttctactgtcccatgggaacctgacgtaggaagggctcttgtcctagagagtccagtctggcttttgaaggggaaaagatgaatgggaaatgctgaggcacttctttcagctcaaagggaatatgctggtttccaaagcctcctgaaatgaagggaattggccctgtcctcattacgccaccctccatctagaaggtcgcccctgagaaaggtagggtcagccatgtctgttttgttactatgtccctttaagactacagctgagagccagcaaagggcctggctcctcagtgaggtgctgttgccgtgttggctctgggtccagcctacattgtgagttgtgggatgtcagaaagagaatttggcaacatttatgaatgttggggtagctgggccattgaatgcctaggccactgtttcctgtttggggcccacttccacgggacacaaggaccctgagagtctcaatattggatcagatcatggataggtacagcacaaacttccactcactgcaaggtttggcatagctattctgggtggagaaattttctggtgtgctgagggttaagcagaaaactctttgggttcctcctccttcccccacccccacccttcctacccacccttatctcccctgcccttgttgttggaaaatcttttttcttttcttttcttttttttctttagacagagtttcgctcttgttgcccaagctggagtgcaatgccacgatctcggctcactgcaacctccgcctcgcgggttcaagtgattcttctgcctcagcctcccgagtagctgggattacaggcatgcgccaccatgcccggctaattttttgtatttttaatagaaactgggtttcaccatgttggccaggctggtctcgaactcctgacctcaggtgatctgcccaccgcagcctcctgaagtgctgagattacaggcgtgagccgctgcgcctggccagaaaatctttctacagagacatttaagtccatattcttcccttagggagccagtggaccctgggatccattcattctttcctaatggaggatcataaggtctcagggtgatcacatctcactcagcagaaccagagatgtagagaggatgagagcttgtctgagtctgggctgaacctgggacctcctttccaagtctttttttttttttttaactaaatctttgatacgaacttgttttcttattgacctcattttcctaaaagctggaatagggggaaaaaggagttaattaagagttgccggtgagtggggctccaggaactcaaagtttgactgcattgtgattgtgctgccaagactccatacttgatttggaatattgtacactctcctacacgttccattctggaagccaccctgttagattaatgtctcctatttcccaaacagatagctttctttgaggattgcttggctgccttttggaatgatgtggttgagcatggccgtctcataaagctcatttggacagttggatattgttccagtcacccattgcagctctcctctgcctcacgtgtcagaaaagccaaggctcgcagaactcaaaggcagtctctggacctctctaatagtagggctgctgcttctcaccctttcttcttccttaccactctctggcacctccaaaccccctaccaacttcctcaactcactcattcaagcctctaaccattcaacaaacctattccctgccccactgatcagtgcagtaggaacagatttgatctctgggtcaggaagaccctgggctgcagttctagctctgtaatttattacctttgccgccttgggcaaggtagcctctcagacccttggtttcttcatctgtaaaatgatagtgacagtgcctaaaccttggggttggtggtgcagccagcacagtgtctgcccatagctgatgctctattaatagtaactattattgtcagtgagtctcagactcaatttgcttttataattgaagtataactaatgaacaactcagacgagatcaggtgtgttcagggtggtatggccgtagacaaattaatgatcaattcaaatgcagctttgctgggaaccttaacccttttgccttcccttcccataccacctggatttctctgcctctgtctccacataagggagtccctcttgaaggagctgtttttacttctgtcctgtgccctgttttcctggtggtgtttttcccctgccagcccagcttatttctctgtccccttttcttctcatcatcttccttggaatcttcgggggaggggaaagcaatagttgaggaaaaattaacaagccaatgaaaggtcagctcggagactttctgaaccaagaaaactctatgtggtgcagagggcaaattaatattaatatatcagggaattctgataccagttaagctcctgatttaagaggtttttttttttagtgaatgttcttgatgacccataagtatagcctgcactttgttctgtctactacacatgtcttagtgcaaacaccgtgttcagagaggttgtgtcttaaagttaacagaatgtcctgagatcattattgtctcccacctaaagtgagatgaagaaaaacaccatcccgggctagtgcagcaggtttacttagttctattggtcagtactttgcaatataatggctcttgtacacatattatcaccactggaatccaccaatagagcaccacaccatagccaaaaatgttggctgttcagtggcataactgccctggaagccgggaggaaatcaaggccttcagactgcatttggctggggccttggccagggtgttagtgccaggcacctggttaagataaatgtcctgaagcaaacaataattaccttctttgctgataagaggccccagtacttttccaatagcatgattgcgttaggatctttctttggaccacagcctgtggagcactgattcatgggtactggccttaacttcatccaaactgttgtatatgtggtggaacccaatgttctcctttggtcctgagttggtgtaaataatattcccggttgcatcacctgtccctgcccctcttgctccttctggtggaaattctgcttttgtccaccaggtggcctcacttaggaaggagcagaagaaaaggacctcaagtctctggtgcctttattttttttccctcagcttgaggctgaatataaataagatatattttaatggaaacgtgtaacttttattatggaacaatcacctcatcttgtttatggtttggagtctgtttttcctgaagtacctctaatgctgtgcatggctgggcccatcacagggcaggtgttttcctgggatcgtttatataaatgtatacctttggtttggagtgttattgtcattcgctgttttaaagaaaagtaacaaagttgtgtttttaaaaaatagagacacgggatcctggataatgttgaatgtattttcttcaaagagtagaatgtggagactaaagagaaaagggctggcatcttgtggtcactccagtgctcactccaataccctgtctcctcctcacctcctctgtcacccacctagctgctctcccatacatgttcacccactcacctcagctcccggacaccctctcctccatacatatgcatctgtagattagcatggacctgtgcatgcattacatgcatgtcacagatctgtacatgtgccggtccacagacaagtactcccacacctgaacattcagaggaaggggcaagtggatgagtgctggggttcagggcaggtcggcaggccagctggctggtgaggggaaagctgagttgattagagagtgaatgtgcaggtgacaaagtatgtgtgcaggggagagactgagagggcagtgactgggaagagggtgaggccgtgatggtgagggcgcgtgtccagggagtatgacatgggagagcatgcaaagccatgggggcatgctggctgccacctgaagaagagcttttcaaactagcgctgttctttactgaatgccctctgcctcttgttagggcatttgtatttcttatttctctagaaatcagctccagtttggtttttatcgatctccagagccttctttggagatgccagttggtacaagaaagtgctgaactgtttacagtcccagcctaaggttcagggaggggatgtggtttaactgggccacaaagcccggtacaggactcatttgcatggcccctgacgccatgtgacgcagccggctcctcctatataaagaagcaggagccaaaatatctccgagtctgggttggactggcggccgtggagtttgtgacatacgaggtgacacccctcgagtcacttcccttcaactccagct

SEQ ID NO: 186 - DNA, 261 bp, mus musculus
ggcttcgggaaggagccacagagagggcggggcgtaggacctgcgcttcgggggtggagtcggagcggcgcggcggcggtcatgcgggacgcggatgcagacgcaggcggaggcgctgacggcggggatggccggggtggccacagctgccgcgggggcgtggacacagccgcagctccggccggtggagctcccccagcgcacgcgccaggtccgggcagagacgccgcgtctgcggccagggggtcacgaatgcggccg

SEQ ID NO: 187 - DNA, 261 bp, mus musculus; identical to SEQ ID NO: 186

SEQ ID NO: 188 - DNA, 23994 bp, mus musculus
cggactaaggggagaggcgcgagacttcacaagccgtacggcgcgagcccccaaacggccctcgagagctcgagctggttccaccggcctccggcccgcctccattcgttaggtgtgtcgaggctgtttcgggagcggcggctgcactaaggcgctgggcggggaagcgggacggtctcaagatggcggctcccacaattgtggtctgagcgccggcggggctgcgacgaccgcggcgcttgtggctcctttccacccgccccggaagccggccagtgctggggacttgggggtgtgggaaccgggccggggctccgccatttccggcgggggagggctacgactgaggaagggaggagagagaggcggctcaagatggcggctcccagggcctcccgcccgagcttgtaagcgggagcgcccggacaagtagtcggggcgacgggactcagcggcctccagcttcttgagcctaggcgctcgacagtttcgggcggctcttgcggagacggggtgagcgagaagaaagggaagagccaaagggaaggagggcagttaagatggcggcctccatggagtcgtctaccgctgtgtgagaaaccgcttctccgtgagagctgccttagacgaaagggggtgtgtgaaaggaattgaggggctcccttcccgcttgttgacttctccccaccgcaccctttcccggaactatggcttcggccgtgtcgcccgccaacttgccagcggtgcttctgcagccccgctggaagcgagtggtgggctggtcgggtccggtgccacggccccgccacggccaccgcgccgtggccatcaaggagctcatcgtggtgtttggcggcggcaacgagggaatagtggacgaactgcacgtgtacaacacgggtgagtgcaaagcccgctgggtcttcggctctttccctccctccatctcctccctctccctcctctttcctccctccctccatctgctccctccctctcctccctccctccatctcctccctcaccctctacccttccctctctctctcccctcctcccttacccgtccttctcccctctccccgtccccctcccccttctcccctcctccccctccctccccactgatcggcttgcccctcccctttgctgtgccgggcttcagtgcttttctctgatcttctccccgttcccttgtctctcccgtgtttgaggattggttttcgttagttaaaagaaagcccctagtccgactggtgagggagaggggctgtcgccagcggtggtgacttcagacccacaccgttacccagcgggctggggctggggctggggcgggcggatgtgtccccttggcgcaggcagagctcccctccctccctccctcccttctcctgcgcctgctcagctctccctcatctcgagtgcccattctggagaaatgaccatttctagattacagattcgttctctgtctctcgaaaaagggagggaagggaagcgctcttaggacgcagagtttaacatccgccgacccgggtaatgccggagccttggggacccctaggacgggccggcggcagggccgcctctccctttccacgtttacttctgcagcatttctttccaagtcgccccttctcctaatctggtgccttctggtttacaagctgaattccagttacccctcagcggcctgcgtagtcgtgtgtctccccgcttctgcggatccagggggttaccccacccgctcttctgcctccctgcaaaacccaaagcccgttagttgggaaggggaggaacctctctcttcaggtatggctgatgcaccacggccttcgtgggggccgtttgttgttgcctctgcctagtagccttgcttagtctctagggcagaaagcctgctgctgtccacgacagctttgtggcatcctttttcttggtggctacttggcccgttttgtgcccctagcacaagggtcagttcccaagttgcctactgactgcccgttggcccacaggaccctggccttgcccagaaggcagggtcagggtgagttcggtcccaggcaagagctggaagagtctgggtgagggaaaagccccctgcaggcggctgggggagggccttgggatgccctagtcctgagtggcaggcacggctcccagcactaaccccttgctccgcggccgttctctcctgggggctctagcgatcccctggcctcggtggtggccctgcagacaaaccctcgctgagtgggctttgtgtcctgagcggtgagaggctgctgttctttggctgagctccagtgcctcgatgctctgggggtgggaagctggagctgcctggagggagaaagttggtttagggagttgggaaggctggagctgggctcttgggtgccgcttccttccccaccccccaaggcagaaagtgctggtttctccacatctcggagattatcgccacctaccacgttgactttgaaaggctggtgggttgtctgtgaccgtttttcgttccaggtctctcagcacctgttgcctccagggagcagggcctttctcagcagcccccgggcgggggcgcttggtggttggtggtgccccgcgccagcccaggcagctgcagtagcaggaattagctcagtaagctaaggcttctccagtggtggggctgtttatagaggcaccgtcaccatgagcagcaccttctccactctgtggaccgactttcttctcataaggcctggagcaggctccctggcagggaaatgcaattttagaaagtagggcaggggcctaattacagtcggctccagagtccaccaccactgctgccttggcttcctggggcctctgcatattcattagtttattaaaatgaattgaccactttggcatgaattcattaccagtctgcaaagacaggttgtgcattagaggggtagcctgccttccaaagggctgcttaaaatgaagctctgggatcctccagggtagcagtttggaaactgtcatcggcaattcctcagacgagagagcagctggcagacctgaagccctcttcctcaccggggtttctgccccctcccgccagcccggcctcgtcacctttgtcttgtcttcttttgttgtgtttgggatgagatcagggcatattctcacgcctgtgccccttgcagttctgcgggatcagtcctcaaaaagccttgtacctttggagagagctgatctggaaggggttcccgttgctaggataagaaagcttcagggggtgtgtgctttgagagctcttagggtagctactgtgcttgtccttagggaattttagttccatgtggcaagccaaaggattcagagtgctgccaggtgtggggggtgggggagcgagagctttggctacggtggctctgtaatgtccataggttcttggagctggagggagccttggaaaatacctagtggaactacttccttgtttctgcagatgaggaaattggggtccaagaggggaagtgacaggtccagggtcgccctcccagctggtggcggagttgggcgggagtgcaaaccttcatagaggccgttctgccacctgtctttggggcccatcacctttgaaatgcctccattctctcctctgtccctgtatctaattgttcattgcgttgggcaggcatcaaatgtgtccccttccacaccaagccctcctctcctcttactagactcttgcagtcacttcctgattggccctgctagtttcatttgtcgggaaatcctgttcacccttcaaggcccggctgaaacgtcacctcttctgagaagccctttccactcctgtcctcccctctccagcagtcgcactgctctgtgctcccaagggcccggcttggtcagagctcttctagggtgtttgtctcatcgtgggaggggggcatgcagccttcctaccccattgggagtatgagcacaagatcggtgtcctctgtgcctcccagcacgtcgtatgccacacaggaaatgctctaatgtgacaggtagaacagagaggaaggcagctcgttgaacttgaccggccacctcactgcatgggcaccagtctctaggtggtgatgggacagtggcaaccagggatggagcttgcagagcatgaagtggttgggggagctgatgaaacacagagaggccggggcacagccttgctcaggagaggggagctggagtggtcttcatctagtgcagggtcctttccccaccttcccctcccagctgagagccagcatttccaggatgaggggcccaaggattgggttacatgacaccccccagatgattcaggggtgactgagagcagctgtcacattgaaaagctgggagaagggaggagagcttgctcgtgtgctttcagggggcggaaccaggactcgtgggtgagatgaggagccgcaggtttgtcgtcacaccaggagctgtgctccctgacagacctctcttgacgggggtggggagggcccctgccctgcctggagtgttctagaatgagatcagcacctcttgggtcctgtagaaggatctggtgagcgggatccccaaagatatcacagggcgcttctggcctggcccaccggctcactgatcagcgtgtgataggaaagctgcccactgaccccacgtgccatttagctttgtcccaaactctgacccgcagccccatagctgtgggctttgaccacgagggtgctcaggggagtgagggtggctgcctggacatgggaccctagggaaggcacagatcggttgcttcaagtcagtgatggggctgttgtctctgtctctgttttacgctgtgacctcaggtgtcgcttgccctcctgggctctgcccctttacctaccgagagcagttggcccaggcagccttaggtctcgttatgcgtttaccctggtagcttgcatggagctccctccagggattggtcaggacggctctccagtgcgcaaggctgttggccttggcagctcttgcttttctggggtggtttttgcactgggaatgagaaagaggcagagggccaggatccgagcttgcacatgcgggcggcacaggtgttgtccctctgctttagggaaatggcaggggagctctagtgctcggcatgtccgaggcccagtgactcagctgaatggctgcagaggctgtcagcctgctcgaagcctacccgcagagtgggtgctggagagcggggtgggggtgctctcgcctcaggaggagcggtggtggtacagttgtgctgtgtggggttttctgttttttttgtttgtttgtttgttttgaggttaggtcttgctctgttgcccaggccgggatgcagtggtgcggtctcagctcactgcagcctcaaactctgagggtcaggcagtcctcccgcctcagcctcctgagtagctaggaccacaagtgtatgccaccacactgagccagtgttttaaaattatttgtagagacggggtctccctgtgctacccaggctgggagttgtgctttggataagggctagccttgcacacggttccgcattgagccctgggggtgacagtgtgagactgggtgggaccagagtgcagtggggcatgcattcccaaccatggtcagccgcctggccctgggtgcacacctgaatatggaaaaaaaacactgtttttcctcttctatggtctcacaacacttttggccaccaaactgaatagtctgtattatatcacaatatcacagcatccctgtgtggaagccttcccaccccacaggaatccccccatgccctgtcacgtcctgggggacccatcttgcgtcttgagtcatgtggaggggcctcagttccttctgccgtctgcttgctgagatctcacccaggccagctcagaggcacagagtcggggttgcacctggcccccagtttggggtttctggaaagagtgtggtgaatcctctgagggacccctcataggaggaggttttcggggaagccctggcctgccaggtgtgaggggagtcaagtttgaggacatgagggaggggcctggtcccagctgaaggctgctgtgccatcctgtggaagcaaagcagtgcctaaggtctgatttccctctttcttggtggtcgcctcaccctcatgagcttttgagaagcttctgtcacagctctgctgagactgctgcctctggcttgcaagaatgttctggagtaccataggtgtggcagcaggggcagggagggatgctggtggaccatcacctaggagaccagaggaagtccgggaggtcagagcagaggccgggtctcatccccatggctcttcgtagcctgcagcggtcactgttttggccacttgaaagtgctgctctgggctctggctgtcctgaccctgtgatgaagggacaaaaatgtgggctccagggaggaggagcacaggcccaccaagagggtattttggggagaaattcatgtctgatcactgagtgctagggaaggaaggcagtggctagattcccagtagctgatgagggatcttgcacagtaacttcccgctcattaagatgaccttggcgagaagcagggtggtcacaggctcttttgcactggcctgaagtcgaggggtttggaagatggcccaggtagcgcagctggagttgctagagcgcccgcagggatggtgctggctcagcccctctcaccaagcttgacggctggcacatttggggaatgagaggaatgggggctcccgggtgttctgacttctgcctccttctgttccccagcaaccaaccagtggttcatcccagccgtgaggggggacattccccctgggtgtgcagcctatggcttcgtgtgtgacgggactcgcctcctggtgtttggtgggatggtggagtatgggaaatacagcaatgacctctacgaactccaggtaaagcagccccaggttctcactctgcctccttggccccatgtgacctgacggtagtggcttcagggttgaggcaagcgggaggtggaagggacgcttgagagtctgccaaggctgctctgaacttggcccacctcagaagaaggcagcaaggaccaacacccaggaccttcttgctccagcaaggcacctcgctcacccccggccatttcctcctccaccacaagttgccccgggtccctagtggtggccttctcatcccacggttcagtctccaggtcttgattttgcaggcgagccggtgggagtggaagagactcaaagcaaagacgcccaaaaacgggccccctccgtgtcctcgactcgggcacagcttctcccttgtgggcaacaaatgctacctgtttgggggtctggccaatgatagcgaggacccaaagaacaacattccaaggtgaggcttggtccttttctctggaaccccccgggtgggtgtgctctcacatgcacagggctccatggtgtcctaaagaatgtgcgcagcagagccccgtggccgggtccctttctcgtgctgggttgtaaatgagagagcggcaccggatgccctctcaggagctttcgggctccaaaatcgctactgaccctgagcaggcctcgtgggaggagggccaagctggaggtggaagccactttgccttgggctggcccagctctcggagtcggcttagagctgctcgcgttccttctcagcctccgctgcctacaagtttcctgatgggtattttccaaggcccgtggccaaggactctctgtctggaggtagtcccaagccagcgccccctcttgctctgcggagccctcatataatacccagctttgtgtgcatggcgggggcctgctgctgggtctggactcggggctgctgtgcagcctcacccaccctgtgtcccctgttccagttggactcatcctagggagcttctggcagccccttcctcaagagctagggtagaagaacttcagagctcccacagccctagcccctttgtgttctggggaggctgccactcactgatagccatccagcgaagcctctggcgtgaggagtcgagacttgccgtaactgatctttcctcgtcaggtacctgaatgacttatatatcctggaattacggccaggctctggagtggtagcctgggacattcccatcacttacggggtcctaccaccaccccgggagtcacatactgccgtggtctacaccgaaaaagacaataagaagtccaagctggtgatctacggcgggatgagtggctgcaggctgggggacctgtggaccctagatattggtgagcagggtggtagcaccccagcagccatgggacaaagcgggtctgcctcttggctggccccgtgggtggcgctgttgtatggtgaggtggggctcttagggagctggagcataccacttcgtgctttcctcttgtcatggtgggccagggtggggaaccctggatcgtccctaggtttggggctgttatctctgccctgtgctggctgagtgggctgaattggtctgcgggcttataagagaataagtcattaaggctttctagaatggaattctctggatccgggtagcattagtccctcttgactcgtcagtggtcagactgtgtggagtgctgcatcctggtctgactgctgtggtaccattggatgccggtaaaccgtgaggccttcggggactgcttgggccggtcaccaggtggtggtatcaggagtggctgggaaagattactaactgtggatctccggaggcctcttcagctgggagagaggagatggcgatgttgtcctatagatcagagtcggcactccaaagaagcagtttcccgtgagagaattttccaacagtttgccaaaatgtctgtagcctaaggtggttatggcggtgaacgtatttcatggagagttcggggtgtgcccaccactcctcccccagcacagagtgcagtcctggctcagggcaggtgctcaggatgtacctgaaggagcgctattgctagcctggtcgaaaccgcctgggtaacacaggaatctagctaccatgacaacagtcagagggcctgccgtaggctatagggaagccagggatggaattctctcactgagacagatcctaccttcctgagctagcttgaatccagggaacgacctgtgtgcagtctaccttgtgtaaccctttcccctccgtctctctgcagacaccctgacgtggaataagcccagtctcagcggggtggcgcctcttcctcgcagtctccactcggcaaccaccatcggaaataagtaagtggctgctcacctgcgtctctcttctctagactggcgtggcccctcccccgaagggctctcactcagttttgtcctgtcagaccctaaggcctgaggatgcctctttctggctgggctggcatttggcagccctgtttttccattacgaccctgggggaccaaggaaagacagattcaggggggagagggccacacacaagctgagtctgagaccctccccgggcctgtgaggctccgccctatcaggtacagagtgttctaggtcctctgtgcaagcacctgggtgtctttgtggatgtccaggtcctaaagggaacctagaaactgtggacatgaaggtgagctttagatgagctgaacggcacttttatgtggtagaggtgacacagttctcctgagggctgagccaccaggcaggagagggccacgtcaggaggcttcacgcatccttggggactctcctggggagagccagaggactgagctctagaactggggtagcagaggtggcctctagcttggcaccaactctacaatcctttcccactcttccctcctcactcccagaatgtacgtgtttggtggctgggtgcctctcgtcatggatgacgtcaaagtggccacacacgagaaggagtggaagtgtaccaacacgctggcttgtctcaacctgggtatggcctcctcgggctccgagtggcctgtgggaggctgcaggaggctggcccttctcagcctaagagctgtgtggggtgtgcggggagcaagctgggcccccggctccctttggaatccactggaaggatccagtgggcagagctctctgaagcaatgttccgcctctgagttttttgaatgagctctccatccaaatggcccaacatccaaaagtgcaaaagcctctacggtgcagggcctccttccctcctcccggttctccggttctgcttctcagaggcagccatgtgggtggtttcctgtccaccctgcaggggctcttcatatctgagcattagccataggtccctttaaaaacaaacagtggcagcctggcgcacgcagtgccacacctggcctttctcatccgccgtatcttggagatcactccacgtccctgccccgcagcagcctccttcgagttgcggttgtgctgctgtaacttgtacaggcgccgctccgtgagtatccttgcaccatctccacccgtgtgcaagtgtatcctaggggtgaaaacctagaagtagggttgctgtccgatgcggctgaactgccctgcacagaggctgtgcccacgtaggcgcctccagtggtgccctcacggaatggtcaggccactctttgccaagcctgatgggtggccgaagctccccctccggctcaccttgagccccagctgctgcgggcctgaaaataaaaatgccaggcgccgatggttgaagtttagatttcttttgcgtgagagtgtgtgttttttcttaagatctttctatcacgttttccctaaaccactttcccattgccgtctctttctgtgagttgtagtgttctttaacgggcaaggaggtaaacctctgactgtgtttctcatggttttcttagttggccgttggtggtttgtaattttattttttgtgttgctttttgccacaaagggtttctttgttttgttgtttttaatgtaataatccaataacttcttgattttaattcccatccttgacaacaaaagaaccaagggcaaccaggggtggcgggtttcctccatcctccttgctgacctcccttgtctgccctcccccagataccatggcctgggagaccatcctgatggatacactggaggacaacatcccccgtgctcgggctggccactgcgcagtcgccatcaacacccgcctgtacatttggagtgggcgtgacggctaccgcaaggcctggaacaaccaggtctgctgcaaggacctctggtacctagagacaggtaggcccggcccagccgactcccctcctcccatagcctcccgccccttctcaccaactgcgttctcccacagaaaagccaccacccccagcccgagtacaactggtacgcgccaacaccaactccctggaggtgagctggggggcagtggcaacagccgacagctaccttctccagctccagaaatatgacattcctgccacggctgctactgccacctcccctacacccaatccggtcccatctgtgcctgccaaccctcccaagagccctgccccagcagcagccgcacctgctgtgcagccgctgacccaagtaggcatcacgctcctgccccaggctgcccccgcacccccgaccaccaccaccatccaggtcttgccaacggtgcctggcagctccatttctgtgcccaccgcagccaggactcaaggtgagccaggggaccagggacgtttgaaagtagggggctagcctccggggagaggcagcggccaagtaggggctgcgagacggcagcctagacagcaggccagcagccgggagctttgggcttgtctccaagggttgtagggggatgctaaagcctggccccacctgtggaaatggtcactctcagggcacagagaagagccagactcccacacaagcaggccaacagaagtggctcagggctgcctgcaaaggggctggggacatcgtgcagaaggtgatggctgacggctggccccttctctcatcaggtgtccctgctgttctcaaagtgaccggtcctcaggctacaacaggaactccattggtcaccatgcgacctgccagccaggctgggaaagcccctgtcaccgtgacctcccttcccgccggagtgcggatggttgtgccaacacagagtgcccagggaacggtgaggagtggtcactggggcgggtgggatttcctgttgatccagtggattaagttgcaagtgtactgaggggttcacatccctctcgggctctggtaccacgcaccccacacctttccctcctgggacgtgcagatggggaaacgctcctgcgaggtcatggtgggaattaataggttaatgcctagaaggcctaacctgctgcctgatcctaagagcatttgccacgtggactttcttgtcctgcagcctgagaggaggatctagccagctgggcttgccacaggcccatgagaatcaacgggacctgactctggtctttagaaaggatccagagctcccagctgcctcttgccacgggggttgccgtgcatggtgggtggtgggagccctctgtgtctggggccaggagagcggggtctggcagtagagaaagctgagccatgctggcgggatgaggctcccaagagcagggcagcccctgggcaggttccggtgaggtccaccaagcagggaggtgggtggcacctgtgacctggcctcacatgcccgtgcctgctgcaggtgattggcagtagcccacagatgagtgggatggccgcactggccgctgcggccgctgccacccagaagatccccccttcctcggcacccacggtgctgagtgtcccagcgggtaccaccatcgtgaagaccatggctgtgacacctggcactaccaccctcccagccactgtgaaggtggcctcctcgccagtcatggtgagcgtcttccggggcttgtcactgtggtcaaacaagcatagtcattccctccgggctttagagttagccgttggaccgtgggctgcagaataagctgtctccattaggggcgtcatggcctcaggtgagagctgcaggctcagcctcctcccttgcctgttaaaggaagggggaaccaagctgttcttgggcttgggagcaggaggaggaggaaggtgagtgttgaggcaggagctatgggcccaccgtggacatcttgggtggtttccccatcgctttctttgcctggcctgtcactcgtctctgcctcctccaggtgagcaaccctgccactcgcatgctgaagactgcagccgcccaggtggggacatcggtttcctccgccaccaacacgtctacccgccctatcatcacagtgcacaagtcaggcactgtgacagtggcccagcaagcccaggtggtgaccacagttgtgggcggggtcaccaagaccatcaccctggtgaagagccccatctctgtcccaggaggcagtgctctggtgagtgatgggtgctgccaggctacggccactgccagtggtgaatggccgccctgggccagctccaggagagtctcagccaggccatgcccttgtttggtttccagatcactccttgctccatcccttcctttttagatttccaatctgggcaaagtgatgtcggtggtccagaccaaaccagttcagacttcagcagtcacaggccaggcgtccacgggtcctgtgactcagatcatccaggtgagctctcagtctttgcacatacgcaagagtgggggcctgggtgccaggccacaggaagaactcatgtccctgcccatggaagatcccatgagcacacatggctcagcaagttctgctgctcactcccctcgcccacagcctccagaacattccctgagccgccaaggctgccggcggagagtagccagaccacacttcccttcctggcagtgatgccggctcatgcacctgcttccccctttcagaccaaagggcccctgccagcgggaacaatcctgaagctggtgacctcagcagatggcaagcccaccaccatcatcactaccacgcaggccagtggggcggggaccaagcccaccatcctgggcatcagcagcgtctcccccagtaccaccaagcccggcacgaccaccatcatcaaaaccatccccatgtcggccatcatcacccaggcgggcgccacgggtaggggcctcccccgacatatgagtgtctgcaagtcctcactggaggggaaatggagtccgggttataaggcgtgctgtgtttctgtttagtttacccttttctatcttctccttgctgccttttgtgtctaagggtagtgaggagatgggcagggctatggctgtgacttgtggatgttcattatagtctaggggcagcaggggcagccctcacagagcctgtctcccctgggccccactctcccatccaggtgtgaccagcagtcctggcatcaagtcccccatcaccatcatcaccaccaaggtgatgacttcaggaactggagcacctgcgaaaatcatcactgctgtccccaaaattgccactggccacgggcagcagggagtgacccaggtgaggcactcccagccgtctctcagcccagtgtcctagtgcagtccaccccagcacgccacgcaggtcctcccgacaggcctgggaggggcagcatcggtggcatctaccagcctggtggtgacgttggtggcactttcctctggtgttccaggtggtgcttaagggggccccgggacagccaggcaccatcctccgcactgtgcccatggggggtgttcgcctggtcacacccgtcaccgtctccgccgtcaagccagccgtcaccacgttggttgtgaaaggcaccacaggtgtgtacccataggccaggtcccctgccacccctagattataacgaagcagggctggccttcaatccccatggcacagctgggtggcacagcagctcctctctcccgagccttctatgcaagcagctccagagtgccccagcctgtgcaggaggagctgctgggaaggagacagcagcagccttggcccaactcttgcctcctttccttcaggtgtcacgaccctaggcacagtgacaggcaccgtctccaccagccttgccggggcggggggccacagcactagtgcttccctggccacgcccatcaccaccttgggcaccattgccaccctctcaagccaggtgatcaaccccactgccatcactgtgtcggccgcacagaccacgctgacagcggcaggcgggctcacaaccccaaccatcaccatgcaggtagggcagggcctgaggccacgtgtgggcgagggaccccacacaagtggaagcacgtgaggctcacgccgtccgtccacaggcctttccttcctggtgttgcgctgctgccgggtgcagccatggcaggcctttcctcacctggggcattttccctggtgtcacatggtccctgtgtcatagtccgtggtttggctgtcatggtttggccatgcctggtgtttgaacaccgggttcttcctctcgcagtgttctacaggacgccgcagctcgtctgcatgtgtgtgcagtgttctgttcatacatattaaggaaaacggtgaaacgtttgttgttggcctttgagcattgagggggatttccattctctgacaaaggacttgacttcagccagcctcctgccttccccttgccctgtcctcacagcctcttcctcatcccagttgcctttgaggcaaagtggtgcctcttccctggcctctgagcaagtcagtgtcttgggggcaggggtgagtgggtcttacgtctgccagggccgttgagaagtggtcagtggtcccagcctgtgtggtgacagtgcaggacagtgggagggacaggcagacagccagctgcagcactaactctcctcctcgtgtgtctccccagcccgtgtcccagcccacccaggtaactctgatcacggcacctagtggggtggaggcccagcctgtgcatgacctccctgtgtccattctggcctccccgactacagaacagcccaccgccacagttaccatcgccgactcaggccagggtgatgtgcagcctggcactgtcaccttggtgtgctccaacccaccctgtgagacccacgagactggcaccaccaacacggccaccactactgttgtggctaaccttgggggacacccccagcccacccaagtgcagttcgtctgtgacagacaggaggcagctgcttctcttgtgacctcgactgtgggccagcagaatggtagcgtggtccgagtctgttcgaacccgccctgcgagacccacgagacgggcaccaccaacaccgccaccaccgccacctccaacatggccgggcagcatggctgctcaaacccaccctgcgagacccacgagacgggcaccaccaacactgccactacagccatgtcgagcgtcggcgccaaccaccagcgagatgcccgtcgggcctgtgcagctggcacccctgccgtgatccggatcagtgtggccactggggcgctggaggcagcccagggctctaagtcccagtgccaaacccgccagaccagcgcgaccagcaccaccatgactgtgatggccaccggggccccgtgctcggccggcccactccttgggccgagcatggcacgggagcccgggggccgcagccctgcttttgtgcagttggcccctctgagcagcaaagtcaggctgagcagcccaagcattaaggaccttcctgcggggcgccacagccatgcggtcagcaccgctgccatgacccgttccagcgtgggtgctggggagccccgcatggcacctgtgtgcgagagcctccagggtggctcgcccagcaccacagtgactgtgacagccctggaggcactgctgtgcccctcggccaccgtgacccaagtctgctccaacccaccatgtgagacccacgagacaggcaccaccaacaccgccactacctcgaatgcaggcagcgcccagagggtgtgctccaacccgccatgcgagacccacgagacgggcaccacccacacggccaccaccgctacttcaaacgggggcacgggccagcccgagggtgggcagcagccccctgctggtcgcccctgtgagacacaccagaccacttccactggcaccaccatgtcggtcagcgtgggtgccctgcttcccgacgccacttcttcccacaggaccgtggagtctggcctagaggtggcggcggcacccagcgtcaccccccaggctggcaccgcgctgctggctcctttcccaacacagagggtgtgctccaaccccccctgtgagacccacgagacgggcaccactcacacggccaccactgtcacttccaacatgagttcaaaccaaggtaagtgaaggtggccagcctggctttcatggtctcccagccccccaggctgaaaggccaagacaacgatggcgggggtccgtccagagtccaccagtcaggctccttggcacccaatttaccagtggggagagctggggcgtcctggctgtacctgaagcagacagaggtctccaggagcctgtcctgccttatctggccctccccttggtggtagaggaagcctgtggtggtcaagccaagtacaggccgggggggctcctgctgagcagccgcctgcctgtcgcccccacagaccccccacctgctgccagcgatcagggagaggtggagagcacccagggcgacagcgtgaacatcaccagctccagtgccatcacgacaaccgtgtcctccacactgacgcgggctgtgaccaccgtgacgcagtccacaccggtcccgggcccctctgtgccggtaagagcccagggggccgtgttcttccccgccttcccggcctacgcccgtgcagttccacactcagacgccagatgtcgctcttgtaccaggcatggggccgctcctggtcccttttccggaccataaaagggcagcctcggtgcctgctgcggcaggaggcaggagcctcaccgtcccccgcatctctggggcgcttttatttctgggactggttctcatcgcgtgtcacttcaccgcagcctgtataagacatggcgggggtctgagtgcccatttgtccaggccagggtgactgaggacgggttaaacctgaccgggggtctcaagggcctttctcctcatgctggtcagagaaccactgtcccctccctatttaacatgggctggagctggcccatcaagaatgaaaacttaggcccacaaggaaaggtgagggctggcttgcttctcagccctgctgcctggctctggcccctctcctcccctctgacaggggcttctctccctttctagaagatctcatcaatgactgagactgccccaagggctctgactactgaagtccccatcccggccaaaataacagtgaccatagccaacacagaaacttctgacatgcccttctctgctgttgacatcctgcagcccccagaggaactccaggtgtcgccaggtcctcgccagcagctgccgccacggcagcttctgcagtcggcttccacagccctgatgggggagtccgccgaggtcctgtcagcctcccagacccctgagctcccggccgccgtggatctgagcagcacaggggagccatcttcgggccaggagtctgccggctctgcggtggtggccactgtggtggtccagccacccccacccacacagtccgaagtagaccagttatcacttccccaagagctaatggccgaggcccaagctggcaccaccaccctcatggtaacggggctcacccccgaggagctggcagtgacggctgctgcagaagcagctgcccaggccgcagccacggaggaagcccaggccctggccatccaggcggtgctccaggccgcgcagcaggccgtcatgggtgagtgccggtgcaaccctggggaagccgggccgctcgggggagcaataggccgcggagacagcctgggaagaggagcccatttccctcgagggtggcatgagccagatgtgatggggaggacgagcacaggggaccccaggcaggccaagtagtagagactgccgtgtagaacaggctggctggggttagcgcctgggaaacaggcagggcccctcggccagggcttagcctacagtggagcacggtaggaggtggacggggtctctaggacaggctttgggggcctccgcccgggctgcccgcttctggccagccttcctagtaagtagtgtttctctcgaccctggagcaggcaccggcgagcccatggacacctccgaggcagcagcaaccgtgactcaggcggagctggggcacctgtcggccgagggtcaggagggccaggccaccaccatacccattgtgctgacacagcaggagctggctgccctggtgcagcagcagcagctgcaggaggcccaggcccagcagcagcatcaccacctccccactgaggccctggcccctgccgacagtctcaacgacccagccattgagagcaattgcctcaatgagctggccggcacggtccccagcactgtggcgctgctgccctcaacggccactgagagtaagcgactgagggcgaattggtgctggggtggtgggggcacccagggaggtgagggcaggacgggaggctcggtctcacttgggagccaggtttcccgagtctttcccgctgacaccttctttcttcctaggcctggctccatccaacacatttgtggccccccagccggttgtggtggccagcccagccaagctgcaggctgcagctaccctgaccgaagtggccaatggcatcgagtccctgggtgtggtgagtcgggtgtgttggggctcctgagtccgtggcctggggggcagcactgcctctaggtgctgagggcctgatctcgtcgcaccgattctgtcttgcagaagccagacctgccgcccccacccagcaaagcccccatgaagaaggaaaaccagtggtttgatgtgggagtcattaagggcaccaatgtaatggtgacacactatttcctgccaccagatgatgctgtcccatcagacgtaagtgtccccaggtgctgatgtcctcaggtgggtgggtcttggctccaccaccctgagcggggcttacaggaaactcctccatctttgggccaagctgagtagccaggaagcctgaggaaggtgggcagagaccatcccccctgaagcagtagaaaaggagagctttggttccttcccgccagtaccgggccacagtcagcctcgccacgtccctccttgccgtgaggggccagccaccgctgacctcttttccctctggcccatagttaccatggacctgcagtgttcctggggtggcccagagctgccttctccacagtggcgttcatgccactcctcttttcctaggatgatttgggcaccgtccctgactataaccagctgaagaagcaggagctgcagccaggcacagcctataagtttcgtgttgccggaatcaatgcctgtggccgggggcccttcagcgaaatctcagcctttaagacgtgcctgcctggtttcccaggggccccttgtgccattaaaatcagcaaagtgagtcttgctgtggggtggccgtctgtccctggttggtttctgcctgcctcagcacatgaggtggccgggggggggcataggagagctaggttttgagtcccagtttgtcttagtccttccacttgggggaagatctctttgaagctccttgaactaccacatggaatatctctactgtgttagaaaatggcttatgggaaccatgattagtcagttctggaagcctctagcctgttctgttgaccttctgaccccctggcttctagagtccggatggtgctcacctcacctgggagccaccctctgtgacctccggcaagattatcgagtactccgtgtacctggccatccagagctcacaggctgggggcgagctcaagagctccaccccggcccagctggccttcatgcgggtgtactgcgggcccagcccctcctgcctggtgcagtcctccagcctttccaacgcccacatcgactacaccaccaagcccgccatcatcttccgcatcgccgcccgcaatgagaagggctatggcccggccacacaagtgaggtggctgcagggtgagtgtccttcgtggagctcttcaggcacagggaaggcccaggaagccgggtgcagcaggaggaactgtcaccatctgagattttttcccatgtgcggcgtctccctgcttcctttggcgcgcacacagccccccacgggggtggccatcaagtagagcaggggacccagctccgggcctgggggtgcaggggacgccaccccaggatgtttgaggggacaagcagtgagagggctggcgggaaagtgtaggtttccaggcccgaaaacagcacgtcccaggtccctggagtgcagcaggtgagggatggaggccagcctgcctcctgtcaggtcatgctcctgctccagctcccctggggctctgggacctgggagggcagtgagaggtgggagctgagctgagtgggtttctaacctacgtccagaggggagtgagtggtgtcgtgttctggtcccaaggagtggcgtaaaaggtgaccacccatagggcaggcgccccacccttgccagctgcgggtcatgccatgtggcaccaagagactctgcaggcgggcagggcgcatgtgttccttgctctcgttctgtcacaatgctgctcacgcatctctcccgttccttccagaaaccagtaaagacagctctggcaccaagccagccaacaagcggcccatgtcctctccagaaatgtaagcaggaagcccctctcgggaaccttctgagactaggggtggaaatagctgggttcagcctcttgtcaaatgactgggggcccctaaccggccctgcaccagcagggcctccagtggtgcagggcccacactaactttctctttcctttttctgccttccaaggaaatctgctccaaagaaatctaaggccgatggtcagtgagaggaagctgactagcccctggattcttctccagacccccctgcttcaggaacacccgccagggcccacccctcccaccccgtcccagcattcgcacttcaccctcgcgagccgctgttcactcctctcccctttctctttctctctgtttttaaaataatctaaagaaagcacattttaccattgctgttgggaggaagcagaggcagatgggaaagcagagagaggagcgcgcttcctttcctccccgctgccgcccaccctggggagagacttttgcggggagggaaggcggagctgaggacagccagctccgccctcccaaggctgtgcgttcctgagggccaggtcgggggcaggcatggaggggaggaaaggcgtccctcttggccctccccagagtggctttcctggcaccctggcctgggtgtctggttctgttttcttttcttccccttgtgtttccagtcacctaacttcccttcctcaggctcccccggcccaccctgctcagtgaccccacaggaagcttacacattttctcagaggcctttgtgctcccacctcttctaccctccccctcttctttcccattttaaaaaagaaaagaaggaaaaagaaaaaaggggcaaggagccccgcggcggcctgggcagcgcctgtgcagacctccctgcaggccgcactgccaactgctgcatttgttgtgttttttaggttgcaattggtgaagttcacactttcattgtaattttagcgtgtggggttttgtcccttttttgttgttgttagctgtgtacagaatgtgtaatcttttttcttttctcttttttttgttttgttttgttttgtttttgtttttttacttttttcttcttggctaattcttggcagggatctttctggaggaaaagctggggccagccagggcaggagaggtgtgaaatctgccacgaggggcctgctgtttgccacccagcccaacttcctgttgctggcccctgccctctgcccttttgcctgtcctcaggccgctggaacaaaggaaggacagctcattcctcatgggcgatcactccgcatctatagggtcgagcctaggggagcttgagggagggctggggcctccttgtcctggatttccagctctccccatgccccctccctgagcaccaccggcaccgcctcccaaacagggctgctggtttccgcagccactgctccacctcccccaaatcgtcatggaaagggtggagaatggaggggaaccaggcgtccttggaggcagcttgggagggtgactgtgtagtgtcacccacaagggaggctagggcaatggagcaggccaccagcagcagctgtgcagcatggaactcaggccaggctccgaggctgggggatctgcttggagttttctgccccccaccccaaacttctgtcgaggagcaaggcttgccagcaagtcagaaggatttgaaccgagcagccaatctttccagccctcccctaccgacctctgcctggagacgcagcagcctgtgtcctccagggcctctggtttgttgtattatagtatatttcgctgtggaaaatgtcacgtttagtcaccttggagcccactcacctggtcctgttgttttaccccatcccttctctcgcgcgcctattgatttgtttctgaggagagtacaccgttcactattgtagagtaacccctgtgactcaatattaccatagtgcgatgtcgttttgtgctattttgaacaattaaaagactttttttgaaataacca

SEQ ID NO: 189 - DNA, 34856 bp, mus musculus
gggcagtcccgagcgtgaggaggtcggcgcaggctacaacagtgaggacgagtatgaggcggctgcagcacgcatcgaggctatggaccctgccactgtcgagcaggtaagagctgtggggtgaggggtgagcggccacggcagatgggacccccagactgtgaagggactcaaggaaggctgtttgagatcgccccaagggatctaggcgttttcactgggcctgacagtcttctctggcggtagggatgtgagacaccttctttcctcccctccaggattttggggctagaggcctacggtaaggtgtcagacttaaagatccgaggtctcttttaaggtctatagtcgtcattccagtccctgggacctcatcatatagggccaataggtgggaattctccaagagatacaggtaggatcgcgcccctcttgagtaggagtctcaggtctcccaagagacttaggtatgtgttcagtggcttaagagctcttttcctctgggatagaagtttgagattccccttccaggaaagtcaaataaggtggagacctcggagatcggggctgaacatccccaaggagcctaagccctttcaagagtctgagacactctgcatataggacaatcctctcccgcttcgctgggtaacactgcacaggaccactgaatagccagacctgagacctcaagggtcctaagtctgtcttcaggggcctgagagtcctgcttctagaatcaaggtcctgacacacacacacacacacacacgccccctttaaggatagggatcttctaagctttttccagggatgtaagacttttcacagggagatatgattcccttgcccttggggacagggaccaaaaccaacacccaatgaccagcagctttacttatctcctttctgagtgacaaaggtctgcatttcctatcagtggcctgagacctacctcttgggagacaagggcctgaaccgcttcaggatcttaagcttcttgtaagaagagatgggccctcagcacccccaccaggggcctgaacctttcttcaggaaaatgagactcacagcgttggatcctagggcctaagatccacctgcttatggactgaggtttttagagaccgagtctgaggcctcttcaggggcctggtgtcctgctgcaaaggtctcagacaaggtgaagtctttaggagatccttcttctcaaggctggtgtctgagtggttttggggatctgagactccccaccccacgagcatatgtgacccttttaccccaattataagggactgaaacataccttggggatacagtatcccattttcccctctgtaacaggggtttgaggccctcccaccttgggcctaagctttttgtcagggacatacgacccatgccttgggaacttgagcctgagacgactactcaggggacatgggcaacatgggatcccagagatgatgtctggggcctccctacagatctttgcctacttttaagggcctgagacccactctgccaaggacacttgagctttccttcagggacaggagactcatacataccttggtgacttgtgtgtctagaggtaaggtctgagcttcctcctcaaggaacttaagatgtacacctgagaaacaggaggactcctccccccagacctgagccctgagactcttcccttggggcatggataaaggatccctgtggaacagggtcctgagtctacctccaagggtttgaatcataactcaggtgtgtgaaggcctgttccccaccttaggacctgatttctgaacctgccctgagggtactgtcacctcacctcagacaacttacatacaccctagtcttaggggtcatttagggacataagacttcctgcctcggggacttgggccttagactcccaactccttttggggacatgaatagggtaggattctgaggaaaagagtctgggcccaagctttctctctgggacaagataccgtttgccttagggactgggggcctggctcccacttgggcatgaggctctcctcctaccacaccaggcaatcctttctgtccagggagaggaacgtgaggtcatcctctcccattggacagaaggacctggatgctcttcagggtcatatgaaccccttatccagagctccctcgtggccagggccaagaaggtcctcctactttctatgagaagattgtcaggtcctggggacatggagtctggagcctcccttctgaaaccaagagcgattccgagtctctccctgacctagctatgcttgcttctcacctctaggtcatataataagttttgaactgcttttgacaagcttttttcttcccagggacaggaaaggggtttgggacatcgccactctggggaaattctcctcccacattccttttccccttggctcaggtaaatctttctgtacttcacaggggccccaagccttgtcttgagctccttgttcttggtcccttcctcccatcattaattctggcacgataagccatttgtactcaagggtcaggaccagttatttcttctctctctggttgggtagtttctttcctcctctagaagcagggagccatacatcactggtcctagggacagaggaaaaacatcctatgcagccatgataattcaaaaacacctccttactcccctcccttgcgatacatccctggtcccagggacagagagaaagaacatcctatgctgccatggtaactcaaaaacacttccttatgccccttgcagtccctcccttatacttgtccccataagaacataggagtaagccgggcatagtggcgcatgcctgtagtcccagctactcgggaggctgaggcgggaggatcacttgagccctggagttcaagacctgcttggcaacatagcgagacctcatctttactaataaaaaaaaaagaatatgaaaatcaagttttgtgggttcatgaaacctgcccttcccaatgacaggagaggctttctgtccccacacttcttaggacaaagaaggtgatcctcttctccctgcctcacctggtccaacttgagagcttttggggatgagaagagggaagattcctcctgccaccccagtcttggtcctaaactgtcactgggggtggttgtagcctggaggtcagttggatcccttgggaagagaggcgtcgttgagggggagtctagatggcgattctggggttctgactacttgggcttcctctttgtcctgattctcttgtatccctacttcctttaggagtctttttggcactctggggtccaggtgctgggtgggtggtgatgtcaggggttcccaggcatggctgccttgctgagagtctgctctatgaaaaggttggcctgtaagcatcctgagtttggagaccccacagagctctttgagaaggggcatgtgaactgaggtggtggaaaaagctgggtgtggcacggtagttggtgcctgggttccaactctgggtctttcaaggctttgctggatgaaccagggtaggttctacctatgctctctgggcctcagtttcctcactggccaggcaaaatgctggtgaggtgttgtttagctttgggattttagggaactcagtccaaagttctctggacctggaggtggcaaagaatggtggatgtcttttgaggaggaactgggtttctcccctctcttcctggctcctctgttccctctcagccatccaagcttggtgggcaggacaagcagcctgttttgtgtgaggctcagggttgatgaacagccattttttgtgggcagccatgttgtaatgaacaagctcgatgggatttcctgtcaggaggcctgttggatagtggtgtagagaggtagagttgtgtgtggagtttgggctttggagcaaggcaagctttgagccatcatccctcaattctctcatcacctccagacctcagcatctcctccttacctgctttatagctttaggcaaactacttgccccctcagctgcccattttgcaaaagtttgtccatgcccaggtgtgtctgaccttgctcaccttggaccttggccggttcttcctcttgcccagaatgggcagtttgccccagggtcatcttggttcttcctaggagcctttgtccactcctagtaacctatctttgatagcaaaggcccttcatttggcatctaggaacctgctgatttcttgggctcttcttaccccaactggaattgggtagctagctggtggggaagcaggaaggggtctctgcccaggcaacgtggatttgagtcctgtttctgcagtaagcttttctgtggtcttcaggcagttctcttttctggttcttggtttctccctccatgaaatgggtagtgttgaggagggaggttggactcattgctctgaagcaagttatagtctcctccctgctcccactcccctcacccttcatgaaagttttaagtgggaccccttggcctttggggattgtgctaggacatttcaagcagtgttcagcgtccttggctggtgctgagcccttgggtgtgtttcttttaacaactttaatgagatgtaattcatgtaccatactattcacctctttgaagtgtacagttcagtggcttttagtatattcacagatttgtgcgtccatcacatcactacagtccattttagaacattttcatcaccttaaagagaaatccagcactctttagctatgatcccccaatttcctcatccctttccagcctctggcaaccactaatctactttctggcttgattgatttgtctgttctggatgtttcatgtaaatggaataatagaatatgcagttgtttgttacttggcttttttcacttagcataatatgttcaaggcttatccatgttgtagcatacatcagtgcttcattcctttctattactgaataacaggaccttgggtttttttgttttttggtttttgtttttgtttttgttttttttttaaggcggagtcttgctctgctgcccaggctggagtgcagtggcgcaatctcaggtcgctgcaacctccggcttccgggttcaagtgattctcctgcctcagcctcccaagtagctggggctacaggcatctgccaccacacccggctaatttttgtatatttagtagagatggggtttcaccatgttggcaaagctggtctcctgaactcctgacctcaggtgatctgcctgccttggcctcccaaagtgctgggattacaggtgtgagtcaccgcaccctgccaatcttagaggtttttaatccccctgccctcagtggcctagccaaatgttggggccttgctcttctccccttctgccctggagggcttgtgttggtccttagagagtagtgtgtctatgttcctcgttggatgggttgcctgtgtgtgtttttttttgagatggagtctcactctgtcccccaggctggagtgtagtggcgcgatcttggctcactgcaacctccacctcccaggttcacaccattctcctgcctcagcctcccgagtagctggaactacaggtgcctgccacctcgtctggctaatatttttgtatttttagtagagacagggattcactgtgttagccaggatgatctcgatctcctgacttcgtgatccgcccacctcggcctcccaaagtgctgggattacaggcgtgagccaccacgcctggccccctgtgttttgtccatggagccaggctagtgttcctgggtgctttgctggagggggtggtcttggcaccagggctgctgggacagagctgtgagtcacagaatgctaaacaccttttgaccataggctctgggaagacatctgtccatgaactgccactgctgctgccatcttttgcccccccaccccacccccacttcagtggcagctcatccatccataggcagggtcagtagtttcccagggtgagaagggagattccaggcccctgctgccttaattctaacctcccaccctggaggatggtaggcaggtggaccttgcagagcgggatccatgccatattgtctcacacctgtgaggcactagggaacagacaccaaggagtgctaccaaggggggtgtgttagtttcctgtggctgttgtgacaaatgttaccacagactgggtggtttaaaacaacagaagttggccgggtgcggtggctcacccctgtaatcccagcactttgggaggccgaggcgggtggatcacgaggtcaggagttcaagaccagcctggccaagatagtaaaaccccatctctactaaaaatataaaaattagctgggtgtggtggtgggtgcctgtaatcccagctactcgggaggctgaggcagagaattgcttgaacccaggagacggattggaggttgcagtgaggtgggggttgcagtaagctgagattgcgccactgcactccagcctgggtgacagagcgagactccatctcaaaaaaaaaaaaaaaaaaaaaaagagagagagaagtttattctgtcacaattctggaggccagaagtccacaatcagtttcactgcatccaaatcaaagtgttggcagggccacactccttctggaagctctcagggagaatttagaccttctctagcctctcgtggctgccaacattccttggtttatgactgcatcattctaatctctgcctccatcttcaccatcgccttctctgtatatgtggtttccttttctgtctgtatcaaatttccctctgtctctcttttataaggacacttgtgattgcatttaggtcctacctgatactctaagataaccccccatctccagatttaataatgtaagttaattacatctgcaaacactttttttcttttctcttctctttttttttttttttttgaggtggaatctcactctgtcacccaggcgcagtctcggctcaccgcaacctccgcctcctgggttcaagctattctcctgcctcaccctcctgagtagctgggattgcaggcgcccaccaccacacctggctaatttttgtatttttagtagagatggggttttgccatgttggccaggctggtttcaaactcctgaccttagttgatccacccgcctcggcctcccaaagtgctgggattacaggcatgagccactgtgcccgggcttttcttttcttttcagacagtgctggcctctgtcacccaggctggagtgcagtggcgtaatcttggctcactgcaccctccacttcctggactcaagtgatcctccagcctcagcctcctgagtagctgggaccacaggtgcgagccaccatgcccggttaatttttggtgtttatttatttgtttttgagatggagtctcgctgtgtcacccaggctggagtgcagtggtgctatctcggctcactgcaaccttcgcctcccaggttccagcgattctcctgcctcagcctcctgagtagttgggattacaggcgcctgctaccatgaccagctaatttttgtatttttagtagagatagggtttcaccatgttggccaggctggtctcgaactcctgacctcaggtgatccacccgcctcggcctcccagagtgccgcgattacaggcgtgaatcaccgtacctggcctgtattttttgtagagatgagatttcaccatgttgcccaggctagtcttgaactcttgagctcaaagcaatctgcctgccttagcctcccaaagtgctgggattgcaggcatgagccacgacgcctggccctacctttttcattataaggtaacatttacaagttccaggggggttagggtttgatatctttgcgtggctattaatcagcctactagagaggcttttttccctcctggggaagggaagggaactcattaagtggtctcttactgggcaaagccctgtaatatttgagtctgcccagcatccctattattgggaggcttggtatccccattcacagattggaaaactgtggctcagagcagttcatcatcacatggctaataattggtggagctagattggaacctaagtcagttgggttccacagcctgctccaacttcacttgggcccttagaccactaggttacagaatcttgcctcagctcctgggatcctctggtgttagggagctttactcagcctttttgtggaggctcaaagatatggagggattttcccataggctcagcgatgagtttgcaaggttcacaatctcctcaggccagggcattgttggagcttaaacttatctatggctgagctatcccctaccccccacccctactagcccttcctgagcaacattttctccccaaaaggagaaagagaagggccagagcccaaactcctcaggctgctgatgacaaagccagtgggtggctagcagtccagcctctagatccaagcctggatgccagtttgactgccccaggacccaaaccctgcagtgcgaggggcctattcaggtctctttcatgtttagagacaaaccaggatattctgtggatgggctgcaaggtatgtcctccatgctgtggctcgtgggggccttccctgttgcctctacactaggctttgctggtatccaaactccagctcctttctctttctgcctttgtttttttgttttttgttttgtttttgtttttgtttttgagacatagtcttgctctgttgcccaggctggctggggtgcaatggtgccatctcggctcactgcaacctccacctcccgagttcaagcgattctcctgtctcagcctcccaagtaactgggattacaggcacacgccaccacgccctgctaattttttgtattttcagtagagacaaggcttcgccatgtcggccaggctggtcttaaactcctaacctcagatgatccttccgccttggcctcccaaagtgctgggattacaggcgtgagccaccgtgtctggcctcctttctgcctttgtaaagtgagggtaatgtttcctgccacctgggctgtggtcaggaaaattaaacgaggtcaccctttgcatctggcatggggcaggtattcagttaatatgagttcatctttcttcctggtcctccctgcttacctgcctagtactacccagaactttagctctactgaattcattgctgggctccaggcattcctggtacttcgtggcagaagtgacttcatttctcatccagttaacaagcatttttggaggtcttggtgttttaatcctttggtcaggtggcacctcctctcaggtgctagccttaatgactgtgtttctttttttcttttttttttttttccttgagacagagttttgctcttattgcccaggctggagtgcaatggtgcgatcttggctcaccacaacctccgcctcccgggttcaagcgattctcctgcctcagcctcccgagtagctgggattacaggcatgcaccaccacacctggctaattttgtatttttcagtagagacggggtttctccatgttggtcaggctggtctcaaactcccgacctcaggtgatccgcccacctcagcctcccaaagttctgggattacaggtgtgaaccaccgtgcctggcccaatgactgtgtttcttttcttttcttcttttttttgagacagagtctcactctgtcgcctaggctagaatacagtggtatgatcccggctcactgcaacttctgtctcccaggttcaagcgattcttctccctcagcctcctgatttagctgggattacaggcatgcaccaccatgcccagttaatttttttttgtattttttagtagaaacaaggttttaccatgttggccaggctggtcttgaactcttgatctcaagtgatccacctgcctcggcctcccaaagtgctgggattacaggcgagagccacttcgcccagcctctttctgtttcacaacacctggcatttacatttttcacagccttgttcataccttgtggtggttacctgtttccctacccctctgctaagtagtttgtgagcttatcaagagtggagactaagtctgattcatttcactgtcctcactgcccagcccagtatcttacttagtagctacctggtaagtctttcttgaatggataagtaggagcccctctcctgtttgatctccttttctcctctctttttcccctctctccaaagccaggaagtcgctgtgttcccttctttttaagaacctattcttgtgtcaggtttgggactatagttgtggttgcaccatccctgctggagacccctggctggggcaggcccatgactctgggagatggctgaccatgtgtggccaggatggacttgggcataactggctggagtgtgttaatccacaggcttgggggcaaggagggacacctggactactggaatgttgtgcacaaacaggagtccttgtgctgcgcatggaagctcattaagggcttccaggtgtctttgtcatctctagaaatccagccacattttcctggggtgtgggccctgatgatgggactggctgggtattcccttgtcacctcttcctcccctcctgtcccgctactcacctaggactttctgagggtctctcagttgtgcataatctctgtgctgatctcctccccttctgtgattggcgacaacttcccctagtatatggtacgttatttacaaagcttctttaggtcctgaaactcctcacagctctgtccggtagatcaacatatcccccattctataggaaactgagagtgataacagacagcaagtgtgtggcaaagctggggttggaacccagagctcttgcgttccaaaccttgtgcttacaactttgccagagatgcttctcctctggctttcttaggggatgggttccaccccttgcttgagctggggaaaaatggccttacggataggtgggcccctatgtctggtctctaataccccagatcctataaatccctgggcaggcctgtgtccacaaggagcaggcttgggatcctgtagtttgcagccttgttgctaggtcaggctggctgcttctggtagccagcagagggcgtgaggggcccaggaaaggtctgctgcttctggttggttttgttttgaaatgaaaattatgttttaagaggttatatggtcattatttttttaataaaaaaatatgcatttgtacaggttcatttaagttgaaccttcgtggtgccaggtgtgctttggaatttaggaaaaaaacaatttataaaacttacctggtgtgtatactttgtgttacataacacctccagcagggtctgaggcagcacctcataatcaaacacctgaatgttttctgcattgaaatatttgaatatttaccccaagtgggataaatagattcttgtcagttctggtcaggttatgatgccaaatgaattagataaagacttttgggccgggcacagtggctcatgtctgtaatcccagcactttgggaggccgaggcgggtggatcacgagatcaggagatcgagaccatcctggctaacatggtgaaaccccgtctctactaaaaatacaaaaaattagccaggcatggtggcaggcgcctgtagtcccagctagtcgggaggctgaggcaggagaatggcatgaacccgggaggcagagcttgcagtgagccgagatagtgccactgcactccggcctgggcaaaagagtgagactgcatctcaaaaaaaaaaaaaaaaaaaaagacttgattttcaaagctttttgggtttagtgtaactttataaaagggaaagtgcaataaaatcgctgataacaccaggacttagggatattttgctgtctagccttcccaattttgtgtacgtgtgtttgtatacatacatatgtatatatgtgtagatatctgttaaatgtgttcagtcacagatgagaacattgtttgcacacttttgccttctagagtatatctcttttttttttttttgagacagagtttcgctcttgttgcccaggctggaacgcaatggggtgatcttagctcaccgcaacctcttacctcctgggttcgaacgattctcctgcctaagcctcccatgtagctgggattacaggcatgcaccaccacgcctgactacttttgtatttttattagagacggggtttctccatgttggtcaggctggtctcgaactcccgacctcaggtgatccacccaccttggcctcccaaagtgctgggattacaggtgtgagccaccatgcccggcctacagcatatcttggaatcctctagccctttgtcaggttcaggatctaggctcttgctagttaccccctcttcaccacctttcctagatgaaactccttgaggtagagccacattctccacccaggcacttgctgggtctgagtctctggctgcctgaggcagtgtggctccctgggccaggccctgcaaggtcaacagaagccataaggcatatggggccactgttctcagggcacctaggacccttttggaagtaagtcttagtttcactcagcaactaattccctaaaagagtctcctacttcacatgcatggagtggtcaaacagggctgagaactttaccttggccagcgtcctctctgtcaatgatctaggcctctcgggagcttgaggtcggggccctggggagggagtacaggttttccctgttgctgacccccacctcttccctccagcaggagcattggtttgaaaaggccctacgagacaagaagggcttcatcatcaagcagatgaaggaggatggcgcctgtctcttccgggctgtaggtgagtctctgccttagtccttaagggcctagggctgcccctaagctgtgtcccagttatcaggaatagcccctgagacagggttgaggcagagctagctaatcttttagggactctaggctccagcctcaagttggtatctgacctctagccgtgggtcttgagacattgtagtggtgcaagattaatatgcataataacagcaagaagaatgataaagaaaataatatcctttgggacacattgtcaggtgctacaggaaacctctttgattcccctctaagctaggtgagtgtagggactactgttgcttccatttgtcagatgagaaaagtggctcagagatggtgggtgacttgtctggagtgaaataataagtggtagagttgggattcagtgtctgggttagattagtctgaggcccatgctcttaaccatagcacactgctgccaccctgggctgtatgacccctaggtttatacccagatcccatctctggtgtgttgcgggtctctgttcctcaatctgtgtgtatgggggctatcagactagatctttacaaatttcttatatcatagaattttttttcaacttatataaaagtagagagaatgatgaaccctcatgtacccatcatccagcttcaaaatagtcaatacgtggccagccttgtttcatcactatcccgcccactctttctcactcccctgaaagaagagtatttttaaagcaaaaccccgacattggatcatttcattcataaatatttctgtatgtttctctgacagatacagacttactctcttctttttaacataatcaaaatgccattactgcacctaacagaattaataatgccttaataccatctgttatccagtctgagttagatctttgaggccattttggctctgaatctgtgacccaacaagtagttgtgaggtcctgtgctagggtgaaggggaagctgggaatgtgacctgatcctccctgtggttctctgatatctaccaaggaaaagtgccctctgataggagctttgagctgggagtcagaagacctaccttctagttctggccctgactcataactgctgtgacacttggccttggtcttcccgtctgtgaaatggtgttgattctcaatgcctctttgagttccttcttggtctgctattctctccgtctgtgggtaccccccatgtctactggtgggctggggtgttttaggctccatccctggctgcacaactgattcttggtatgaccttaggcaagcagctcttctttcctgaggctgtttcctcatctgtaaaatggggctaaaagaccctaatgctgtaacgatttaatgaagttgctttggtaaatccctttagtgcctgacacatatagtagaccctcatggaacagtagcatttgtaaaacccagatgccattttcactggtgcctcagagtcacatgtgtttgttgaaagggtggagtgaatggtctcctctctattctgccaagcagaagaggctcaggcaatgggctctattggactgggaaaaaacttatccctcctacccctctggctcaagtttgtgttttccctgggatgtttcccagaggaagagctgggtttcggggcatcttggacaaaagaaaggcaaagaaagaataggtgggggcctgttaggtgctaggccctgtgttgagacctcaggctagatgtggggtaagcagggcttctggtggagttaggattagagaatgcagcgggcatctgagtcttgggcagtcattgagggtaagccttgggactggctagtgaggacctggcttgtgtagtaactcatatcaagagccgtgtgtgtgtgtgtgtgtgtgtgtgtgtgtgtgtgtgtatctagctagctgttctctgtgtgtgtgtgtgtgtgtgtgtgtgtgtgtgtgtgtgtgtatgtgtgtgtgtatctagctagctgttctccccaaatacccccgacccttggggctagctagtgaggacctggcttgttgtagtaactcgtatcaagagcagtatttgtgtgtgtgtgtgtgtctatatgtatctagctgttctccccaaatactcccgacccttcctcccactggggccttcggtaaggggcctctacttacaggaagagctgaccagggcaggttgaaggcctttccttatcggcactatggctacacatttcccctgactgggctgcctttggcttttctctgtaaaacctcagaagtcctctggcctctcccccgaagtacatggcccttggtctctagaccttatctggaggtttccttggtgcagagtgcataatacatgtgcctgggaaggggactttgtccctgggctttttgctgcccccgtttccagcctcgcctggatggggacagatggcagtcagcttagactgtagtgtgaagccctacaggctgacttcctgccatgtgttgaatagtggaaggaacgtggagcagagagttggagttgggcgggggctgcaaacatagagggcactgtttccttgacccctgctgtgtgctaggcattcagctgggtgcttcaggctcactgcaaaacttggatcattatcccatgagacaggtgaaaagattgaagcatagaaagggaaatgacatgctcagggccattagccagagctggcctgggaacccagaggtgtccaaaggacacgcattcttttttttttttttttttttttttgagatggagtctccctctgtcgcccaggctggaatgtgcagtggcgtgatctcggctcactgcaacctctgcctcccgggttcaagtgattcttctgcctcagcctcctgagtagctaggattacaggcgtgcaccaccacacctggttaatttttgtgtttttagcagagatggggtttcaccatgttggtcaggctggtctcaaactcctgactttgtgatccacccgctttggcctcccaaagtgttgggattataggcatgagccaccgcatccggccaggacacattctttttatgatcctaggatccttagcttcttagcttggttgtcaactggctggatgaccttggctgtgttccttgacttctctggaccttacctcctccaagtaggagcacgtggccctctgttgttgggagtcttgaggcaggtggctttctgccttctgttcccctggattatcttcctatagggtcctaccatttgctttagagacttctgagaattgcctactccccaggtagctgcctgcctgccattggttcccctgagttaagcaatatccattgcttgcgctcagttctctcccacctcctcttattggggattcatgagcatcattgaaggcttgggtggagtggaggtgggaacctgagcctcagaggtatcctgtggcccaccctgtccctgttatgctcagataacctcctcctggaaacatgactctgcatctctcccttgctccctccctccatgtggctttgactcagcagaaacctctaaccctgaccagggtcctggtgctagcttctgtgggcagagtgaaggccacatggttgtttctacatgggccatgggggagtggcaagggctgtgcatgttaccacgatgaggcccagaaacattagctaggcccactcttctgggccttttggtcttggaacatcagcactaggagggatggatctgagatcaattttgattgttttataaatggggaaactgaggcctcaagagaaagccaagaccctaccctatctaggtcatacaaccagtgtcagaacattggtatttgaggttgaaccaggccacagaaagaagattcccacgggccatttcctgtacaccagcttccttcagcctctcccgtgtatccttcaggtttctcatccttgcagtgggaatccttgagcagaggagcacacatctcaggaaccagactatccagtgggatgagttctgtctctcccactgagggtatgctagttggggtagttggggctacagaccaggtcacaccacagctgcttgacaggcaagtgagacctttgtcctggctcatctcctcaggagattggttctcagtggggccagggttcccactggaccaggagggtagtggggagcagaccaggtccctgtctccctctgcagctgtgtgtacacacgttagtgtggtttgtttttaggttccctgtagacacctagcttccttttttgcccttagcggaacttgctgtggctcttctgggaggcaggcagctacctggggagtaggcagttctcagatgtctctaaagcaaatggtaggaccctataggaagataatccaggctctcatgtcttgcttcttaacataaatctgggtacattattggttacattacattagttacataaggacttcccccgggcaacagaggagagaggttgaggctagtctgttagagctcttggttatttcccctgccctccacctaccctgccagaggccaggaaggaggttggtggggtagggggtccctcagtttatagagcctcacatcttcagtctttcctgaagtggcaagggcatctactcattgaatgtgatagttctctgttgtgggatttgttgggtgagcatttggcctcagggagcatctttggcagtctctgctgtatgtgtatacacatgtgcatttctatactggtgtctctgtgtgtccagaaaaaggaaagaagtggggtgtgtatggggagggtaaggttcatattggcctctgtggccctagggagagatgcagcccctgatatctataatctctgccctctcccatgcctttcctgggttctagctgattcctgcttgtgctggtgtggaaactgaggcacacaagatcaggtcctgccccagggagtaaggtgactaagatggtggctggattggggtgaaggtggtaatatcagctggggccagcagttaccctttgagagcctggcctccccttcactccccctaaatctgtgatcccaggcaagctttgccacatttctgtgtctcctgggtaaagtaagagtgttttggtaaggatagaatgagttggagtgtgaaaagtctttggtgtgggaccaattgtagtattgtactgaggatttctgagccctgtttgagatgggaacagaggtagaatggtgggggacccccttccagctggcctctgggaggggagaacaggtgcagattgcccacaagtgcagcgtcagcaagaggaggagtttcagtttctatcaaaacaagttctctgaattcccctacctctgcaggtcatccccccaacctcagacccctccacagggaagtcaagcctggcccccagccctgtgtgccagccttctgggaagaggagggctttctggaggacagaggtggagctaggaaagtcagaaaaacgaattcttttttttttttttgagacagagtttcgctcttgttgcctaggctgtagtgcagtggtgtgatcttggctcattgcaacctccacctcccgggttcaagcgatttttctgcctcagcctcccaaatagctgggattacaggcatccaccaccccgcctggctaattttttgtatttttagtagagatagggtttcaccatgttggctcggctggtcttgaactcctgacctcaggtgatccacctgcgtcggcctcccaaattgctgggattacaggcgtgagccaccacacctggccaaaaatgaattcttgttgagtacttcctatgtgtttagctctgtgcttagatgcttttcctgccttatattattggagaaatccttctattctcccttgttgggatagtactattgctgttttccttggtttggagatgtatattttcttccacgttaatgattccaaacttagggtataccttataatcagtgtggtgtgtttcccccctcaaaagctgtgattaggtacatgttataccatatcacctatcagtgccatcataggattgaggagagaaggtggtattttacattttacagataagtaaagaagtgtcataactcgtccatactttaggaccctgttttatgaagcctgtattgttaattcgatattaatttaactgctgaagttttgttagaactaacggcctagaggtagacttgtggacctttggtttcgctaaaggtagagagccaggagaggacatgcatcctaggtctgcatttggggctttcctctggctgaggaattgcaacagaaatgaggaagggcttcataagtggttatggcaacattctggctgactcgtgggtaactagcatatgaaggaatcattgtcgtcatgacaaattgtgttcctgtttcttgaccacctactgtgccttaggtgcttggcaaacctcctgtgtagttttgacaacacccagcagatggaagaggagttactgtctccaccttatgcatgaggacatttcagcttagagaggttaaaggccttatccattgctacacagctaggaggcagcagagcctttctgccaggcaaaggggtcagtggcagagaaatgggaccctcagggggttttcccccagatcccttccctgttccacagtctcctctctttccccattttcctgcatctggcatctagctcttgaagatagaactcccaggcctggaaatgaccgttgacctttccataggagatgggctttctccagcacctcagcctatctctctgagcctggccagccaacccctatttaaccccttcattctcatctttgttcctgtttactgcagctgccaacagcactgcctcccagtaccccaagctcagtctacagaaatagctccccaagtagctcactgtgcgggctctgtggtcctggcttctaagaaaggcagcagcagggggcccccagcctgtgcgcaggacatgtgacttgctggaaatgccgctggggagggcgggggagagtgtggccgcagaacccacatccttgtttacattggtgaaggggctaccccccttcccgccttcacaacctccacacccccttacccttcaggtctcttcacctccaagaggactggagacaaacatgggccctattttctatctcagagtagcctttctcacagaacactccagggtaggaaggggaaggcagggaaggtgttcttctgacagttcttcagagaggtagactgacagggaagaactcaggagtgttcctgtgtgacctgaccctagccccatgccccagggagatcccatcagagcagtggtcctctggggaaacaaagggaaattcccaaaaccagtggaaatcagacttgcatgatcttcaggcccactttaatttcacagggagaagagctccctggcttacccagcctatccatttgctcagtaaacttttcctgatttcctttactgtatcgggccctgagctgggggtggactttggtgtgaactgccctttgccttctgtgggagcccagtgtggtcgggcagaagtctatgcacacctttgataaatctggtgatagaggtgtcctgggtagtggggaactgtattaaagaacatgttgggccaggcgcggtggctcacacctgtaatccaggcactttgggagtctgaggcgagaggatcgcttgagcccaggaggtcaaggctgcagtgaactatgatcgcgccactgcactccagcctgggcgacagagcgagaccttgtctcaaataaataaataaataaagaacacattggtgtttgagaagtaggcagctgacgaggatggaaggagcgtcctgaagagaaggaacggcatgtgtgaagatcctcaagcgaagcagagggagtgtgtttccttctcgccttagtttgaccaaatctcacgacgcctggactattcgggccacaggctgcccatcctgagttaagctaaagttagttgcatgtgtgtcttatctcttttactagactgtgtgctccccgaaggtaggggcaggattttactcacctctgtcaccttcacagtaccccacattcaggcctccctacggaggaaggaattctgatttactctgtggctactctgtcccaagcccagtggtagttattttatacccgttatctcatttaatccccacaaaaggcctgccatttggttatccctttttttttttttttttttttgagacagagtcttactctgtcgcccaggctggagtgcagtggcatgatctcggctcactgcaacctctgcctcctgggttcaagcgattctcctgcttcagcctcccaagtagctgggattataggcgcccgccaccatgcccggctaatttttgtatttttggtagagacggggttttaccacgttggccaggctggtctcgaactcgtgacctcaagtgatctgcccaccttggcctcccaaagtgctgggataacaggtgtgagcctccacgcctggcctgttatccctctttttcccattttacagatgaggtatatgaggctcagaacacttgggtcacttgcctctggtcactcaactctctagtatctggcagaactgggcttggagcccatttttttttctttcctttttttgtctttgttcccttttttttcagcctacaaaggccatgttgacttgtaggagtcaggaaaactgaattcagagttgactctgtcacagactgactctttgtgaccttggacaaaccacaaactccccctgaacctcagtttcctcatgtggaaagcaaagggggtgtgggaatcaatagcatttgaggccaacctgtggaacttagaatgttgttgatttctctgagtggccacgtgtaccctagacaaagtcatctgcccaagaggcctgtggatgtgttcctctcacctgcactctcttgttcttcaagtctggccctgcctgccatatttttccatgaccccgttctagcctacaagggcaagaactctccaggccttggggtagaaaagggaatttccctggtcccccagttcctcctccccaaaggatgttctatgattcagagctcttctctggcatctctgaccctagctgctgctttcttctgcccccacagctgaccaggtgtatggagaccaggacatgcatgaggttgtgcgaaagcattgcatggactatctggtgagaaaatggaggcctttggggaaggggcagggtgggaggatttcttctccacacagaccttaaccttccaatctattctgcagatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacaggtacttctgcagtgggtaggtgagggaaagatggtgcctcattcgagcctgcccaacctggcctgctgtggatgctccctccttctctttctctgcagaacccatcaacacattccatgggatacatcaaaacgaggacgaacccattcgtgttagctaccatcggaatatccactataattcagtggtgaatcctaacaaggccaccattggtgtggggctgggcctgccatcattcaaaccaggggtgagtgggtccctgtgcccagaatggctgctggatatagaggtcagaaacctctgttggagtctgttttgcccctaactcacaaaaatatcctgtctcctctctcccctgaggtctcacccttacaaaaaaaaaaaaaaaaaatagggagttacttaaggtgatctctcagggcttgttctttggtcttggtttgcctgtctgagttggcttacctatcttttgtgcccgttgagggctggcattttaggatgtggagtcctattttggagcagtgagccagggcttgctctgggcatcttggcatggatctttctcctgggatcatagtggttacagacagccatggtcacagagacatggggtacaggcctggccccaccactcactggctgtgtgatctaggcagattctgtaagtattccaggctggcagcttggctgatacagaaagcacctcccactgggcctggggcctagtaggtgttcagaaggtggcagtgcattttcccagcacataccgatagattctcattcatttctctctctctctcttacagtcatttgctgaggattttggtatcttctattcaggtttcacttctacaaacacaaagtactcctgcttcattttcggaaacacatagcctaacaccaacacaccctccaacatagggttcttttttgttttgtttttaaataaacttaattttagagcaggtttagatttacagaattactgcaaagaggctgggcacggtggcccacacctgtaatcccagcattttgggaagccgaggctggcagatcacctgaggtcaggggttcaagaccagcctggctaacatggtgaaaccctgtctctactaaaaatacaaaaattagctgggtgtggcagtgggtgcctgtaatcccaactactcttgggaggctgaggcaggagaatcacttgaaactgggaggcagaggttgcagtgagccaagattgtgccactgcactccagcttgggcgacagaatgagactctgtctcaaaaaaaaaaaaaaaagttacaaatatattacagagttcccatatgcctcgctatgattaatgtattaacatagtacatttgtcatagttaatgagccaatatcgacatattattaactaaagaccatacttgactcaaattaccttagtttttccctaatgacctttatctgttccaggatcccatccagggtgccatattatatttagttgttgtgtcccctttatctcctcttggctgtgacagtttctcagaattttcttgttttttgtattcgatctgtttactgactctcgttttgccttttctagaatgtcatataattggaaatgtacagtatgtagctttttcagactggcttttttcacttaacactatgcatttaagattcatctgtgacttgtcctggtttaatggctcattttcttttttggtgggcgggtggagagacagggtctcactctctcacccaggctggagtgcagtggggcaatctaggctcactgtagctagcctccacttccctggctcaagcaagcctctcacctcagcctcccgagtagctgggagactacaggtgctcgccaccatgcccggccagtgttttaaaaaaactttttgtaaaaaaatgaaaaaaaattttttttttttgtagagacaaggtctcactatattgccgaggctgaccttgaactcttgggctcaagtgatccttgtgcctcggcctcccaaagtgctggaattacaggcatgagccactgcacccagcttcctctttttctttcttcaaaaatatgaatgttctggccaggtgcggtggctcacgcctgtaatcccaacactgggaggctgagatgggaggatctcctgaggtcaggagttcgagaccagcctggccaacatgatgaaaccctgtttctactaaaaatacaaaaaaaaattagccgggtgtggtggcacacacctgtaatccgagctacttgggaggccgaggcaggagaatcacttgaacctaggaggcagaggttgcagtgagctgagatttgacccctgcactgcagcctgggtgacggagcgagactctgtctgaaagaaaaaataaaaatgaatgttttaagtttttgtatttaatagacttaattgtttagagcagttttagatttacagaacaattgaggagataatacagaattcccacatatccttctcttcccaaacacagttctgctattattattattattattattattattattattattatcatcttttttttgagacgaagtttctctctcatcacccaggctggagtgcaatggcgcaatcttggctcactgcaacctctgcctcccgggttcaagcaattctcttgcctcagcctcccgagtagctgggattacaggcacccgccaccacgcccagctaatttttgtgtttttagtagagacggggtttcaccatgtcaaaggctggtctcgaactcctgacctcaggtgatccacccatctcggcctcccaaaatgctgggattacaggcgtgagccaacgcgcccagcccagttctgctgttattaacagttcaaatcattatggtacatttgttacaatgtgcgaaccaacattaatactttttttttttttttttttaaggcagagtttctctctgttacccaggctggagtgcaatgaggcgatctcggctcactgcagcctccgccttctgggttcaagcgatttttctgcctcagcctcccaagtagctgggattacaggtgcccaccaccacacctggctaatttttctatttttagtagagacggggtttcaccatgttggccacgctggtctcaaactcctgacctcaggtgatccacccgcctcggcctcccaaagtgctgggattacaggcgtgagccaccatgcccagcctaatacgttactattaaatgaaatctgcatgcctccttaggcccctttatctttgatagtttctcagttttgttttgatgaccttgacagttttaaggagtactgatcaaatattttgtaggaaatgtctcttttggactttttctcatgtttaaactagggttgtgggtcttagggaggaagatcacagaggtaaagtgccattgtcattacatcatttcaagggtttatactatgagtgtcatttatgcctgttggtgttacccttgatcaactggcagaagtagtgtttgttaggtttctccacctaaggttactctttcccaccttttccatactgtactgtgtggaaggaagtcactatgtgcagcccacgcctaagaaatggttatgccccatccccttgagggtagagtatctacatagattatttggaaatctttaaggaggatctgtgtctcatccttaactcatccttaatttattaatttttccagttattacgtacatcaatatggtcttttttttttttttgagagggagtttcgctcttgttgcccaggctggagtgtaagggcgccatctcagctcactgcaacctctgcctcccaggttcaagcgattctcctgcctcagcctcccgagtagctgggattacaggcatgcgccaccacacccagctgttttttgtattgtttagtagagatggggtttcaccatgttgggcaggctgaagtctcgaactcctgacctcaggtgatccaccctcctcggtctcccaaagtgcagggattacaggtgtgagctactgcgcccagctcaatcagccatttctttagagagccctggcatgtattggagactgttaacagaaatcaagacctaggtgttgaatgtgctcttcgatatcaggttgtccatgcttctaggccctgtcagctgatagagcaaggagctacatgtatgtatagtggcctttgtacacatatctataaatatttctacctgtaaccatctgtatttatattaaacatgaatccttactgatgtctccaactcagatccattatcacatgcttcattctagccttctccccttgttcatctgcaaattccctctccaacagtagatacgccatcagatgtatatgcactggttcctaccatccatttatgtaactgctcatttccatatacacgcgtagcagaatcacacttgttcacccgtacccccgtgggaaacaactttatcactatagctcaatgctacatatagttcttttttgcctttggtgttacagactccattcattttgaaagtgacctacttgtacccccacccccttcaaatgagggtgtttatttttattttattttattattattattttttgagacagagtctcgctctgtcgcccaggctggagtgcagtggcgtgatctcggctcacagcaagctccacctcccaggttcacaccattctcctgcctcagcctcccgagaagctggtactacaggtgcctgccaccacacctggctaattttttgtatttttagtaagagacggggtttcaccgtcttagccaggatggtctcaatctcctgacctcgtgatccgcccgcctcggcctcccaaagtgctgggattacaggcgtgagccaccgcgcccggccaaggttgtttcatgtttgtaatacatttgtattattttgtcacatttttgcattctatgctgggatctcagatctcctaattttttatttatttatttttgagacagagtctcactgtcgcccaggctggagtgcagtggtgcgatgatctcaactcaccgcagcctctacctcctgggttcaagcaattctcgtgcctcagcctcccgagtagctggaattacaggcatgcactaccacacctggctaatttttgtatttttagtagagacggggtttcatcatgttgcccaggctggtctcgaactcctgacttcaggtgatctgcctgcctcggcctcccaaagtgctgggattacaggcatgagccaccgcgctggccatagatctcctaatttttattttattttattttatttatttatttattttttgagacagagtcttgctctgtcacccaggctggagtacagtggtgcgatctcggctcactgcaacctcagcctccgtggttcaagtgattctcttgcctctgcctcccgagtagctgggattacaggcacgcgccaccacgcccagctaatttttttgatttttagtagagacaggtttcaccatattggccaggctggtctggaactcctgacctcaggagatccacccaccttggcctcccaaagtgctggaattacaggcatgagccaccgtgcccagccttcctaatttttttttaaatagcatatattaaggtccactctttgtgttgtacattctatgggttttgacaaatgtgtaatgtcatgtatctactattacagtattattcagaatagtttgaccacccttaaaattcctcatactccatatgcttacccctcccttcctccctcttcctgcaaacactattgtctttgtgggttgcctttttcagaatgtcatataattgtaatcatacagtatgtagccttttcatactgtttttttttttttttttttgagacagtgtatcactgttgcccaggctggagtgcagtggcacaatatcactgcagcctttacctcctgggtttaagcaatcctcccacctcagcctcccaagtagctgggaccacaggcacacaccaccatgcctggctaactttaaaaatatttttattttgtagagacaggatctcactgtgttgctcaggccaatctcaaattcctggggacaagtgatcctcccgccttggcctctcaaagtgctggtattgcaggggtgagccacctgcagccaatttgcttttttcccccctgaaattaaaatggtcaatgtgacagactgcttcttttcacttagcagtatgcattaaggtttctccatgttctttcatggcttgttagctggtttctttcttatcacttaatgttccttttatggaggtaccagtttaattattcacctattaaaagacattcttggttgcttccagtttttgatgattatgaataaagcttctgtaatgtgcatgcaggtttttttgtggacgtaattttttagatcagttgtatacatacctgggagcaagattgctggattgcgttgtaagattatgttttgatttatgaggaactgagaaactgtcttcccaagtggctgtattatttgcatgcccaccataatgatttggaagttcctgttgtcagcattaccagcaattgatactgtcattgtgttggattttagccattctcttaggtgtgtagtggtatctcattattttaacttgcagttgcctattggcaaatgctgttgagcatcttttcatatgcttatttgccatctgtatagcttctttggtgaattgtgtttgtgacttcctgacatacaattcctaaaatccttagaatctgcaaagtgttgcctttttgtatgctaatgaggtgactgatggctggcagcctctaggtagcttcaggatgggggctggtgacctgaaagaccaaggcaggattagaggtttgcaactttaagcccatcccccagcctttggggaggggagagaggctgaagattaggttgatcactagtgtccaatggcataatcaataatgcctgcataatgaagcttccaaagaatcccaaaaggattgggttctgggagcttttgggtagctgaatacatggaagtttctagagggtggcaccccagggagggcatggaagctccacgtcccttcccccatatctcactctgtgcatctcatctgtatcctttgtaattttctctataataaactggcagacgtgtttcctgggttttgtgagctgctctagcaagttagttgaacccccaaaaaagtattgtgggaatcccaatttatagctggtcagtcagaaattctggaggcccagactttcgactggtgttcgaagggggttggggggagtcttgtgggactgagccctcaacctgtgggatcccaggctgtctctgggtattgaattgcattggaggatggacaccaggtgtccgctgcttgctgtgtgggaaaacaccctccccccagcccgcacacttggtcacagaagtctcctgtgttgattgttgttgagtgagagtagaaaaaacacttggagtgtgtttaacactgccagagtggttagattttttgactatttttttaattggcttgttctaacatagttttacgaattgtttttaactattcacagtaaaaaattacattttatctgaatgcaaggtctgcaggaaaaagaaaagaatacattttacatgattacttagcatatatgcatttgtgtgtgatgtgtatatgtgcattaaaataatgttaactaaagcttcatgaaacaacatttgcacttattccctgggatatattctgatattttctattttttaaaaatgctgttggatctcagcctgaaaaacagtactctgatgtagtgtcctgtaactcatagcaccccacaccatgttgatactgcccccttattccctcacacacccactacttcccccaacccctcacatgcttgaatactccctccacccggtgcacacatagctaatttttgtatgtgtctcatctgctcatgtgtgtgaaagtcctcaacattatgaaacagtcatcactggatggggcttctttaaattaaggcccagggccaggtgcagtggctcacacctataatcccagcactttgggaggccgagtcgggtggatcacctgaggtcaggagttcaaggccagcctggccaacatggtgaaaccccatttctactaaaaatacaaaaaagttagccgggggtggtggcactcacctgtaatcccagctacttgggaggctgaggctggagaatcccttgaacctgggaggcggaggttgcagtgagccgagattaccccactgcactccagcctgggcgacagagcgatacttcgtctcagaaaaaaaaaaaaaataagtcccaggttggaaggcacctgactgctccagtctcagtgcctcagttgaggtggtttgggggttagagtcaggtcttacaagcataggagtttggaatgacaggtcccacatcccaagcctgctttcccctggtccccaatcaagaggtagtctgtggagtgttgctctttgggagtacctgctttcctgtctccttttttttctggggcctgtgggcctacctcgctgagcctgttctggctcttgggcaggttcagtgtgttattgcacatccctgttcctctccctccttgcagtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccaggtgggtcatggactctgtcacaggcttggccaaaaactcattacttctcatgctttgccctcaagcgagcagaaaaaaattaagcagttttgacatctgggagggaaggaagcatccagcaccatctgtaactcatcttggtcttagttttggcattgtaccttggaactttaaatacttgtgcagaacaggcacttaaggagtgagaggagggcagccatgctgctggtgacacgagaataatggatagcttcagagacacaagcttttgttgactgcccttgtgtgccaggtctctactgagaatgtaacatcagatctggactactctgccctcaacgatctcgtctgttggcagagacaactcaatggtggggtccttgaccctgactgggagatcagtggaggtgggggctccggttagtcttcacagaggaaggttgaattgttaggggagcggggaggggcggggcagacaagcatctgaggaattgtaaaatcgcaaggagtttggagtgattgtagatgttggctggcaggagctgagttttttttttttttttttttggagacagagtcttgctctgtcgcccaggctggagtgcagtggcgcagtctcggctcactgcaagctccgcctcccaggttgatgccattctcctgcctcagcctgcggagtaactaggactacaggcgcccaccaccacgcctggctaattttttgtatttttagtagagacggggtttcaccgtgttagccaggatggtctccatctcctgacctcgtgatccgaccacctcggcctcccaaagtgctgggattacaggcgtgagccaccgcacccggctgaaggagctgagttttattccacaaatacctactaccagtctgtggcaggccctgttttcagtatatggggatacataggtgagcccagcagaccaagatccccgtccttgtgatgttcacagttttgcagagtgaaataaaataataaatataatgaataaattagttgggaagtgctatggatggaaagtgtagagccaggataaaggggctgagcaggaatgtgcgttcacggtatgaaatagcgcagtcagggtaggcctcagagcaggtgagatttgagccttgcagaaggtgagagttagctgagcgcacatggaggggaggacagcaggcccacacacctggtacaactcaggcacagcccagagggaggccggtgtatccgaacagaatgtagtagtagatgaagtcagagaggttgtgggtccaattgggtaggggcttgtgggctgtggcgaggactttggcatttactctcagagaggcagaaaccatgggaggattgtgagcagaggacggacaggatgtggttggggatttaataagatcgccttgcctgctagtcatccagtggagtctggtgagtgagggcagaagcaggggccagtgaggaggaggctactgcagtaggccaggtgactggtggccagtgctggcagtggagttggtgagaaggggttggatttgagatctattttcaagatagaggtaacagggtttcctgtcagattggctgtaggggtgtgagagaaagggtaaggagctccacctctgtcctgtgaggagtcttgtggtccaccgtgtgagtggggatgatgttgacctacatagaagctgtatcatagccaaggtcctgggaagggagccagcattcagggatgggtcacaagaaggtcatggctgctggtggtccttaacgcatttaccttccccgctgcagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtcagtgacttgcccacagggaatgtgctgggagttaggaggcacgtcctgggtcctgggtcctggatcctgggtccctacctttgactgtccgtctgcttcaggtacaagcagtcagttctcggcaggggccgaccgggcaacttccccccttgtgtccctctaccctgctttggagtgccgggccctcattcagcagatgtccccctctgcctttggtaagcctcctttgtctggggggatggaggctgctaggagctgggagagactggaagaagtggcaagtcctgagaggggctttctggagcctctggccatctccccaagaaaagaagggagaggcactggaggggatttttcagatccaaggaatttgccccagaagggtctggggtctaagtggggtttcacaggcctagcagatccttctgttttgagaaaggagtgagaagggccctatgggatttctccagagccccagatgtcggcacagggtgaggagaaggcaggctgagagcgctccatcatccttttcctcttcctctcgcccagcaggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccagtactcctgctctccggtgccacctcaccttctttggcttcttccctcttgcctccttctgttctttctgctctcccctcttttccctcctcctcacttccctctggctagcccacccctgcactctctctcattgccgctgccactatcacctgtctctctgccagctgatgtgccctgttgccccccaccccatcccgcacagaaccatccctgcattccacaggggactcgggcaagggtgccgaagatagacaagaggcacacagagacagaccaactggcagccaggcagccccagaggagagagacattcagacagaggaaagtctccctgcccctcattccttccaagatgagaaaaacttgccgccaccccccgacactgatgccagggaggtgggaggaagaagtgggaaatttcccttcccagtacccccaagaacgtctgagccttcaatgttgaattttttctttattaaaattacttttatcttataaaatcaactaatcaaaaatgatatagacgacagcactggctctgtgaaggtggcatctttctgggcaggcaggccatggggcatggaggagggtgcaaagatatgggttgctgtcttctggcctccagctgcatggaggccggcccagggtctagggtgtgcactgggcaagggcagggcggcaggtgtcaggccggcttggacaatgaaaccctgaccttgctgcattccttttgcttccaccaccactagcttctttggaatcttggggtgggggtcatctttggggattatggctgccacccgggatttgagtgtagggagtgtgggagcagccttggcagatggggcacccgtgccctgcaggtgttgacaagatccgccatctgtaatgtccttggcacaataaaaccaaatgtcagttt

SEQ ID NO: 190 - DNA, 34856 bp, mus musculus; identical to SEQ ID NO: 189

SEQ ID NO: 191 - DNA, 45904 bp, mus musculus
gcccaacaaaatggcggcggcagcggtgtcgctttgtttccgcggctcctgcggcggtggcagtggtagcggcctttgagctgtggggaggttccagcagcagctacagtgacgactaagactccagtgcatttctatcgtaaccgggcgcgggggagcgcagatcggcgcccagcaatcacagaagccgacaaggcgttcaagcgaaaacatgaccgctgagcccatgaggtaaaacgcaaccccgtctcatgggccccagcggtctgggcccaggcaccgtctgagtcgggtgtttgggaaggcgttcgcttggtgggttaggcctgtgtgttgcttagccgaaagaggcatcgttttctctttaggtgagaagggtttcggggtatcggcgcaaggctccgacgggggtgggggtggggatggggtggggggaggtggggggggcgcggcctagggtatggggcgcttcttgcaatctcccctaaacggtgacgcttggtcgggctcctctgtttattctttggtgcctgtgggattgagacctcgaagtcggaggcggtctttggtatcccggtcatttttgctaatctttgggcctagaaactgcgtggggaagaagcggggggagggtgagaagagggggaggggtgggcgggcgcgaggatgtgagatcccaggacgacttagaggcgtttaggttgctggagatgggaagcacccgggccctgcgggattttttctctgcagccccaggagacaagcctttttttgattgggttgtggtgcagttccaggtatttaggtatcttttctactccatatcctgaaggatatccttgggtttatttctaggcgaggggggacttaacacagggttttgcttccagaggaccctagtatactactttttgtgatgtccagccttaatgggacctcaagtgtttccccactttctgggcaaatttcgaggagtaattaggccctatctttatttacttatttattccatgaaggatgaagggcaggttaacgtgggctgatgcgaagtaagatttattgcaagggaaaatgcctggcaggcctcctcttaaccaatcaagcacgtttattaggttgaagctgtttttctgtgtgcttctgatttgcctcttgacgggtctgaaaatttgggtagtcaatatgaaatgtatacacttttacccaggtggctggctggcgtttcagtttgacatttgaattttcatcccacaatgtgaattaagtaatttttttactcggagatgcatccttggcgtccagtggcaaaataaaattacaaggagcatgggtcagaattgcatttcaagttggcgaaatgtgcctttgagtaactcttagattggcatatgtttttagagcaatttagctagaatgtagaattgggcaatgagcctatgatacgtatgtctgtatttctgcatgaacaagcagtagattatattttctttaccttggggaaagatatgcttcagttcttagattgtagatctctagttgtgtacacgattgtggccttggtttctgaatttgtcagtaggctcaaatacaacaaatctttatctgtggggtattaggcacgtaagtggtacccagtataacttgttggcctgtaattaccaggcactcatgttcatatgcatggatggtgtaccttacagttaaattatgacctctagattttactaagtttcacaaagtctacatttgaaactatagtttgaagtcggatcttctcagtttctttagaatgaacaaattacgtatatagaatttctgaatagaataattaattttacacaagggtcagtttttcttactagtcttggatttttgtagatcttgatgataagagtaataatcataactaagttgagtgcttattgtcgttctttataatcttgatgaattctcaaacctgtgaggtaagtacttggttttgcccattttaccgatgaggaggaaagtgagacatagatcaagaacttgaccgaagttatacagcttgtaattggtggagctggaattgaaccccatcttgacttcacagcttatgttcttaaccacaaggcattaatgcccccttcagctgccaggtctaacctgattatgaccatttaaatttagcccaagtgttacaatgaaagaagttcatattacctactctgatttgttgcaggtctatgattttgtagctgtttataatgttacattttttgtgtccaggtgtactatgtagtgagataactgaaatatttaatgctaggagagtcttaagctacatgaaaaacctctagtaaagaactgcatatatgcatgtagggaattaattaaaaagtgtgacactccctgatgatttactatgaaagagctccaagtaggtgttcagaactgtctcaggctgaagtgtcatcgatctcctaaaccataatcatggttaaaggagaatctgacaggtaatgcttgagttgaacccacagtaccaaatccctcttgagtcttttctaatgtgaggcagaaataatataagcattattgttaatattattttacacagtagttccagattttctctttatcaaatattttgtcaagcacttaaaaagcaggaacaaagactagttctaatttttacttgtgtttataaaaaaaagtaatattctaggattctgtggtggaaaaatggccagaagacaagaggaaggaaaataaaccgatgacctggctaaaacatacactgactaatcagtggctcagtctttaaaggttttgttgtttttaaaggatttttttggttgtttgtgttgtttgaaataagattgacttgcttctggcattataaaagataaggtcttttataatcaccaagctctcaatgtagtacttgggtacctgggtgtcactgctgattattttttaatttttaaatttatttttttgagacagagtctcactttgttgcccaggctggagtgaaggggcgtgatcttggcttactgccgcctccgcctcccaggttcaagtgattctcatgcctcagcctcccaagtaactgggattaacaggtgtgtgccaccacgcctggctaatttttgtatttttagtagagagggagtttcaccatattggctaggctggtcctgaactcctggactcaagtgatctacctgccttggcctcccaaagtgctgggattacaggtgtgatccaccgcgcctggctctctgctggttattcagggcccaagggctcttcagttatcaggtgatgtatgctgctaggactgggaccttcccttcagggcagcagattcccttctggcccaggatgtgtctagaattgtcatcctggagctagggcctggaatggaggcttcatgactgatgaactttaatttgttttctttatttttattttttttgagatggagtctcactctgttgcccaggctggagtgcaatggcaccatcttggctcactacaacctttgcctcctgggttcaagcgattctcctgcctcagcctcccaagtagctgggattacaggcaagtgccaccacacctggccaatttttgtatttttagtagagacggggtttcaccatgttggccagccaggctggtctcaaactcctgacctcaggtgatctgcccgcctctgcctcccaaagtgctgggattacaggtgtgagccactgcgcttggccttaatttatttgcatataaagatttcagtattgggagatttggtgaaatttgtcattctaatccttatggcaattgattacttgaaaagctgacagctatattaccttgttattgatcttaaatataaaaaggcagaagttgtctaaattgagagattttgaatgtcttagaaagtatctgttaaggtggtagtttacaagcagttacattgtaacctaattgttgaaaaatgttatctgtgaaatacttgcatttccactatgaaaagcatgaaaccaggcccttggagggggaggagatgcaaattttataaaggtttttaaaaagcatttaaatatcaatggcttggttatgtaatgggttggggtgaaaagaaagacatttgtgaccttaatttttatcaggcccagttttattattggccacccttggcatagttggccttgagctttcagttatgtattgtatttctagagataagataaatgtagtacttaaaataatatttaagtattgatgtaggtgtgtgaaataattgtttcataagtaattgtatgtgtctttttcacttttggggtctgaataaacttatgggttgggtaataggatacgggcaattcttgaatttacatgaagtgctttcccccagaccgtgaatgttcttttggatatcagaaactatttaaatagttgaagccagtgaaaactgatgcatagatcttcctttagaaatgttgaatataacagggcagtgaaaggagggtctaagcagtctgtctctaattttatcctaatgcttgtcttatgatcagcttggaagctgacatgcaagatgtttaacttctatttttccatctgtaaaatgggaataagctcaaatgggagtaaatatcaatatttatcaataatagatattgataaagtctaaaggtattctgaaggaggtaacatgtttgtaacaatggttcttaaaagagaaactaaagctctggggtcctagttttttttttttttttttttttttgagacagagtctcactatgttgcccaggctggagtacagtggcacgatctcaggtcactgcaaactccgccctccgggttcacgccattctcctgcctcagcctcccgagtagccgggactacaggcacctgccaccatgtgcggctaattgtttgtatttttagtacagacagggtttcaccgtgttggccaggatggtctcgatctcctgacctcgtgatttccacccgcttcggcctccaaagtgctaggattacaggtgtgagccaccgcgcccggctgttaatttttaagagtgaaaagaggtgctgcgactaaatggtttgagaactgcttgtatagaggaatgaacactgaactgtgagccaagccttggtttttcagttatagctctgttgcttgattgtatgactgtggacaaatcatttatctgttccaggcttctgctttgtcatttgcagaacgaacaagactagatggtctgtagcattaatttttttttgggacaaggtctcactgtcacccaagctgtagtgcagtgacactgaacatggctcactgtagccttgacctcctggctcaagcaatcctcctgcttcagcctcccatgtagctgggaccacaggtgtgtcatcatgccccgctaattttttgatttttttgtagaaacagtggtctcactttgttgcccagtctggtcttgaactcctggacttaagcgatcctcctgccttggcctcccaaagtgctgggattacaggtgtaaaccaccataccctgcctaaagttagtttttaaaaaattctgcttacaggccacgtgcagtggctcacgcctgtaatcccagcactttgggaggccgaggcaggtggatcatgaggtcaggagttcaagaccagcctggccaagatggtgaaaccccatctctactaaaaatacaaaaaaaaatcatctcggtgtggtggtgggcacctgtaatctcagctactagggaggctgagacagagaattgcttgaacccaggaggcggaggttgcagtgagctgagattgcgccactgcagcctgggcgacagggtgagagtctgtctcaaaaacaaaaacaaaaacaaataagcaaaaaattctgcttatatgagtgtttatcattttctcttatctgccttttgtgggttagggagaagggtagtggtgagataaagtttctttattcagtgtatttatatctttttgccttaaaacttacatggttaggttacaggtgttttgttgctgatacttgtcatagtatcatgtatacctggttgtataaacatttattggaaaggaaaaaacatttttgttggaaagtttggtaattattgtggcttaggatatgttctattttgaaagattgctatatccagtatatttctgcccttttatgattgaagatgtacgtctgaaaatacctatgttagttctagccggttgttctttttgcgctgggaagtctttgaattttgcactgtagctgctattttcagatcctgtctctgaaactttgtctctcagttttagcttgaagtagccatttcctgtatctgtagtccagcactcttgttaactgtcccatacaatatttgttaagaaattattgttctggcagtagtattcacatgtatatatcctgcactccatattttgggggaatgctttattagttgatcaaatacttaagtatcaatttggggccaggcatggcactgtgttagggttatgccaaaggtaataaaattcctgccatcttaaggcattcttagtcaagtgagggagattggtaagtaaatgagcaattagaaagcagtgctaaaatatggaaatatattgattgcgctagggatcagaaatgaaagaaagcctaatttgggggatgtctaggaaagttttgcaaaggagatgttaactgtattgagtcttgaatgagttagcagttaagggttgactgtgagagggcagtccagacagctattagtatggttaaagattagtcttattttccatatatcagaggaaataagacatgtacacgattagttttggtgcaagatataaagtgataaatgctgcatgaagtaaaagtaagttgttgtgtgagttcaaagtagaaagacatttctggtggggaccaaggaaagctttatagagagatagcatttgagccgggcgccgtggctcacacctgtaatcctagcactttgggaggctgaggcgggtggatcacgaggtcaggagatcgagaccatcctggctaacatggtgaaaacccgtctctactaaaaatacaaaaaaaaaaaaaaaaaaaaaaaaatccgggcatggtggcgggcgcctgtagtgccagctgctcgggaagttgaggcaggagaacttcgtgaacctgggaggcggagcttgcagtgggccgagatcgcgccactgcactctagtctgggcaacagagcgagactccgtttcaaaaaaaagaaaaaagagagatagcatttgaatctagtccttggaatataggtacagttttgacaaaggagactgtgggagaattccagatgtgaggagtagcagcttgagcaaaggaatgttgtgtatattagcattttctatttggaagaaggtcaacatcgaattttaaacttaatttctggacaaatactgtataactattgtgcctttttttttttttttgagacgtagtctcgctctgtcacccaggctggagtgcagtggcatgatcttggctcactgcaacctccgcttcccgggttcaagcgattctcctgcctcagcttcccgagtagcttggactacaggcgtgtgccaccatgcctagctaatttttgtatttttagtagagatgggatttcaccgtgttggccaggatggtcttgatctcctgacctcatgatccgcccgccttggcctcccaaagtgctgggattacaggcgtgagccaccgcgccctgcctattgtgcttttttttttttttttaagagacagggacttcctctgtcacccagcctggagtgcagtggggtgatcatagctcatagcttactgcatcctagaactcccgggctcaagtgatcctcccacctgagcctcctgagtagctgggaccacaggcatgtgccactatgcccagctactattgtgcattttgtatggtagcttttgtggcttgatgatcttgtaaaaggtacatgtgcctttgtgaatgggcctgataattttagttcagaattgtcaaaagtattatctacttttttttttttttttgagacagagtctcactctgtcacccgggctcagtggcaccatctcagcttactgcaacctccacctcctgggttcaagcgattcttctgcctcagcctccgagtagctgggactacaggtgtgagccaccatgcctggctagtttttgtatttttagtagagacggggtgtcaccatattggccaggctggtctcgaactcctagacctcgtgatctgcccacctcggcctcccaaagtgctgggattacaggcatgagccaccgcgcctggccagtattacctacttttaaataagattgtgtaggatttaatgcacagattttgaatcactgtgataaaaatgcatccttagttgtcttcattttgctcatttgaagtgctcagttgacttttgggtgggtaacatttgacttatagaatctaagataaaaaattatttctgagtaatactggatttgttattttgcttatttggattatattagttattttttggtttatttgatagcattccagatttagttttgctataatgcttgttttgaaaatgtggattttttccaaaagggttgatatttcagggaacaatttgaagcatacgacaaaatttgcatttgcttatgggggattttgtctgcagggtcagggatcagcatactgtggcctaccaaccagtggcctgttttttgtaaataaagttctttttttttgtttttgatctttgttttgttttgttttgttttgttgagacggagtcttgctctgtcgcccaggctggagtgcggtggtgtgatgtccgctcactgcaacctccgcctcttgggttcaagcgattctcatgcctcagcctcacgagtaggtgggatttcaggcatttgccaccacgcctggctgatttttgtattttttttttttttttttttttttttttttttagtagagacagggttttaccacattggcctggctggtcttgaactcctgacctcaggtgatccgcctgccttggcctcccaaagtgcagggattatagatgtgagccatgtaaataaagttctattggaatacacctatgtccatttatttacattgtctgtggctgcttttgcactgtagttgcagagttgaatagctgcagcagagacctagtagcccacaaagcctaaaatgtttactgtctggccctgtattgaaagagtttgctgattattgtgctagatgaatgcaggatactacacccctctaaaaagagctgcatagaaatacatgcatatagatgcacacacgtctgacatctaccagctacctcatttcaccacttgggttataaaccacacatatttacatctgttgtacaattttcaatccgatttcagataaccttccttctaccacttcacaataattcatgagctgcaacccttttgatgcccacttcacaagcaaacttcaggtctttttcaaagtaaagtgccacatttattgttatatttgagcatttattatttaacatgtcaaactgtgctaccatttttctttggtttctttgttttaaaaaaagtcactgatgaaatttttgaatgttgtgcttctaacctcatttttcctatgagttctatggtgttaattgcacaattttacatagtttggtggtttttaggaacccatatgttacattattgaggaactgactaattatcatcctgtaaaaagtactaattcattcaccaaacatttctggggtgatgtaaatattaagtgagttaaatgggcataaagcacttatgtctttattgttactcaaatattagttattactgattactattaccatgtgtcaggaactgtaataagtagtgcattgatgaacaagacagataagggacctgtctccatgaagcttacattgtatttttaaaaatctattaatatacattttggctagtaaccgagcccttgccccacagaaaagttgtgctgttacacaaaataatattttaagatccatccacaagtcaaagacatttcacttaaaacagctttctcagcagtgtctccttgatagggtataatattttattgaattattgtttttggctgggtgcagtggctcatgcctgtaatcccaccactttgggtggccaaggcaggtggttctcctgaggtcaggagttcaagaccagcctggccaacatggtgaaaccccgtctctactaaaaatacaaaaattagccgggcgtggtggcgcatgcctgtaatcccagctactcaggaggctgaggcaaaattgcttgaagccgggaggcagaggttggagtgagccgagatatcaccaccgcactccggcctgggcgacagaatgagattccgtttcaaaaataaataaataaataaataaataaataaataaataaagaattattgtttttaatttttgtttttttctgagataggctgttactctgtcactcaggctggagtgcattggtgcagtcatggctcactgcagcctccgcctccctggttgcaggtgatactcccacctcagcctcccgaatatctgggactataggtgcatgccaccatgctgagttaatttttgtatttttttgtggagatgagtttttgccatgttgcccaggctggtatcgaactcctggactcaagctatctgccctctttggcctcccaaagtgctgggattataggcatgagccaccaaacctggccatgtgattgtttttttgtaactgtaacctcaggagatgaatccgatctatctttagggagataaagagtaatcatcccttcctttttttactgtataaaaggttacaaaatataatttcagacttgtagaaaatttgtaaaaatagcacaaagattctcagatgtgcttcatccagatgcagcaaggggtaacattttaccatgtttactttatcatcctctattattatttttctgaattgtttcagagtaaattgcagacatgatgtccctttactcccaaatactttaatacatatttctcgaaactaggaatagtctgttacatgatcccagtatagttagcaaaattaaaaattagcattaaggctgagtgcggcctcccacacctgttatcccagcactttgggaggctgaggtgggaggattgtttgaggccaggaattcaagaccagtcttctcaacatagaccctgtctctacaaaacaaacaaacaaacaaacaaacaaacaaacaaaagtactaaattagccggtgtggagcatgcctggagtcccagctactcagaaagctagagtcaggaggatcacttgagcctagaagttccaggctgccatgaactatgatcatgccactgcagtctagtgtgaatgacagagtgagacccccatctcttaaaataaaagagagattagcattgatacaataccatttttttttttttgagacagagtctcacactgtcgcccaggctggagtgcggtggcgcgatcttggctcactgcaagctccgcctgctgggttcacgccattctcctgcctcagcctcccgagtagctgggtctacaggttcccgccatcacgcccagctaattttttgtatttttagtcgagacgggttttcaccgtgttagccaggatggtctcgatctcctgacctcatgatccgcctgcctcggcctcccaaagtgctgggattacaggcgtgagccactgcacccggccgatacaataccatttttaatctacagaccttattcacattttaccaattgcttcatgacatccttcatgatgaaagacaaaaagttcttgttttctgatctaccatctaattctagaacactcattatatttcattgtcatctggaacagctcaccttgccatttttttttttttgagacagttttgctcttgttgcccaggctggagtgcaatggcatagtcttggctcactgcaacctccatctcccaggttcaagtgattctcctacctcagccacccgagtaactgggactacagacatgccccaccacgcacggctaattttgtatttttagtagagatggggttgcaccatattggtcaggctggtcttgaactcctgacctcaggtggtctgcccgcctcggactcccaaagtgctgggattacagatgtgagccactgcgcccggcctcttctccatttttaaaagaacacaggccagttgatttgaatttgtctgatgtttccctttgattatatattttggtaggaacactatgaagtgatgttttgtccttcacagcacattttatcaggaggtgtataatgcctttgcttttactatgttttagaatgattttgctttgtttttttttttctgagacagagtcttgctctgtcgcccaggctggtgtgcagacgtgcgatctcggctcactgcagcctccgcctcctgggtccaggcgattctcctgcctcagcctcctgagtagctgggactacaggcgtgcaccaccatgcccagctaatttttatatttttagtagagacggggtttcactgtgttgatcaggatggtctcgatatcctgacttcgtgatccgcccgccttggcctttcaaagtgctgggattacaggcgtgagccatcgtgcctggccgattttgcttctcatgctaaaattattaatcagctcattctctgccattttatttagaggtttgaagtttggcttgattaatttctacagaattggggagagttttcccacctcccatttttcttgctttttccatttcctccttcctcagatacccccaaagttcaaaaccaaccaccccgattatgaattttcattttgtattctgaacatatagctaaaagcagagaattaagggtgaatgtttcatgttaaagtgattggacctgttgttaagcatatgaaataatatatttccttcaaaggctgactatactatagtgcatccaacatagcttgttgaatatctcagttctttttttttttttttttttttttttagctgaaatttgccacagggaaatatctctccagcctgggcaacatagtgagactctgtctcaaaaaaaaaaaaaaaattagccaggtgtggtggtgcacaactgtagtcctaaatacttgggaggctgaggagggaggatcctttgagcacaggagtctgaggctgcagtgagctatgattataccactgtactctagcctgggagacagagcaagaccccgtctctcaaaaaaaaaaaaaaattggtggtgaaatacacataccacaagatttagcattttaaccattaaaaaagtttgtttttggctgggtgtggtgactcacgcctttgggagtgatcccagcactttgggaggccgaggcggatggatcacgaggtcaagagatggagaccatcctgtccaaaatggtgaaaccctgtctctactaaaaatacaaaaaaaaaaactagctgggcatggtggtgtatgcctgaagtcccagctactcgggaggctgaggcaggagaattgcttgaacccagggggcagaggttgcagtgagccgagatggcgccactgcccgccagcctggagacagaacgagactctgtctcaaaaaaaagcttttttttttttttttttgagagaagggatctcgctatgtttcccaggctggtctcaaacttctggcctcaagcaatccttctgcttcggcctcccaaagtactgggattacaagagtgagccactgtacctggcctcatttttctattttgataaacacttttttttttttttttgagacggattcttgctgtgttgcccaggctggagtgcagtggcatgatcttggctcactgcacctctgcctcccgggttctctgcctcccgggttcaagcaattctgcctcagcctcctgagtagccgggactacaggcgtatgccaccgtgcccagctaattttttttgtagttttagtagagacgggttttccccatgttggtcaggatggtctcgaactcctgacctcaggtgatccgcccgcctcggcctcccacagtgctgggattacaggcgtgagccaccatgcctggctgataaacacttttaaggcttaacatgagctaagtattattttagaacagattgtctcaaccttggcactatagacattttgtccagaaaattttttgttagaggctgtcctgtgaatgcattttatccctgacctctacccactagataccagtaacacccctaccctgagttgtgacaagcaaaaatatttccagaaattgccagatgttccctgtgggcggtatgggtttgagaaccacttttctagataataggcatttgtagataatgaatactgagctaagtggaggagtaaatggttgaaatagactatgtggttaagtacagttacagagatataaaccaagagatgtggaagaatagcaaaaaatttccttagagagttgatagcaagtattttcccaagagagacagcaattctgagttgggtcattggggatggtggggggaaatgtgctgaggagggggaaatattctaggtggtggaacgggttatgtctagagatacggtagaggagcccttgggtgccttgagaaaaatgagataataagtatgattggagagaatatgggaggtagaattggaaagaaggatgctagttggggtcaggtttgagaaaggcttttttttttttttgagacggagtcttgccctgtcacccaggctggagtgcagtgcctcactcggctcactgcaacctccgccttctgggtttaagtgattcttctgcctcagcctcttgagtagctggcattacaggtgcgtgccaccacttccggctaattttgtatttttagtagagaccgggtttcaccatgttggccagactagtctcagaactcctgaccttgtgatccgccagcctcggcctcccaaagtgctgggattacaggcatgaaccaccacgcccggccgagaaaggctttttatgctatgctaaaatgtttcattttccccctttcattatagaaaatcaacaaatacttttaaagtctgtagagttatatgatcagctttttaaaagaatagtgatacagtgaaatggtaaaaatggtcaatggtgaatattaaactcaagaagataactctagcctgtaaagtaggaaaataggaagggatggagatttatataaaactaaaactagatgtcatatgttgcccttaaatcacatcaccctgtgtgtagacttcttcatcctcatttgtcaaaattctgacatattgtcaatactgatgaagattcttgatattcaaagcaggagtgaagtgggcaaaaatctgtattctaattttcattaccctaataatgtccttttaatttggagcagttctgtggcctctctttgtctgtcctgatcttgacatttttgaagagtatagaacaattattttttagaatgtatctctatttgggtttgtgtgatgcttctttatgattagatgaagggtatgcatttttggaagaaataacagaagtgatggtatgttgttttcagtgcctctgtaacaggagatgcatgacattggttggtcccattactgatgatggtaattttaatcacttgggtggtttccagtagatttttctatgtaaagtttatcatttttggccgggcatggtggctcacgcctgtaatgccagcactttgggaggctgaggcaagcagattacttgaggtcaggagtttgagaccagtctgaccaatgtggtgaaaccccatctctaaaaaaatacataaattagccaggcatggtggcatgcgtctgtaatcccagctgctcaggaggctgaggcaggagaatcacttgaaccctggaggtggaggttgcagtgagccgagattgtgccactgcacttcagcctgggtgacagagtgagactccgtgtcaaaaaaaaaaaaaagtttatcatttcccatttttattttgaaacagtcttgctctgttgcctaggctggagtgcattggcacaatctcagctcactgcagcctcaacctcctgggctcaagtgatcctcccacctcagtctcctcagtagcgtgttccaccacacccggctgctttttgtattttttggtagaggtggagtttcaccatgttgctcaggctggtctggaacccctgagctcaagggcactgatcacctcagcctcccaaagtgttgggattacaggtgtgagccaccacgcctggccctgaaaaatatttttaacggttacattatcatggagaattggatggtataaaacaatagcagttctcatatttgaaaataaattgatgtaatgaaacaaatgagaggatcaaataatattgtaaaaagaataaaaacccacatatggacaggtctgtggaaattgtattaaagactacctctcccagattgtttccgtttgttgcaatccatttaagaacagtttttgggctgggcacggtggctcacgcctgtcatcccagcactttgggaggcccaggcaggtgtatcatgaggtcagatttcaagaccagcctggccaacatggtgaaaccctgtctctactaaaaatataaaaattagctgggcatggtggcatgcacttgtaatcccaggtactcgggaggctgaggcaggagaattgcttgaaccaggactcgggaggtggaggttgcagtgagccaagatagcaccactgcactccagcctggcctgggctacagggtgagactcagtctcaaaaaaaaaaaaaacaaacaaaaaacagtttgtgggaaaaaacaatccttgtgtatgacataatttgctgcttttcccatttagaaaatttaaaaaatacttatttgagatggggtctcactatgttgtccaggctagggtgcagtggctattcacaggtgtgaacatagtacactacagcctcgtactcctggccttagcatcttgagtagctgggactgcaggtgcacatcacagtgcctcgcttactttttccatttttgtctgttgatcctctctctcttcctttggggtaaaaattgtggcttgtgatggtggtttgtggggaaagaaaaagttggtaagctacaagctctgagcctttaatgtgtttttgttaaccatgcagacagacattagatacatagatacaacatagatgagttaaatttgaaagaaggcaccaaactttgttactttaaagcaggatttctcaaagggacactgttgacattgatttcagaagtgagattttcatggtttttaatgttattattataatggtatggatagtgttttgccctctaagaagtagctaggagtgtttccatagatgcatttagtttatatcacttatgtattctgtctctattttgtaagaaaattgcctatgaacagaattttttctgtatgtggatttaatgtcttcttctaaaggaaacatgggtgtggttcacatttccttagttttgagtagcatggcttaagttgtgatccaattttaaaaaatcagttgaataaataaatagaaaataaaaggataatttctgtactaaaaaagtcagctggacagttaaaacatctccttttattcgtaagtttttcaataaaaattgttaaaagcagtattcatttgtgtaatgatataatctttgttattgttttatgtgcttttctaaaatgcaggaaacataaggtaaggagaagtctttccttaccctgggaccagatgtctatgaggactgttgacttttctgctataaacaggatgataaattaacagtggtgtgataggtaaagtagatttgttatgacatatcttccattaagcgataataacttgatttttacttagttgatgaaataaaataactttgaaaccttgggtaacatgaaattgaatcaaaatattttcaagttatggaacatagtgttattaatagaatggagtgttgaaaaagcactggattatgctttctgtaacttttagttctgggtcttatgataactgtgaccctgagcctcagtgttttccttttaatctgtagtgatattttttagttcagtctctcattttaaactgcttttagctctaaaattttatctcagtgacctgttgagttatataacaatcgtatcaggtaacctagataagaagaggaaggcagtaacatttcagaaatacagtttggggttgggaatccttaagtgatccagacttctcctttggtccgaagatagtgtgaataaaacagctgagggatgtgggcatcaatatattgcagaggaaaaggttatttccaggagtggatttgcagctactcttaaatctattatgttggggctgggcactggggctcatggctgtaatcccagcactttgggaggctgaggcgggcggatcacctgaggtcaggagttcaagaccagcctggccaacgtggtgaaaccctgtctctacaaaaatacaaaattttgccgagcatgatggcgggtgcctataattccagctacttgggaggctgaggtgagagaattgcttgaacccaggagtcggaggttgcagtgagctgagattgtgccattgcactcctgcctgggtgacagagcgagactctgtctcaaaaagaaaaaaaaaatctattatgttggatagatggtcttttccagaagcaaattttatagatggaaagcattttaattaatctagtaaaattctctcattttacaaatgaggctccctctacctctctccccctctccccctctccctctctccctctctccctctctccctctccccacggtctccctctccctctctttccacggtctccctctgatgccgagccgaagctggactgtactgctgccatctcggctcactgcaacctccctgcctgattctcctgcctcagcctgccgagtgcctgcgattgcaggcgcgcgccaccacacctgactggttttcgtatttttttggtggagatggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctcgctacaacctcacctcccagccacctgccttggcctcccaaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctctgcccggccgccatcccatctaggaagtgaggagcgccttttcccggccgccatcccatctaggaagtgaggagcgtctctgcccggccgctcatcgtctgagatgtggggagcgcctctgccccgccgccccgtctgggatgtgaggagcgcctctgcccggctgcgaccccgtctgggaggtgaggagcgtctctgcctggccgccccgtctgagaagtgaggagaccctctgcgtggcaaccgcctcgtctgagaattgaggagcccctccgcctggcagccgccccgtctgagaagtgaggagcccctctgccccgctgccaccccgtctgggaagtgaggagcgtctccgcccggcagccaccccgtccaggagggaggtgggggggtcagccccccgcccggccagccgccccgtcggggaggtgaggggcgcctctgcccggccgcccctgctgggaagtgaggagcccctctgcccggccaccaccccgtctgggaggtgtgcccagcggctcattgagaacgggccatgatgacagtggcggttttgtggaatagaaaggggggaaaggtggggaaaagattgagaaatcggatggttgccgtgtctgtgtagaaagaggtagacatgggagacttcattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagaatcatcaccactccctaatctcaagtacccagggacacaaacactgtggaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaataaaaataaaaataaaaaaaattaaaaaaaaatgagaaaattgagctctcctgaggttgcagtttgcttaacagcatagatctaattagtaattaggactagaaccaaggttatctgactcccagttcaaggttcttggtacagtaccgtgtttttaactagtccattaggttgttttctgtgtattttataacacttctgtaagaaagtggaatatttttctctaaggtatgttaaaactcttgttcgagaaaatacagtaaaggatacctgttgtatcttaaagtgatttttatgtttttctgtcaatgccacaatctgaagaaagtaaattagctacacttctattgctgtgacaatagattatttagaatcttcttgattacttgtattattgttcccgtgcttcagagctgtttccttgctatttaaaatcattatggtatagcccagaggctaagggggttttctaagagtatgcaatttgtcattgacatagtttttttgtttgtttttgtttgttttgtttgtttttgagacagagtttttgctctgttgcccaggctggagtgcaatggtgtgatctcggctcactgcaacctccacctcctgggttaaagcaattctcctgcctcagcctcccgagtagctgggattacaggcacccaccaccacacctgactaatttttgtagaggcagggtttcaccatgtcggcgaggctggtcttgaactcttgacctcatgtgatccacctgcctcggcctgtgaggattacaggcatgagccaccgcaccctgccaacacagttgtttttgattggaaaagtttattttcctaatctcaaagtagcttgtatctgttctttattgtgaaatgcagtttctacattgaatttgtgtagtctgtagttttgactgttttaagttcaataactagcttagtagtatacttgttagaggtcagagtaggttaactactagaaagaacagtccttctgcttactgtactaggaggaagtctgtggtggagggaaaaaaggagtaaaacaattccagtcttctgtaaaatttgagtaatttctttctctactccttctacatgaaaaatacatcttatttgatttttgcatcacatgccttctatatgtgttggaatctggatcaccatttcttcattacttgtgggtttttgttgtgaaaaatgtggagtaagttagaagttgactgtagaataggtaacattctcttaaattctttgatcagagtgagcagagtccagaagcttggctcagacttagggaactcatgacacttctcttaatatcctaagttcatgacatgtctcttaataccctaagtgtacaatacaatagtagatcaaggaaggcagaggtatctggcagacttagaagtaactgttcataaaaacaaggatcagtatgtttctacaagataatgatttaaagttgagccaggattagttatacctttaatataaaaaattgaaatagcttatttaatctgttctaggctatagtatacggagctaggtattaaaacattctctatatatttaactcttttttttgagacagggtctcactctgtctcccaggctagagtacagtggcatgatcttggatcactgcagcctagacctcctgggcacaagtgattctcccaccttagcctccacagtagctgggactacaggcctttgccaccacacctggctcatttttgtattttttgttgagacggggtttcaccttgttgcccaggctggtcttaaacccctaagctcaagtgatccgcttgcctcagcctcccaaagtgctgggattacaggtgtgcaccactgcgcccaggctatttgacttttttattctgtaaaattgcaagcatattcagaaataagaaaatagtataacggggccgggtgtggtggctcacgcctgtaatcccagcactttgggaggctgaggcaggtagatcacgaggtcaggagttcgagaccagcctggccaacatggtgaaaccccgtctctactaaaaatacaaaaattagccaggcgtggtggtgggcgcctgtaatcctagctactcgggaggccgaggcaggagaatttcttgaaccagggaggcggaggttgcagtgagccgagatcgtgccactgcactccagcctgggtgacagagcaagactcattttttttttttttttttttaaaaaaaagaaaaaagaaaatagtataatgggttgggcccggtggctcacgcctgtaatccagcactttgggaggccaaggtgggcggatcacctgaggtcaggagttcaagaccagcctggccaacatggtgaactcttgtttctactaaaaacacaaaaattagctgggcatggtggcaggcacctgtaatcccagctacttgggaggctgagttaggagactcacttgaacctgggaggtggaggtttcagtgagccaagattgtgccattgcagtccagcctgggcaacaagagcgagactccatcccaaaaaaaacaaaaaacaaaagacaactatatatatatatataaaataacgaaaccccctaagtacctgtcacccagcttcaacaattatcatcttgcagttagttgaatttggttaacacttacccttcagtggattattctagactaaatttccaaacataatcatattgtattgaagtgttttttgaacaaactatactatggggtatttacctaaaatgaactatttgcaaaaagataagttgattttttttcttctggtgccagtacacatcataattgtagttaaaagctattatcctcacattaaagtttaatttttaacacattatgaaaatttaaaacttacagcaaagctttaaaaattttacactgaacaccaatattattaacatctagattctacctttaacattttactcttcttttttttttactcttcttgttttatcacatattgatccatctgtccaactctccattgatgtaacatttcattttattttcttattcatttcaaagtaaattacagatattagtatagttgaggttcagtttttaaagtcatattttcaactaattgtttttcctgttttgaaagactgttatatctgaagttccacattatgacaactcatagtctctatggttccagtgcttcccattttgaacttttctttcatgttctacgaacctttattaaaatatttagagctatgtacaagtaatatatacagtatttagctaaaactaagtagaatgaatgagggttttgcttgtgtgtttattgcagtctttaaaaaaaatctcttctagtgagtcaatgtgtatcttttttttttttttttttttttttgagacagagtcttgctctgtcgcccaggctggagtgcagtggcgtgatctctgctcactgcaaagctccacctcccggattcatgccattctcctgcctcagcctcccgagtagctgcgactacaggcgcctgccaccacgcctggctaattttttttgtattttttgtagagatggggtttcattatgttagccaggatggtcttgatctcctgacctcgtgatctgcccgcctcggcctcccaaaatgctgggattacaggcatgagccaccgcgcctggccaagtcattgcgtatcttaagatggtacactaaactaatatgcttgccattggtgacaacatagatgaacctggaggacattatggcaagtgaagttagccagacgtggaaaaaataatacttcatgacttcaacctatatgtggaatctaagaatgccaagtctgcaaaagaagagagtagaaaagtagttaaatgggtaggaaggtgggagaaatggggagatattggttaaaggttaccaagttggaatcacgtaggatgactaggtctagagatctaatgtacagcatgaacactatagttaataatactgtatcatgtactggaaagttgttaaaagagtagatttcaggtgttttcagcacacacagaaaaagataactatatgtggagatgggacattttgcttgaccatagtaatcatttcactatgtatatgtatatcaaaacattcatgttgtacactttattgattgattgattgagacagggtctctcgctgttgcctcagctggagtgcagaggcatgatcacagttcactgcctgcttgacctcccaggctcaagcgatcatcccacctcagccccccaagtagctgggactacaggtgtatgctaccatgcctggctaatttttatagtttttgtagagatgggttttgccgtgttgcccgggctggtattgaactcctgagctcaagcaatctgcccgcctctgcctcccaaagtgctaggattacagatatgagccactgcgcctggccataccctttaaatatatacataaaaagaagaatgcctttaaaaattttccatttaacaattactctcagggccaaaactcactgtttaagtattttgctcttttactttgatcttggtgttctatgtagtgctaaaatatactttcatctccatatgactgcttgtaacaaaaagctgttcaccacattatgaactccctgaatacacacaataatcatatagtaaatgcttgttgaataaacaagacaaaattcatcagtttttatccttacttaattttttgaacttttccttgaacttctgttatcaaacttaatacatgaacaacagaaagatgctacggatctatgtagtacaaagtaaaatatgaaatttacacactaaatatttctgtagcatattttcagaagtaagtaattgaatataaacagaagcaagcatattctatttttttattatttaagtgggaaatattttaaaatcttatgtcatatttgctttagatttcttttaaagaattaaaacattacagatagagttgaagcctcatgggttattttaatgttttctacataaacatgtttccatatacataaaccttatttagaattttttcagtttatttatttatttttattattatactttaagttttagggtacatgtgcacattgtgcaggttacatacgtatacatgtgccatgctggtgtgctgcacccactaacttgtcatctagcattaggtatatctcccaaagctatccctcccccctcccccctccccccaccccacaacagtccccagagtgtgatgttccccttcctgtgtccatgtgatctcattgttcagttcccacctatgaatgagaatatgtggtgtttggttttttgttcttgcgatagtttactgagaatgaaattttttcagttttatacgtttatgtaagtggcaccatacagtacatattattttgcaacttgccttttttttttttgtttgtttgctcaatgttgtttttaggattttgatgtaactccagatctgcactgtccaatacaatagccactaactatctgtggctattgagtactggaaatgtagctagtccacattgagatgtgctagaaatatatttgtacatggaatttcaaatatttagtattaaaaacatgtaaaatatctcactaaaagtttagtatccctaagaatctgaaatagaaaatgctccaaaacccaaaattttttgattactgacatgactctcaaaggaaatgctcaaaggtttaatgcaaatattccaaaatctgaaaaaatctgatatattgaccacatatggaactgataatagtttggatgtattggattaaataaaatgtaaaaattttaccagtggtttccttttttaaaatatggctactagaaaatttaaatatatatttgaaatgccttacattatatgtctgttgggcagcactgatctatattgcccacttttcattcctgtttatttattattattttatttttatttttattttttgagacagagtctcgctgggtcgcccaggctggagtgcagtggtgctatctttgctcactgcagctgctgcctcccaggtccaagcaattctcttgccttggcctcccaagcagctgcgattacagctgtgcaccaccacacttggctaatttttgtatttttagtagagacggggtttctctgtgttggccaggctggtctcgaactcctgacctcaagtgatccacctgccttggcctcccaaagtgctgggattacaggtgtgagtcactgctcccagccttcactcctgtttagtattaagttatatagataatagtttgctactggtggatagttgttgttttttttttttacgaatttggtgctactaaagactgttctcatgagcattcttaaacatgtctcctttgcacatatgctagagtttctttctccctaatggttcttctgatttatacttccactggcagtttgagaatgttcttgttctgcagttcttcatcctggtcgatgtttttgtgtagataactgtaatttaatacttaaagtcaaaagcataaggaagcattggtaattatttaagtgaatataaaatgtcagcttatttttctcagtgaatcttttgtaatagtcaactcacattgcctattttttattgtagtgcttctgatctgaataaataaatttaaaatttaacagccatgttatgtatcttattagtaggcagctgcagttatgcaaccaaagaatgtcccatctttaagttccattagcttgaaaaagaaatggcagctttacgtcatggaatactgtgctgccactaaaaatgatgttttagaagaatatttaatgatgcagaaaaatattcacagtatcttaatggaaagaaaagattataaagcagtaaccatttcgttttgttaaaatcaggtctatgttagctttttttttttgagatggaatctcgctctgtcacccaggctaaagtgcagtggcgtgatctcggctcactgcaacctccgcctcctgggttcaagtgatgctcctgcctcagcctccctagtagctgggattacaggagcatgccaccacacccggctaatttttttgtatttttagtagagatggggtttcaccatgttggccaggctggtcttgaactcctgacctcaagtgatccacccgccttggcctcccaaagtgctgggattacaggtgtgagccaccgtgcccggcgagcatttccttacatgcttatctctggatggtcagattgtaggtaacttctattttgcacttcacactttttttttttttcttgagatggagtttcgctcttgttgcccaggctagagtgcaatggcgtcatcttggcccactgcaaactccgtgtcccgggttcaagcgattctcctgcctcagcttccagagtagctgggattacaggcgcccgccaccacacctgcctaatttttagtatttttagtagagacagaggttcaccatgttggccaggctggtctcgaactcctgacctcaagtgatccactcgcctcggcctcccaaagtgctgggattacaggcgtgagccaccgtgcccagcctgtacttcacacttttaatatttcattttctgtagtggatttactattaccagggaaggggaatgcaaggaggagggaagagttcttaacctaaaattttcatagttggaatattattataggaaagaagagattgaatgaggtgtcactgttcccatgtttaaagataagtcaattgggaggccgaggcaggtgaatcacgaggtcaggagttcaagaccagcctggccaatatggagaaaccccatctctactaaaaatacaaaaattagctgagcgtggtggcaggggcctgtaatcccagctactcgggaggctgagggaggagaatggcttgaacccagagggtggaggttgcagtgagctgagatcgtgccactgcactccagcctgggcgacagagtgagactttgtctccaaaaaaaaaaaaaaagataatactttccttctattcaatttcaggcttttcttaagttacaaatggaaccagccaaactatgttattgcttacccattgtttttccagcgttagaggagtttttcaaagaatattttttgatttagagattattttatttattatctatttagagattattcatcatttagagattgccatttaatttcagtaagagttccatttgcatctgatattttttagtttcggagaaaggaaatggtggagaaatggattcatctccaatcctttggaataaaattcagacagtttaagctctagtctcaacttgatttaatttggaattgcatgatgtggtgtcagatttgggttcacatccagttctcttgctgtgtaaccttgggaaatttacccagcatctgagttgtttcttcatgtgtgcagtggagacaataccaagatgaagatttcatgagatgtctagtgtagacatctatttttcagagtggatgcatttaacagttggatgctgaatttataagagtatggatttcataaaaagagcataaatttcatgatatgatgtatatatcaaaagatataggtcgggtgcagtggttcatgcctgtagtcccagcactttgggaagttgaagcggatggatcacttgatgccaggagttcgagaccagcctggccaacatggtgaaacttcgtctctactaaaaatacaaaaattagccaggcgtggtggtgtgtgcctgtaatcccagctacttgggaggctgaggcaggagaattgcttgaacccaggaggcagtggttgcagtgagccgattttgtgccactgcactccagcctgagtgacagattgagactccatcttaaaaaaaaaaaaatgatggctgaataggaacagctctggtctgcagctcccagtgagaccaaaatgtagaaggcgggggatttcttcatttccaactgaggtacccagttcatctcattgggactggttaggcagtgggtgcagcccatggagggtagcagaagcagggtggggcgtcgcctctcccggaagtgcaaggagcgagagatctcccttccccaagccaaaggaacccgtgagtctatgctatccggcacagatactacacttttcccatgatttttgcagtccgcagacccggagattccttagtgtgccaactccaccagccctgggtttcaagcacaaaactgggcatctgggcagacagtgagctagctgcaggagttttttttttttccccctcttcataccccagtggtgcctggaaccccagtgagatagacccattcactcccctggaaagggggctgaagccagggagctaggtggtcttgcttagcgggtcccactcccacagaacccagcaagctaagaaccactggcttgaaattctcattgccaacacagcagtctgaagctgacctgtgaagattgagcttggtgaggggaggggcgtctgccattactgaggcttgagtaggcagttttcccctgacagcactaaggaggctgggaagttcagactgggcagaactcaccacagcgtggcaaagtggctatggccagactgcgtctctagattcttcctctctgggcagggcatctctgaaagaaaggcagcagccccagtcaggggcttatagataaaactcacatcttcctgggacagataacctgtgggaaggtgcagctgtgggcgcagcttcagcagacttaaatgttcctgcctgctaggtctgaagaaagcagtggatcctgacaaggaggattctcctagcacagcacttgagctctgctaggggacagactgcctcctcaagcgggtccctgaccccagtgcctcctgactgggagagacctcccagcaggggttgacagacacgtcacacaggagagctcccgtgggcatcaggctggtgcccttctgggacgaagctcccagaggaaggagcaggcagcaatatttgctgttctccagcctccgctggtgatacccaggcaaacagggtcaggagtggacctttagcaaattgcagcagacctgcataagaggggcctgttagatgaaaaactaacaaatagaaagcaataatatcaacatcaacaaaaaggacccccacacaaaaaccccatcaaaaggtcatcagcctcaaagatcaaaggtagataaatccacgaagatgaggaaaacccagtgcaaaaatgctggaaattccaaaaacccgaatgcctcttctccttcaaatgaacacagctcctctctagcaaggccgcaaaactggacggagaatgagtttgacgaattgacagaactaggcttcagaaggtgggtaataacaaactcctctgagctaaaggagcatgttctaatccaatggaaggaagccaaggaacttgataaaaggttacaagaactgctaactagaataaccagtttagaggacataaatgacctgatggagctgaaaaacacagcacaagaacttcgtgaagcatacacatgtatcaatagtcaaatcgctgaagcggaaaaaaggatatcagatattgaagatgaacttactgaaataaggcatgaagacaagattagagaaaaaaggttgaaaaggaacaaacaaagcctctgaaaaaatatgggactatgtgaaaagaccaaacctatgattgattggggtccctgaaagtgatggggagaatggaaccaagttggaaaacacacttcagggtattatccaggagaacttccacagcctaccaagacaggccaacgttcaaatcaggaaatacagagaacaccacaaagatactccttgagaagaccaaccccaagacacataatcgtcagattctccaaggttgaaatgaaggaaaaaatgttaagggcagccagagagaaaggtcgggttacccacaaagggaagctcccagaggaaggatatctgggcagaaaccctacaagccagaagagagtgggggccaatagtcaacattcttaaagaaaaaacttttcaacccagaatttcacatccagccaaactaagcttcgtaagcgaaggaggaataaaatcctttacggacaatcaaatgctaagagattttgtcaccactagacctgccttataagagctcccgaaggaagcactaaatacagaaaggaaaaactggtactagccactgcaaaaacattccaaattgtaaagaccatcgacactataaagaaactgcatcaactaacggtcagaataaccagctagcatcataatgacaggatcaaattcacacataataatatgaaccttaaatgtaaaagggctaaatgccccaattaaaaggcacagactggcaaattggataaagagtcaagacccattggtgtgctgtattcagaagacccatctgatgtgcaaagacacacataggctcaaaataaagggttggaggaatattaaccaagcaaatggaaaaaacaaaaaaaaaaggggtgttgtaatcctagtctctgataaaacagactttaaaccaacaaagttcaaaaaaggacaaagaagggcattacataatggttaagggatcgatgcaacaagaagagctattttaaatgtatatgcttccaatacaggagcacccagattcataaagcaagttcttagagacctacaaagagacttagattcccacacaataatagtgggagactttaacaccacactgtcaatattagacagatcactgagacagaaaattaacaaaaatattcaggacgtgaactcagctctggaccaagcagacctaatagtaacctacagaactctctaccacagatcaacagaatatacgttcttctcagcacatcacacttattcactcaaaaccccacaactacatggaaactgaacaacctgctcctgaatgactgctggtaaataacgaaattaaggcagaaataaagaagttctttgaaaccaatgagaacaaagagacaacgtaccagaaatctctgggacacagataaagcagtgtttagaggggaatttatatcactaaatgcccccatcagaaagcaggaaagatctaaaatgaacaccctgatatcacaattaaaagaactagagaaaaagagcaaacaaattcaaaagccagcagaagacaagaaataactaagttcagagcagaactgaaggagatagagacatgaaaacctctccaaaaatcaatgaatcaaggagctggttttttgaaaagattaacaaaatagaccatgagccagactaataaagaagaaaagagagaagaattaaatagacacaataaagaatgataaaggggatatcaccactgatcccacagaaatacagactaccatcagataatattataaacacctctacgcaaataaactagaaaatctagaagaaatggataaattcctggaaacatataccctcccaaggctaaaccaggaagaagttgactccctgaatagaccaataacaagttctgaaattgaggcagtaattaatagcctaccaaccaaaaaaagcccaggagcagatggattcacagccgaatgataccagaggtacaaagaggagctggtaccattccctctgaaactattccaagcaatagaaaaagaaggattccttcctaactcattttatgaggcaagcatcatcctgataccaaaacctgtcagagacacaaccaaaaaaggaaatttcaggccaatatccctgatgaccatcgatgtgaaaatcctcaataaaatactggcaaacagaatccagcagcacatcaaaaagcttatccaccattatcaagtctgcttcatctctgtgatgcaaggctggttcaacatacgcaaatcaataaaagtaatcaatcacataaacggaaccagtgacaagaaccacatgattatctcaatggatgccgaaaaggccttcgataaaattcaacaccccttcatgctagaaactctcaataaattacgtattgatggaacatatttcaaaataataagagctatttatgacaacccatagccagtatcatactgaatgggcaaaagttggaagcattccttttgaaaaccagcacaagacaaggatgccctctctcaccactcctattcaacatagtgttggaagttctggctaggcaagagaaagaaataaaggttattcaaatagcaagacaggaaatcaaattttctctgtttgcagatgacatgattgtatatttagaaaaccccatcatctcaacccaaaaactccttgagctgataagcaacttcagcaaagtctcaggatacaaaatcagtgtgcaaaaatcataagcattcctatgtaccaataatagacaaacagccaaattatgaaggaactccctttcacaattactacaaagagaataaaatacctaggaatgcaacttacaaggggtgtgaagggcctcttcaaggagaactacaaaccactgcttgaggaaataaggacgcaaacaaatggaaaaacattccatgctcatggatgggaagaatcaatatcgtgaaaatggccatactgcccaaagtaatttacagagtcaatgctattcctatcaagctaccattgactttcttcacagaactaggaaaaactacgtagagccaaaacaatcctaagcaaaaagaacaaagctggaggcatcctgctacctgacctcaaactatactacaaggctccagtaaccaaaacagcatggtactggtaccaaaacagatatatagaacaatggaacagaaccgaggcctcagaaataacaccacacatctacaaccatctgatcttcaacaaatctgacaaagacaagcaatggggaaaggattccctgttttataaatggtgctgggaaaactggctagccatatgcagaaaacagaaactggaccccttctttagagcttatacaaaaattaactcaagatcgattaaagacttaaatgtaaaacctaaaaccataaaaaccctagaagaaaacctaggcaataccgttcaggacataggcatgggcaaagacttccatgactaaaacaccaaaagcaatggcaacaaaagccaaaattgacaaatgagatctaattaaagagcttccacacagcaaaaaaactatcattggagtgaacaggcagcctacagaatgtgagaaaatttttgcaatctatgcatctgacaaagggctaatatccagaatctacaaggaacttaaattacaagaagaaaacaactccatcaaaaagtgggtaaaggatatgaacagacatttctcaaaagaagacatttatgtggccaacaaatgtgaaaaaaagctcatcatcactggtcattagagaaatgcaaattaaaaccacaatgagataccatctcacgccagttagaatggcgattattaaaaaggcaggaaacaacagatgctggagaggatgtggagaaataggaacacttttacacttttggtggaagggtaaattagttcaaccattgtggaagacagtgtggctattcctcaaggatctagaaaccagaaatacaatttgacccagcaatcccattactgggtatatacccaaaggattataaatcattctactataaagacacatgtacctgtatgtttattgcagcactatttacaatagcaaagacttggaaccaactcaaatgcccatcaatgacagactggataaggaaaatggggcacatatacaccatgaaatactatgcagccataaaaaagattgagttcgtgtcttttgcaggtacatggatgaagctgtaagccatcattgtcagcagagtaacacagtaacagaaaaccaaacactgcacgttctcactcataagtgggagtcgaacagtgagaacacatgggcacagggaggggaacgttacacattggggcctgtcaggggttggggggcaaggggagggagtgcattaggacaaatataatgcatgtggggcttaaaacctagatgatgggttgataggtgcagcaaaccaccatggcacatctatacctgtgtaacaaacctgcatgttctgcacatgtatttcagatcgtaaagtaaaaaaaaaaagatatggaagttactatgcgcgttaataaaatatgtttatacctcctcccttaggtgtctattatgtagaacaagtttattacattctaatgataaagtaaacactctgttttcaaaggtggtgttatacgtttgtgtatcttttgccccgggcatgatgatttcatcgtttgtgtaataaatttaatactaccatagtctccccttattcacacgggataagttccaagaccccaatggatgcctgaaactgtggatagtactgaatcctatatacacttatgtttttttcctgtacactcatatttatgataaagtttaacttataaattgtgcacagtgagagactgacaataactataataaaatagaacaattataacaatatactgtaataaaatttatgtgaatttggtttcaaaatatcttattgtactgtactcacccttatgatgatgatgttagatgataaaatgcttatgtgatgtgatgaaggtaggtgaattatgttaggcattgtaatgcagcatgaagctactattgaccttctggtgttacatcagaaggaggatcatctgcttgggtggtcctgaatcatcacgtcctgatgatgtctgttgctggttgtcaggagcagacagtgtccatgactaatgggcaggcagcgtatatagcatgtatacactggacaaagggatgtctcatgtccacggctggacagagcaggagagtgcaagattttgtcacactactcagaatcgtgcagtttaaaacttaccaattgtttatttctggaattttccgtttaatatttttggactgcagttgaccacaggtaactgaattcatggaaagcaaaacaaccatggacaaagtgggattactgtattatttcagattttaattagcatttttcaaaactctgtctagctagtgcttgcattgtagaatttgtctgatttcatttttattgattagggaaataagctttatttttatctggagtgatttgtttctttgtgcttcctcaaaattgagtagtggctactgagtatatatcgaaaaggaaataaattattatgtcaaaaagatacctacatttgtatgttgattgtagcactgttcacaagattaaagatatggaatcaacctaagtgatgaagaaaattggtgtgtgtgtgtgtttgtgtgtatacatacacactgtggaataatactattcagccacaaaaaagaaaaaaaaatcatgtcttttgcagcaacatggatgggactggaggccattatcctaactgaaataactcagaaagtcaaatactacatgttctcacttacaggtgggaacttaaatggttacacatagaatagagtagaataatagacattggagactccaaaaggtgagagggtggcaggggggtgagggttgaaaaattacctattgagtactttgttcagtatttgggtgatgggtacactaaaatcccactttaccaccatgcaatatatgcatgtacgaaatctgcacttgtaccccctaaatatatacaaataaaagttttttaaaacacttagtaaatagcctgtcatagggaataattgaaaccatttcgtatctcactttaaaacctttaggctgggtgctgttgcttatgcctataatcctagcactctgggaggccgaggtgggtggatcacctgaggtcaggagttcgagaccagcctggccaacatggcgaaatcccatctctactaaaaatataaaaattagccagtcatggtggcacacgcctgtaatgccagctccttgggaggctgaggcgggaaaatcacttgaacccaggaggcggaggttacagtgagccgagatcacaccactgcactccagtctgggcaacagagcgagactccatctccaaaaaaaaaaataaaaataaaaataaaaaacctttttagttctgtttcaatgttatcttctttttatttaattatttttggaataagaaataatatttatatggtttgaacaccaaaaggtataaaagatatttttaaaggtataaagtataaaagttagaaatttcccccacttccctgttctctgttcccacagctgccagcagcttaccaccccccagcccaatcactgctactgatgcctaacctatctttccagagttctttgtgtgttcagtagcagttaaccacagatctttaatcattcccctttataccataaaaggtggcatgttatgtacacttgcctcccctttgctttttccacttaatgtgtcttgagaagctttccatatatcagtacatggaaaactttcttatattgttttattttaaatttatatacaataaatgcatggatcagaaaaataattgaatagtgggccccaaattaaatgattactctaatgatttgtagatgggtttagttaaagcactgggatatttagctacaggtataggaatgcatgattattttctgtcaggaaacctagattttgttcttctccccttctttatcaaaggtgaaatcagactcttatttaaaccaggattaagtattctttgcataataatatatatttgctttcccaagttattcttcaggaaagtcttgactctctagcaaactttgtttcttaaaatggaggttagcaggtgttggaaataaggtgagagttttaacacttaaaggaaactatataaagattagatatagtcagaaatttagaaaacattaggaaattcacagagagatggatcccccttttctaccctagattacccctgggctgcttaatggcttgtctttactattagattgtgagctccttgaggtcaggttttatctgttttttatttcaataccaagtgccaagaatatattcagcatttggtgtaaatattataaaatgagtaaatgaatgtgctcttgaatagaagttaactctgattttgggttaagtcccccgccccctttttttgagacagtctcactctatagctcaggctggagtgcagtagcgcagtctcagctcactgcaacccccttctccggggttcaagcaattcttatgcctcagcctcccaagtagctgggattacaggtgtgtgccaccacacccggctgatttttgtatttttagtagagatggggtttcaccatgttggccaggctggtcctgatctcctgaccttaggtgatctgcctgccttggcctctcaaagtgctgggattacaagtatgatctactgcgtctggctgattttgtgttaaaatcctttatgtcagttccagaagaggttaaatggaagttttcgaggcaagagatacttgtgaatttgacatgagtggcctttgttttgaaattttaatgctacacagatgctgtaaaaggattttttcaggccgggcgcggtggctcacgcctgtaatcccagcactttgggaggccgaagcgggtggatcacgaggttaggagatcgagaccatcctggccaacatggtgaaacctcatctctactaaaaatacaaaaattagccgggcgtggtggtgtgcgcctgtagtctcagctactcaggaggctgaggcaggagaattgcttgaacccgggaggtggaggttgcagtagagccgagatcgcgccactgcaactccagcctgggccacagagcaagactccatctcaaaaaaagggtttttcaaaaaatcatgtacaattagaaaattgtgtctcttaaatctatttgcttatgttattaatcccagattatgactgttctttcccctaaggcattagcctgttgaaagaaacagacctataggacttttgttgatgttaaagccagaccagaaatttagaaaatcaggatatttgccattttgataagaaaaccatttaatagttgaatataggaatttgcattttgagagtgtgtactaatttagattctccaggaatagaaccatcatctgaaaataaataagtttaaccagacggacaaggagtgatatgtagttttaggtggtaagactgtgatattgttaggttacatgtatctagggcaagatgctcaaatacaataagtatatacagactaggaactctagttgtctttttttaattaatgaaaagagggttttatgcttcatttctaaacattctcaaaggaatttatgttttgttgatgatctttttttatttatataaatttacgggggtacttgtgcactttttttttaaacatggatagattacagagccgtcaagtcaagcctttagagtttccatcacccaaataacacacattgtattcattaagtaatttctcatgatctcccacctcctgctctctcacctttccaagtctgttatctatcattccatgctctacgtccatgtgtacacatttttcagcatccacatgtgaatgagaacatgtgttattcccaccaacagtgtatgagtgttcccttttctctgcaacctcaccaacttgtgttattttttgtctttttagtaatagtcattctaactggggctggatgatacctcattgtgggtatttttaaaataaaaaaaaatttgtgtgtacataggtatatttatttatggggtacatgagataatattgatacagacatacaatgttcaataactacatcagggttgtatccatcaccaagcatttatcctttcttggtgttagaaacaatctagtttctaatctctaatagtttctaatctctagtagttatattaaaatgcataatgaattattattgactgtagtcaccccattgtgctatcaaatgctaggtcttattcattctatctaactatatttttatacatattagccatccccactgtgccaccatccccattagtgccctggcccccactacccgtcctagcctctggtaaccatcattctactctctatctctatgagttcaattgttttgatttttagataccacaaataagtgagaacatgtgaagtttgtttttctatgtctagattatttcacttaatataatgacctacagttccatccatgttgttgcaatgacaggatctcatacttttttaagggctgaataggactccattgtgtatgtgtaacacattttctttattcgtccgtctgttgatggacactcaggttacttccaaatcttggttattgtgaatagtgctgcagtaatcatgggagtgcagataactctttgatatactgatttcctttctttggggtacatatttagcagtggaattgctggattatatggtagctctctagtttttttttttttttttttttttcatttttgagacagggtctcactctgttgcccaggctggaatgcagtggcggaggttcacttcagcctcaacctcgcaggcttaggggatccacccacttcagtcttccaagtagctgggactataggcgcataccaccatgcccagctaggtttttgttgttgttgttgttgttgttgaggcagagtctcactctgtcacccaggctggagtgcagtggtgcgatctcggctcactgcaacctctgcctcctcggttcaagccattctcctgccttagcctcccaagcagctgggattacaggcgcccaccaccatgcctggctaacccagctagtttttaattgttcgtagagatggggtttcaccatgttgtctagactggtctcgaactcctcgactcaagtgatcctcctgcgttggtgtctcaaagtgctgggattgcaggcacaaggcaccgtgcctggtcagaatttttttttaagggtttctcctttgtaaatttcttattcatatcttgaattgattttctgagtttcttgtattggttttcagacttttcttgcatctcagtgacccttaaaatcaatattttgaatattttatctgggattttgtggatttcattttggttaagatctgttgctgcagaatcgtgttcctttgacagtgtcatattaccttggtttctgatgtttcctttgtcttttcattgatttctgtgcatgtgctgtaacagtcacttcttatctttgaatttactttcatggtgaggggagatttcttcctgaagatgtgactataatgttggttgggccttgcttctgggtgcgtgcagtagtgaagtctctgtatgatttattttgagacagctctgttgcccaggctggagtgcagtggcacattcatagcttgcttcagcctcaaagtcctgggcataagtgatccttctgcctcagcctcctgagtacctaggactacaggcgtgtgccaccatgcctggctaattttcaattttcttttagagatgggggtctcattatattgcccaggctggtcttgaactcctggtctcaagcaatcctctctccttggcctcccaaaatgttaggattacaggcatgaaccaccgtgcccagcctctgtatgatttctttggctataaatagcattaatggtgtctgtggtttccttgatgtcttagcttgagtttatttgtggaggctgaagttgcgctggggattggaatgcctaataggcctgtctttaggtttcaatggtagtgatggtgggctaagcatgtctatccatgtgccctggggcagtgtgtgctggtaactgtgttggcagttccaggcaggctgattcttgggcttctgagtgactttctcagatgcctgttgtaatggtgtaccaggtgggtgagctggctcttgagctcctgggcaactggcatggcatagtttatggtggtagtagttttgttgagatactcttgtgggtcccaagcactttgcatttgtgttagcagtggttacaatgagatccaggccagtaaggtggtacttgcaggcatgaggcagctgaggcggtactggtagggtgttatccctgacctctgtcccctgggagaagtactctggtgtttcagagtgtttcaggtagtgggtttggttgtggaatcccctggtaacctggatcctgcactgtttctcagccaggtcaaagcctggtagagctggactgggaaagcttgcactcaggcccccacagtggtgtaatgtcatgataggcggggtggaatgatcttcaggctgctggcaaaatgcttgggtgagggatgagtgccactgctgagatcctgccatggggaagttgggcctggtcccaggagtgagttgtgttcctttcatgccccagtccaggcggagttccttcctcttgtccctgctgttcagtcagaactctgcagttcttgcctagtccctaaatcatcccagggtcgggtcatataagccccatccagctcaagacttaagcctccagggcaattaatcgtgctcaaatcctgggggtggtgtttgcttctagcactggtggtggctgcatcccacaccaggcagagccaccccatccccgcccctactcacactctgcctctccaaacagcagcccaagtttccctaatggctaggactggccctgttgcttccccgtactgctcacagttatgagctgagatcctgcatcgtgtcttgttacagctgcttaggtttcaaaaatggcatgggacacagaatgtgttccctccctgaaacagttctttctcacagtcttccagtcattccctaaattaattagattcagggcttaagagggtcagggtgctctactgaggactggattgtatggtagtggaccacagaaaaatactcaccctctcccatattggggaatcacttctggttccctgtgggtcccagccacacaggctctctgttttccttttgcttcctagattttggtttttgctgtcgcttttctgttgaactcctgtgttccctctgggataatatatccaaagtgtcattgtctacacaattttagctcttgtacctggatgaggcacgcttgaaattcttgcagtcatccatcttttcctgatcttgtttcttctgccccattccccaggttcctccagggtctcacagttcccctgtatgtgggaaaggcagttttctttctgcccaatcctgcttctcctttgtccacccagatgaggtttccgctagaattgctacttaaagtggttctgtggaacattttgtagcagagaaaatcagggctgagggagcaccataaaggttagaaaagattagaacattaggttagaaaatctgaactactctacctgtcttgattaggaggattagagttgatgttggatgggtttgttggtttattttccacttatctatcagaatgaagaacttactgccttttcttcttagttggtctaatatttatcactttaattatttttaagtgtacaattcagtggcattaaatatatttataatgtatcatgatcattactacctatgcccaaaactttttcatcatccccaacaaaactctatatccaaaaaaaaataaaaccctctatatgtacatggaacaattaagttgggcccctatcttgcaccatataaaacagttaaatgcatcaaagatcttaacgttaacagctaaaattataaaactcttagcagaaaacatttgggctgattttcatgacctgggatttggcaatgatttcataaacataatgtagaaagcacaggcagcaaaagaataagtaagttggacttcattaaaaatttaaaaatttttttacatcagaggtcactatcggctggatgtggtggctcacacctgtaatcccagcactttgagaggctgaggcgggtggatcacttgaggtcaggagttcgagaccagcctgaccaacatggtgaaaccctgtctctactaaaaatacaaaaattagctgggcatggtggcgcgcacctgtagtcccagctacttgagaggctgtggcaggagaatcacttgagcatgggaggtggaggttgtagtgagctgagatcgtgccactgcactagaacctgggcgagagcgcaagactccatctcaaaacaaacaaacaaacaaaatgaagcaatccccccccccaaaaaaaggtcactatcaagagaataaaaagaaagacaactcagaatgggagaaaatatttgcaaatcatatgactgatgagggtttaatatccagaatgtgtaaagaacttttactgagcagcgaaaagaaaacccaatgaagaaatgaacaaaggccttcaagaaatgaacaaaggccttcaatagccatgactttacttttttaaatttaaatttaaattttttgagacaaagtcttactctcttgcttgggctggagtgcagtggtgtgactgtggctcactgcagccttgatctcccagactcaagtgattctcctacctcagtctctggagtagctaggatgacagactcacactaccacatgtgactttgtgtgtgtgtgtgtgtgtgtgtgtgtgtagagacagggtctcactatgttgctcaggctggtcttgacctcctgggctcaagtgagcctctcacttttatttttatttgtagtagagatgagatcttgctaatgttccccaagctggtctcgaactcctgagctcaagcaatcctaccttcctcggcctcccaaagggctgggattataggcgtgattcactgtgcctggcctagtttctttgttttaatttttttcctccccatttgtcttttgagtttccctgagaatctgtcttgctgctgtctcagttgtcattcactgttattacactggaaccctattgatgtagtggtaaggaattagggaggggaagtgttttgtaatctcatgattaaatgtcatttcttttttttttaattggtcctgagtccctgaattgtgactctcagaagtgtttcttagcccttgccctcccacttagatgagacaggaaggctataagcctcgggggttttctaattgtctttcctcttggtagataatggtgtgagcatatttgaatatagtttctttcctctcctcctgctcaaggcacaaggaaattttcctcaaatatttgcagtgaaaacatactaaaacccttgtaggattcctggaggtaaaacctaggaaagtgtaggggcccctctaagactgggatgtcaggatttttaaactctcaaactaatccatatttggcctccagaag

SEQ ID NO: 192 - DNA, 4823 bp, mus musculus
ttccgcgccgatagcgctcacgcaagcatggtaggacttgctggtgggggccgagtaacatccagcttaatctttcccccccttcgtcgcccgtgctatgccgggatgggtccaggctcctgtgtggactcgatatatcagagcaacccaatcttgccgggatcaaccctaaagggaccgggctacggggccaggaattgaagtgatgggttcaaagaggtagagttagccgggggtggagttaatgaggtctcttccctctttggggctcgacggagggaggaagctctgcttgaagcacatggggctggcccaccctgtagtcagaggtagcaagtaatgaggagtcctcctggagtgcctcagctttagctgggtaaggtagggcgttgtgccattgtggtcaaataacattgcacgttctgaactgtttctttactaggttaacgtccctaaaacccgccggactttctgtaagaagtgtggcaagcaccaaccccataaagtgacacagtacaagaagggcaaggattctctgtacgcccagggtaagatggattccgcataatttggtgttaatgtgacatttgtgttgtagaataacatacgagtccgggtctctctccctccacgcctggcttgagcgttaatatttctgctgcgaaattaagataaaacctgtaagacttacttgctgatcttcagtattttataacaaataccaattcgttttcccaggaaagcggcgttatgacaggaagcagagtggctatggtgggcaaactaagccgattttccggaaaaaggtgagtggtagttactatttgacgtttcccagttaattgccgtaaggatatgcacttgtctctagtccacacacttcatgatataggtatagcgttagtttagcgaagttttcactgcactgatatatctagtaggtgatggagctgggaatgcaactcatgtctgactagtccacaatactgcactatttcagtgtttacgattttttatcctttcccttctgaagaggcaaaaaattgaggaatgtgccctgctttcctaagaactgaagtgtgagtacactggtaaatcctttcatttgccttgttccttatctgtcaatatgtctgaatcctcgcttgttggttgcactaagaattgttctgttgtttctcatcacagaaatctgcagtcaactacctgttctcgtgaagtcttaaaactcttatagaatagccatttaggcctttctgctagcctcctgaattctgtattctcaggctgagcgagtttctgtttactctcaaaccttaggtgatttggctaactcttaaagtaattagcacgatgattggaacggagcattctctccaacacagcatttcttttggcactttgcttcttgtgcagtttagctccagaaagtattaaggaatgactttagtgctcatttggatgcagtaagtggtttgatctcagggtggcaaaaagaatgctttttttataccttttcacattcggataacttgtttagaagacagaggttctaactaggttttggcctattaagaactgcaaactagcagcagcagaactctggctaaaggggcaagcttattaggaaattgagtatttaaaagttgagctaccatatgatccaacaatcccactgctgggtatatacccagaagaaaatcggtatatcaaagagatatctgcactcctatgtttgttgtagcactgtttataatagctaagatttagaagcaaccttagtgtccatcgggatgaatggataaagaaaatgtacctatacgcggccaggcacggtggcttgtgcctagcactttggaaagccgaggcgggtggatcacctgaggtcaggagttcgagaccagcctggccaagatagtgaaaccccgtctctagtaaaaatacaaaaattagccgggcttgtggtgtgggcctgtaatctcagccacccgggaggctgaggcaggagaatcgctggaacctgggaggcagaggctgcagtgagccgagatcacgccactgtactccagcctgggcgacagagcaagactccatctcaaaaaaaaaaaaaaaaaaaagggaaaaagaaaatgcacctatacacagtggtactattcagccataaaaagaatgagatccagtcatttacaacaacatgggtggaactggagatcgttatgttaagtgaaataggcacacaaagacaagcatcacatgttcttgtttgtgggatctaaaaatcaaaacaagtggacttgtcatatagagagtagaaggatggttaccagaagctgagaacttctggtggcgggaggtggggatggttaatgggtacaaaaagaaaaaagaatgaattagaccaactatttgatagcacgacagcgtgactaaagtcaataacttagttacatattttaaaataacttagagtgtaattggattgtttgtacctcaaagaaaaaatgcaataaaactttacagtggagaaacctaacaagcactacctcagccaggtaatcaaggttaacatcaacagtcacgagtcatgttgatatatacccttgataaggtgtgatgaaaatgacacttaaacctaaaaatccataaccctatctaatgagaaaaataacaaatcccaagaggggcattttacaaaatacttgaccagtagtgcggaaattgtcaaggtcatcaaaaaagtctgagaaattgccacagccaaaggagtctagagacatgatgactaaatgttaggtggtgtcctgcgtggggtcctagaacagaaaaaggacattagaaaaacataaggaaataaaaaaaaagtatggacttgagttaataaggcatcagtgttggtttgttaatgagtcatactaatgtaagatgagaaactggtaaggtttataagaactctgtagcatgtttgcaattttttggtaaatagaaaacttgtaaacaatagttctgttgtttaggtaaaaggagcaatcaaggccgtgcgtggtggctcgcgcctgtaatcccagcactttgggaggccaaggcgggtgtatcacctgaggtcaggggatcaagaccagcctgtccaacatgatgaaacccccatctctagtaaaaataagaaaaaattagctgggcgtggtggtgggcgcctgttatcccagctactcaggaggctgaagcaggagaattgtttgaacccaggagaaggagctgagatcacgtcattgcactccagcctgggcaacaagagcaaaactccatctcaaaaaaaaaaaaaaagaacaataaaaaaagttgaggattagtggggagtgtagtttgagttaaataattcagttgaatggacataaattctagacataattgtaggtagtcttagaatttattgatcttttatagagatggggttctcactatgttgcccaggctggtctcaaaatcctgggctcaagtgatcctgcctcagcctcacaaactgttgggattaaagaactatgcagagctgctgaatggccacaagttcagggtggcaagatgagttgcccatttgataggaagctctaggatgtttgatctgaatggggtttggattcaaacttgatgacaactgggtgacatgccatctttgctattaccacattttctctttatatatatatatttatatattatatattatatatatttttatgttttttatatatatttatatatataatatatatatatatattttttttttttttttgagatggagtctctgtttccctggctggagtgcagtggtgcgatctctgctcactgcaacttccgcccacctcccgggttcaagtgattcttctgcctcagcctcctaagcagctgggattatagacacgtgccaccatgcccggctgatttttttgtatttttagtagagatggggtttcaccatgttggtcaggctggtcttgaactcctgacctcatgatctgcctgcctcggcctcccaaagtgctaggattacaggcatgagccactgtgcccagccttctctttattttttttagtccacaagttctacacattttctcttaaattcactgatttttagattattttctccctatggcttaagagtatactgagtactatttaaagcaaagcattgcaaaagaatagttgccccactattcatttgcaatgctttgctttaaatagtacttaaagtagtcatttttgaagaaagtgatcttctgtagttatttattaaggctttaatttaattttttttcaggctaaaactacaaagaagattgtgctaaggcttgagtgcgttgagcccaactgcagatctaagagaatgctggctattaaaagatgcaagcattttgaactgggaggagataagaagagaaaggtatataattatgggtggaaggtgcaatctttttcatagctttattatttgaaaaggtgaacatctattcattgtggcatagagctcaggggtaatcctctaaaaatattagatctatagctaaagatatgtgaggtcttttgctacaaggaggaaaggaagaatgaggcagcttaacagcatggtgagtattttaggaacagataatgttcttaatggggcagtagttcatggcaaaatacaaaacaacttttttctgttctgttacagggccaagtgatccagttctaagtgtcatcttttattatgaagacaataaaatcttgagtttatgttcacttcatttgtttgctgttcatcttttgggagggaataagctaga

SEQ ID NO: 193 - DNA, 163120 bp, mus musculus
cggccccggccccgccccctccccgccagccctccgggctccctccgccgccgggccggcactttctttccaagttacggcgcaagttctgcggcgctcggagcctcccttgcgatcccacggccgggactgcccggagtgcatgggcgcgggccagggacgctgagcggtcgcgccatggagggcgccgagccccgcgcgcggcccgagcgcctggccgaggccgagacgcgggcggcggacggcgggcgcctggtggaggtgcagctgagcggcggcgccccgtggggcttcaccctgaagggcggccgcgagcacggcgagccgctggtcatcaccaaggtaaggcggccgcggggcgcgggcgctgacagccgggagctggccgccctgcggggcgcgtcgaggtaggggcgcgggaggggcggtaggctcgcgcccccgggtctggcgcgcgcgtctgctggggtcacctgccgggcctgggcgccgggaccggcgtgggcgtgtgatcctggcggttccccgcgcctcgcagagtttaaatggctcctgcccggagtccctttcccctccccctccctcctccgggcaggggcctggccgggtcctctggcgctcccgggcccgccagtggcggcctgcacctgcggggctgcctggaggccagcgaaggaacgtgtccccgagccgtccccacctatgtttgcctctctggggtccctggttcggcaccccttggacccgtgcctgtgatcactacgaaatccagagtagcagctgtcgccagcgcaacttctcgattcccttcagcccatcaatgtttactgactttcggcttccagtcccagatccactgcgcactggatacctgcgcaaacttagagaaacctgaaagcctgcttcctaagagcaggacccgagttctaataataataaagaaattccagatgtatctcatcaggaatgttgtgtgtgtgtgtgtggtttgctttagaacattgaattttattgtctcaaaacaaaatccatctggaaacttaccagttgaacctgtatgaacttgtaaaagcaaacacataaacaacagtccagtcaccctgtgttctagttaaaagtgtgtagtggtcattttctctgggaagggttgagtcggacctttcgtgtggacgaagttccttttaaaatgtaaagattcttggcgactagaagcgtttgaagataatttactggttttctcggctttcctgcctctccacagcaggaagaaattaagtgattcctaacccgccgcactggtaatcagtttgggaagtgggatggctttgttgttcaaatagcaaatgagacaccagcgtcttccattctatattttctgtcgcttttatgattacaaaactttgtggagggatttggagaagccttgtttagctttgcactaaatttttgttgaactcaggaaagaggttgccattgttataaatttgaccaatgtgtaatcttttatcacactggcttctttggaaacatggtggacagtcataaagtgtgtatactctgcccagccagaacactcctcttttttttttcttttatttcttttcttttctttctttctttcttcttttttttttttgagacagggtcttgttctgtcagcctcctgagtagctgggaccacagatgtgcgccaccatgcctggttaattttttaaaattttttgtagaaacggggagtttcaccattttgcccaggctggtctcgaactcctctgcctcccaaagtcctggcattacaggcatgagccactgcgcttggctcagaatgtggattaatccaagctttgaatcttcctctcccaaaagctactgaaaagtcactggggctcattaaaaaatagctcttctaatcgtttttttttttccacttgtaattaaatagttacatattagagccctggaatactgtacaactcacttgctatttagcagactctgatttggggatagcttgcattaaggtaagagcgcaccttctctttatgataatgagggtatcatttgaaagcctcatgggagtgcgtgtagtagaactgggaggggtgtcaagaacaaggctggttcggtcctggtcttcagatggaattttatcagcccattttatagatgaaacagctgtggcccaggcagggcaaatggtgtatcctgaggtcacaaactgttgagtcctgggaaaggccctaagaatcagactctggccccagtgttcaagcctgctgctccccttcagtcagtgccatctgcttgggtctgggatctcctgcaatgccatattgaataccttcgtcacatcggttaggtgagggtttgccagccttggcattggggactttgtgagctgaatctctttgctgtggggctgccctgtgctttggaggatgctcagcagcctccccagcctctacctgcttgatgctactgtcacctctctccaggtgtgatgacaaaaatgtctccagacattgccaaatgtcctctgggggcaaaattagcctggttttgaatctcttttgttagattaaccatatatcacctttgctcttaaaggattcttgctcttaaaacttctgtttctttttgaatagactggcctttagggtggtgtgtttagaggcctctggcattgccagtgtttgcatggagagctgttttcctcccacgcgttggccctgagaataggctttatttacatagtcaaactcaaacaaatacttgcttcatctgcattttttgtagctggagaaaggaaattgaagcaggaactcccaagtgctgtgttttatgggcatccacagtggctgttcagaatcaggactgactactctctgggtctagtttgaagctaaagggataccaacttcagaggagtagcattcttggaatttggggtgcatgcatgaagcccagcagaacctccgctgacagatggcgacaggattcatcactcctcagtacgtttctgctgatttctgccttgaaattttgctacagttggtggaaaaaatgcactcaaacccatatttccatgctgttgttagagagggggcaggaataacatccatgctgtaggaatctatgtaacggaagtagagatggtggatatatgtgatcctggtgggttttttgcatgtttctgttcccatccattcaaccagtggaagtcttcagtggggggaggggaggggactgatttctaaaatgtcactagagtggcttgaattccacaaagctgtttgggggattcatgaggaagcgttaaatacaccagctgggtgtcagcagccccctgtggcctcaggaatgtttgttaagggagggaaggaatgaagccccagcctctcctgttcactatttcttagagtccgctccctcccccaaaaagaatgccagaagccttagcccgaagctccaaagaagacagtaacttgggcctggcctagccccaagggcagctcctttgggaacccattgattttcgggttgccattgggcaccagagctgttgtgtgcgacaagactgctgtggtctgggacgcttggaggtcccccccacctgactcacccaccccagggcttcagactctgagaacatttctctggattggagacagagctttgaaatgtcctttccagtgtgaatgccaaagacggaatcagggcatattttggggggcgtgcagccaggtggcaagtgtcttatgtaaagtgttagctgagtccttgattgcagagggcacagggctgagactggtggttggtgatgggcaggagtggaggccccgcgcctctgatgtaccttacttattggtttggaaagggggctctgcattatgggccatgccaagtcacctcgtgacccgaggaccggggagatcagagtgaccaccctggtcgggatcagttcttgtctcatatgccattatattggctcccaagagccaaccaagctctttgtgaaatatcagtaaaggttttgaaaaagagggacctgatgaattcagcagtgggtcaggagcgggtgactctcaactttgtggctgctggtggatttttgtgcccagatgcagtgtgcggtcaacatctgcacgagggagtgctgctgcttctccaggtgtctgagaaccagtgggtgagggcttggatctcccttgcctctgccatctctaagtgatgtccgagttgtaaagctttactcactttttgatgccagctaccatgttttcttcagctattaggataagtgtcattataaagatccatctgtatttaagaattaatagtaaggttaaaaaccaagaggtgagctttctttcctgtgctgaaagaccctttcagttggtaggcccgccttgccaactggctttcaagtctatctttattaccttttcccagcctgtgaattaatgtgaccctgctgaattctcatccttgttctccggcgatgttttgggcaagagtgtggagtcaggcagtgagcctcaagtcctattccagggtctgggagctggaggctttgagggtcagctctgggaggattcttcctctcttagacattaactcagcttgactcacgcctatgaatccagagccttctgcgattatgagaagctgtaaacataagctatgcatctcacttctgtaccaggatgcgttcggtcttcatggctcagttatgagtatttcttaacatgtcgtaacatttatcttttgaaaaaaaaaaagaaaagaaaactagtttgcccaagagctaaaggtagaatagtatgataatgaaaggctcagaacaagtagcagttttcaccttgtcctaatgagctgggggtttcttaatctacctttgtaattcatggtcaaaaaaactggcttgccacttgggaagggctggtttttctctttggaaagcattttggagttgtttgtccccttgccagagttgttttgtatcagcatgcaaataaacctggatttgtggccaagttcttaagggcagtggagaaaagctggggctctgtggaacttttcttcttgcacaccgggtgcagcggaaacattctacacgataatgttagaatgtaaaagctgaatggactttttattcaggtcttcttttactttcaagcactgtagtcagcagtggggcaattcatgaaggataaattctgcaggtttctgcaagccctcttcctacacatgcaagccgaaaactttaacccacatgaaggattttgaaagagttctgggttgcctgttgctcttttaggcctttaaaaaaatatcaccagtgccaggcacggtggctcacgcctgtaatcccagcactttgggaggccgaggcgagtgaatcacctgaggtcgggagttcaggaccagcctgaccaacatggagaaaccctgtctctactaaaaatacaaaaaaattagccgggtgtggtggtgcatgcctgtaattccagctactcgggaggctcccgggaggcagaggttgtggtgagctggagatcgtgccattgccctgggcaacaggagcaaaactccatctcgagaatagaatagaatagaatagaatagaatagaatagaatagaatagaatagaatagaatagaatagaatagaatagaatagaatagaatagaatagaatagaatagaatagaatagaatagaatagaatagaatagaatagaatagaatagaatagaatagaatagaatagaatagaatagaatagaataatcaccagtatctgatacagggagggtgtattctggaggaattgttgtcctttaccttgtgtgatgcagtatttgggctgtcctgtagtagagccagcctgttcccattatgggtgtgaatgttccagcttctctttgggggaacatgtcttagaaggataatactatatcattaaaaagaaaaaattggacaaacctcatttggttgaaccttagaactaggatgttctgaattgcaaagcaaaggtaacatttttttccccagataaggagcccctgggctgtttttttgtgttgtttttttttttgttgttgttgttgttttaaatccccagcgtattaagttgcaggcaatgagggctgcttcttttggatggaaagggaagaaaaacagcatcttggcttggctaggaagggctgggattatctttcttttggcaaaaggtgactttcagatcaaaggcaaattgttgaggtcaacaagaacccaggcagggtagactctgtgtccttgaaaggtaacacttcttactcatagaagggaaggggcaagcatgatagcgtatttttttttttttaagacagattcttgctctgtctcccacactggagtgcagtggcatgatcttggctcactgcaacctccgcctctggggttcaagcaatcctcccacctcagcctggcgttacaggcgcacaccaccacgccctgctaatttttgtatttttagtagagacagggtttcaccatggtagccaggctggtctctaactcctgacctcaagtgaaccacccgccttggcctcccaaagtgctgggattataggcatgagccatcgtgacacgctaggagtgtcagtgtatcttttatgaggttttattttatcaaagtggctcttgcacagtatgaattatcaagtagttcttcaagggtgcttatatgctactggtcatttggcctgactactgatcacttccccctccctagagacaactatcaaaacgtcttagctgatttcttttggtatttctgtccatatccctaaatgatggcttatattgtatattgctgcaacttttgtttattagcttgttcttcccaatgtaggatattaggatgtagccttttttccactctttttttttttttgaaagtctcgtcctgccactcaggccagagtgcaatggcatgatctcggctcactgcaacctccacctctggggttcaagcgatcctcccacctcaccctcccgagtagctgggattacaggctcgagccaccatgcccagctaatttttatatttttagtagagatggggtttcgccatgatggccaggctggtctcaaactcttggcctcaagtgatctgtccacctcagcctcccaaagtgctgagattacaggcatgagccactgcgcctggcccttatttccactctttttcattgctcatctaccctcccccaactactcaggcacaattcttggcccttcatacccctaatgtgattacatcataattttttggtgtggggccatcctgtgaattgtaggatcttgagcagcatacctagcctcttcctttctttttttttttttagacagggtcttgctctcttgctcaagctggagtgcagtgtcatgatcacagctcactgcagcctccatctcctggactcaagtgatccttccccctcagcctcctgagtagctgtgactacaggtgcatgccactatgcccagctaatttttgtattttttgtagagatggggtttcaccgtattgcttgggttgatcctgaactcatggcctcaagtgatcctcccaccttggcctcccaaaatgttgagattacaggcgtgagcaactaaggctggcctcttccccgctctgaggagcatggggttaccaatattcagtgtttattttggttgctattgctatcactgctgagtctgggggtacatactgtggagtcctgataagttagcatcaatgaagaagggaccccagggtgggggagaacaattgttctgagaaactgctaaccacaaacaactctgcgtgtagcttctccagcatgatcctataaaacttccctccagcccctgcctctttgcaaccccttctctgctgtgttgcctgttgctcccttgcaacatactttttctctaataaattagtcttctcttctcttctcttctcttcttttcttttttctgagatgtagtttcgctcttgttgcccaggctggagtgcaatggcgagatctcggctcactgcaacctccgcctcccaggctcaagtgattcttctgcctcagcctcctgagtagctgggattacaggcgcctgccactacgcctggttaattttgtatttttagtagagatggggtttctccatgttggtcaggctggtctcaaaatcccaaccttgggtgatccgcccacctcagcctcccaaagtgctggggattacagacatgagccaccgcgcccagccataaactagtttttctttaactgactactgtctcagtaaattcttttactgcccgtgactctggccccagccagtgtacccacaacacaagtttctgcagtcactagggttcaggatagttttctttgcttaattttcagtgcacttatccttgattcatccctcaaaccctccccagtgatgaaatatctcttaatatattcagacacaccgggggtcatcttttgagatcttctctgtctgaaaacagcatgatttttatcttgacagtaaattgtttgggcgtagtcctgaatggagacagttctcccacagcactctgaaggtggtgtccactctgctgttgtgcagtattgctggagggagatcagacgtttttgtttcttgatcttttgtactaggtctactttttccctctcatttttctttttctttctttctttctttcttttttttttgaagagacagggtcttgctgtgttgctctggctggagagccgtggctattcacaggcacggttatagccacactacagccttgaactcctgtgcttaactgatcctcccatctcagcctcccaagtagttgggtttacaggtgtgtaccactatgcccagctctcttattttgcatttctttgtatttttgttcttcctggaagattttgttcaacatcatcttctaatctttccattaagttttaaatgtatgtcctcatttttccctcagattctaaacttttaaaatttgtttctcaaatgttcctttttcataccatactgatcttgtttcatgattcttccatatctgtgacagtattaaactggtctctaaaaatgtcctctttttgcatagattgtttctgagctctgcttttgttgtttgttttggctgctttcttccctgttagaggttgtcttcaaatgtctagtgctccttggccgtctgctggtattgaaggttgcgttccccaaaatgctgtttggacactccgtgcatgggggtgagtgatcaggtgaagctgtttccctgggtattcctctaaggctgtatctttctctttttttttttctggaggggcagggaggcggccatgtttttgtcagatactttttttctacttaataaacttctggtgtagtacaggttgaaaagtaatgggaagtctgccagttgaggggatctctcctttgctcagctgggcgagggtgatcatctctgccccccaactttggctgtagtggttccagtttggagggaaggttaccactaggcagaggaggcagtgcttgcttgcttgcatccggagctggatcttgctctcagttcctaaccgtttctaatcagtaatcctctgtctgtccaactagaatcattcctattttattgtggtatcatggggattaaatgaggcaacacataaagctatctctagtaaattcaaattccccctcacttctcttcctcactttccctactcaatcctgattcattaagaatttggaactttgggaggccgaggtgggaggattgcttgagcccaggaagtcaagacaagcatgggcaacaaaatgagaccccatctctacaacaaatagaaaaattagccaggcaaggtggtatgtacctccagtcccagctacttgggaggctgaggtgggaggatcgctttgagccaaggaggttgagggtgcagtgagccaagatcacaccactgcactccagcctgggcgacagagtgagactctgtctcaaaaacaaaaaataaataaaaaataaaaataaaataaaaaatacatctaatgcccagcatcagtacatttcctatgttatttgtagcccaccagaagtgattctttcctctcctctaccaaaaaacttttttccagaataatagtgtttcttatttttataatattaataaagggagtagctctttcagatcaatgtggtattcagagtagggtttttatttgtttttttgtttgttttgatatggggtctcgttctgtcattcaggctggagtgcggtggtgtgatcacggttcactgcaacctcagtcacctgggctcaagcagtcttcccacctcagccccccaagtattaggactacaggcacatgccacctcatctggctaattttttgtattttctgtagaggtagggtttcgccatattgcccagggtggtctcgaactcttgggctcaagtgatctacccaccatggctaccgaaagtgctgagattactgatgtgagccactgttcctgggccagagtagggtgttaaaaaagtagttttgggaagtggcaatagtgggaaagatgaagattcagtatccctgtgacaagactctatttcttcactctttcaatctttggagtagaaaatctgttagggtttagagtgggacccacaagtgtggcagaaatgctgcctgcccgagtccttgttgcctcctcctctcagacactgttgggccacatttcccagcctccctagcagttagctgtggcctcctgacgcttctaccctggggagtgcagctgcagccatgcctgccattttacttttccccttctggctgcctggaatgaagatggccgcagggcagagttcatcagcgtggatccctgaatgactgcagaggtggctgcccatgctatggtcaccatccatggtgagcaagaagtaagcctctgctgtgtttgggccattcattgtatgttttttggattacttgctgtaacagactattctcacaaatgaaatgctgggagaaatcagaagttttccttctagcaaatatacccagctttaagaggcggaatatacggtgcttcttttacacccatgctggaaggagtgaggaaagcatcactgtgggtgtccaattagcatgaagcctattccctgcacacttattatataaaatgagacctccacgcccattggcgtctttccacctccttacccttttctctcagctggtaatttattcacccccaccccccacttgctcttccttctcctccccggggatgatttcctgggagccctggagcattggggcaggaggccgggagaatgcccagtctagataattagtcctaggtggggctggccggaggcacagtgggtggggtgggtggccagctgctgttaggatgatttcagggattggaccttcctcctggtggtggtgtcctttctttaactgccttggttaaaatgcaaatgttgcctgggagggctacacattgtcatcattaacagaactgccttcatcagattaattaattatagttctgtatggcagacttttttccccctggtagtagcacccagacacatgaattagaccagcaaagagaggagagataaagttgaaagccagatgaaagccaagtaaaactggcctcgggaggaaggtggagctggcggagtgggagtgctgaggaaagaccttgtctgttcaggtactggccgcctacaaagaggagttaggacagcctgtggaggaagctggtagggagagcaggggcccaagtccagctgaaaaccctccctggacttgcaaaagaggtgaaagagattctttacctatggcttgcagattctgaagctgacgaaattccacatctattggtgttaattgtgcatctgtttgcaaatttgtaaacatggtgatatttatctctgctaattgtataatgctttgtacagtgtcttttttcttgttgcacaattaaaatgaaaaaaattgaaaataaaggaaaagattgatccatagcccaaaacatgtaataatcttatttctgaaagtacagctgtattgatttttccccatctctgtggaattctttgctttgaacctcgtagatctaatttttaattgcttgaaaacccttaagaattacattgtcaacaatctttggaatcagatgaaaggagtttaattgtgtgtatgccacttgacgttttaagaaatggtatgttttgttgtggaatatatttttataatttaggtttttctagacaggcatatttttaaaaaccctaatttctggaaaacggagtgtactttatattggtcaaatatgtcagtctttcaaacaactatgcttttttgtatgtgcagcttttcttaacattttcattatgtttagatgccctgaatcttgaattaaagtttggaaagaaaacatctggacttgaaaagataggcctgctgctgcttcaatcatatttattttgtgttgatttaacgacagagctctcacatgctgatgccattagggtttgggacggagccatttccactccccctcctcatttttagtggctggtgttttggggacaagtaattaaaacttgtaccactattcatggttgtgaaatctcaacacaaaggtaaaattcctgaggatgcacctccttgtaccctgaggcaggaacttgtttgcctttacggagagtttaattcttttttttttttttttttttttttttttgagatggagtctggctctgtcactcaggctggagtgctgtggcatgatcttggctcactgcaacctttgcctccccggttcaagcaattttcgtgtcttaacctcctgagtagctgggattacaggtgcgccaccgcgcccggctaatttttgtatttttagtggagatggggtttcgccatgttggccaggctggtctcgaactcctgacctcaggtgatctgcctgcctcagcctcccaaagtgctgggattacaggtgtgagccaccacgcctggcctgagagtttaatttttaattcttaaattacccattaattaattaccattaattaagaatttttaatttttaaattacccatgttgtaattgcttcactgaaaaaaatgttcaattcctatgaaaactctttatttccccttctttctatttttacagtggcttacactggttcttttcctttgccatctactagaaggttggatttcttgaaggtccttttatctgtcctctctctctcatctaggtggtctcatgtgcttcctcgagataacgtgcatctgtttgcaaatttgtaaacatggtgatatatggtgcctatagacaatgctcatatctatatgtgcagcctcaacttctcttctttttttaattttcaatgaccattttaccaaatcaacttttcgtctgaactctgagatggcccttgtgtgttgctgaggccctttaaactcagcacaatccaaatgggaatcattcatcttcctttaccttctctaattctgaatttctaatcttgatcatcagtttatccccaaatctagaagtcgtccctgatgccttcctccccttaacctcccacagccagttgatcaccaatcctttggagcctaaatacggggtgtgcattgctttcttctcatgcccagcgtcactgcctccagtggtttgctccagtgactgcctgggcaatcacagtagtctgtaacatgcatactgctgctcacctcttcacatgacagactcttgagacctccagtagtcggtgtgccaaaacagtggtctacttctcatgctcttgctggaaaagcctcagtaattcctcatgggacaccttagctaggtatagaaggcttatttattttatgtattattattattattattattatttgagatggagtcatgctctgtcacccaggctggggtgcagtggcgtgatcttggctcactgcaacctccgcttcccaggttcaagtgattctcttgcctcagcctcccaagtagctgggattacaggcacctggcaccatgcctggcaaatttttgtatttttagtagagatggggtttcaccatgttggccaggctggtcttgaactcctgacctcaagtgatccacccgcctcagcctcccaaagtgctgagattacaggcatgagccaccatgtctgtccactttatttttattttatagagatggggttctcatctctgtcacccactggagtgggtggtatgcagtggtgtaatgataaatcactgtaacctcaatctcctgagcgcaagtgattctacccccaacccttgcctcagcctccgagatagctgggactacaggcatgcggcaccatgctcagttaattatttttattttttgtagatacagagtctcactgtgttgcccaggctggtcttgaactctggcctcaagcaatcctcccaccttagaaggctttttatgttttatcgatcctgcctattttccaccctcgtttgccagtaactcttcatgtaacactgtattagtctgttctcacgctgccagacatacccgagactgggtaatttataaaggaaagaggtttaatggactcacagttccatgtggctggggaggcctcaccatcatggcagaagaacaaggaagagcagaaggatgtcttacatggcagcaggcaagagagaatgagagccatgtgaaaaggaaaactccttataaaaccatcagatctcatgagacttattcactaccatgagaacagtatgggggaaactgcccccatgattcaattatctcccaccaggtccctcccataacatatgggaattatgggagctataattgaagatgagatttgggtggggacacaaccaaactgtatccaacactttagctgagtatgaaaagttcttcatgctttagcatctgtcttttccctggcctcatcttctgctgttacccaccttgatccttcagtcctgcattgtctaatatggtggccatttgtcatatgtgactgttgaacagttgaaatgtagctggttcaaattgagatatactgtaaattaaaatatacactggattttagacttagtctgaaacacaaaagatgtaaaatattttaataataatttattatgttggaattataatattttgactacattgggttaagtaactcaaatatattattaaaattaacctggccaggcatggtggctcgtgcatgtaatcctagcacttgggaggccaaggtgggccaatcgcttgagcccaggaattcgagaccaggctgggcaacatggtgaaaccccgtctctacaaaaaaatacaaaaaattagccaggcgttggtgactggcacctgtagtccaagctgcttgagaggctgaggtgggaggatcacctgagcccaggaggttgaggctgcggtgagctgtgattgtgccactacacgccagcctgggtgacagagtaagaaacaccctgtctcaaaaaataaaaattaaaaataaaaataaaattaatttgacatattcctttttactctttgaaatgtagctcctaaccaatttgaaggtagatgtgtggtgctcttagtctgttggacagctccgttttagcctttttttttttctttttttaaaagagatggggtcttaagctatgttgcccaggctggacttgagctcccgggctcaagtgatcttcccacctcggcctcctgatgccattggcactacagtcgtgcctcaccatgcccagctcgctgcagactcttgttaggcaaagtgtggtttttaggtcagcatatccgcatcacctgggagctcgttagaactgcagaatctcagcccctgccccatacctgctgaatcagaacccatattttaacaacgtgattcagtcacatggtaaaaagtttgctgagtgctgctttagagaatgatttgctggtctcccagcatcctctgttatttgaggctttgcagaggttctgagacattcacagttttgtggaaggctttgctcagaatacatcacccaggcgaagtggccctaactgtccatccccagtcatgtggaatgccctcggtggccctctgtaatcattggtcttgcagcatcctcaagcctacttgacccgggaggtccctgagagtggggactggctctgtttcattgctggtatcgcgggcatattgcctggcatgtaatagatcctcaaatattaaagtcctttaaacacagcttacacgtagccttgagatgggatgaacgactgcacattgttacactgttctgagcaccgttaggtcctttgtccccttcctttttatgaggaccatctaagacaaggtaacttgggctgagagtgatctgtctggatcatgcaggtcgtacatggagtcaggatccctgaagtctccatctgggtgacatcacagctgcagatttctttttttttttttttttaaatgaaacagcatcttgctgtgtcacccaggctggagtgcagtggcgtgatcacagttccctgcagccttgacctcctgggctcaagcaatcctcctgccttagccccctgagtagctgggaccacaggcacacaccaccccaacttctgacttggttttttgtttttttttttttgtggagatgggggtcttactatgttgcccaggttggtcttgaactcctgagctcaagcagtcctcctgcctcagcctcccaaagtgctgggattacagttgggagccaccacccctggtagcatcccagctctttctccctctttacctccttgctaaacaagacactcaagcctatcttactgtgtaagccacatgagccatacaaagacttcttaaaaataattttttaaaaatttgtaggctgaaaagattttagatttttttttctaaaacagaaatgcacacagcagccttgctttgcggtaacccttggttccatgggtatgggactggctcaggtgccagaggctgggtggagaggcaggcctccatgctgtctctttggtgcctgcccccaggactccagagaagggtgcccggcgcttttcccacccgatggtgctccgtgcctcctgtcaggaagaaagcagaactgactgccacacactaccagattcaggagcctctcctgtcttcctgggaaggtggttttgatgaggtactgatgaacttgggcctggtttttacaaaatgaacatagccatcagttgtgacattgcacacagccaactcttaggaggggccgccatcacagaccacctccggacacagaagtcaggattttagggttttctcctgtgcatgcagtatactccatgggcatacaagggaaaagcagtgctggtgagaatctgccagcactgttgggcagcacgggttctcgacaggtattgttttatgtgcgtgtggtggatataaggaccaccaaccagtctcgataacaaatctagccgtttaaacatccacagacattttaacggtcctaatctgtggtcactcacagtgtctggccttgggaagatggactgggtgggttaaggaaggcccactgggttaactagatcgtgcccgggttgggaggatggcacgttaaattctgtggtgtctgatgtctctttctgttagctccccgtcttcctttgacaactccccagtggatgaggtctttggagaggtggaggctgaaggagcatggctcatggtgcagcaggaggtggtgtgtgacttaacactccttcccaggactctgagtctcaagcagggcaaggctgggtgcagtcagctctgtggcctgctgtggctgatgggccggggcccagagacaacagcttggatgcaacggtctacaagcccagcctccccaggctccttgtctctggctcatttctgaccctttacctaagactttcaacaatccttacattcctggtagcatcttagtgaatcaccctttcgcttagatataggaattcatttccgttgcttgcaaccaagaaaaccatagcctgaaacagcctagtaggaagcctgcagacctgagatcagtgggaccttaccactttgttatttgtggccctctggaaacgtgccatctgacccactgcaaggaagagtctctgcttcagaaggtcagaggagcggcatcctgagactggctgtggtgagctggtgggtgcagctgtctcctgcacactgacctgggtggctgtccccagacctctgaaaattgggaggaaccagggtttccttttactttaccctcaccagcactgcccagtctggagccctggagggtggaacgttgtaggaatgactcctgggctctgtagaacccctactgtatgccagcagctttgcattatgccgtgagttcctgggctctgggaactgctgttgtcccgtgtcaccaagtcacatggcattggagtggtgcagtcagaatccacatagcagccaggcacagtggctcatatctgtaatcccagcactttgggaggctgaggtgggtggatcatttgaggtcaggagttcgagacgagcttgcttggccaacatggtgagaccctcatgtctactaaaaaaaaaaaaaatacaaaagttagccaggagtggtggtgtgtgcctgtaatctcactccggaggctgaggtagaagaattgcttgaacctgggagacggaggttgcagtgagccgagatcgcaccactgctctccagcctgggcgacagagcgagactgtctcaaaaaataaaaaataaaaaaataaaagaatccaagtagcatctgccaaatctccactgtgctccaggcactgttcaactttatgtgaacttcacagtggttctgtggggtaggtttatacagttgttattggtgctatgatctgaatatttctgtccccccaaaattccggtgttgaaatcctaacccacaaggtgatggtattaggaggtgggggccgggtgtggtggctcacgcctgtaatcccactttgtggggctgaggtgggcagatcacttgaggtcaggagtttgagaccagcctggccaacatggtgaaaccctgtctctactaaagattaaaaaattagccgggcatggttggcaagtgcctgtaatcccagctgctcgggaggctgaggcagaatgtagggctgatactggagttgggtcttctatagcggagggaagtcagggatggaggccaagatgggctgattttcctgctgctgctaaaaggaaaccaattaatgggagaagacttgagttgggacttaaggagagtatctgttgtggttctcacgagttggagtggcatcgcttgaacctgggaggcggaggttgcagtgagctgagatcacgccgttgcactccagcctgggtgacagagtgaaactgtgtctcaaaaaaaaaaaaaaaacaaaaacaagaggtggggtctttgggaggtgattaggaatggggtcagtgcccttataaaagagactcaggtagttcttcctcccttccatcctgtgaggacacagtgagaaggcgcctcctacaaaccaggaagtaggtccacagcagacactgaatccgccatgtcttgaccttggactcccagcctccagagctatgagcaatacatttctgctgtttttgagcctcctagcctgtggtgttttgttacagcatcttgaactaagacagttagtgaggagcgttaggcttagagaggttgagaaacctgcccgtggttatggcagggccagtctcttcactcgcacagcaggcacatcgctggggcccatgaacatgttctagttttcacaagaagaaaatgaacttttaggtccccaaaaatgtttcgagataacatttcaatatttaatgatttactatataatattaatatatataaaataatcaaatacatcaagttaaacagattaattgaaatacattaatgatctagattgtgtgtatatatatatgtatgtatatatatgtgtatatatatgtgtgtgtatatatatatatatctgtctccttgtgccagcacaatcatcacatgcaactttaatcctttttttttttttttgagacagagtctcactctgtcgcccaggctggagtgcagtggcactatccgggctcactgcaacctccagtgtatatatatgtgtgtgtatatatatatatctgtctccttgtgccagcacaatcatcacatgcaactttaatccttttttttttttttgagacagagtctcactctgtcgcccaggctggagtgcagtggcactatccgggctcactgcaacctccacctcccgggttcaagcaattctcatgcttcagcctcccaagtagctgggattacaagcctgcgccaccatacctggctaatttttgtatttttagtcgagctgggctttcaccatgttagccaggctgttctccaactcctgggctcaaggtatcctcctgcattggcctcccaaagtgctgggattacaggcgtgagccaccacgcctggcccaactttaatccttttttatggagatggggtctagggaaggcctgccgggccctgggtcgcagctggcaagtgaaggggttgggttcccacccattctgtctggattcaggagcctcatgaaggtccctgcctcgagtatgtctgagcctggatgatcccccagcagggtcacagccagccccgtcgccatgcctagcgcataacagatgctcagtagatgtttggtaggtgcaggaaagccagcctgtgaaagggcgctcatccttcctgcattcaagcatcaagcctggtcattctgctgctttgtttcaggcgtgcgagtttgggggcaaatgtcagagtgtccccaggagcaagcaggttgcacagggggctgtttccatgagcctgggctgaggggacctgttgggaggccggcagccctgggagacaggaacaggcttcaggtgtttctaaggatcaaggccttggcgtattgcaaagacattacaaaatcaggcttccagaggcctcatagcaacaggcgtgtcacatagcctgtgctgtgccacggaaataaaacccgagttcaggactgcatgctgcctgctggtctaggccgtaaaaaaagctgtccatgccccaacaaaaaagtaaagcagagaaattagactcctgagattaatttgcttttctttcctgttttccacattgcttgtagcaaggtgatgcttttctgtgaaaaggcatttctcactgtctaaagggagcccttctgtgatcctccctgagagcagcccttctgagtgtcctttcctgcccgccctaggctgccaggctcctgctgctaacttgactgcttctgaagtctctttttaaggttcaatgtcaaggggaggtcagagaggggcgtggttcagcaggaaaagaggaagagagcctgacttgtgaccatcctgggtgccaggcacacctgagcacatgcagccccgagcttttggcctggacaagcccaggcctggcaccgcagggagaactggtctgtggattgtctccacagcctgatttcctcccagactttgccccgcttggagcattccgatctccggtgtttgagggtttcatccagtaaatacggtagtacttcaccctctcagattaaaggtgtgctgtgcagcctgggagttcctttacttgggggtggtcggggaggctgaaggaagccttcctgcacttcttttttcttgagttttttaattattaaaaatggagactgtgcgctgtggctcacacctgtaatcccagtgctttgggaggatcactggagcccaggagttcgagaccagactgggcaatatagtgagactctgtctctacaaaaaaaaaaaaaaaaattagccaggtgtggtggtgcacacctatagtcccacctacttgggagcctgaggctggaggatttggcttgagtcagagagttggaggctgcagtgagctatcattacggcactgtactccagcctaggtgacagagtgagaccctgtctcaaaaaatttttttaaaataagtggatataatggttgggcgcagtggttcacgcctgtaatcccagcactttgggaggccaaggtgggtggatcacctgaggtcaggagttcgagaccagcctggccaacgtggtgaaaccctgtctccactaaaaatacaaaaattagccaggcgtggtatcaggcgcctataatcccagctactcgggaggctgaggcaagagaatcgcttgaacctgggaagcggaggttgcagtgagccaagttcgcgccattgcactccagcctgggggacaagagtgaacttcgtctcaaaaaaaaaataataaaaataaatggatgtaattcacatgtcacaaaattcgccatgttaaagggtacagtttagtggtattttttctgtatattcactgacttgtgcaatcatcactttaattccagaacatttttatcaccccaaaaaagaatccctacatccattagtactccctcccctttccctcccttcccccaaatcccacccccacactgatctgctttctcttattagtcagggttctctagagagacagaactaataggaaatatatatgaagaggagtttattaagtattaactcacatgatcacaatgtcccacagtaggccatctgcaagctgaggagcaaggagagccagtccgagtcccaaaactgaagaacctggagtctgatgtttgaggccaggaagcatccagcacgggagaaagatgtaggctagaccagtctctccttttcacgcctttttgtctgctttagattagatggtgcccaccagattgagggcagatctgccttccccagcccactgactcaaatgttaatctcttttggcaacaccctcacagacacacccaggatcaatacttggtattcttcaatccaatcaagttgacactcagtattaaccatcacaagtccaccccttgtcaatgtgagatcgtacataatcttcaagtaaagacaatggtaaggtcataattacgcctaacatgcaactatcctttgtataaccagaaatgcatcattccccaacccaaatactattacataaagctgataatacttaaatgctgatatgaagtcaataaatctttttttgagacagagtctcgctctgttgcccaggctggagtgcagtggcacgatctcagctcactgcaacctctgcctcctgggttcaagcgattctcctgcctcagcctcccgagtagctgggactacaggcgtgcaccacgatgccagccaatttttttgtgtgtgtgtttttagtagagacggggtttcaccatgttttccaggctggtctcgaactcctgacctcaagtgatccacctgccttggcctcccaaagtgctgggattacaggcgtgagtcactgcgcccagcctgaagtcaataaatcttatgtcacacgataagggaaaagaaaagaaaataaagatattttcctagcactagtacaagtgtatacatgcgcaaacatggttttagcaaaaggaggaggaaatactcatgacaattgcagtccccatgtctgcagctggtcacatggttgtagctggtactgatgactaccctcttctactacccattctgtattccctttgccttcagcaagcaccttagctggttgtgtgtttttttttgcctggtggagtgacccaaaccttcattcctgaagggtctgggtcatttgtagtccggcctggattgggctgttgtagtgtccccttgaccttaatcacagggcatggtaatactaagagacgccctaatgggtctcctgtattgcatgcatactcttccctagttccattgcggagtagtagactgattttatctgatagtctgggtcagtcaccccagccaacactgtaactcccttcttagcctgttgacttaaaggtaggaggagcccaaagcacccaggtggcaatctgaacttccagtttaatggaatcattgttgtgtctcctggtggcagcgttcctccctctggaactaagaccccctaggccagcagaacgtaatgttgcaggaacaggaagcaaaaattttgctagtggatcactaggggtgatggtgagttttgccacttctacttgcaccccttgatttctggactcgtgaatcctggctatgggagaaacagtaccatatattgggcgctgattcagagcatacatggccttctgaagaactttgccccagccctgcaaagtattgtcacctaattggtgttataattgtgacttcaaaaggccattccaccgttctattaatccagctgcttcaggatgaaggggaacatggtaagaccagtgaattccatgagcatgaacccactgccacacttctttagctatgaaatgagtgccttagaggcgatgctgtgtggaataccatgatggtggataaggcattccgtgagtccacagatggtagtcttggcagaagcatcgcgtgcaggataggcaaacccatatctggagtaagtgtctattccagtgaggacaaccctctgcccttgccatgatggaagaggtccagtataatcaacctgccaccaggtagctggctgatcaccctgaggaatggtgccatatcaagggctcagtgttggtctctgctgctggcaaattgggtacccagcagtggccatagccaggtcagccttggtgagtggaagtccatgttgctgagtccatgtgtaacctccgtccctgccaccatggccactttgttcatgggcccattgggcgatgacgggtggctgggaaaagaggctgagtggtgtccacagaaagggtcatcctatccagttgattattaaaatcctactctactgaggtcacctgttggtgagcactcacatgggatacaaatatcttcacagtttttgaccactcagagaggtccatccacatacctcatccccgaatttctttgtcaccaattttccaatcatgcttcttcccgtgaattcagcccatgaatcagtatataatcacacatctggccatttctctgtccatgcaaagtgcacaaccaggtgcactgctccaagttctgcccactggaaagatttcccttcaccgctgtccttcggggtgtcgtagaaaggggctgtagtggtgccactctctattttggggtggtgtctgcatatcatgcagaactgtctgtgaaccagaccctagtcttctcttcctctgtcagctgatcatagggaactccccatgagactattggtgcaggctgggggagagaagacagggtggcagagtggagaccatgggcatttgagccatttcctcatgtaacttacttgtgccttcaggacctgcttgagcccgatcacgtatataccacttccatttgatgatggaatgctgctgtgcacacccagctttatggctagatgggccagaaagcatccagttcatgataggtagttcaggtcgcatggtgacttgatgacccatagtcaaatgttcagtttctgccaaagcccagtaacaggccaagagctttatctcaaaaggagagtagttgtctgcagaagatggcagggccttgctccaaaatcctagaggcctccactgtgattcacttatgggggcctgccaaaggctccaaacagcatccttatctgccactctcacctcaggcaccattggatcatacggcccaagtggcagagcagcttgcacagcagcctggacctgttgcagagccttctccagttctggaccccattcaaaactggcagcctttcgggtcactcgataaatgggttggagtaacacacccaaatgaggtgttgcctccaaaatccaaataggcccactaagcgttgttgtgcctctttcttgcttgtaggagaggccaaatgcagcaacttattcttcaccttggaatatctcgacaggccccataccattggacccctagaaattttactgaggtagaaggtccgtgaattttagtcagatttatttcccatcctctggcacgcaaatgtctcaccaataagtccagtgtgtttgctacttcttgttcactggatccaattggtataatatcatcaatgcagtggaccagtgtgatgtcttagggaagcgaaaagcaatcaaggtctctctgaacaagattatgacacaaagctggagaggtgatataccactgaggtaggacagtaaaggtatattgctgctgaagacaaattgcttctggtgggccttgtggacaggaatggagaaaaaggcatttgccaagtcaatggccgcataccaggtaccaggagatgtgttagtttgctcaagcagtgaaaccacatctggtacagcagctgcaactgaaatcaccacttggtgaagcttacgataatccagtgtcattctccaagatccatctgtcttctgcacgggctaaatgggagagttgaacggggatgtggtgggaatcaccacccgtgtgtctttcaagtccttgatggtgacattaatttctgcaatccttctggggatgtgacattgtttttgatttactctttttctaggtagaggcagctctaatggcttccactgggcctttcccaccatagtagccctcgccctaccagtcagggagccaatgtgggggttctgccagctgctgagtatgtctatgccaattatgcattctggcactggggaaatgaccacaggatgagtctggggacccactgtaagtcggacctgagctaaaactccattaattaccatacctccataagcccctacttcaactggaggaccacagtgacgttttggctcccttggaatcaacgtcagctcagagccagtgtccagtagtccccaaaatgtctgatcatttccctttccccaatgcacagttaccctggctaaagtccagaggtctcattggggaaggatgggagaaagagtcaccacataaattgttcgtaatgtagtggggtccttcctcaaggggacctggcctcctcttcattcaagggattctgggtctgtaaactggctcaagtctggaaattgattgaggggctgtgattctctgtttttataattcaaattagtcttttgtccattcgacccagaagttttctgcttatataaattcagtaggaaggcagtaggcttcctatcgatttcccttctaggaacaccatgattaattagccagtgccagagctgtacacgagtcagactattctgattgccgctttgcctctgctgtccattatggtagctacgcacaccttgcctttgacggttgagtgtcatcacttggctcctgccacctcgggatccaattattcccatcatatttaaattttgtagttgcgtgactgcagttcccaccattagatctgacatacagggaagaacaattacagggctcttcaaagatgcaggtgctgccctcacgaatctattttgcaaggcattggttaagggtatgtcttctggaccctcccagctgggatgagtaggtctaaagtggctaatccactccaccatcccaatctccctaagcctttggatcccttcctctacattaaaccaagggagatcaggcatttccagctcactcccagtgggccatcttttaatccatagttcagctaaccaagcaaataaactcttagaacctttttttaactccccagctgcaacattaaaagcagagtccctacttagtgggcccaaatcaataaattcagcctgatccaactctgtgttctttccaccattatcccatacccttaatatctattcccatgcctgttctccaagatttctgtttatatcaattatagaactcaaatggttcttttcgagtgtagcgcacctcctcatgggtcacattctcaacctcacctctaggggcctgctgggactttagtgataggtctagaagcaaacaggggtgtcgggggtggctcctgagaagaatcaacatattttgcctggcaattgcctcaggggaggccatcactgttgcctcaggcagcacagggtttatctcctcagacaaaggtggaaaggctgatggcagccatgggtcagggaagggatgttgccattacaggggatggggaagctgttccttctggcaaaaaaggttcatcggagtttacaaactcagtgtccccagcttcatcagggttctccctcaccgtccccattccaagttgcagggtcctattcttttcgaatcaatgccctcactttaacagtagacacctggcgaggctgtgcatgcatctttcattgaaggtcagcccctcgcatgataagagcatgtgtctgtttttccacaatttcagctctttctctacaggagataagactctcactcagggcaatcttagcagatttgaggctcagtatctgcttttgaagccgggagacagaatccccaagttcatcattttctttcatcactttgcccactgaacttaggagcaaccaaccaacttcattatattccttggttttccacatatggtcaaaggtattatgtatagagtcactaaactccttgcctctcatgagcagtgaatcaggagtgtcaaatgcatttattttgcataactctctaaatggtttatgccaaggactatcagtgttctccatactatgagaagtggagtccttagcattttggagtctaatcatattaagcaggcaactccagaaacctcaacccacaaaagaacttcatccttaatattctgttcctctagaaccactctttgtaccaaaatctgtattagggttctctagagtgacagaactaataggatagatatacatattatgtgtgtgtgtgtgtgtgtgtgtgtgtgtgtgtgtgtgtgtgtgtgtatataatatctcctatatatctcatatgtatatatcatatatagagatccattatatatatatatcctatatctatcctatatctatatcctatatctatatctatatctatatctatatctataaaggggagtttattaagtattacatcccacaatcacaaggtcccacagtaggccatctgcaagctgaggagcaaggagagctggtccgagtcccaaaactgaagaacttggagtctgatgttcgagggcagaagcatccagcatgggagaaagatgtaggctgggaggctagaccagtctctccttttcacgtctttctgtctgcttaatatttgctgacagctgattagattgtgcccaccagattaagggtggatctgccttccccagcccactgactcaaatgtaatctcttttggcaacaccctcacagacacacccaggatcagtagtttgtatccttcgatccagtcaagttgacactcagtattaaccatcacagttactatgtacggatttgcctattctggacatttcatgtcagtgggatcgtagaatatgtggtcatttgtgtctggtttatctcagtataatgtttggagattcatccatgttgtagtgtgtatcagtcattccttttcatgtctgaatgctattgtcctatgggaatggactgcgttttgttcatatcctttgatggacatgtgggtggttctcctttgtgattcttgtaaataatgctgctgtgtggacaagttttcaattctcctgagtattttccttgtgtttcaagctttttaacctcagtgccccaggcatagcgcttgtgatttcctgagcacatgggtggcgcatccctgatgaatcaaaagaataggattggtcattttggcttcacggctgttgaagcaaaattaaaactcacaatttcaaaggtcataggatttttgtcctgaccccggtgggtgtgggcccctgcagggctccgacagaggtggtcagcatgtctgctgagccttcaggaagacatgcctggtcaccggcatccttgtggtccttgtggtggcagtttgtggttagctcagccttaccccctgctgctgctgctgctgctgctgctgctgctactttctgagcaggagcatgggagtctttcaccctccctgcgaagtggacatggggttgattctggggttcagacagcgagcggggtccctgtagcccaagggtgatagtgctcgggacggtgtccccccttagacatgagctgctctcttgtcatttcccactccttcacttcccagcaacaacacagcttcagaccaaaatcaaaaccttcacctcttcatcatttctggttatatttcagaaacccgtgctatagggggatccctcaacaaacttaaattttccagatttaggggacattggcagtatcttcatcataacattgtagggtttgtaaggttttctgttgaatatttttctttttcttttttttaagagacgttgtcctgctctgttgcccaagctggagtgcagtggtgtgaccttgcctcactgcagccttcaattcctgggctcaagtgatcctcctacctcagcctcctgagtaggtgggactacaggcacccgtcacccatgcccagctaatttctgtattttttgtagagacaggatttcacgatgttggccaggctggtctcaaacccctgacctcaagtgatccacccacctcggcctcccaaagtgctgagattataggtgtgagccaccacacccaacctccctctaactttttttttttttttcagtatgtctaaacattttggaattgtaatttaaatcataagggcaaaagctgaaaattaatgcttaggtttactagtaagtgcacccttccctgtttcccccaaataaaatcagtttattttttaattgtaccccaaagcaagttctctcagtacgaagcaactactgcgtacacacaaaatggttgttaatgtaataacttccctggctcacccaacgtgcagtgcacacgacttcaaagactacaatttagggcaagtatacatgaaatgagaaaacaactctctaagtttcaaaacctgctgttaaattatttctaggacactcaggtcatatttacttctcagtaggatgttgcactgtcatttggttatcagtctacctcgcagtgtacattaccagatgccaattggagggactagagataaaacttatgtagtactatttcttaatgggctgaataaggtaattacaaataagtttgccttacatcctgttgaagacctctttacagcctcagtacctaacaatatctagcagcctccaagaatgctcatcaggtgaaacgatgatgtaacatttgaaaatggagccagatacttcagcttaagtcattcagagccaaatatctgaagaatggccaaaatcaaatctttatttttataactgtataaatgtgatccaaatgtgtccaccaccagtttttcaaaaagaaacatgctataaataagcaaactacatctgctcactgatgtgtgtatggactccctggatgtctcattgagcttaattacagaccactcacagtaatggatttttagtgtatagtgtagcttgatgttaagccattttagcttttgcgcatacatgttgtgctggctggtaacggagaagaatttgcagcattacaatgttaagctaggttgtatccatcccattaaatggcatcaatatcaatgtcatcatccttgttgttggactttacagtttcaactttaggtacactggcagtcttctaatacaccacctcaatgttctcatcttcatcttcttcaccaccagaagattcttcctctgcctccattttataaatggttctactttgacacgaatctctttggcaggttcttttgagacatgtttcttaaaggcctttttccgaccagctgatgacgacctcttcttctaaaaaatctacatcatacatctccttcaagatatttggaatcttagagataagctgagcttggtgcattgctaccccacacgtaaagccatgaagaaggtaccattgagcttttttgttgttgtgacaaaatcataagaaatggtgcctgtatttcttatgtgttctctaatctcctctttaaaaagaacttcagtcagaacaagagggcccatggctttaacatccagtccttctgcttcagtaacaatttctttgtcacataaatcaatgataccctcttctttctttttcttcacaaaatcaaacaggatgttggcccgctcctcaactgttttttccaaatcatcatggagtatcagaacttttgcatgatcactgatttcatccattctgcacctttgagcttcctcagttgtatcttccccccagtcatcctcctcttcttccactgtatgtggaggagggctaatttctttggtggtggtgtctcactgctggatacggagccattttccttgtctttgccctttatatttttcttttccttttctttctttcctgtaccactgtcactattctcaggtgggtttttgagaatgaatgtgcagagtttatgatgtgtgtcaagcatgcctcgatagccacaggctttataagaattacctattgtttgctgctttggcttgacatgcatatctgtttcaggattctcacattcaggacagagaacaaattttttaatgagtccatccaatatgtcttgcagcttattggcctcctgagatccattcacaatgtaacaatgtatcccaccaaaatacttggtgggataccttggaggccaattaagcgcctttgcagtgtcagtcatgttgactataactgtcttgattccatttcctttgccctcaaccttggcaatcagacagggcatcttgtaatagaactggtctgatatgctggggttgacgttgacagacattttggcttattggtggctttatcaataagatgaagagatctttgattgcagcttttttatatcttctgtctggagaagaagggatgacataaacaactgcaaaagttctcggtctctaatgtgaaaacattttcaccactgaggctgtaagcgtcttgcttgtatgctatgtttccccaatacaggtactaatggctgcgcaaaagctcttctggtgaaggcctccctgctctcccacgcttgaaaagcgctgtccttcatgcttccctgtcaccttgctcctagcaggcatcacgtcgagtccaccctgccagtttatctttttttttttttttttttcttgagagggagtctcgctctgttgcccaggctggattgcagtggcgtgatcttggctcactgcaacttccgccacctgggttcaagcgattctcctgcctcagcctcctgagtagctgggactacaggcacctgccaccacacccagctaatttttttaatttttatttttagtagagatggggtttcactatgttgtccaggctggtcttgaactcctgacctcaagtgatctgcctgcctaggcctcccaaagtgttgggattacaggcatgagccaccgtgcctggctccctccacctttaaaattttttttttttttcagattatgtttttcgagcctcaagatttattttattgcagtattttttttttttttgtaaatatgaagagttgtccagtagagtctcatcatatgtcgactgaagctggcaccatcctatggcccacagaggcttctgtaactgggtcttcaacatgtggccctccctccatcctttcccaccctctttgctccagccacagccagcttccagcttctagaagcagcctgcattcctcccccacccttttttaaatagagtcttgctctgtcacccaggctggagtgcagtggtacaatcatagctcactgcagtcttgaattcccgggcttaagcaatcctcccacctcagccctcccaagtagctgggactacaggtgcaccaccgtgccctgctaattaaaaaggttttttttagagatgagttctcaccatgttgcccaggctggtctcaaactcctgggctcaagtgatcctcctgccttggtctcccaaattgctaggattactggtgtgtgccactgtacctggccttcctttttcttttgaaaaaatccttaggttttaataaaattccacgtcctccattctctgaaatctgtatgaagtaccagaagtctcaatttgacaatagacatggtcaggatatttctaatgtttggatgatcctctgcaaactagaggccagcagacttctgtaaagggccagagagtaaatatttttggctctgtgggccaaattactcctctgtgctgtatagcatgaacgctgctgtagacagtatgtaaatgaaaggattgtgtgccaataaatctttatttacaaaagcaggcattgagcagtaattggcatcctggctggggcttgctgtccttggtaagcagtggttttcaaagtatggttcccagaccagcagcatcagtatcccctgggaacttggtagggatgaaaattcttggaccccactctagacctaccgaaccccaaaccagaagttaggaatcatctgggtgatgctaatgctggctccacacagcagagcagttctctgtacaactgctctacagagatgtggcctgtctgccatttgtattctaattagcatgtgcaaaacctcggaatcacggttgctgggacccagggacctgaattttaacaactggctcagatggttttatacacactgaaatcggaaccagtttctaaagcagcacttctctgaaccagtagaggacgtgggggaggcgtcagggaagtttttcaaactacagcctgagcttgcttggggtactttgcaagaaggagggggtaaatgtggaaaatgggagcagttgtggctttttgttagcttattgtgaactctgcccctggtacctggtctgggaaggtggatttatttcttttctcctacatgtaatgcgtgttttgaaacccaggaatttctgaaattttaaagcctgttggttgtaataaatattgcaccccaccacatttgctaccacatttgcgaacttttatttagtatttgaagtgaaaacgggttgagaaatataccgtatgatccattggtatcaaatatcttgaatatgcaaatgcttcaaatgcttgaatatgcaaaggcagcaaaatggtggttaccggggcggagtgcagaggggagggtctgccagcaggcgtggggtttctgttggggtgatgaaaatgttctggacttagagagtggtggttgcacaactctgtgaatatactaaaaaccctttgattctatactgtaaagaggtaaattttatcgtatgtgagttatactcaagaaagcagttatttaaaaaaaggaaatgggtcgaggtgtgtgttcagccttattcttgaattgtagagacctcactgagaggaggctgaccctgaaggcccctgttagagcccatcctggggcagttcttcagtggccctgaattcgtgtcacagggatcatcactaagctgtgatttttggtgctggatctgacccaggagcagacaggcctgggaaagagtgtgtgttgtttaaggagcctcacctctgagtgggtgaaccccgattgagggagaaactcacatggtgttcctccagggcatgtagctggaaggccccctgggctgaggagctagtggcagcctgcaggttaggggaaggggggaggaggctgcagtgggggaggtgggcaggagccagggccttgctccagggcagtgggagccatggaagacttttaagcagggtgtggtggcaaagaccacttgtaatagaagggcaaatgggtacaggagttacagggaggaattaggaagccttgtcctaccagcagtgatagagaaaagttaagggatgcgagtggtaccaccacggcacagtatccgcatctggtgcagggatggagaatcctggtgcctgaacacacgtgtgcatctgtgcatgactgcttgcctctccctccctccatcccatctgcctgggggaggcgagggctgagcagggatcagtcctgggagtcctggctcctggatctgtgctcagtgccacgcaggtggcagctccagaaagctctgcggagggaatggccaaatctggtgcagaccagctcctctctgcccaggtgtggctaggctgcttcaacatgcttgcttagtgccaggaggaggaggaggagtgctcagtgcctccgggcaggagcggacctccctggggctctgtcccttctctgaggactcccagcaaacactggcagcgggggtcttcaatgcactgtcctaactgcttgggcaggaaatgaagcaatttgttggaaaaactcaattttgagaataagaataataattcttcttcttcttcttcttcttcttcttctccttctccttctcctcctcctcctcctcctcctcctcctcctcctcctcctcctcctcccttctcccttctcctcctccttctcccttctccttctccttctcccttctccttctcccttctccttctccttcttccttcttcttcttttcttcttcttcttcttctcctcctcctcctccttctcctcttcctcctcctcctcctcctcctcctccttcttctcttcttcttcttcatatttttagagacagggtctcactcttgctcaaactggagtacagtggcatgatcattggtcactgcagccttaaactcccaggcttaagctatcctcctgcctcagcctcccaagtagctgggactaaaggcttgtgtcaccatgcctggctaatttttcgatttttagtagagacaaggtcttgctatgttgcccaggctggtgtggaactcctggcctcaagtgatcttgtctctgccaatttcatgttattcttaaacataagattttatttgaatggtcaccataaatagatcttatttttgtagttatgtcttcactgcatgtaaaattgtatagtgtgctaggaaaacagaatcaggtagtagttacttctcccaggaagaggcaggatctatacgaagtcatttttgctttttgctttgtttttggtaataatcatggaattatgctccagatttacatggagaaacaacattttttttcttttttcttttttcttttttctttttttttttttgagacagggtcttgctcgtttgcccaggttggaatgcagtggcgcaatcacagctcactgcaacctccacctcccaggctcaagtgatcctcccacctcagcctgctgaggagctgggactataggcatgtactaccaagcccagctaattttaaaattttttgtagagacaaggttttgccatgtttcccaggctggtctcctgggctcaaagtatcctcctgccttggccttccaaagtgctgggattacaggcgtgagccactgcagcgtcccaagaaataacatttgggtatgaagtgaatgaggctcgtttacattccaggttttcccccaaatctttttagtttaaacaacagcttaaaaattaaggtcggccgggtgctatggctcacacctgtaatcccagcactttgggaggccagggtgggtggatcacctgaggtcaggagttcgagaccagcctggccaacatggagaaacctcgcctctactaaaaatacaaaaaaaaaaaagctgggcgtggtggcaaatgcctataatcccagctactcaggaggctgaggcaggagaaactcttgaacctgggaggcggaggttgcagtgagcggagatcgcaccattgcactccagcctgggagacaagagccgaaactccgtctcaaaaataaataaataaatagaataaaatacaataaaagatcatggatttctagtaagagaagagaatatgtaagctggaaagcataaacctagaaatcttccattccatagattttgcccctctcttcctcccctccccacaaagaaataagtcatttggagcaaagcaattgcttaaacttttcttagctggtttccggagctccctgggaagaatgagggtggaaagctggaggggcgttctgggtattggaatgcaagccagtggatctgtagcccgctgtgcttctgggagcctgacacgacacacaaccggcacacaaccgttgtgcccttttgaactgtgcagggtcttagctgggctgggcagtttgacacggctgttttcaccatcaggacgttcacttatggttgagtacctggcaagggtagggagagaggaatgttcccagccatctcctgcgggacacttgggcggctttctccctgggacccccatctcgagatggcctcgggattgtggagggggtggcaggggtgctgggtttgctttcatgaaagagcaaagcagtttcccttctacttatcttgttttcagatgtagtggaataagccaggaaatatttctcctggatgaaaggtcattcttcttacattggaagctttggaaaaatctccctaaatatcaaaatacaaaggttatggaataatatgtgcttcgaatagcttaagtggttaaaaaattctctttgcagctcaatattaaaggaaaaataatagactgttcttggacaaaaatgaaagggatcacgaagaatgtgtttccagccagcttcctgcactggggttattgcaccaggactgtctccctagtagaggccctgtttactatgttgcttagtccttgcttcacaaaagcaatatttgaaccaataatcccacaacagcatgacattttaacttgtaagactttgggttttcacaacatggtgggagtctgttttggtattttgttctataaattcagttggggctgacaaaattaatgaactggcattttagagaaagtgacattgtaacttcccctcctcttcgcatgtttacatccacactgataaagatgcaatcttgtctgtagctcattctccaggaacttgagtgtcaaggacagtctgcacggcccttgggaaatgggcattccctggcattgagttgttaattggacgctgagtgctcgagctgcatttatggttccatatgtgggtgtatgtttgtgtttcagtgaggaagatagtagctgcttccctcccacagccttgtggaccctggctgcacatttgagttgcctgtttgacgctgtctgaccctttcttagccagtttctggagctccctgggaagaatgagggtggaaagctagaggggagtcctgggtattggaatgcaagccagtggatctgtagcctgctgtgcttctgggcacccaacacgacacacaaccgtgtgtgttcccacagaacctctgtgtgtgtctgaagccctctgggtgactccacctgtggccacagttgggagcaagcctgcctgggcctccgcctcctgcaaatgtgatagtccccacccagggtgggtgcatgtgcctctcacggtagcaactccatggcttgcctgaggtgggccaggttcttcgggggctaatgtctcaccgccctgtccagttctggttctcagtgaatgtgttatgccatcatgacctttgtcactttcttccccttgccttgtttttgcacattggaatttgcaagcgggtctgtggtcatccgaagttgtgctcttcatgcataacctggcctccacgcctcactgctgggctcggatgacacaggtgggagacttctgaatattagaagtttattggaacatctaaattgtattctaaataacctttttctttttttgacaggtatcattttcctttttttttaatctctatttctaagaataactttatcttcagctcttatccatcatttaaaaacaataacaaaagaggctggatgtgatggctcactcctgtaatcccagtgctttgggaggctgagctgagaggatcgcttgagctcaggggttcaagagcagtctgggcaatatggtgagaccccatctctacaaaaaaatacagaagatgtagctgggtgtggtggtgcacgcctgtagtcctaggtgcttgggaagctgaggtgggaggatcacttgagcccagggaagtcaaggctgcagtgagctgtgattgtgcctctgcactccgtccagggcgacagagagctaccctgtctccataaaaaagaaaaagaaaaacaagaagaaaagaaaagattactatgtacattctcatctttcaaagaacgaacaagatttgggaaaatgcaccaaggctcaaacgcttttgaaaggtggacagtggtagagaatgttgagtctttgggcctctggtcagcttttaaggccagggtgaaaacagacccttggaaatgttactgtgtattcagttaaataaaagaagggggatgactccattcctccagtgcagtggtgaaaccttggctgtgctccctgggggagctgcgaagcgctattgatggccaggctgcaccccaggccagttagtcaggagatggaggggcaggggcaggtattggtgattctaaagaacaccaggagagtccagtgtagcctggatggagggttatggtcttacatgttagccttgacatttttctttttctttttttttttttttttgagacagggtcttattgtgtcacccaggctggagtgcagtgacgtgatctgggctcactgcagcctcaaccacccaggttcaactgatcttcccatctcagcctcccagagtggtgggattacaggcatgagccaccacgcccagctagccttgactcttgttggcaggttaacagacaggcaccaagcattctctgcaaagctcatggtgaacattgagtccccccggccaggggcctgcctgagtttaatgaatgggtgtgttttctgagctcgagggggccacattggttctctttggtttgaggcgagggagcacgtcaacctttggtcaggctctggtggccaaggtgtcacaggaagggaaaaggtgtagtctgtgctgaggctggggccgagggattttcaagcagaaggagctccagggagtatggaatgcactctcctgccttggggagcagggagaccaatagacccaagcagttctgggaaagtaagtggtgctgctgtgtggggaggtggagcaaggaggagggaggaggccttcctccgctgagagaatagggtccttccgggtcggggtggttgggctgcattgtatggggtactagcgaaggacctagcaggtgccaggctaaatgctttccagcagggcttctctaagagtgctcttcccatcagcagcatcagcttcctctgggagcttgtccaaaatgcagaggctcaggtcctgccccagtcctgccctttaagggcagggtttcacactgctataaagaattacctaagactgggtaatttataaagaggcttaattgactcacagtttcacttggccgggaaggcctcaggaaacttacgatcatggtggaaggggaatacgcacatcttacgtggcagcagtcgagagagagcaggcaagagcagggaaaactgccttataaaaccatcagatcttgtgagaactcactatcacaagaactgcatggcgggggaatgcccccattatccaatcaccttctacctggtccgtcccttgacacatggggattatgagaattacgattcaagatgagatttgggtggggacacagaaccgaaccatatcaagggccttctcgaaggatgcttctgatcataggctggtgcttgggaacctcagcctgatagactttctcttatccattcctcatatgtgttccagggaagaagttattgttcttcttcttattattattgttgctttagtgacagagtattgctctgtcagagtaagccttacccaggctggagaccagtggcatgatgttaactcactgcaacctccaactctcccacctgagcctcccgggtagctgggactataggtgcctgctaccattcccagttaatgttatttttttttgtagagatggggtctcactatgttgcccaggctggtctcgaattcctgggctcaagtgatcctccagccttgcctcccaaagtgctgggatcacaggtgtgagccactgtgcccagctttcctgtctgtctatatctgtctatctgtctcttcatccacacatacaattttacgaatggcaaagcaacggttatttctattttgaacaggcaaatgacacctcagcagggtgtagcgtaaggaccatagcgctatctttgagttagtaaaccagatgctaatcctttgtgttgattgactttggatttaaaacctttgagcacaattttcacatatctgaagttgggaaggtaatgcttcctggggttgtttgtttttgtttttgtttttgttttttaaacagattctctctctgttgcccaggctggagtatagtggcacaatcttggctcactgcaaccttcacctcccaggttcaagtgattctcctgcctcagcctcctgagtagctgggactacaggcatgcgccaccacccccggctaacttttgtatttttagtagaggcggggtttcaccatgttagccaggctggtctcaaactcctgacctcaggtgatgcacccacctcagcctcacaaagtgctgagattacaggcatgagccaccacgcctggaccctggggctgagtagctgtcgccagtctacacatgccagctgttaccagcagcactagtcagagaccccacttttccagtgcccttgcagtaggtgtgattgctttgttggctaagagctgaccccagaggtttgtggtgacaaggaccagagccatcctttggaggtggagttccaatgatgcccaatcatgatgggggccgctgttgatccgtacacactccgattccttttcagcccttagggtggcagggacacattgagattctagggccaagagactgggagccagtcctagtacaaggcatttttttaaatatatggaaacaaggatggtgaatctggaagttgagaaattgcggttgcctgaaggtgactcacaagcgaaggtatttctaagccagaagaaagtatgattcagattgaaaacagaactcacacctgccggttgcggcagagtgatctgaacatgctcattacgacagtctagttggggtaggtacaaagcttatttatcatgcatgctttcaggatgagaaaaccaagggctcagatctaatacaatattattcaggtttcaggttcagttgatgcttttaggagagcattttggcccagttttttttatttttatttttattttttaagaatcattagctaatggtttcagaaaatacattagattatttcagattcacactggcatgtcttgggctctgcaagtctccctctctcacacacagtaagaaggtggccttctgcagtccaggaagagacccctcaccggaacctgattatgttgccatcttgatcttggacttcccagctccaggctgtgagaaatacgtttctttctttttgtatgtgtgctgggattacaggcatgggccaccgcacctggcagaaatacgtattgttgctattccctgctcccctctgcccctggtagcctctattccactttctggttctatgagtttaactgcttgaatctctttttgccatgtacacggagcagggggagtgctggcgcctggatggtggcctgaattttcttgctgcctagagtcgctgatccaccacagccatctgtctggaaagtggggtcagctgaattggaagtggcatcctgatgaatttccgacatagagcttgataattcttatccttcacccaaagattaaactggaagaaagcagcttgtggctaagaaaattgatcagtttagctgttacagggtctcaagtgaacccctggtttcttttttttttttttttttttttttttttttttttgagacagagtttcactctagttgcccaggctggagtgcaatggcgcgatcttggctcaccacaacctccacctcttgggttcgagcgattctcctgcctcagcctcccgagtagctgggattacaggcatgcaccaccatgcccggctaatatttttgtatttttagtagagacagggtttctccatgttggtcaggctggtcacgaactcctggacctcaggtgatctgcccgtctcggcctcccaaagtgctgggattacaacccctagtttcttagataactgtccagcctgttggcaaaggccagacattaacaccatgtgttgaatgcatgggtctcacgagaggcatcttgtgagttctgagtttaggcagaaggcgagagaagtcagattctgttgtgcgttagaggaaggcttaaggttgaacccatggaactacacacaggagagtggggagggaaactgaggaaaacactgacttttgtcagaaaagactgtttcagaggggaaaccgaaatagctggttagtgccgtagatgtggtttgtcaacatggcactatcgacatttggggcttgatgattctttgctgtggggacttttctgtggattgtaggatatttagcaacatcttggcatctgtctccaaatgaggacaaccaaaactgtttctagacattgccaagtgtctaggggatggggaccacagtcactgtgtcttggtctgttcaggtttctataacaaaagaccatagaccagttgacggtggctcacgcctgtaatcccagcactttgggaggctgaggtgggcggatcacctgaggtcaggagttcaagaccagcctgaccagcatggagaaaccctgtctctactaaaaatacaaaattagccgggtgtggtggcgcatgcctgtaatcccagctacttgggaggctgaggcaggagaatcgcttgaacctgggaggcggaggttacggtgagctgagatcgtgccattgcactccagcctgggcaatgagagcaaaactccatctcaaaaacaaacaaacaaacaaaagcaacagacatttgttgctcacagttctgggggctggaaatccaagatcgaggcgtggcagattcagtgtctggtgagggcttcctggttcacacagtgccttcttgctgtatccatgcatggtggaaggggcaacagagctctctggggtccctttaataagggcactaatcccattcatgaggctccaccctcatgacataatcacctcccaaaggccccacctcctaacaccatcaccatgaggatcaggatttcaacatatggattttgtgggtgggggaacacacacattcagtctgtagcacacgccagttaggagccactgctatccactgtcagattctccctaatgtgtcatccttcccttggccttagggctgggacccctagggaaccttagttaaggtcttcgcaccttcttctttcgtgtgttctctttgtgctgaagtttgcttcaggtgtttaagagagtctggtccttgaagaggcaggatgaccttggcaagacctggaggagccaggggtgcctgtccagaggcagggagctccttaggcctgcacagtggggcttggccagggatccatcctcaggacttggttctgctatgggaggtaacgcccaccctgtgtctctctagcccgccgagcccctccctctgcagcacacccctccttgctggtcttgcactttgtgtttgtcagggagcatgactaggttggtggggagtggaaaggaaatctccagtcctgagggatgctgtcccgtggccatctcttggtcgagtcttttggaattgtgtgctggctccctcgaagtagaatgcatgtgaccatgtggcacatgcaggcttagtagttaggaaaccgtttacccagtaggcacatgggatagggagcgggcacagctagagctgggagtgccccagcacactagacgaaccagcaggagcctgcatatgaaccggctgagctccccagctgaccgctgagctcacttgcaggtcaatgtgtcctggggcttgcttgttgaacactaacgtgtgtgcaggttgcaggggtaagggtggggggcgggtgcacctcactctgagcccgcttctctgatggcccctgcttgctggtctaccaggtgttcctctggccaaggtcaaaacctcagatatttgatatttcttgttttgtgtataggaagtactagaaatctactttgtaatgggtcagaggaaggggaaggacttatttgtgttggtttttgaagcaggaagtggccacatgcaaaggttttcctgtgactgggcagtcacagaggggagatgagatgggaggaggagttgccggcacaatggaaagtgctttacttctacttaacaaatgtcttctcgcgtccttgtggagaaggaaaacagcaggtggccctgggactctgttgactaggaaatgacagacggaacaaaaccgcagcctcagagcaagcatccctgagccccttcactgtctgtgtgtgggaacacattggtcctcattccgtaacgggaatctgccagttgtggagcgggcgttttattacctgtgaccgccccatgttgaaatgaatacactttttgtccagttttctctctggctcttgtgttagtgtagtgacccgcagtctctcctctccaaggcagacttccacattttcccaaagtgctggaaattctcttctcctaggtcatcatgaagaaaatgaatcaaaatactgggagatgtttgctctgcaggctacttttgtttaaaactatattatgaatcactgtacacattttcagctaccccacccctgcatcggacctcctaattagggacctcataactaagcacttagttactaggacattgagcgctgaaggactccactgacaatgaagagacacacaagtagactctgtgtgtgtgtgtgtgtgtgtgtgtgtgtgtgtgtgtgcatgcacgtgcacacatgataacagaattccagacaactccagacagccagaactactttggttgcaagtgacagaaatacagcctagaccattagcttccgtgggagagggactgcattaactccccagctagaaagtctcgaggggcttcaggcatgctggaggacccactgtgtctccctgtcccaccccactgagatccgacggcctccttcctgctggcctagttctccagcacatttcccacagtggccacacgtgtccctgggcttgtgttctacagacctgcagcctcaaaggaaggatatgttcctccctgacaagcctcgctgaggttcccatctacactagtggttcacaattgggagtgactttgctccccagacatttggcaatgtccagaggtatttttggttgtcttaagatggggggatgccactggcctttgtgggtggagagcagggatgctgctcaacatctgccagtgcgcaagatgccccccacagcaaacgggggtccatctcagtgtggtggtggtgctgagccaagagctgcagcgctggacctgtcaccctatcccaggactgtggcccccagcatgggttgagtcccatgcaccaggagagtgctggggaagcctgtcaggaggaggtggtgtcctccagagggaggaatctgctggaagaaaagagaggctcagacactccgtgtggtgttgcatgtcctccagaatgttgtgcgcatgggaaatgctgtataggtgcctgcagaaccgagccggcaagacagggaggcagagctccctccaaaacagggagcagagctcggtgctcactgctttgctcaggtgttgccaaggcagctcgtggaacttcacctggaagaggtcaaggggaagccatgggctcattgcgaagtaaattggtgttgctcatcagtgctcttggccattcctccccagtgctctttctccaccttatttatttatttatttatttatttattttctttgagacaacatctcacaaaaagtaaaaaaaaaagaaaagaaataaaaagagcatctcactgttgcccaggctgtggcacaatcatggttcaccttttaccttgatctcccagggtcaagagattctcccacttgggttttccttgtcagggagctgagccaggtagagaggggtgtttgcaaggtgcactgcccgtgcctgcaggatctgattactggtgcagagcccatggtttagctttgtgctggctttgttctaaaacttcacccagcatctgccactgtgcagaaacaggtggcgctccatcaggaggtggtgctgtcgtgtcctacccaaggtgccagtcaggggagtccctgttcatcctcattgattctgatgtccagaatcttacagagaatttttttctttatgtaaagtaggttttattgtgttcaccttgaaaacaactcactgatgggaaaaaacacactgacagtgttgactgcaaatagagtgacctcatatcatttcaaactgggagtcaggaaactagacctgcagggcagagaacctgtgctttgcagttgcctggaggaccagaagtccacaggaagaaagggccagttgaatatatgcacggacagatgtgtatggggcaaataattcccggggctctgtctccctctcttccctcctccctgtccagcagttttaatgtttcgagccttgctgttctaaggaaggaagcaagagcagcagcagcgtcatccccttggaagcacattagaatgcagggcaatggggagaaaccatgtggctgcactagcgtttaggaaaacgttaattcttatgccatcttacagggcctggctacaaaaagtaaaatgaagaagaaaagcagcattagcatacaccattgtatacctcaaagaagggttgtgtttttagcaccagcgtgggccaggaggattctgattttagaaaaccaaacttttaaggctttgggagagcacctgccctgccctaggggggtactgggtgcagaagcccagcactgcttttgcccgacctcactggctctcttcatgtttttttttttttttggttgttttgagtcaggctctcgctctgttgcccaggctggatggagtccagtggaaccatcataggtcactgcagcctccaactcctgggctcaagtaatcctctcatcactggagtagttgtgtgccaccacgcccggctcagttttctgtttttgtttggaggctgaacacagaggttccctgaagaaagttggttggagctggagttgttctagaacctctcactgtcaagtaaagaaccctgctgagcagctgagcctggaagcttcttcgcacccctgagcacctttcctgagccacgtacagcccacctgaaggcatctgcacacctggagagcggggaggggaggggcagcagacccgggcaccagatcagccctggcccaggcccaggcccaggcccaaggcagccgtctttgcacggtgcagtggggagtggaaaggcccatgtcccctctcccagctcctctttttagtggacagctgcccttgggtaaaagtggaccatgctcagcctcagttttctctctaaaaagaggggaacccctggcagcatagtgtctggagtctgcagggcctcagagattgctggacacatagacagcgctcaacagataggaactggaggtttctaagaacatttctgggcccggtttagcatctttgcaatgtctgtgtgccctcgcttctctccctctctagctgtccttcagcctcagcctcagtctaccccccagcttctctctctctctcttttctccctctctaccccctccttctcccttctctctctccctttccctcccactgtttttcttttacagctttatcgagatatgtgattttctttctttttttttgttaagagacagggtctcactatattgaccacaccggtcttgaactcctggcctgaagcaatcctcccatctcaacctcccaaactgctgggattacaggcgtgagccactgttgccggccaatttctacactataaaattcacccattttaagtatacaattcagtgatttatagtgagttcaaaggtgtgcatccttcatcatgattcaattttagatcctttccatcacccccaaaagattctttttattcctttaagccatcccttctggttcccaccacagccccaggcaaccatgaatctcctttctgtctctggacttgcctcatttggacactccctgtacatggaatcctgcagtatgtggtgttctgtgactggctttttgactccgcatcatattttcgggattgatccacattgcaggtggtatcggtactccattcccttccggtgccaagtgctggtccttggtgcagactgaccgcatggtgctgaccagtgtgtcagctgatgcacggtctcattgctttcccgtgccaccctgacaagagtggttcccacttttgtgggcacacgggagggggtctcggctctggaagtgaccagctttgtggtttgtggggaggctggtcgcataagtccttagaacatcaactgtcacttgggagccgggattgttagcataggattgttcaaaaaatctaataagccaaatattttaaaaacgtgtttcatgttgcctctctctgacctcaggaagtaagtcactgtcaattattgtcgtgtgagcaaaaatctccagcttccttcaactgacagttcaagggatagaggcttctagaagcatgttctccatgtggttctcctgatgatgaaacgtgtggtgtgcacatgtcccatcctgccctcccgacagggcggcatgcggaaggaacataggggaccagccctgttttggtggcggggaggctcacaggagagtgggcgctgggctgtgctctgagaccgttccttgtcttgcttggctttttctttggccaagtggagacagcaccaggtggccagactgtgttgggcctggtcgtgtgcttgatctgctgtactggggatgtcgcctcatacccctgtgcccagctccttgcggctgggtgggtctccttcaccctcctgtccttgctggctcagtgtttgtgtgcctggccaatataatgtgtggcaggttcctcacatccttcttgggccaggcggggtgccttcgctagggcactgcagcctcagatggtggtagcacctgcccccatgtatggatcaggccactggggcatcggggtcaccattagtcagcagaacagctggaattgggtggtcctggacatttccttgggaagcaagagcactgagtaagctgaagacttaaatcaggagtttttctgtgtgtgtgtgtggtttttttttttttttttttttgagacagagtcttgctctgtcacccaggctgaagtgcagtggcacgatctcggctcactgcaagctccgtctcccgggttcacgccattcttctgcctcagcctcccgagttgctgggactacaggtgcccgccaccacgcccggctaattttttgtatttttagtagaggcagggtttcaccatgttagccaggatggtctcgatctcctgacctcgtgatccacccgcttcggcctcccaaagtgctgggattacaggcatgagccaccgcacccggccttaaatcaggagttttaaggtcacgagctggctgggattgggttgttgccaacacccacggcagctaaaaactgcttaagaaatgcctgcttgtgggacttgcagggagcctgggaattcacaacccctaccatatagtagatcaagccttgactactaaggaaggaggggttatggtaatctgcaggaaagtatctcagtagtgacgaactcatcatagtatgtcgtatagcctttgtttcttctcaaaacttttacagcaagttcaggatggcttcatccagacacccgagttaagcaagcaagcaagaaacaaaaagccttaaataagagaagttgaagacagtgtgccccttcgtgcctgaatttggctaggaaaacattggcatgggagcgccaccaagggctggcacattctctgggccaccttcagaggtttaacttctgtgtgagagaaaccatccactgggatgcagcttttacgccacatactgccggattccacgtacagggattgtccaaaagaggcaaatccagagacggaaaggagattcgtggttgcctggggctgtggtgggaatggcttaaggaatacaaaggatcttttgggggtgatggaaagggactaagattggaccctttccttccctgtcgcacgtggaaggaaatcagaaaccaagcaagagagctgggggtatgaaaggaactgtgtcattttcttgactgaaatttcaccaggtggcactgggtgttgagatacatatcactgagcaatatcaggtcacacaatacaggagtattgtttctgtcacttccgaattggtgtgcttgaccccaacagctattttgtatgcattatgtgggcaaacccaagtgggtattgttgggttttcatagcaacgaggcagcagggcagagacgcgtttttttaccatcaccctctgtggtgtgggtgcattatgtctgagccattggtcatcttttcttgtcacccacatctccctgggtctggaatctgaccagaaaggaagccgcatttgctcatctgacaagtcctaaggtcagagagctcccgcctccatgaaactatcactgtggggcagatgatgagcaaaccacacacccgaaacatcacacatgcgcccccttgccatcttctttctcctgcctgtgtccccagcccaagcacggagctgctttctgtccctttaggtcactgtacattttctggacttgtatgtagatggagtcctgcagcaggtgctcccttccacctggctcctatctcttggaataaccattctgagatgtgcccgtgttgtcagatggatcaagagctcattgctttgcattgctgagtattagtgcagtgttgggtagcaagttacatgctggtggcattttgtgttaatattagaggctagtttttagaaaaccgttgcaaggagagcccacagggagaacaaagagagtgtcctgtgaaagctatctcttgaccctgatggagagaagggcgctccagcctgtgcagatgtctgtttccggtgccatcgagctctaacttcaaccttgactctgctttccgagtttgggtaagacttgtttcctactctatttgaggtcatcggagaccatcactttatcatggatgggaaaagttttcaggtgatgaagggctgtgctgttgatttggaaagaggacacaagactggacacttcctttcagggtaccatttctaggccctcttgatattttaatatgttttaaaaattaagagaatgtctgcatatgtactagaggaagtcctgttacacaggaaatactctaaattcaactcacatgcagttggttcccattttcaattcttgggaatatgttagaaaacaaaaattttaaccttggagttaaaatctgttgctattttcttttctttttctttttggagacagggtctatgtcactaggctggagtgcagtggcatgatcatggctcacctcctgggatcaagcaattctcccacctcagctccccaagtagctgggactacaggtgtgcgccaccacactggctaattttttgtattttgttgtcgagacggagtttcaccatgttgcccaggctgatcttgaactcttggaatcaggcaatccacctgtctcagcctccgcaagtgctgggattacaggcatgagctaccttgcctggcctgctattttcacagatgctaaatgaaaacactcagaattctatgaaatcattcagactataaaatattctttagcaattcaagctgctgtttatgaggtgggctgtttatagtagggtagatgcttctaatctaatgtagaattgcagctgcagcatagaaagggaagaagaattgagagtacaccaagatgttaaatgtttgtcttttggttgtggaatatgggtgagctcccccctcacttctttatacttttatataatatagaactcttggttcttctgtagtgaatatttatttttaagaaagcagataaatgttgcacataacttgctttggaaaacttttcccattacggttacttgaagactgaaagatttttgttgttgttgtttttgttttttgagagggagtcttgctgtcatcacccaggctgggagtgcaatggcgcgatcttggctcactgcaacctccacgtcctgggttcaagcaattctcctgcctcagcctcccaagtaactgggattacaggcatccgtcaccacgcctggttaatttttgtatgtttggtagagatggggtttcactgttttggccaggctagtctcaaactcctgacctcaggtgatccttccgcctcggcctcccaaagtgctgggattataggcattagccactgtgcctggccattttttttttctatttttaaaatccttcatatcttccatggcagtaaatatggtaaaataatatgtatgtgaggatttttataatgcataaaatattgtagaagataagttcttgtacatgcttttgaatcgtttcatttgccttctctctttggcttacataataaataatgaaaactgcagtttctgacttgggccatctaacattcctaggaagggaaggaggaggcaggagggagacactggaagaggtggtagaatcacagtagcttttgtttttgctgcatgccagacacaaaatgcgaactcacattatccaggctgatgagtcctgcaggtcagaccccacagcataggcaggcagttatagttggaggccttccctcattgctaagggagttccttagcagaccaattcggaatgagttatgtgtaaaaatgagcacagaatgcttaatgcagtgggccacagaatcacatctgatgttcaaacattctaatgaggctaggtgtgatggctcatgcctggaatcccagcactttgggaggccgaggtgggaggattgcttgaacccaggagttcaagaccagcctgggcaacatagggaaactgtctctccagaaaaatttaaaaagaagcaaacaaaaaaataattagctaggtgtggtagtacatgcctgtagtcccagctactgggaggctgaggtgggaggatcacttgagcctgggagttccaggctgtagtgaactatgatggcgccaccacactccagcctgggtgacagagtgagactttgtttctaaaataaaaacatcctaatgatgtgtggtgatgctgtgttgtatactgtctgcatgctatagtcatttggtaacctaattaagattttaggttgtaaatttttcatttataacttcctgagattcatttcttttaatactcgttaaggcaacataaatttagagtttggatcattttcctcttaacttgttgttttacttcacgattgctgcatttagaaaacttttaaaattttatttaaaaaaatagataatcccaaggtgttgatattacaggtgtgagccactgtgtctggccagattcatttcacttaaatccctgaagatccacatgggattctgacagatcgctctgagacatcctcctgttgtttccttttcaccactgcaggtctccacctgccctggtgtccttgggaggaaacccaccgtggtagggcacacagcggctgacttgtcctggtaaatcataagcatggtgggctccgcaggtgcctccctcctttctgtccttgagtctgaagccagcaccttctttgatgacacaaacgtctgtggtttagggttttcaaaggaattccccctcttcctctcccaccacaagaaaggctgctgtggggagccggtagcttgcaggctgggttgtctggtcgtttgaattccacaagaaagccaacctagctgtcctggcttggggcgaggcgggagggcaggagtcctggatctgcctgtgtctgtctgtccctggctgtctgcccctccctcctccttccctcccctcttgcttggggttgggtggggtctgtcttagggagagaaggagggcagggagggagagagctggaatttgaccccagagctgtctgcagcttcccaggagcccttttcagaccctgtctggctccttagaaaggctgtgtggctcctgcgtggcagggccacctcattaaaaacaccggctcaggggagggtgctggtcactcttggggccaaccaggatgtttgcatttgtcctatgcacacagtacaaagttgttgttttttaaataccattttagaggagttttagctctacagagaaatgcagagatagtaaggagaattctcacctcccccacactgggcttccccctattgttttttttttttcttccaattaccatatatccctgccatcccctattgttaacatctcacatcaccatggtatatttgtccaagcaatgaaccaatattgctacattatttgttgttaactaaagcccaaactttgttcctatttccttagtttcccagtttcccattaatgtccttttctgtcctgggattaaccacatgacttttttttttttttaactgagacaaggcctctctctgtttcccacgctggagtgcagtggcgtgatcatagctcactgtggcctctgccttccgggttctagggatcctccagcctcagcctcctgagcagctgggattacaggtctgcaccactacgcccagctaattgttttgtgtttttagtggagttggggtttaaccatgttggccaggctggtctcgaactcctgacctcaagtgatccacctgcgtcagcctcccaaagtgctgggattacaggcgtgagccactgcgcccggcccacatgacatttagtcttcctgtcaccttaggttcttcttgactgtgacagtttttcagaccttccttgttattgatgactctgacctttttgaggagtactggtcaggaattttgtagactgtacccctcttgggattcatctgatgattttctcatggtagaatgaggttatggctttttgcaaagaagaccacagaccattctcattacacacgatatgttttgttttttagttttgattttctaacttttcttaactgtaggaattaatgaagatttttccacaattcctatgctttggaaaatttcctttgatgatgaaatttctttagggaaaaaattatttttcttctgaaagtgtttaggcagagaaactttgttactgaaatattagtgatcagagctgctaagttatagcaaatttgtagagataattgtcccagacaggagggtctgctgagtatgtcctgtggatatgttatttatcttattctgtgctgttgtgcaccctaaaaataaatattttaggctgggcatggtggctcatgcctgtaatcccaacacattgagaggccaaagctggaggatctcttgagccctggaattcaagaccagcccaggcaacatagtgagacggcatctctccaagaaatttaaaaattagccaggcatggtggtgtgcatctgtgatcccctgcttgggaggctgaggcaggaggatcacttgagagcttgggaggtcggggctgcagtgagccatgatcacaccactgcactccagcctggtccacagagcaagaccctgtctcaaaaaaataaaaaaattaaggccggatgcagtggctcatgcctgtaatcccagcactttgggaggccaaggtgggcagatcacctgaggtcaggagttcgagaccagcctggacaacatgataaaaccctgtctctactaaaattataaaaaaattagctgggtgtggtggcgggtacctgtaatcccagctattcgggaggctgaggaaggagaatggcttgaacccgggaggcaaaggttgcagcaagctgagatcgtgccattgcactccagcctgggcaacaagagcgaaactccatcttaaaataaataaataaattaattaattaatttaaaaaatggtagatttcaaaatagtgtttgaaagttcttggcgaattggtgtgctcctgcgttcctctcaactcccactcttgctcagttgcctaccatcacctccaatctcctgatgctggatttgcaagttaaagtatttctctagcgtgggagttggcaagtgtcttctgttaggagcccgtaaatgttttctgtttgggccacttgttctctgtgggactcctcagggttgttgcagtagcaggaagcagccacagccagtgtatacatgaaggtcgtggctgtgttccactaaacctttattcaccaagcaggtggcaggccaggtttggcccaaaggctgtagttggccgacccttactttattgcagaagtgtatactgccaggacttttttcttgtttttgttttgctttgttagggagtctggctcatttggcccatgtttatggggcactgactctgttgtttagcaagcgctgtgttgctaaagaatgttttcgagagatttagacccacccagtaaacctgaacaagaagccagcctgagcagttagccggggtcacagttctccataacttctccccctgcttcctgctggaacagctcacttttgaaatggcaggggagtcattccaagctagcatctcccatcccaccttgtcacccacccccacccacctttttgttttttctggaaaacaaataaaggcttttattgtatctacttgggcaggatgaggggagtggtagttccagagacaaaggactcagagccaggacctggccctcacctctgcgcacaccagcccacactggctcccgtcaccctcctttctgtccgtctctgctcctctctggtctcaccccgtctgctgcagacagtccctcttcatgagttgagaaacataattcctggcagctgcagtgtcgcaaccccttcctctacattttgtggaatgaacacagctatgtaactcgctacccagatcaagagatggaacattcctatttatgttttaggaatgttctagctccccaggggtgcccttgagcctccccaaccccccaaatataggactgtcttgaatgtccacactatagatgaggttagcctctatttggcctttatataaatagcatcatctagtatggactcttttgtgtctagctttttcagtcaacattacttttgtgagattcattcatattgtttctggtggcagttgtagtttattcatttttgttgctgtgaacctcagtttgtttggttttggttttggtttttgagacaggatctcactctgttgcccaggctggagtacagtggtgccatcagggctcaccgtagcctcaaactcctgggctcaagccatcctcctgcctcagcctcctgagtagctgggaccacaggtgcatgccaccacgcacagctaattcttttatttattattattatttttgagacggagtctcgctctgtcacccaggctggagtgcagtggtgcaatctcagctcactgcaacctccgcctcccgggttcaagtgattctgctgcctcagcctcctgagtagctgggactacaggcacgtgccaccacacccagataatttttttgtatttttagtagagacggcgtttcaccgtgttagccaggatggtctcaatctcctgacctcgtgatccgcctgcctcagcctctcaaactgctgggattacaggcatgagccatcacacccggccaattattttatcttttatagacatggggtcttgatatgttgcccaggccgctctcgaactcctgacctcaggcatgagccactgcctccagtctgtgtgtttttctaaagaattcttagtggctaaggaaggttaagaccttcctatcgtctctttcatctttccccagagatgagccattttgaacatggatttggcatctgtgccgcctctgagcccatgcttggctgatctgtggttggcgtctgccttccagagaattccttgttttcccacagtccctttgcagctgtttcatggagcacggggacgcatgctggctgctgccaccagctctgatggctatgaaggtttgagacgagtctcataggtgaaatctgggctctaagacagcccaccttttgaaaggacaattcagccaccagaatatcatcttcgatctgctggttttctcattttggtttccaaaagcctttagccattgttattattccgtgcttgtcttggtgttagctcagtatccatgaaacccgacaaacctctttctagaatgaggccggcaaaccagtctcataatgttcaaccccagtgaagaggaactaaacctcaaaattgttgtaccacaaactctattggccttttattggtggggattttgtttttattacaagaggggtgactgctacagtggcctttccggcaccaggccgtgcctgacggatgagaatgctgtgtcataaacagtcttttgcaatgactaaccgtgctgggttggaatgcagtgcacaccaaaggaaggtaggacttttagtggttgtcacaatagctgtgcgaatccaaatatggctggaaaatgtcaacatactctccagattatcagctccgacgaatgtaagagacatagtgttagggggatgtctggataagttgaactctaatcagagggaaaagggggttggaggaataatgaatgagggaaacacttttattgggagaatagcttgcaaaacggccagttgcataaagtgtcctgtcctaagaagtcctagtgtaagcctcggccagtcctaaaatatgaatgagacctaggacttattttacgtattgctgttatccttactagcacttttggagtctgcattctggtaatgcctaaatgcttgtgctgagttacatgtggaaacagctctacacaacattccctagtctcttggacacttacagtgttggccagtccttttctcgtgattttttccctctgatttactcgtgttgtaacaaagttatcacttttttattgtttctctttgctttcatcctttgcatctgtggctgctcacttgctatgcccagggaaggggaagatggagaaatagattatggatatggcactccagggcctgtttaccaacaacctgaaaagcttatattctcagcaggtcaatactccccatgtctgagggcgaatgttgtgtggattaacaggcaaaacatgttgcatagatttgcagatccacgtttacagattccccactgtatactgaggccatcgaggaacctgaatttgtgtatcccttgtggctattgatatgttgctgaagtcaagtcaggtatgtattgaaaagcatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgactgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaagaaaagcatgttctaagtatctaagtatttaagttctacatgtctagagataaaactctctttatacggggatgtgaggagaggaactaggaggagactttatcatgtgctgatttatgctctgccggtaatgagccatgcagccctaagcatgttacctcatatctctgggacgaataaagtgtctgtcctttggccaattttttagcttcccgaatcagtttatcgacaagatggggacatgcaggtgtatctgccagggttaggggaagctctcaatagtaacgtgtgctgagaaccagctggtgccctgcgtgagtgcagcgctccgtgaagaacattgtgttatgaactcctgggatgcctggattcccttccattcatccactttgttcacctaaagggccagagcaaacaaccgtccactcaggtaaacattcccaccccagagcgaccgtttgcatcctccaggagttaacagtacagctggactcacccgtgggtctcctggaaggcactgtgtcggaaaccgagcttctctcctgcttcccttgctgtggcctatctgggaatctatagtctggagcatcccagggcggcctcctttggcagatggtgtaggagtgctgcaagccctcctggatgcacccaaggacccaggaagatgggagcgtggatctctgtgcctcagcacagaggctgggaggagagacagcaggcgccggctggcaggagcagtccatgtgggagcttctgtgtactcccacctctgcttcacctcctgttgatctctcctccctctgcagcacattctgccctccttccccagactcctccccacagttcgccctgaaacaaacctttccatgggattgattttagaggctgcccatgtgggaccagggctgcagcttccctatgggggtgctggtggccttgtggcacttgctaagctgggcgggcgtggctaggagtttgagcagtaaccaaagtttcctctctgctgagtgctcctggggtccatccctctggggtgatggcaggcagctttacacgtcgccttagagcatgtctttatttgctcctggatcaagaaccttttgccatcaatgtagggctgagcacccccaccaccacacatgccctgtccagatatctcgctctggggtagaaggaggcagttgtgggaagaagtttcctcatcacattagctctaggtaatttcagagaactttgccaatctcttccctagcttgtaggtacaatgaagataacaccagcagacaagataggatactctttcttgagtttaaaaggcatcaaaatagttgcatgcaatttagcaaggaatggatacattagattgtatttaagagagtgcctgttgctgtacagtttttaacaacacgttgaagcagagcaggtacctctcagatactgttttggtggggaggattggggacagtggtttcctgctgtcacactggggagaactgaaggagagaacactgctgcacctgagcggagactgacacttttgaggtgagcaccctgaaccttgggtgtgtattgtccctctcatacctgctgggcatcttggggccaggctgggctgcgtggcagctctgtgggatcattcccgtctgcagcacccgggggcgctgctcattgtgtagaccaaaggccagccagcggagatgcccacttgctgaccttcttacatgcctgcttttctgctacaagctgtcattttcttttattgattggttggctgtcattttcttttattgattaattggttggttggttgacaggccacatcactgcagctttggtatagtcacttctctaatctttccaaaaagtcgcttcaggttatgaagtgagttagcggcctgctccctggttgctccatgagagttcgccctctcctcacagttgtacagcgggccagcattgttgtttggcttcctggctcatatgccccttctctgtggcaccccatgtccttatgaaaatgacctaagccaggcgtggtggtgcacgcctgtaatcccagcactttgggaggccaaggcgagtggatctcttgagctcagggagttcgtgaccaccctgggcaacatagtgagatctcgtctctgcaaaaaatacaaaaattagccaggtgcggtggcacacagctgtagtcctagctactcaggaggctgaggtggggggatcacttgagcccaggaggtcagtgagccgagatcgtgccactgcactccagcctgggctagcggataagactctgtgtcaaaaaaaaaaaaaaaagagaaaacaaacagaaaaacttgtaccctggtattgataagtcttaatgggagggcccctgcctctcaccacagccttccggaagtcagccagatccctttgtttccagcccctggtagaccagcgtggccttatgatcccctctttgtcagtctcatctcttcctctctctttttttagagacagagtctcactctgtcacccagactggagtgcagtggcagaaacacagctcactgcagcctccacctcctgggcacaagtggtcctcccacctcagccttctgtgtagctgggactgcaggcacactccaccaagcctggctaacgcttttaatttttgtagagatcaggtcttgctatgtggcccaggctggtcttgaactcatggcgtcaagcagtcctcctgccttggcttctctaagtattgggattataggtgtgagccaccatgcctggcctctttttttattttgagatcattatagcttcaggtggcaatacagagagatgccatgggtcctgtacccaggttccccacgtggcaacagtaccttttttgtaatatgatggtaacaatgtttcaaccaggatattgcttttttttttttcttttttttttggatagagtctcattctgtcatctaggctggagtgcaatggcgtgatcacggctgactgcagcctcaacctcagcctcctgggcccaagcaatcctcctacctcagcctcctgtgtagctgggaccacaggtgtgcgccaccacacctgacaaatttttgtatttttttttttttttgtagagatggggtgttgctgtgttgcccaggctggtctcaaattcctggtctccagtggtccttctgccttggcctcccaaactgctgggattttacaggtgtgatattgacatagagaccgtcaagacacaagacatttccatcccaagaggttccctcacattgccccttttaacttctctcttgctataaagatatcaagttcaaaactttattatatagtaaaactctgttaatcaattgttgaccgtttaaactggaatttaactgagagccaaggatcttccccaggtgactgaagtctgatgtatcccttcaacttctagttttgaattaacaggagttcagtgtatttggagagaggcctgtcactcccttgttctgttcctttaaagagttatggtccagtagagagggcacgctcgttaaaagcagtctctcgtgaagtggatcaagatgtgttggaatgtaaggcatgactgctagctgctgagcaattcacatactttggaggaggttagtgcccatgaaaaggtagatgcggtaatcagaaaaaactccaggctacctccgggcaacatatttggctaatgctttgattaattgaaacatttaattaactagattttttccccatgctttgcttttaggaaggatccttcactttctgccttggcaggggagtggggaccaaagatattaccctctgattcccagaccacctgcaggcgttttccagctgggattagtctagctccttgctggcttttcatggcacctgaagcttagttcttattgccatcaccttgaaggtctgctccgagctgggtctaccaaaggctttctctttctgttatgcctggtctccagtggtccttctgccttggcctcccaaagtgctgggattttacaggtgtgatattgacatagagaccgtcaagacgcaagacatttccatcccaagaggttccctcacatcgcccactttccccctgggatacccagtgcaccttattggtgcaaaaatttgtatgaattgcaattttaaagacagtcgaatttgacctgcaataaaaatgatgattgtaatttgtcatggcagaattgtaaagctagaaaagatctttaggattgaactgatcattttatggataaggaaactgaggcccagaaaaggtcattggtttgcttctaatgtgtgtttctatctctggggagagctggaaacataccctctttagccagtggtgcccagcccactcaagttgttaacaatggatggatgtagacctactatgtgcctcactctgcattctccggtatgcagtggaaccaatctagaaaagccggcatctttacagccttgagagtgtgcttctcagtgggattgtggatggtttcctctttaataggaaagcctgtttttatatagatgtatttcttgggtgctgacagacccagcaccaccagctcctaagcgagccccagtgttttctgctggggacaggatccagaagcatcccgtggaggggttgggtaccccagatccacctgccaggactccgggagaggcgtgtgtgagcagccagtgagcccccagctgtggaggactgaggcttcctgatctccttctggaacattcagtggccacaccagcagttctttgtgctcacttactagcccatttcttgtagcaaatggaggctacatctgtttcgtagggctgtcataacaaagtacctagcacaaagcttaaagcaacaggaatgtgttgtctcatagtaaagaggcctggaggccagaagtctgcaatcagggtgtctgcagagcctctttctgaaggctctgggggaagagccttccttgtttttcctgcttctgtgactccaggcattccctgacttgcagatgcatcatgccaatctctgcttccgtctccacatagttctcccctgtttatctgtgtccaaatttccctcatctgttgtggacaccgttattggattagggccctccctaattcaggatgacatcgtcatcaccagttacacctccaatgatcctatttccaaataaggccacatgtacaggttccagaggtgaggcttcaacatatctttttgggagacataattcagccccataacaaagggtaataaaatgttttgagagagaatctaggtacagaaaagtgctcacatggtagcatagacattgatgaattttcacacagcaaatcatacttgtgaccccacccagatgaaggaatagaagagacagtcttagaaaatagataccaaattccatgccttatggagaaagccaaggctcgttagtctggtttgtgcttttagggttaaatcaggtacgttgttgacacttcagaccaggtacacgtagggatgtgggtattatgctgcaaatcacaaaggacagtttcactttttaaccccagtggcttcctgagaactctattgtaaagcgtactgttataaactaaattgcattttgaataggaataattagatttaagttagagattctgccaaaaattgctttatcagatcggacgtgagcagttacatcataaaaagaagaaatgccactcaaacctgtgattgccagtttaggagaggctttgcctcttgggccattgcttcatgttcccattttgggtgccttgtctataaaggggaggaaggggtgtcgggatggctctctgggttggatagcgggaggagactgcagcccacatctggttccagcctcttgtcacacagttgagggagtggagcccagctgagattgacctgctgaaggcacctggatgggggtcatagttgccatccctttattttgcattttctcgtgttttaaagctttggtgcccaccgattccagccctgctgttcttgtgaaagtcgcatacacagagtgactgtcacagcaactcattactcttcacggtcctgagtttgcttttctgtaaaattgagaaagaaataattgcctgacctctcatcccacgattgtttttaagagtgggaatcacagcttggggggcagggagttgagagcttctgctgtagtggtgtgagcaacacaggatggccatatttaaattgggattgtactgtggagagttatattaaattcataaggtcaggagaaacagaaacacgggagttgggccttattgcagactcctcctcggtgattttatttggagtaaacggcacacgtaatcttagcatgtctcatgtcaaaatcacttcaaagaatgccacgggtgagtctgcggcagatgttcagggcatctttttaaaggagaaccaaaaaattaaaatttatttcctttttaattgtggctgttttaaactttgttactttaaaaattacatatgtgtaagtggtccactctttttaaaaaaaaaaaaaaaggcatcctcattgttcaactcctggacacagggagggaaacatcacacaccagggcctgtcggggagttgggggtagagggataacattaggagaaatacctaatgtaggtgacgggttgatgggtgcagcaaagcaccatggcacgtgtatacctatgtaacaaacctgcacgttctgcacatgtatcccagaacttaaagtatagtaaaaaaaaaaaaaaaaaaaaaaaaaaggcatcctatcatatcttggcaccctcgatgtcaaaatgtggtaaaaaggacctttgcccattgtgttatgcattttagctctgttcagaatctgtcactgttacctacgcttattttgtttttagaatttgggggcagaaattttttttatctgtcatggaaaatagctgatgccccaatttttgaactcgataaaaatcccaactattcccatattaatccagatagatagatagatagatagatattgcatcagattttgtccctaaaaggactgagtacagtacaggatgtggagtgaaacaaggctgctacggtttcagaaacagctttggagctgagactttgccaaggaaagtgggaactgctctgcgccaggaagaagcgatgaacccatccttgacttgtacgaccatcgggtgtgtcagccgccttgtcgctgtgctctgcaaactcttgcccaccacgaactaggcacacgcttaactcagtgttgtggcagatggatgactaattcgggttttaacttggaaaagcagaggtgggcagattccaccatcctggcagaaggttgcatacccgccaaagcgcactaaaaatcttcctaagttactcggctttagctgaggctgagtgctgctgtctcagaagaattaattactttgaatgggagtcattttttaaagacttaagaatgtttccttttttttttttttttttttaaagcaaaaccgaatgaacttgggggaaataaatgctttgcctttgagagttgtctgctggaaaaagtcaacaaagggcttctgggttttgttcagtggtgtcttgattagagtggcataaatcttaagtactttcagaggaggcttacaaattagagaatagtttggctgttttggtttgattctaacaagagttcagcatggagaaataataccactgatgagatgaggaatgtgtttagcataataaaaaaactacctccgtgtagccccatttttcgggcagatgcaatttgtgtcttaaagaaaaacataaaaacagccagacattatcatttttctttgcttgttcctcagacgcattaatagattatacccctcaatctattgggattgagatgttttatattttaattacacaagtgaacaaagttttgctgtttagaactattctgttgagtgttggtttttaagttataaacattaaaggaaaaatcatctggacttatataatgatgagtcttgagaaatgtcagtgttttctgggaagagttgttccattcttctaactgcctcactggggatcctggactggagcgtttgcccctgggatgcagcgccggggcacccctacttctgggcaagaggctgtgctgttcctggcctccgtgactcttcaggcctttctctcccagttgcatggtagctgctgcatccccacgcatcctgtctttgtttaagaccagaagaaaagggaaagggtggtaccagacatttctgcccctttgattgcagagacaaaggctctcctcaagcctgcagctgacttctgcctttcccccatccgctgggaccgcacatgccaccctgcgctgcaagggggcacgaggctgctccagtctccatggtggattcagatattaaggagggcagggctgatggctgccagggatcctctgatattagtaatgggggagagaggaggacgtcagttccaaaaggtgcggtcttcctggagaacgtgggacttgaatgaagccctgatagagaagtcaaatttgaagaggcagaaagaggacacgaaggtgacatgctaatgaagtctaggatgaagagaaacagtgagggaacgttgagaacaccaccttggtgtgtagggatcctgcatgacactgtggattctaacacaaaaataatgcggaaggaattgatgtttatacagagtggggtgtgagtttcctgcaccagagcatgccagttggtggttacacgtttgacccttggacatgattttagggggagtggggatggcctcacctagttttattttttaattaagaatttttttttttttcagagacatggaatcttgctctgtcgccctggctggagtgcagagtggtgcagtcacggctcactacatcctcaaactcctggtcttaagtgatcctcctgcctcagcctccagagtagctggaactacaggcacacaccaccacaccctgctaatgtttaaaatttttttgtagagatagggcctcaccatgttgcccaggctggtctcgaactcctggcctcaagtgatcctcctgccttggcctcccaaagtgctgggattataggtgtgagtcactgtgtccaccgtgctttcacttagttttaaaagcaaaaagattgtgaacatttgcagacacagggagattacccaccccgcccccgaaattccagattttcagctgcattaaacacattgcaaaattcgtgcatcctggctgctcatttccccatgagcagtcactacccccgacactgggtagtggctgctccttcagaaggaaggaccctgtcccttcaccacaatgcccagtgctcgaggctgtagaccccatcctgagggtgtgtgttctatacatgcagcccctccacttgcagcggcccctcccagcctctgcgagcgctggcgtgtgcactccagggctttatgttttccccgtgttgccttcttaggctctgctgcctaggctgtgacaaaggcatccctgaagagagttgttcaaaaaagaaagatagcccttgtgacgggtgagatcatccatatgttacccaataaaaagtcaaaggcttgaggggccctttgagttcactccagagaaaggtgcagcagcctcggctcagtgccccctaggcctccctgacgttgcacggcggcagcattagattatctcactgaacaaggcccgtccctttgaaatagcagtaggatgggaatgtccattaaagtaaacagctgtgcgttctgagaagcggggacactttgttctaatggccagcagttccttttcctgtttcttggttgcctatcagttctttcagatcgccttttcactttgaaaatgcaaaattaagtaatcccagttatctctgtttaagcgggtgcttcagtgatgtgatgacttgctttcaaaagctcagtgaggccgcgcacggtggctcatgcctgtaatcccagcactttgggaggccaaggcaggtggatcacctgaggtcaagagttcgagaccagcttggccaacatggtgaaaccccgtgtctactaaaaatacaaaaacaattagccgggtgtggtggtgggcacctgtagtcccagctacttgggaggctgaggcagaaaaatcgcttgaacccaggaggcggaggttgcagtgagctgagaccgcgccactgcactccagcctgggtgacaagagcaatactctgtctcaaaaacagataaaaaagctgagtgagaaggggtgaggatctgggcaggtctgcgttctgtgttggctggaagcctgctggcggtgctttgactaaacaattcttgatacttctaagatggacttgaggccgggcgcggtggctcatgcctataatcccagcattttggcaggctgaggtgggtggatcacctgaggtcgggagttcaagaccagcctggccaacatggtgaaaccttgtctctactgaaaatacaaagattagctgggcgtggtggcaagcatctgtaatctcagctactcgggaggctgaggcagggagaattgcttgaacctgggaggtggaggttgcagtgagctgagattgcgccactgtactccagcctgagcaacagagcgagactccattgatggacttgaaagaccaggaatatggtacaggttttgttttttcctcctgtagtgctaagatgaaagcagggctttagacaacgtcgcttatgttcgatgattctttttctctctgttcatcctctccagaaacattgcctattgcattgcgaccagcttttgtataggaagggaagaaacagatatcatttgggttttgtcatcagtgagatgctagtcttgttgtgggatgagaagcataagctggtaactgtcagcagggttaggagcagatagtggccatgtgctccaggcactagggaggctgggagatgtacagagtcccttggtggagacggtggggttcaagatggcgtcctgagggctgaatgtgggcgagctgggcagagtgtgtgcacagcagcgatgggggtgcatggtgtttccagaggggacccagtaaacaaagctctgcaggcaagaaagaccactttctctagggaggaaggacaaagggcctgttgttgcgggtgtgtgatgtttgggcagggtggggatggtgtccagaacagcaaggcttgttttacatggtggtgagtaggacttgattaaatgcagtgcctccctccctccccctcacctgatcaaactgctcttttgcgttgctgctagaggcgagagagaagatgatttgcgtgaggaagacggctgcctgtttcctgccgtggtaaatggattttacagggcaggaggttaaagcgtgactttagaggtgccttggttttgttttactgttccacatgagccatgggtgaccatttctaatacgttatcctttctctggaatattggtggttctcccctgggggcagttttgtcctccaggagacatgtggtaacatctggaagcatttgaattggtcacaactcggggcaggagggtgctactggcttctagtgggtagaggccagggatgctgctgagtcccctgcaatacccagggcagccctcacggcaaagaatgatccggccccaaatgtcaatagtgctgaggtggaggagcgtggtttggagtgtcctattgtttatccatgttttatctattggacatttgggtaaaataacccatttgtagctcttacagatggtcctggtatgcacattcttctgtgggtcttgtggttaacatacatgcacatcactgagtcacttggtctgttttcccagtcatgtcaatatttttttttgagacagggtctcactctgtcacccaggctgcagtgcagtggcgtgattttggctcactgcaacctccacctcctgggttcaagcgattctcttgccttagcctcctgagtagctgggattataggcatgtgccaccatgcctggctaatttttgtatttttagtagagatggggtttcaccatgttgcccaagctggtcttgaactcctgacctcaagtgatccgcccaccttggcctcccaaagtgctgggattacagacatgagccaccgtgtctggccactcatatcaattttggtattcaccccgtattcaggagttgaaggtgtaggaagcagcgcaaatggacattgacagacgagtggataaagagaatggagagtgtacatacagtggaatattgctcagcctcaaaatggaaggaaatcctgttacctgtaaccacatggatgaaccttgagtccatgatgttagctgaaataagccagtcctacaagggcagatactgtatgattctacctatgtgacatatctggaatagtcaagttcacagaggcaggaataaaatgcaggttgccagaggcaatgggggattgttcattgggtactgttgtggttttgcaagttctagagatctcttacacaacaatgcgattatagttaatgctactgaactccatgcaattaaaatggttaagagaacacatttgatattatgtttttgttgatgctgttgttgttagagatagggtctctctctgtcccccaggctggagtgcagttgtacgattataactcacggtagccttgaactcctgggctgaagtggtcctcctgcctcagcctcccaggtagctgagattacaggcatgtgccactgtgcctgactaactttaaaaacaaaatcatagaaacttggtttcattgtgttgcccgggctggtctcaaaactcctagtctcaagtgatcctcctccattggcctcccaaagcactgggattacagatgtgagccaccatgcccggcatatataatgtgttttttaataccacttaagctctgatttcctcgtgttatgatgaaaacggatactttgtcactgtccctgagagtggagcagcatagcctaggttccactggcagtttggacatgaagaaattataacaacagcagaataagttgtaactgtacttgtagcatactttagagtttgcaacatattttcataattgtttcactgttatcctcctggtcgtcctaggatgtaagacaaccagctcttaccaccatttttggggtgataaaaccaagagtaggaagcatttctccaaattgtgtacgtaagtggcagaggcaggtcttcagtaccagatcattcctcatcttttgaaacgctccgtgcccccaccctctgatgtgattattccctcctgtctgccaccaggggatcctgtgcatgtctgtcactgcacttgcctcatgggatttgtatcagccaggatctagttaggagacggaagccacacagtagttggaacaggagtgcttcataggaagcgggatttcgtggactgaccaaatcccaccatgcccccgtgcttacggcttttctgtttacagaagcaaggttgaacagttgcacagagatcgtgtacatgcaaagctcaaaatatttacattacggctctttgtgaaaaagtttgctcacccctaatgtaaagaactattaacttgtggcagtttattatctattatcgacgaattattaactagtagctactataggtaaggagaactctaaagaatacgagaatagcagatagagggagtggccactccctccagggctggggcacagagtacctgaggaaggaataaatttggaactattctccccaccccctccaaagctgagattcgaatctcgatggaagatggctcactaggtagtggagaaagtcgctgagggccaccgctggctggagagtagggagccacccccggcatgccactgaagctcactaggaagctggctgggggtgtctgtgggactcggtggaaagccaccgaggaattgtctctaaaagtcgctgggaagctgcccgccagagcaccagtggaacttgctaggaggccgcccttggagcttagtgccactgtgtgtgccacatgactgccaggtcccactggagcaggcagggaggaaagcacgctggaatgatgaaggcaagccctttccaccgcccgcgtgcctccaccgccctctgctgatggtgctcaccaggtgccagcactggagaaacgcccacagggtcctgctccaggatcaccatgtgggcagtgaaggtgcatttgggatgcagaggcaatgcattgctaactggcaatgttgcaacaggttgtcttcagagctgcactgtaaattcctctgacacacgatggtgttccagaaatcctccctgaacgttgctccccattaaccatctcttaggtggatctcggcctgtgctctgtgaaattcagggctgacatggtggtcaggatttggccaagtcctgaggccccaggatctttgctacatgtggagaggaggcacacacctttgggctctatgctgacctccctccaagaagactgtcaccccttgccacagaatgcacactcttcttccggtcccgtccagttggcctgcattctgacgctgcagctctcacctgcccagggcacattccacccctgcccgtttctcccagtcactcctgggacagtcagcttgccttccgttgctctgtagaaatgctgtctgccaactcagtctccaccacctccagatcttcacctcatctccctccacatttttgggagccacatgcccccttttcacctagccgatcacccagccgtaggttttctgtcatgacactcccttggcctgtgtgtccattagcatggctttgtcacctggtgcagccacgtcctcgtcctctcctcatgcctcatcctcgcgcctctccttgccatggtgcctcgtgtggtgcagccctcattttagggagagatgaaacaagggctagacctttgtggactgaatacctccttgagcatctagttccaaaacacacgaggagggttttggtttattttgttagtgttatttattatttttttttggggggggtgtatatttcttaagagatgggtgtctcactatgttacccagacaggagtgcagtagctcttcagaagcgtgggcatagcacactgcagcctccaactcctaggctcaggtgatcccgccatagcctcctgaggagcttttttgtattgtattatcatttttcttgctttcttactaattttgtcaactatgaggaaaggaattttttctttcctaatagagattttattgatactttggaagatcaatacaaagctgtttcaatgtgtatcctgttgttaatgtccttacagaaaatctaaagagctgtgtcattggattcttttccaggtactccagcgaccttctagctgaaaacttggaggcaaattttccttaaaaggccaggaattaggattttttgaagtctcagcacctttgggtggtggtttccatctttaggagcacgagtctgtctccgggcgaaacttcagtgtagatgcatgttctcaggatatttcacaacttgctgccttgctggatgggtcacatttccttccccaagcgccggtaccttcagatgttgacgagctgtcacatcagaagtcacagtcactcaccgttatcagcaacactgcatactcaagttttcagcctttcatagcacattaacagagagattaggaaaaccgactgccacgaccagaagactttcagggtgcatgcctctctgatagggagagccaggatcaaggagtccttttccttccgaaacagttctactaaaaaacaacccatgggctcacacctataataccaacactttgggagaccaaagcaggaggtcaaggtagtaggattgcttgaggcctggagattgagaccagcctgagcaacatgctgagacctcgtctctacaaaaaataaaaataaataggccgggcgcggtggctcacgcctgtaatcccagcactttgggaggccgaggcgggcagatcacgaggtcaggagatcgagaccatcccggctaaaaaaaaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaataaataaataaataaaaataaataaataaaaaattagccaggtgtggtgacacatgcctgtagtcccaccttcttgggaggctgaggcaggaggatcgcttgagcctgggagttcgaggctgcagtgagctgtgatcgcaccactgcactccagcctgtgcaacagagcgagacccagtctcaaaaacaaaaagcaaacctatgagtataagtaatttaagctgctcaagacatattaaaggcctgaccatgactgcaaattgccagtcagtatgctttgtgctgtaggatatgaaaactgtccacccagcctagcacccaagacagtcaaagcctctcataaaatatataccaaaaaacaactagcaaatgatttcacctcttttaaaaaaagcatttatgcttaaaacatggaattaggtgggattctctccttaaaaatgtttacagaactactaaaaaacttgcatttacaaaacagttgctgaaagtattcccctggcatatatgggaagggagacaggggctgctgagcagtgtatgatagtaatcaggtttctttccctcctgcttcctgggagcctggactctacttgcatttagactccgcttcctgcaggtcaatcttcaggttcctgctgagccacttcagcccatttgccctttgctcccccttttctcttttgtgctttttttccctaaggatttatcctttcctgctgccttttttttttttttttttttttttgagttggagtctcgctgtgttgcccaggctggagtgcagtggctccatctcgactcactgcaagctctgcctcccaggttcacactattctcctgcctcagcctcccgagtagctgggactacaggtgcccgccaccacacctggataattttttgtatttttagtagagacggggtttcaccatgttagccaggatggtctcgatctcctgacctcatgattcgcccacctcaccctcccaaagtgctgagattacaagcgtgagccaccgcgcctggcctcctgctgcctttttgggcttcatttccacttctgcagaagcaggttgagccgacagcctggcggacctctgggctgtgccttggccacccctggggctgacctgaccttccccttgggcatcttggcggtgcctggtgcctgctgcccaaaagccttatgaatctggatgcaccgcaactcccttccctgccctggcctctgggaccacagcaggggccaggaattttttttttttttttttttttttaagtctcaacacatttgggtggggatttccatcttctaggggcttccctgttatcggagcacaagtctgtctcacagagaaccttcagtgtggacaaggtgttctcatttatttcccaacgtgtctctttcctggatgagtcaggtttcctttctgaagacgccgagctcaataaattaagcagactgagaggtgacttcagtgcttgtcctcatcatgcagatattttatctctggaaagcgaagcattgttgaggtggtcagaattgatcaattgcaggtgtgactcatagcccttgaaatatgatattggacttaaaaaaaaactgctttctctcctctcattttgatttctggtcactgtgattttccaaatccctcaagctgaaaaccctgcggcaggtgacatgtccagatcttccttcccagcctctggagttggtgcattactcccgtgatttttctctgcctcttaccccaggagttctgcagagatgtaggggtagtgcccatcagggtcgttgtccttgtcgttttattcttattgccaaataaattcatttgtgtgtgactataagacgagtcttccagaagcagctgctgtagtgatgagttcactcctccactgccatggctgccttcgctgggcccccactgcctgcaggacagcgtccagattcccattccagggcggggtcctcgtcttcccccacttcggccctatcttcagacactcccctgcacacacactcatgcctcaggcctcctgcctccacgcccttcttcacggggaagcctctgcggaaggccttcccagctttttctagttgccgtttctatttggaggccttcttatctccacccgagacagagggtcacatccccctcatgctgccactgcagggaccccattcttttcagcgtgagcctgctcccccgctgcactcaggatgcccttgcccttatgggacttcatttggattgtctcttcaacgaagtatcaacaactttgttccataaaagactttgattaactgtttttttcctgctgttcctagagaaaacatttccatgagaacaatgaggcattctgcacgttaggagacgttgaactctaatcggggccataagagtgagtttccacacagaatatcagttaataactaaaacaacagtatttgcccgggtgtgtggacttggtgctttgggtctgtgagtgcccatagcatggcacctgggccggcatcgtcatgggtcggggatgattgacttcctagctttttgtagaggggctttttgaggttagagcaagtgagagcaaagatttttcctaagtactacaggacagaacttcctcatttgtggctctggcactccacagacattaagcggctgtcactaatcggtgcagtgccaagtgcttccttaccttgtagacctgggactgtgacaaaatgagcatcattgtgatgctatcacgcatgcggcaccttccctaaggtgcctaattaagcctaattaattctactgaacttgagaagttcagtggggcaaagagaatagaatggaggttttcaaagctgctgctgcttttctgactacttttccccatagcaccataaacatgtagaggtactttatctggataaggaagccaggggaaaaaatgaagacttttatctcccaaaccaaaacacatttttgctgggaaatataggtggagtgtggtgggggaaggctgatggatgttgtggaatgcgtccttcatatctagaggggaagctttaggaatccttgcagatgagaagaaacagcatcatgttgtcctttgcagtgaagtcagagcaactgacagccctttctgagagtccttcaggacttgcttacacacgtgcttgtgggaatgagacacattcccaccgaaaaccccacccggtcaccactgagtcagacacagaactgtgtcaccctgaagaagtgctgcttcaaaagctgtcccaagaccctgcaagccatgagtctttatggttttgcctaaagattttcctgtgatacttaaattcaaacatgtcattgtggagagaaggacacaacttcatttatttttatttttatttttatttttatttttattttatttatttatttatttttttagatgaagtctcacgctgtcgcccaggctggagtgcagtggcgcaatctcagcccactgcaacctccaccttccgggttcaagcgactctcctgactcagtctcctgggtagctgggattacaggagcgtgccaccaagcccagccaatttttgtatttttagtagagatggggtttcaccatcttgggcaggttggtctcgaactcctgacctcgtgatccacccacctcagcctcgcaaagtgctgggattacaagcgtgagccaccgtgcccagccttttatttttatttttttgagacagggtctcgctctgtcacccaggctagagtgggttggcatgataacggctcactgcggcctcaaccctctgggctcaagtgatcctgctgccttagcttcccaagtacctgggtgcctcctgagtagctgggtgccaccatatctggctaattttttaccctttttttttttttttttttttttttttttgtagagacaggatttcttttgttatattacccaggctagtctcgaactcctggaatcaagcgatccttccacattggcctcccaaagtggtgggattccaggcatgagccactgctctcagccctagacacaattttaaagttcactatatatcactcttatactgggtcaaaatagtttccttgattttattttaatttttttaattttaatttttcaagacagagtctcactttgtcgcccaggctggagtgcagtggcatgatattggctcactgtaacctccacctctcaggagcaagcaattctcatgcctcagcttcccgagtagctgggattacaggcatgcgccaccatgcccagctagtttttgtttgtatttttagtagagacagggtttcaccatgttggccacgctggtcttgaactcctgacctcaggtaatccgcctgccttggcctcccaaagtgctgggattacaggcatgagccaccgcacccagccccttgtttttagatattgaggaatgcataactttttattatggtaaaatacacataatatgaaacttatcttcttaataattttcaagtgtactgttcagtgatgtgttaagtacatttacattgttgtccaaccatcaccactgtccattttcagaacttgtcatcttcccaaactgaacctctctgcctattaaacactaacttgccattccctcctctccccagcccctggtaatcaccattccactttctctgtctatccttttgatgactcaggtacctgaattcaatcgtatagtgtttctccatttttgactggtttatttcacttagcataatgtcctcaaggttcatccatgttgttgcctgtgtcagagtttctctccttttttaaggctgaataatattcccattatatgtgtatgtatatgccatattttatttatccattcacctgttgattgacatttgggttgtgttcacctagaactcataattgtttaaaggcaaaaacaaaataaggctctgtcctttgaaatttattttttattgttgttgttttttaatgcaaatttatgaaaaaagtatcaaggttttttgttttaatttttgtgagtacgcagtaggtgtatcgatgtccttagaaatttgtgatgatagaattatactttgtaaatgtgcatttttgctcatgtttgtaaccccagcactttgcgaggccaaggcaagtggatggcttgagctcaggtgttagagaccagcttgagcaacatagggagacccccatctctacaaaaaaaataaaaactaaaaattagctgggtgtggtggtgcatgcctgtagtaccagctattcgggagactgagatgggagaattgcttgagaccgggaggtgcaggctgtggtgggccgtgatcacgccattacactccagcttggatgacagaatgtgaccctgtctccaaaaacacagtgcatttttggacacttcaaaatacaggctcaattagttttctaagcagttacttcatcagcatgtgactggtattatttttctcacaattctgttactttagtcaatatttttatgctttgctttactacgtaaaatgttggattcttccccttagtaattgtctatgcttttctccagactcattaaaggtataaattaaattctgagttttacaccatgtttcctttggcagtggaattaaaattgggaaaaatcatctatattcatagagattaatggtgaagtctcttaaattagatacatgtctataaatatatattaattgttttcttttgctgctttactctggagcaaattttccaaaattgtaacgtgaagtacagtttagaggagaaacatctactatcagaatgtacttaaagagaccaatcttttcacctctttgtagtaaattggatgtttacattgtcatgagggtatctctcttggaagaaagaaattattctttattctgaggtcagttatagacagtttcagctaaaaattatgaggaactgattggttatgtctaaaactttgagttgggtttttgatacttgacttgttttgtatattcgtgactataattaatagcatctgcatggcaggtaagctatgttatccattgtgaatacaaggaaacgaggaaaaagagaccagaagtcttagggtccggagttggcagccatggatataacacgtggatagaaaaacacttctgtggtctttcaacaaggtggaattcccgacaggcaagaaaagccactaaagacccgaaggctccaaaacaaaagaccagctccaggatgccaagatcttccttggaatccctggacccccagatgtctgtaacttgcctccttatacacacctcatttttactgtctttcccaccctgcctggatactcttatttggttcagggggcaatagaaataagcaaagtcagccacatcaacacttaggctttctagcatcgaaatacagatgtgcgggcgtcattccagccacagcacttagcagtgacctagagaaacagatagcgcccttcatctctgatccatcctcctgaggcacagccctggaagaagcctttcctctgtgaagaaacctggggggagggttgctccagatccccagcctcctggccggccccttggtctccctcttggggcatgtcgaaacccagtctcccccaggtatcgcctgccttttgctatcccttggctgtgtgtgcaaccttagtgggtggaagcttatttacagtctgtaaagacatcaggataaaatcgtctagaacttttgaaaccagttggtgactgaaaaaattgctgcatatttttgttaggagtgctttttaaaatttgtttatggtattgactagcagtgaataattgctttattcacaaaagttcacttgtcctcagatctaggtggagatttcaggaaaatatgcagcttcagaattgaggcattgtaagttacttagcacctagcttctcctgaccccccaccccaagaagtaagcttgaatccaaaacacttagcttttcaactgccagaagaatggacggcattagcttcaggctcactcttggaagttgttcttgggttagccatgacatgcagctggctagcagtggattcaaaggctgtatgctgatgtgcttgtaaccagtgatttcttctcactggttttcctagcagtttataaagctttttggtgtaaaacagttggcaaaccatttttggaacaagcccagtagtaaatatttttggctttgtgggccaagctactcaattctgccctgtagcaatatgtaaaccaatgggtgtgactgtattacactaaaactttgggtggtgggagggggaaagaaagctggctggattggctcactggccacagtgtgccagaaaatggacagattaactggaatgaattgctgttgagttctactttactgtataggaaaatctaggttaataaaagttacagaatgtaggccgcgcacggtggctcacgcctctaatcccagcactctgggaggccgaggcgggtggatcacgaggtcagaggagttcaagaccagcctggccaatggggtgaaaccctgtctctactaaaaatacaaaaattagctggacgtggtagcgtgtgcctgtaatcccagctactcaggaggctgaggcaggagaattgcttgaaccaggaggcagaggttgcagtgagccgagatcgcaccactgcactgcagcctgggtgacagagcgagactctgtctcaaaaaaaagaaaaaagggaaaaaaagctgtagaatggatggcattcaagctgttacggagtcagtcaatacacattgggaggatactgtgtttagcactgagtagtgaatatcttaacatacacggcatggtataataatcggattagggctatgacaaaaaacagatacgtgttagcaaggatatggagaaattggaaccttcatacaccgatggtgggaatgtaaaacggtacagctgctgtagaaaacagcctggaagctcctcaggttgttaaatgtagttatcatagggcgcagcagttccactttataatagccaaaagtagacactgatgaatagataaaatgcggtctgtccatacaagtgaatgttactcaaccataaaaagaaatgaagtactgctacatgctacaacgtagataaacttagaaagcatcgtgctaagtgagagaagccagacccaagaggccacatattgtattactccatttatgtgaactgtctaggacaggcaaattcatggacacagaaagtacatttgtggttgccagaggctggagggattggaaaccgagtagtaatgagcacaaggtttctttcggggttaggggaaatgccctaatattgatggtggtgatggttgtacaactctgaaaatactaaaagccatgctttatttgagtgaatatatggtatttgaattacatttctataaagctattacaaaaacagtctagttccaggattaatgtatgagaaataattaataagtaatttaaaatggtcaaaaattattgtctggttaaaggagatctagaaaatgaatcagtatcttcaggtcccctgttttccattgtgtgtgttctcaagctttcccattccctggataaacaggagtcgtgtccagggaaggcaggccagggtgaggggtgtagtgcatccctgatcccctgagtggtaataaggtcagcccccagggcccattcccgccaagtgtgaggtatgtctgctgcgttccgaggacctgctctgcctcaggaattgctgctcgtggaaggctcatggaacatgcttctctgttacagattgaagagggcagtaaagccgcggcggtcgacaagttactggctggagatgagatcgtcggcatcaatgacattggtctctcagggtttagacaggaagcgatttgcctggtgaaggggtcccataagaccctgaagctggtcgtcaaaaggtaagatctgagcttcctcccacatttaccacgacacacaggaatgagtggaacatcaaagtgggaagccagttgtcctgcccacatcactacagagatctcgattgggacatgcacttagagttatatgtctcggccaagcatgggcccggcatcaagagtctgaacggttcctaattttattacgacgatttttataaattttaatgtattaagtggatttgaatactcgtatctttcctttgtttatatgtagattattttcttggcaggcagaaaacggtgcttatgctcccagtgaggtgacatgttgttgcctgtcttgtacacaaggtggcaggccactgcgctttctgttttcatgctagaaagagagtgactgtcacgaagatgccagccaccaagggtttagagcactgtgctgaggtctggagggagggtctggagggagctgtctgtctattcctgtacattacgtgtcagttggagcttggatggttttaagaggttagaaagtgaacttggggacatgatgcttttatatacaggaactaaagcaatactccaggtaccacaagagtgttggtgatatgtcgctttcaaagagaaataactctccaccttggttttaaagttggcttattaacaggcaagtgcttacacatccctcttgacaaaattagcatgttcttttgaaggctggctgtaaattttaattaattgacccacatttatttccatttttagtacagacatgaagatatcttccttgttttgaaaaaacaaaaatttttttttcaagtctggtcaagtgaagtagtgtgcgtggagaggaacaaagaaatctgtaactggttgtgactaattatttgtaaacaccgctgcactcaaaccagccaagacaaattcctaaaggcttttttgaagtgggggtgggtggagatgccaaaacagtatccaaagaaaagattcagaaatgaggaagggccagacgtgctggctcacacctgtaatcccagcactttgggaagccgaagcgggaggatcacttgagcccaggagttcaatcgagaccagcctgggcaacatagtgggaccccatctctctctcaaaaaatttttttttaattagctgggcatgatgatgcacacctgtggtcccagttactcgagaggttgatatgggaggattctttgagcctgggaggtcgaggctacaacgagccatgattgtgccactgtattccaggctgggtgacagagcaagaccctgtctcaaaaaaaaaaaaaaaaaaaaaaaaaaaaaaggggaggaaggaaaaacattttttgcctcatgaatttagcaaagtcaattgtaagtggtacatgctattcctgagcacccttttaacaactctttgtagatcagaaagtaaaatctcagaatggtggtttctgagccattggggagggtggggcacaagaggcaccatgacactgtgttatggttcctctgtgatcaccgtcttaaccctcctatagcagcacgtttgttcttacacgattcagttaacttagtggaatgccggtggtggtgagggaagcttgttctgcagaggtaagacgaggagttataaattggctctgggggtcatcatcccgctgccaaggctgactgcaactcccttttcttctgtctcctgtactgtctcgttctgggctcccagagaccccaaaaacactgggctgtgcttgtggtcttactgtgtgtctcttctttgatggagacaccagcttagtcagcatagctggccaactttgtatcaccagggcatagctatgcgtagaaattcctagcatgggagttcctgagtcggaaggtgtgtccgttgtgaatgttcagagacatttctgagtttctcagaccctttcacatcatctctagcataggatatttgtagtttgtttgtttgtattctctgaatgtgataggtgaaatatggttttctatttacatttgcatttccgtagttatgggagtgaagtcaggtatcattccatatgtttagaagcaaggtagatgtgattctttttttgagctagaagtacatatttagtgataaagatagacagtctaaaatctgttcaaaggaaagccatgccacaggagaactggttggtgggaggagagagcgaagcctcagggcatctgctggctggtttcactgagtaggtacttaaaagactcttgggaaaagggattaaacttttgccctgaaggatctccaggagccactgtgtagaatccccattttgtgttctgcagacccactttcctttaaatgagagatgtggacaaaatgataatgtggtttaaatagaattttatttaagtagtatgtgtaacgagatataaagcagcggagtttatttacaaatttttatttcccaacacactttcaataaccgtgttaggaaaaaacccacaagctgtttttcctctgctctcacacaacactcaacacagaagacttctgtgaccaaatgtgcatagaacttctaatactccaactacctttatgtggttttccttactacaaaagcaccaatgggtgctttcaaaattgttcttcttaaagccagaacacgtattcttctctatctaaatttaaatctctatttaaatctccccgccctcctctttctccattcctaggcaaccactaatctgccttctgtctctatggattaggtagcattttctggcattttatgtagagctccaggatggagcatgtacccttacaagtggctagttcatgaaaggaactctgcaggtagttcatagattgagacaccaacatattcatattctatattgctctgcttaaaagcgtgatcaaatggtaaactagcttgcccaagccttgtttgacttgttgcaattgtctgcccccatctgcaaaaatgtgatgagggaaagaggtatatacatctctgtgtaaagcacaggaatccgtggttttttgtttgttaaagacaggttcctgctcttttgcctaggctggagtgcagtggtgcgatcatagctcactgcagcctcgaactcttgggctcaagcgatcttcccaaagtgctggaattacaggcgtgagccgtcgcacctggcctctccatggttttttaaacatgatttgaatagtggttcacggataaactcccctccctgtagtgacagctgctacacgtcttattttgtaggctcattttatctttgtatgtgtggggaccaggggaccaggcagccaggataggattgcgatgggccactttcacaaagcggtggcatcttgtttcacaggcatgggcaacgtggaccttgtggtcgttgagaagctggtgctgggaaagcgatgcgggaggagacaggcggatcactatctccgcagacaaatgagggccagcgcttcctctcgcccagggcagtgggagctggagacaaagaacttgtaacaatcagccctaccaagtgcatgtatgttcttccttgtgaggtccaggtggcatccacggcccgagatgtcaggggaggggtgctgcccaggagtcagatctgtcggttaggtcaggaggagaggctgaggctggcagttttgcttttctctttcttcccaggcggtttgttgttctgtctctacttggcaggggagtgctccttgcaggaaagttcagggcagacatgtagccttttattatgtgtatgtgtgtgtccagtttttttccactgcactgttttcctaggtgcccaggcccacccctggagagtcctgggcaggtcttgaatggatctgggctctggaatcttcacacagagccacaggctatttcgctgggcattagcagcggatctaccgcttgctggccttaagcacaagttcttgggaaggttaaggccagaaaccgggtgaccctttggcattttcctcattaacttagcccagttgggttagtgcaaaagggaggtctgcctgatgccctcaagctgctccggaggagaggaagcagggttgggagggtggggaaggaccgagaaggggacggcagctcctagcttagctgggctcatcctatccactcggtgccagggaccgtggctgttgcctgttgctgtcttctctctgaaatctgcgttaacagctctagggacagagtcatccatttttctcccttcagaggcaaatggctgttaagttcagcttctaaaaagcacctgtaatttcaaacaccctagggaaaatttcttttaaatatcacatcataaattattttctaaagctttgcaattacccttttggctttttccccaaatatgcattataatattagttttgtttacagcaaatccacctgccaccttgtcacagaccccactctgggcagtttctcttgaaccggtcatgtgttgcgagtcattttgtgggggccaaatcgtggatagggttgattcatgtcacttcctgcctctttgctggcagccctaaaccctcttgtgaatctaattacatccactaagcttgcattcaggagcagcttagcagcagagggaagggttttctgcatcaggctgcaagggtttgcgagaccatgtggtgtggtcctgcatttgaagagaagaggctgcatgtcgagggagagcactcatgtttgctaggagctggtttcttacaacatgcgtcccgtcttgggcattgctaaggtgccctgactgctgctccaagcccacattgtgctgtgcccccctctgctgctggctccttggagctgtcctggagcaggtggccctgcagccctaaggttgattagcacagatgttccgggagctgctactcgcaacggtggcagcagtaaggggccgcctaagacgtcagcaggtttacacccccaccccactcccccagcaccccaccccctccagaactactcctgaggcagaaatggtgcatggtcagatggagggcatgctccttagtggggacactggaggacgtcaggtgaaacccatgccttcgaggctgtctgatgtctttgtctgtgattcaggagtgggtatttctattctgtgagcatttggggtctaatggctgtttgctactgtgcttattttcttgttaaaacaaaggagaccctgactggtttaggctattttccattattgtttttatttcatttatttattttattatgagtgaaggaaagaaaggagagagggagggagggaggatgggaaggaaggaaggatgaaatcttgctctgttgcccaggctggagtgcggtggctactgacaggcacaatcatagctcactgcagcctcaaactcctgggctcaagtgatcctcttgcctcagcctactgagtagctgggactacaggtgcatgccaccatgcccagcttattgtttttatttttttttatttaattttattttttctatttttttgagacagagtctccttctgttgctggagtgcagtggcaagatctcggctcactgcaaccttcgccacccgggttcaagcgattctcgtgcctcagcctccccagtagctgggactacaggcgtgtgccaccacacctggctaatttttgtatttttagtagggatggggttgcgccatgttggccaggctggtcttgaactcctggcctcaagaaatctgccccacttggcctgccaaagtgctgggattacaggcgtgagccactgcacccggccagcttattgtttttattaagtaaaatcaggagaaaaaagaaaaccacatagatcagaattgttttattttggggaaagttacttctattggggttttgccttagtgtgtggtttagctaatttaatcagatgaatcaatgtttgcaaatagtgatggtttctaatatagtaagacttacagagaatgtttagcttatttttgtgttgttttggggtctctggaggacctgtatgtgctatgcagtgggatccacactgtacaggttaagtttattttgaggttcaaggaattgagaagttagcattagccttaacgatgaagtttaaatgacttttatttttttatcggttccacaaatgatgtagacttttattttttaaaacagagcagctgtaatgagatccaccaaattgaaagccctgagctttaggagaaaaggttgatctacactggttgaattcccagtttgctattggcttggaaagaagagtgttctggtgagattttgagagcagactctgggaatgtcctctcttgagacttgagggcgcagggatctggggacaggtcttggtgtctgtcatctgggaggtagtgtcctgcgagaggcagcagcccagcagacaccaagggcccctgggatcacgtgctgacctcttagtgggcttagcagggcaggaggcccacatgtggcttctgtccagtgtgccactcgcccttgcagtcacccctaaaggacaggtagatgaggcctttgcaggtcgagacgtccccaaaggctctgtctgtcccacatggagcacactgagcgggtcccctctctgtccatcccgtccttggctgtggtggcactggcacgctgtggcatgctctgccctgcactggccgctttgtccagatggagacaaacgtgctttcagtgtgttgccaaggggcagggagaggtgatattggcagagccatgagcgatggctgcccggcaggtcataaaggcggagtaaatgtcgcctcttcttagaactgtcacctcaagcccggttaccactaacacccattggttccaaggtgggagagtttgggggaagaaatgaagtacccgacacagccttggccctttctacaaagtgaggggcataccttatctgtaacaaaagcctgttttttttgttgttgttgtttgtttgttttaatgtcacttgctaatttattcacacaaagaaaatgctccataatgaaaacaacttcatcccatgtctccctcccacccacacacactcaaacccctcctgtccccaactgcaagatgcgttcctacgtcttggctatctgaaggtacttttagaaccaaatcctcataaaaaccatttagaatagttgcctgataacttggttttattgttaaagaaagcctgtttgtggcagttagagtccaaaggcctttggaatggaatggagtggcatgtttaaggagagtgctcagaaggctttgctgaatggtagtcatgacagcattgatggggaggtgaagtgggctgattaaataactcgagtagttccgacgtccagaccatgttttggtaaggtagccagcgtcatggacagggcaggtagcaacagttctctgcaccacggagggtagttgtaccatttactctgctggttgtgggtgtgcttgcctttaatagtacggaaagcaaggtcattggtctgcagttatagtaaatgacaaagaagaggaaggaatcagatctttcttcagtgatttcactactttgatttgccaactatgacatggtggtttattaaatgtaaagacacagaggaatgttctctggctcaatgcccttgcaaagaaaaggatgcctgccaccctctcggtgagatgataagtgatcaaataagggaagatttttatcagccattcggcatatgtcgatcccatgtgagtggacgtctggcttaccatagtgaccacatgtgcagtggtatttaatagttctctgaatgtgtataggatctgtaaaaagtttggaataaaagcacaagcttcctttggagaaatgtgatttagttgtaatagcatttcactactgccacattcagttcacctgtggtggtagtgcctgtaactttgcattcagaggaattcgtggaccttcctccctctgcctccccgattttgccactgagtttcatctcttttcatggtctgggctcaatgtttctttgctgtgctgtgactgtaaagtctcttttattggttactttccctaaacctcgtatctcttctctataccttggtttttgtttttctatgaagagtatcttcttaactcttctagtaccttgagtaaccatgggctctgggaagggaatttgaggacaaattgagtaaaaatacagtaaattattatgggctttatgtaatgagcagaacatcagaaagggctaggtggggatattgtttgctgagctctagtgggcagaattccacaaagggctaggggagattgtttcttgaaatctctttcctttccctttgcgtctatttacatggctagagcgctttatacatagcatagcatttagagaacagcagtctgcaatcccttgttgcttttttttttttttttttggtatggcttttgccatgtgtatactgatatgttgactcaacaagttaaactttttgtgtcttttttcttatatccgtggtgttcatccttagggctatataaaacgagtcatattaatgactgcacacttgaatgtgctgagtttctttgccaacaaattcattctgttgaaacatagccaggaaattgtgtgggtgccctttttaaaacatcaagctgaatgaaatgatgatttgacacctggggcatatatatggttgaacacaagtggtttggatactgggacagcgatcgtctttttttttccttttctttccaacagtaatgggtttatagaaatgaacattacagaggttaatgggaaaaacaagtcattcgggtctgctccactcctctgttctgtgccgctcggttctgcctgtggcttctgtggcattcctctgcagtcttttctgccataggacccaggttgaacaccagaggtggaggccagaggcggggcacgctcttgctaggggtgaggcaggcaggctggccaggtggagagcaactctggggctctcaccccacgtgaatgctgctgctgggccctggcgtttgcttacaatgaggctctgatgtctcagtttcagctacttaggtcatttgggaatttttatcttgcctcagttctcttcatgtttaaaagcaggaactacttgcctcttatctcctaggaccatagactttatcagacatgatgtcaccattcacgcaggcattgccgcaccactgcctgggaaaagacactgcatataaatcttcccacagtgcctttagggggcgacttttcttatagaaaatacatgcagagttaaccatttctagagtgctctggcgtacttgtatacattcatgtgatgtatgtgagaagcactcccaccacgtggttaaaatcattcctttaggtcccgtcttccaggagcttgcagctgagtgggctgaagagctctcacaagtgcggactcagagaggaaggaagggtggaagttgatccaggaaagtctttgctgaggacaggccagcggagcgatcctttgtagctgagccagttttgagaggcagatataaacgtctgccagccatactaggtgctccaaagctggaagccatagctggaagttctagtgagaacagtagagggggaggcttgggagagggaggtggaaacgtaggatggggccagcacccagtggctcacacacagctgctcaggtggtgcagacactcctgtcccactgcagcccagacttccttggtcttggggaaatgagaatttgctttatctgccaagaccctagatgctacagacgctgccggcccagggagcatgctctgagaacccctggactagaccacagagaacctaggagcatggacttccttttgtggaaactgggagcagctgatggttctagagtgagggcaagacctggccagggctgtgttgcatgcagggagactgatctggcaggaggtgcaggcagactgggagaggaagaagccttccggaggattggcaggaaaaggaaggaagcagagtcagagctggggttcatttgatgtttgcagagaggtggtttttgtttaaaggattagaagagtgtgagcaattgccaggtaaattcccttctccccagaccctggggtctgacatcaggaagcttgtcacagtccctgaggcccccagactgtttccagggcttcccatcctggaccggtatctgcaaggcctttccaactgcagactcttctttcaaaacctgctcttccttatctccaagaagcccttagaaactattatttatctgttttcccacaaaacgttcctcagctcccagtgtaggccaaaagccccccacgtatgtaataccaccaacaccccccgccccccatcgcagtttccaggcagggggaccaggtgggcctgtgtttcagaccgtaggctcccagcaggccaaggcgcctcccctcccagaccctgccttggcctccagccagtgctcttactgtgcacttagttagctgggggcacgaaacacaaactatttgtcttgggaggaggtgcttctttgctttcttctaaaaggttaggaaaataacccaacactcgtgattttttttttcttttctttttttttttttttttttttagtttgagggaagggaaggaattctgctctttgtgaataataaagatttcattgaagcagttcttgtaataattccttttaaaaataaaacaggatatttgatatctaatctgttctttctttttttttagagatggagtcttgctctgtcacccaggcagaagaacagtggtgcaataatagctcgctgcagccttgaactcctgggctcaaacatacagctgttgttcttaatgttcaatgacatcctagcatttttttatatttgtgttctaaaccctgtcctttaaaaaaaaaaaaaaaaaaacccaaacactacctagcatataaaattactctaaaaaattgaagtaagtttcaatgaagtttggtatacaatccatggggaagggatttcaggggaacccaccattagaatgaatcattccatctggagtaccagaaaactcgatattgtcgataccatggtgttttgttatatgaaaggaatagtatgcattggctaaacattatgttttggaagaatgataatggcctgggctgggtgtggtggctcatgcctgtaatcccagcactttgggaggccgaggtgggaggattgcttgagcccaggagttcaagaccagcctgggtgacatgatgagacttcatctctttaaaaaatttttgaattaaataaataaaatttttaaatgataatggcttgggagaatgatcacaaaaccaggcagactggggaaagaaaggcactcgtcaagtctgcaggatgaaagggaatacacagaaacatgtctgtcctgcacatgagacccacggttctagggactaggtggtttaaagtgtttaaagagtgcgtggcttgtgcaggaggaaacaccacagccttcagtctactcaagtccttctgggagcccttgaaactcagccagagggaccgggagtgtaggcgggctctaggtggcgccagagcactctgtccccaactccacgggtctgtgattgagcgaccagcatgtaggggctgaaggtcctccccaccatctccttatcaacaccaatccagccatttcagaggtgccaacaaacagaaaccactctgaccccggcttgatccccaaatacattcattatgcaccaggaaattcagaagacttgagaaaaaaagcatatatattagtaaattttcactgtccacagtaaccaagatatcttcagttaaagcagaaagagtgcaactcttttcactgtgtgtcttcatttgcttatttaaaaaattatccctaggccaggtacaggggctcacgcctgtaatcccagcactttgaaagaccgaggcaggcagatttcttgagcccaggagtgtgagaccagcctgggcaacataacgataccccatctctcattatacaaaaagttagcttggcgtggtggtgtgtgtctgtggtcccagctactcaagaggctgaggcgggaggatcacttgagcccaggaggtcgaggctgcagtgagccatgattgcgtcactgtactccagcctgggtggcagagggagagcctgtcaaaaaaaaaaaaaaaaaagccacaattcgtataagaactgctgaccgtgtcatatgtaagaacacatatatctgtatattatctttttaaaaagcagcttctgggtttgttttcattttttcattgcctcatacagcattgctcattctcttcagacagtttggaaagagtgtgtgcttgtgcaggaataaaccaggtgagatgcattttctgaaggcatggaagtctcacttccaggcaggttccctgcctgcctccgacaactcccacccaagatgccttctgcacatgcattcccgtccatggggagccctcttccatgccatcagcctctctggctgtgacgcccctgttcggactgtcctatcttcctctttccctggcctgcattttgacctcaaccctgtatctttttgtccccgccgatggacacatccacagggatgtcccatagctatgggagatgcacaatatacactttgggtttttgttgttgttgataattatggtaaaatacacataaaatttaccatcctaaccattgtaatgttcagtagcattaagtgtattcacatcatacaaccaatctccagaaacttgtttcatcttgcaaaacagaggctctatatgcattaaacagcaacttctcagtctcccctcccccaccccctggcaaccaccattctactttctgcattcatgattttgacaaatcaggtacctcatataagttgaatcatacagcatttgtccttttgtaactgtctaatgtcacgtagcataccatccccaaggttcttccatgttgtagcatatgtcaaaatttccttttcattgacaagtaatattccattgtatggaatagaccacattttgtttgtccattcttccacccatggaacagtatacgttttgactaaatggccagctgttaaagtctgtattagatataagctgagtatcatcattatagaataaacttctaaggtaaaagtaaatctgaaatgatattattattacaattttgttttaaaacataatgttccgatttcaacagaatgattttggtccaggaacgggattgtttagccttctcagctgctagaaggcttctgtggtcactgccttattcatttgcaacactgaattaattcttattttagcctgaggccagtggaaggttgagatgtattttgggttttttggctaactgctggtttaggttaatgttaccagcaagctgctgtctccccgatgtaactgaccaagctaaagggctaatttctcttcatacttggatttaaggaatcggtgcatggggatgattcattttatttgaaacagttctgcaaactgaagctttgtgtacatggggaggaagatacttcctggatattttcagaagcagatttaaggccgagcatggtggcgcatgcctgtaatctcagtgctttcggaggctgaggcaggagagttgcttgaggccaggagtttgagaccagcctgggcaacatagcaagacctcatctctacaaaaaataaaaaattaaaattattatgtttttaaaagcagatttaagatgattactctccattttgatcatctttgctgcatgaaaagtggccccaaaattagtggtgtcaaacagaagttctagttgtaaaattgagcacaaagcaattggcctatacggaggtactcagaagcatgctatgtgttagggctggctatttcaagatttaaaaatatgctctagaaaatctctaaaaggtagttatctgcacatgatagaagggttggggagggaggcggtgtaaacagtcactgtgctagggttgcaggcagcagacagtcgcaggggcgtagcagcattcctgccatgcagctgagatggggttactacatctctaagccagtgctccagctgcagggctgcagatgttccatatctgtgctgcccaggcagtagccactacccacatgtggccattgagcactcgcaatgtggccagaatgaccaaggaactgaactttggattttgtcactttgaataaattaaccacttatgaataaggataagtgacttccctcctccctcttgactcgtcagtggctacacccgggattgatgtccatctgtccagggccaaagctaggaatagaggcagggcacagctgcgactcactctctcccttcccccatgacaggggccttccgcggggctggcttgagcagcagcagatgcccagaagctttgggccttggttctggctgctggctgggttcctcagtctttttccacgttgcctctgcaggggccatacgtgcaaatgacttccttctctcctgtgtctggtgcgtggggccaggaggttgggcgacagctggggctgcctggtgtcgctttccatacggccttatccacgtggctcacttgggcttcctcatgccatggcatggcacggtcactggattcctcataatctgtcacacgtatatattttttaaaagacagggtcttgctctgtcccccaggctggagtgcagtagcgcaaacacggctcactacagcctcaacctcctgggctcaaatcatcctcccacctcattctccctagtagctgcaaccacagatgcgcgccaccacgcccggctgatttttaaattttgtgctgagatggggtcttgctatgctacccaggctgatctcaaactcctggccgaaagcaatcctcccacggcagtctctcaaagtgctgggattacaggtgtgagccacagcacccggccatttgcatgcatactttgtgagaacaaaatctgttgctaatattcttatatgtgcttgctaatgatagtttatctgggagaacttttattgtacccatggagaactgctgaccctctaaaccagctagtagcccagttattcccgaagcagggctgaactagcgtcgtcttgagtgtcagacgttttcttttcctagccttctctttttctcccctttcctccagtttcagtcagtctagtttattttcttcattaattaactataaaggaagatgaaagaagttgtggatgtcatagcacagagaaagccagctgaaaatgaaattcacatggccagaaccttccttacgaggattttgagaaattccatgaggtacagtctgggttttacaattgctttccttccatggggtgctgaatttgtcttttatactttctctttggttcctgggaaactgtcataaagtcagcatgttccacattttgccacccgtatacttttcctcgttaaaatgatctgagtcatcgaaaggtttgtgttatacatgcttttcagttttattttgtaaaatgttctttattgcataatgttctttaatgtttttgcctgctgggaaaaacatctgatctccacaaagtatttaaagaggcccgcttgagctcgttctccattcttgattgggttatcagctgtcagttctgtcccaaattagagaaatgtaaagctggcttcctaccatgaggctggagaagtgagctcgggaggaggatctcacgcccagcagtgttcccctggaggccctattgcattaccgacatccattgggatttctaaccagacacacctcatcacatctgggcagatgtggccaagacactaagaagccacacatgggatggtggggactgtggcgggggagcccaggaaagctcgtccatattcaggagccctggctgaagggactttagccttttggtgtgggttgtcatgactccctggggggatctttggttgactaagaggctcaggggaagatgcggctactagtcttagttaaccagaaggtggctgtctttactttgttacctaggtaaatagacacagataagctgtctgaactgtgtgtgacccagccgcctgagggacccatataccttttctccagcaaaagataggagatgctgtttgtgttcatactggggcagggagagggcaacatttgcttacttatttatttagaataaatgttctttatttatttttacatttgtaagattttaaattgacaagttaacagttgtccatatttatggaggaacacattttagagataagggctggctgagtgtggtggctcacacctgtaatcccagtactttgggaggccaaggtgagtggatcacttgaggtcaggagttcaagaccagcctggccaacatggtaaaacctggtctctgctaaaaatacagaaattagctgggcgtggtggtgagcgcctgtaatcccagctacttgggaggctaaggcaggagaatcgcttgaacctgggaggcccaggttgcagtgagccaagatcatgccattgcactccagcctgggcaacaaagtgagactctgtctcaaaaataaaataaaaataaagataagggctgctgcacatctagagcctgtgattcccactctgcgttagggcaaatgggtggtgaacaaaaatctaaaaagaaggtgtgggtttggattcagctggcaacccctgaacatggtgccgtgcacctgcctgagttgctgtgatcagtgtcagtctctgcactgtttggcacaagcgtgcgcgctgtgcgcattccctgaaccccctgcactgtttggctcgagcgcgcacgcgctgcttgcggtccccaagccccctgcactgtttggcacgagcacgcgtgcgctgcgtgcggtcctcgagccccctgcactgtttggcacgagagtgcacgtgctgtgtgtggtctccaagtcccctgcactgttcgtttggcacacgcgcatgtgctgtgtgcagtcccgagccccctgcactgtttggcacaagcgcacgtgcgctgtgtgcggtcctcaagccccctgcactgtttggcacgagcgtgtgccctgtgtgcggtccccaagccccctgcactgtttggcacgagagtgagcgctgtgtgcagtccctgaccccccgcctcccctgcgttcttttctaggaggagcgagctgggctggaggcctcactcctggcatgccaccaagttctctgacagccaccccgagctagcggcctccccattcacctccaccagcggctgtccttcctggtccggccgacaccacgcgaggtaggcacccattcccgtccaggatgccaggtttgttcagccttctgcagggagcgcactcctgactgcagaatgattttgatgtttctgatgagactgggccaccgacacataatcacagttggagggctctgaatttttgactgaaccggcaagcgtgtgacacaaaatgaaatggcaagacaaggcatgagcaagaaggggagcataggacttgggtttcagccaagcttctttgggattggccaggtgggatgccaggcagtagggttctgagccggtggggtggcatccacggcacccctctcctttccagggttttacacatggactggaaggcaggagatatatatggggtggcaggtatatcttgtaaaagctcccaagaggttctttaagctttggtagcctctcctcaaccctcttggagttagtggcagtatcctcactagtctcctgttaagaggatggcggtaacagcagatagtctgcttttggtgtgcgtgtgtggatgtctccctgcttgcgtgagtgtgtgtgtgtatctgtgtatgtttacgggtgtgagtgtgtgggggggtgtgagtgtgcatgtgtatttctacacgtttgtgtgtgtgtgtctttgtatgtgtatgagtgttcatgtgtctgttcgtgtgtgcctgtatgtgtgcctgtgcatctctttgcttgtatgtgcatgtgtgtgcacatgtatatgtgtatgtgagtgtgtgagtatcagtgagcatgtttggtgtgtgtgtgtgtgtgtgtgtgtgcgcgtgcgtgcacacgcaggtatgtgtctgtgtttggagctaatgtaaccactcagtttttggctgttaataaatgctggtcttggctgggcgcaatggttcatgtctgtaatcccaacactttgggaagctaaggtgggaagattgtttgagttcaagaccacccgggacaacacagcaagaccccatctctattaaaaataaaagaaaattagctgggcattgtgtgcacacctgtagtcccagctactcaggagactgaggcagtaggatcactgaagcccaggagttcgaggctgcagtgagctatgattgcagcaccgcactccagtctgggcaacagagcaagacctcgtctcttaaaaaaaaaaaaaaaagaaaagaaaaaaaaatactggtctgtaaaattgcaaggtaaagatttatatgacacgaaggaaagacaactgaaatataacattacccctaaagtgacaaaagatgatggtatttagagcccagtgtattttttggggaaaaaaaaaacacaaaaaaacaaaaagccacagattctcaactgagtagtaacacttaagtgaacagtgggccttttattttattcctgaagtgacttaaggtgatgagatctccattaagcccatttggcagtctcttgatgaaagaaacatgcacactgcccacatctgtgtggaaacagtgctcagagttctctagatctgcttggacttgggatctcacagaaaagtcccttccagaatactggtgggtagtcaggagcatgccccgggtttgaggatacgtggtctgttcttacagaagatgggtgggaaacccaaacagtcctctccctcccatagatgacagccagttgttctccagtgttctgtcctggtcacacggttctctcatcctcactctcccccaacctagtggagccacagcttcttcctgttgaagggtgaacatctcagctttgttgagctttaaagaaagcacttaacatcctggataaatagtttcaccattgagagctctcagtcacacacagttattaccttacagaggaatcaatgtgtcaactcaccgtcaatttcatcctcttagacaccatcctgtttaggagcctgtgttttttggtgtgagtgtcaataactctgtagggtataaccagttagctgaaagctgaacacagcagtgtgtgatattattattattattattatctttgaaacagggttttactccattgcccaggctggagtgcagtggcgcagtcacagctcactgcagcctcaacctcccaggctcaagccatcttcccacctcagcctcccaagtagctgggactacaggcatgcaccaccacatccagctaattttttaaaaagtttttatagagatgggggtctcactatattgctaagtaaggctggtctcaaactcctggcctcaagtgatcctccagcctcaagtgatcctcctgccttagcgtctcaaagcactgggatttcaggtgtgagccaccaaacctggtctgtaacaggctagctagtaaatgcttttggctttgcaggccgcacatctctgttgcagttactcagctctttcattatagcccaagagcagccacagacactacgcagacacatgggcacagttgggttccagtaaagcttcatgtatgaactgaaatttgaatttcatatcattttcacaggtgaaataggagaaatagtatgcctcttctcccaccataaaacatataaaaaccatttgggctgggtgcggtggctcatatctgtaatcccagcactttgggaggccgaggcaggcagatcacttgaggtcaggaattcgagaccagcctggccaacatggtgaaaccccgtctctactaaaaatacaacaaaattagccgggcacagtggcaggcacctataatcccagctactcgggaggctgaggcaggagaatcgcttgaacccaggaggcgaaggttgcagtgagctgagatcacgcgtctgcactccagcctaggcgacagagtgagactgtctcaaaaaaaaaaaaaaaaccaaaatcaacaacaacaacaacctgagttgtggtgtggccacccctgcgcttaactgttgattgaccatagacgtgtaaatgcagacgttgcctgccaacgatccgggcatcaggctgagaatgtgcgctagggttgcaaggcatctgtttggtaaaagccatgtaacagggaggacacagtcttttcagcctgtgcccagtttctccgtgtctctactaaaatccagatgtgctgagctgcaacctcagcctcagcaacatcaccgtgggaaattactgtttggcattttggtatttccacagagggtcagctgcgtccaccgccttgccctttgccattgctgttgctaaagcacaccatgccttgtccttcttctcattcttgcagttcttcctcccacgacctgtccagttcctgggagcagacgaacctacagcgcaccttagatcacttcagctccttggggagcgttgacagcctggaccacccctccagtcgcctctcggtggccaagtccaacagcagcatcgaccacctgggcagccacagcaagcgcgactcggcctacggctccttctccaccagctctagcactcctgaccacaccttgtccaaagccgacacgtcctccgcagagaacatcctctacactgtgggcctctgggaggctcccaggcagggtggccggcaggcccaggccgcaggcgaccctcagggctcggaggagaagctcagttgtttcccgcccagggtccccggtgacagcggcaaaggccccaggccagagtacaatgccgagcccaagctggctgcccctgggaggtccaattttgggccagtctggtatgttcccgataagaagaaagcaccatcatccccacctcctccccctccccctctccgcagtgacagctttgctgccaccaagagccacgagaaggcccagggccctgtgttctcagaggcggctgcggcacagcactttacggccctggcccaggctcagcctcgtggtgaccggagaccagagctcaccgatcggccttggaggtcagcacacccggggagcctcgggaagggatcgggaggcccgggctgcccacaggaggcccacgcagacggcagctggccgccctccaaggatggagcttccagtaggctgcaggcctctctgtccagctcagatgtgcgcttccctcagtctcctcatagcggccgacaccctcccctatacagcgaccacagccccctctgtgctgacagccttgggcaggagccaggggctgccagcttccagaacgacagccctcctcaggtgagggggctcagcagctgtgaccagaagctggggagcggctggcagggtccccggccctgtgtgcagggagacctgcaagcagcacagctctgggcgggatgctggccttctgacacagcccttggagccctcgagagtcttcccccacccacggtgggccagagcccacgccatcacctacctcagcctgagggtcctccggatgcccgcgagacaggacggtgttacccgctggacaaaggggccgagggctgctccgcgggagcccaggagcctcccagggccagccgtgcagaaaaagccagccagaggctggcagccagcatcacgtgggcagatggggagagcagcaggatctgcccgcaggagacgcccctgttgcactccctgacccaggaggggaagcgccggcctgagagcagtccagaggacagcgccaccagaccgccaccgttcgacgcccacgtgggcaagcccacccgaagaagcgaccgctttgccaccaccctgcggaatgagatccagatgcatagagccaagctgcagaagagccggagcacagtggctctgactgcagcaggggaggcggaggatggcaccggccgctggagggccgggttgggaggtggcacccaggaaggacccctcgctggcacctataaagaccacctgaaagaggcccaagcccgggtcctgagggccacgtccttcaagcgccgcgacttggaccccaacccaggagacctatacccggagtcactggaacaccggatgggggatccagacactgtcccccacttctgggaggcaggcctggcccagccaccctcatctacaagtggcgggccccacccgccccgcatcggaggccggagacggttcacagctgagcagaaattgaagtcctactcggaacctgagaagatgaacgaggtgggcctcacgaggggctacagtcctcaccagcaccccaggacatctgaggatactgtgggcacgtttgctgacaggtggaagttttttgaggaaacgagcaaacctgttccccagaggcctgcccagaagcaagctcttcacggaatcccgagagacaagccagagaggccgcggacagcgggccgcacatgtgagggcacggagccctggtcgcgcaccacctcccttggggacagcctcaacgctcacagcgcagcggagaaggcagggacttcagacctgccgcggaggctcggcacctttgcagagtatcaggcctcttggaaggaacagaggaaacctctggaggccaggagctctgggcgctgccactcagcggatgacatcctggatgtgagcctggacccacaggagaggccgcagcacgttcatgggaggtcccggtcttcaccgtccacagaccactacaagcaggtaagcatggagccacagcccccttgaccatcatcttaacccaaggacaggacacacccagaatgcagtggctgacgccagggctactcagctccagctgtgcgagcatttaccttttccagatctcctagtgtcctctgttagaggtatttggggacaaagttgacaccttcaaggcaatttaaactgccatattcccgaaaacccacatttttcattctcgttctcgttgccataatctctggctttaactgagtttccccttaagtagcttgctcctaccttcatactcagcaaagaacttggagggagaaactatggaaaatgataactaacgcctctgacatggaaatgtgtggtttatgtaaaagcttaaaatgacatacagtagccacttttcaaacactgatggatgacctttaatatttatagtatttgggtttttttagtattctgttttttatttgcaagtattttcaaggattgctctgggacaaaatgtatttaaaacacattaagtgattgcactttattaaggtgagagttttgatggtgagagttaatgtccagctttctagaaaactgcatatttcttagccctgcttcaaagtgaacagtctctttctctcttgcacctaccccctttgaaagctttttctccctattacatctgcacttgcacatctcaaagaaaaaaatgttccacaatgatagatgcagtttctttttaaaagaatccagggtgggtgcggtggtgcatttgcagttctagtactttggaagaccgaggaaggatgatcacttgaggccaggagttccagaccagtctgggcaacaaagcaagaccttatctctacaaaaaaaaaaaaaagaaaaaaaaaacttaagacaggtgtggcggtgcccaaggaggttcaggttgtggcgaactgtgttctcaccactatactccagcctgggcaaaagagcaagaccctgtctcaaaaaaaaaaaaaaaaaaaagaaccactagtaatttaatacaagatacctaataagtgcatggaaagaaggctgctggtttgctctgtggcgtcccagccctgaaaatccacacagatgctgtgagtgtttatttccactgttggataccctggcttgtggctattcagcatgacctctgagaattccatgcttgctctgtcaggagcaaagaatcccaggctctgacgagtactagagcttgaggcttcaccgctgtaatttgtgaccagctgtattttattttatttcttttggccaattgtgccacacggttttacaggcttcacgtaggagttgtttcctgcccagaacagaagtggacgtggggtcttatttcagtcatctcaatgaaatgctttgtagaactgccctggcaaggcaaacccacaaatgagggctttcataatcacagatgtcctgaggaaggcagcttgaggacttggtgtctcattatgttgccctttgcaggaagcttctgtcgaactgcgaaggcaggcaggggaccccggcgagcccagagaagagcttccctccgcagtccgggccgaggagggacagtccacgccgaggtgggtgaaatttggattcagagttactgaagaggcgtctgagggtgggcttctgtacgatgggtgggtgcttggttaacatggctagatgtctggcttttgccaaacccaaagcggctgaaatccggcgtgatttctagcatccctgacgtactggaggtctgggcagagcctgtgcaccctgcagccctgcctggagacacatcccagggcggggaggccttcttacacggcggtgacattttttggttcttaaaatggctactgtgttttccgcacggtgagactgcttatggagacataatgagaagtccagttgaacatactggagctgcacgctttgcacagagcgccttatggaagggcagctttagctatctagcacacagctgtgtgcctagccgcggcctggaaatcagagttgcctctaaggattgttagtaagaaaggaacagggcaggccttcctaaattggacctagttaatgagttaattttgagctttaaaatagaaatcgagttagtcacctcccaaagagaggcttcaagcatctgcaggaactgtggcagcagcaggagattagagcgttttgtgccataattccagaatgtgcgccgtagccgcttagttgagacaaggacagggttagattaaatacatagtataatctgtgctgggtgtggtggttcacacctgtattcccagcactttgggaggctgaggcaggtgaatcgcttgagcccaggagttcaagaccagcctgggcaacatggtgagatcccatctctactaaaaatagaaaaaaaaaaattagccaggtgtggtggcagatgcctgtagtcccagctaccctggaggctgagctactcgttcaagcacgagaatcgcttgaacctgggaagtggatgttgcagtgaatggggattgcgccactgcactccagcctgggcaacagagcgagaccctgtctcaaaaaaaaaaaaatagtataatcttccccttcatcacacgaggagggcaggcagagagtgtgcgtctctacagaagatgtggtgcaatcttgtttcaaaaaggcggatggagggatgggagtaaatgcacgacagggtccccgggtgtggatttttctgtcgccttgagaatgttgtgtgattgccatgacattcacattaaacactgacctcaaaactcaaggttctgttgcagaaattaccaatttaaaagtttgctttcaagagcctcatgtaatggggttttatttcatttggccttaaacagagctgttatccttctacaaggggatcaaatatttatgtgactctgcaacgacaggattgatattgtgtgtgtgcttgtgtaggaagtctctgcagttacttaacagactctgaggctgaaaccaagaatgcgtgggtcagaaaggccgacgaataatccacctacagaatttagctgtgtctgagaagcacaattagagctttatgactgtggattccaagtaggtcacgtgccgagcaccagctgcagtctgttttccaagccagctcccaggccgttgaggctggccgtgcagtgcatcgtgggcagtgctcgatgggctctgcacatgcgggccttgctttgcccgatgccaccagtgtatcatctgtgcagagggcacccgtgctggtgagagtgtatagctctgctgtgcatggagggggtcgccctgaacagctgtcacgtgcaggctgtgtgtgagtgagtgaatggcactgtcgatactgaaagggtcgagaggaagcggggccccctgcttcattcatcaaggccatgtctcccagcagactgcataaccactccaaagaaattagttccagaaactctctgcttttgagctaccaacccagcaattttcagaattgttgggtgcggttttttttttgagtggtgaggcgcgatgaaattcgagaatatgtaggttgaaaagttgttttcaacttttttcagagactctttaatttctgaaggaccagcaagaaagaatacacttgaaaaatttcaatggagaataatagaagtcaaagttcaggcaagggattgttctttgcccaccaaaaagaaaatctagaatacaaaggtttgaagatacccagtgttttgcataagtttcaaataacgtaaacatgtctgtgtaaatcatatgaagtgctgctctgataatcgatgcgtagcaaaaagtatgtattgtattctgtttggataacaaaagaatgttgagatcggaattgttttttgttgttgttgctcatgtgaaccaaatagagataacattttttgtgaagttcaagatcctgttaatataaagacaagtagggcagattgaagtgatgatactttttttttaagttacatgatgtttcagaagctcagaggagatagagcaaagtgacttctggctgggttatgggagaaacaggtggcgtttgagctaaaatagaactgaacctgagggagcagacccagcacgtttgcttccctccagctcttctgtcctgaacagcccaccgcaccccagcccccacccccactgccatcagaggcttcacctcagacccacaagctcaggcatcatagccagctggagcctgctttggggaaatgctctctcctgctgacttggggccccttgaatgctgggtctgtttcctagtgtggccataacaaactccccaagactgggggactcaaacaacagaagtggattctcccacagtcctagaggctggaagttccagagcaaggtgtgagcagggctggttcctcctggggcctctctcctaggcttgtagatgccgtcttctccctgtgtcctcacaaggtcgtccctctgcgcatttttgtatcatttcttcttataaggaccccagtcctattggatcagagccctccccaatggccctaattacctaattttaccttaattacttcttctaaggccctgtcttccaatacagtcacattctgagatactaagagttatggcttcagcacattgattttgtggggcacagttcagtccctaacactgggagaaatgtccctgcttctccattctacctttatagtaaccacttctacctgctgtcagctctctcaggaagtgtcatcctacccttgagctgatcaggctttacgttcatgacagatgtgaaagcctttaagatgaagggaagagggagctgtcaccctgtgggtggcacagaagaggggcatttggcaaaacctgactggagggctttttgagaaacctgtctggagggttccttggcaccatgcaactgaaggctgacagctctgcacaccttctggttcagtcaatccatctttaagagtttaccttgaaagtggacatccactgccccatgaatgtgctaacctcttcaaactgggatggtttggcagggggacagtgactcttaaactcacatcacggatgtatttgtacaccttcactattccttgctgtctgctgggctggaccgttggctcctggaagatgggattttactttttcatttctcagtaccccgtacctgacataattcctgcacagattacatgctcaataaatggttggatggatggagggactggtggatggacagatgggtggttgagtagacagatggatggaccagtcctcaggtagatagttggagggtggggagggtgggtggatgaatagttggatggatggaagggtaagtggatagatggatggatggatgcatggatggatacatggatgagatgtagggatgcatggatggatagatggatgaatggaagagtaagtggatggatggatagatgggtgtgtggatggatgcagaggtgtatggatggatggatgggagggtaagtggttggatggacgaatggaaaagtaagtgggtgggtgggaggatggatggataagtagatggatggatgaaagggagggtgagtgggtggatagatggatggatagaggggagggcaagtggatggatggatacatgggtgcatggatggatggaggcatgggaaggtggatggatgagtgaatgggaagatagaaggatgggtaggtggatgtataaacagatggattggtggctgaatggataaataccaggctgaccttccttgagttagtctttcttgattgtggtgaataatctttccatattggtacattgtgtgtcctaaaattttatttagaattttagtttacacactagtaagtgaaatggcctttatttatccttctgcactagcatggcatttggaatcaagaagacataaacatctcaaaataaatttggtagcacagatttgttttgggtatgagattttagaccttgtaggaaagtttagaggtaccacatttgttcgttgctcctcaatttcgagaggccttgggtgaggactgtgttctgggtggctccagagactggcactgaaatgagatctgggggcggccccctggagctgtgggtgctggcagtgtcttccttctgtgccttcttgcagccacttccgcccccgcctgcaggagccactgccaagcactgatgagctggcactgacctcaggcttgtattttgttgggacagatgggaggggaggcaaagaaagagagtatatcctaaatcccaataccagctgcaaaattgaatgcatacgaaatagagctctttagggaaaaatttgctttcatataatatgtataaacaagctaaatgaacctgagggtcatcttcctggatgttttccctgagaggtgacttggtgtacagagattcatgtgaagaccaatttttcatttacaaaacaagctccttcatgtagatttcagaataagtaacagagatttatcatccaagctctccccctcatttgtcactttagggcagatgtttgctttccctggccttcaattagctcagggcaattgaagctttccattctgagctgctgtgctaggtaattatgaatagactgtgctggatcgggtcaggataaaaaggtgaaacttgatcttggaattttgtcagggcagagcccagcattctgcatagctttgtacagtgtagtactgcatgctgagcagaaaggttcttgtgcagggagtacttgcggatgtaacaccctcaccccagaagggataaacggtagctgtaggagagagcctgcggcatgggtctagcggacttccctttatgtctttttttgatgttgttttttgagacagggtctcgccctgtcacccaggctggagtgcagtagtgcgacctctgctcactgcagcctccacctcctgggctcacgtgatcctcccacctcagcctctggagtagctgggactataggtgcacaccaccatgccagctaatgtttgtattttttttgtaaagatgaggtctcaccgtgttgcccaagctggtcttgaactcctgggctcaagcgatccacccatctcagcctcccaaagtgctgagattacaggtgtgagccaccacacctggccttgtttttatgccttactttgcaactacaatttccccttacatttatacccatggggactttaagaaacccaggaccgagacaggcggccacccgtttgtttactttttggtttggtcgcgtgattctagattatttagaaggaatagctttcaggtgatagtttatggttacaggatttcggctaaggaggagaagcgggagcagggaggcagatccacaaagccctcgtgtggagggagaagtgtgcaaaaggagggtgaaagtgaccaatgccccaagatgccagagctgagggaagccagagggaaatgcagaggaaaatttaactcaggcatctcagttctagatggggcaggtaagcagtcttctacaaacagaatttgtgtcattgagcagggcacagtggcacgtgtctctaatcccagcactttgggagtctgaggcaggaggatcacttgagtccaggagttcgagaccagctggggcaacctagcaatactctatctctacaaaaaatacaacagttgctgccccatggttgggtgccaacatacgtagctgtactcgcacaggatccttgatccctcatgtgactcctaggctgtggcctgagacttgcctttccagaagaatccagccctgtggaaagctgcccctttgtttcccagcagccccatccctggagcccccagcggcctctcttgggggagagactcccgtagcacgtgctgacgtggcagccccgctctgctctgcctctcctctggcctcctttcttgtcagctggctgcgttcttcaaagctctcagcctctgggccgaccttggctgcgttcgcatgttacgggatcctttggggctttcacctttctccagagagctacctggaaacatagatgtccattctcccctttagcttcttccagcctccattcctcttggctgtgtcctagtccagtcctccacccagattgggctgaggtgacacagacatccacccagaaggctgtacagattgataaccgattgattcattcaaagggtcttgctctgtcacccaggctggagtgcagtggcacaatcatggctcactgcagcctcaacctccaagctcaagtgatcctcccgagtagctgggatcacaggcatgcgccagcacacctagctaattaaaaaaacaaaaaaagtttttgtagagaaggccttgccatgttgctcagggtggcctcaaactcctggcctcaagtgatcctcttgcctcagcctctcagagtgctgggattacaagggtgagccaccacaccacacccagccaatgtgttcatttttaaagtttgacttaagagtcccatagattcagtgtcttatgtggcagttaggtccttgcagttagtctcagaaatcgatttagctcatctgttttctgaaggcccacacatttgaaataaaaaaggaaatagttctgagtcacctccttctcaatataaatagaaaatgcattcaaatattcccacaagttttgtgtcttttaaatctgcacaaacccaaagaattcctagaggaggccgccagagctagcagcacgtgtcaggtctgcatcccaccgggccagctgagcaacccgcttcaggcccctgcataccacacagctcaccaccgcctccaacgccaggagagtccagaaggccggagggcgagggaggactgacgcgtgggcggtgacggcgcgggagccagtgatgtatttctgctttgggctttctcgcacgtggcacttggagcacatccttgggaacatgtctgtcctctttgccagtttaaatttttgtgtgttcgtttccatactagctcttagaatctaaatcaagtgttgtggatggtgtgcaagaccatggctgtgtatgtgtgtgtgggagtctcattgaccacagtgctgacacagtttcccttggtggaagtaaagagtaagttcaggactcccctgtaaatgatgtgctccccatggatgagggacaggaagaacatcagggtaccgtgccagcagagctctgtgccctgttagtcgaaacaaaagtgatggctgagatgagtccttctgtggcacccaggaaactttgatagctgggccaagaagcagcggcactgcagtgccctgggccgcgagcatcatggtttatgctcagcaaagccacatcacctgtcatatagacctgacatcagctttacagttttgcttgcatataacttgcaaattttgttttgtgttttatagcctaagaaccattaaaataaggaaacagattttatatagagacatttagcagtctaataaaaaaaaataaaaatcacatattgtatgatgccatttatataaaatgtccagaataggcacatccgtagatagaaagtagattagtggctgccaggggttaagaggggagaagtgagggagagactgttcatgggcgtggggtttctttctggagtaatgaaaatcctctagaatctgatagtggtgatggtgactgctgtgatatactaaaaactactgaactgcgctgtttcaaagggcacattttatgatatattttatctcagtctttaaaaaaaaatctcaacactgggaatccataagaaaactttttttaatttaaaatgggtctgtcaggcagggcgtggtggctcacgcctgtaatcccagcactctgggaagccaaggcgggtggatcacctgaggtcaggagtttgagaccagcctggccaacatggtgaaaccccgtctctactaaaatattagccaggtgtggtggcagtcacctgtaatcccagctactcaggaggctgaggcaggagaatcgcttgaacctgggaggcggaggttgcagtgagccgagatcgtgccattgcactccagcctgggcaacaagagtgaaactgtctcaaaaaaaattaaaataaataaataaataaaatgggtctgtgcattaagcagctgtagttcagagattgacaaagtttgcggaagatgagatgataaatatgtttggctcagaggaacatagtgtccctgctgcgaccactcagctctgccgtgatagcgcaaaagcagccacacggtgaccaggttgccctccctgcaggcctgctaagaggactctggctagattccagcccttgctggtccccctggcgttggggcaggggggaggcgggcagcatccctactgtcccaccggacccagcagccacaggggcctttcgcttctccacattccttcctgccctgccctaaagcaggaagcaagacaaggaaacctctgagtcaggtatgtggatgtcctctgcagaactcgcctggtcccttccttcaagtcatttgtttctttctgtgagtcagccctgcctcctgtttaccaggcacaggtagttttacctgtggctccctgagcagaactggagccggtgtaacacaggctgtgtctctgaatagaaagtctccacactgccgtgccgctctccactctgtgtttgcccactgtatgcaccagagcaccctcccggctccccttctcctaagcaaatcccacacacctgcatcccatccttcctcagatcacttccggaatcatctgcagagtttgggtttcatggtttgtgcgacactctcaagcagctcacccaaatcgggtggtgtcagatggtaaagggttgaggggtctaggtcagggtcacttggaaacaagttcctgggggagcagagcaactttcttctctacttggaagaatatgataaagcacccctagactcactggtttcgagttctagggaagcagatattgatgactcaacagaggaaaggattgtgtaatcattgctttagtcaggggttagcaaactatggtccacaggccaactctggccccctgtctgtttttttaaataaagttttattggcatgcagccacatccgtttgctcacaggcggcctgtggctgctccctctctataatggcagagagttgagtcattgcaacagatcggatggctcctagggctgaaaatatctgccatctggtcctttacacaaaggtttgcttgccgaccatgttgggcttagtggaggggtgtaagggatggtcttacatgagtgtgcttccagcacagggagcatggaacccagtggcagtctgtctggatgttttcaaagaggcttctttgtaatagttcgcgattatcttgcaacatgatatccatctccccatccctagtgtggttaacttggggaagtttgctttgtccaagtagagggggctgtagcttgttcacagcccaagaatgcaggagcacgcaggatgctggagcaccagcttttctgacttgttagtgatagcctgggttagggaaggttgtccttggaccacatgggctgggcatgcccctcaattcatggaaagtgactcagaaaagttcaaggtttcaccaagactaagaggtgaggaggaagttctttcagaacataagggtactagggtggtgatttcattctgttctttttttatgtgtggactttttcaagggcacaaatgttttgtgtcaattaaaagcagatttgtatgcattttgttacaatgattatgattttaaagtcttaatagtattatactatacaatctacaaaaagatttgagcatcttataagccctgataattatgcctcgctctaagaaacatgggtatctggaaagccacattataaactttaatattataaatgtgctttctgtttagaaggaattcttggagggtctcctttaagagtggattcctaggccaggcacaggggctcatgcctataatcccagcactttgggaggctgagaggattgcttgagcccaggagttcaataccagcctgggcaacatagtgagaccccatctctacaaaaaaaatttagctgggcatggtggtgcacctgtagtcccagttatttgggaggctggattgggaggatcgcttgagcctgggaggtcaaggctgcagtgagctatgatggtgccactgcacttcagcctgggtgacagtgagaccctctctcaaaaataaataaataaataaataaataaataaaaacaaaaataaaaaaacaggattcctagagcacagccagcatgcagaacttgttttctaaggcttttctccaataaaaggaaccagggctcctcagaggaatgactgagtctagggttggggcagggactgtacaagatgagcctggagtatcttatagtgccagaaaataagcgctcaaatacacccatatgtaaacccagcggtgacaacagtgtgggtatgtcatagggacacaggaaccaacaatgaccaaaggcagaacaagttaagcagcaaaattaagtagtagtggattataatccaatatataaaatgaatccacagcccagactgatacgcaggatggttgaataaattaacaaatgaagaatagagaaatctgctgtgcagaaaattgcaaatactttatgtagctactgtgcccttaaggaggtggagcatagctcccccgctccccgctcagtgtgggctgccaacagtaagctccctccaaagagtacagtgtggcaaaggggaccgaggagaggaacatcacagtggagaaactggtgtataccaacttcaccaggcgatcagggccaacgttgacaggtaagtcacattgacagcatgccccttgatatcataggataacagtggcacttcacttccatggtctctctcccagaagtcccaggctaatcataaaaacacatcagacagttcccaattgagagacatgctgcaaaatgccggaacagacctcttcaaaactattaaggtcatcaaaaacaaggaaagcctgagaaactatcatagcctattcaggctgctataataaaacacctaagattatatgatttataaacagcagaaatgtatttgtcacagttctggaggctgggaagtctaagatcgaggcactggcagattcggtgtctggtgaaggtgctttctggctcacaaatggctgtctctctgctgcgtcctcacatgatggaaggggagagggagctctcaggggtcccttttatgagggcactaatcccattcgcaagagctccatccttatgacctcatcacctcccagaggccccacctcctaacaccatcacctgggggttaggtttcaacataggaatttgggggtggggggcacaagtgttcagtctaaagctatagcaccctcacagcaagaggagtctgaagaagcaggcctgagtatgatgcagtacctggatgaggttcaaagacagaaggagaacattgattaaacagaaaatttgaataaagtgtgacctttagttaatattaatgtaccaatattgattcattaactatgacaaacacaccccatagtaagtcagatattaataatagggggaagtgggtagagggcatatgggagctctcgcctggctgttgcaattttttagtaaatctaaacccattctaaaatgagatgctggccaggcgcaatgggtcatgcttgtaatccaagcactttgggaggttgaggcaggaggattgcttgaagccaggagtttgagaccagcctgggcaacatagcaagaccctggccaggtgcagtggctcacgcctgtaatcccagcactttgggaggctgaggcgggcgtatcacttgaggtcaggagttcgagaccagcctgaccaacatggtgaaaccccgtctctaataaaaatacaaaaattagctgggcatggtggcgtgcacctgtaatctcagctactcgggaggctgaggcaggtgaattgcttgaacccaggaggcggaggttgcagtgagctgagatggtgccactgcgcttttgcctgggtgacagagtgagactccatctcaaaaaaaaaaaagtataatgaaatatttattttttacaaatttttatgtagagaccaggtcttgccatgttgcccaggctggtctccaactcctgggctcaagcagtcctcccgcctcggcctcccaaaagtgctggggttataggcgtgaaccaccacacccagccctataataaaatatttaatcagccatcagctgattgctgttccgtgtgtggcctggcagtatgtgttgagcatttgagaaaaggtgatggcccggggtgaatggcaccctctcttagagacagtaacatgtacttggtaaagtaatacgtgaagatgaaaagtactggaaagaacacgggcttcggagttgaagacacaggctggaatcctcattctgcctctcagtgtaagtgtgtcaggtcccccaagcttgctgacctcacggccctggatcatggggatatgcagagcaaccttgctcgcagacttatttacatgcttaagggatataacattaatgaatcagcacagtgcctaaggttaagtgtcgatatgggggaaaaaaatctaaaatagcagtgatacagtataggctgcaaagcagcatatgttatttggagaaatgagcaagagttggaagtaattgctatgaatgtagaagagggtgacaggaacaggttggaaagagaaactccgtcctggtggctaagcccaggatgtgggagggtgggatagggctgtgaggcgcagtggctggcgacgctgcttcctggaggggctgtggtgctgaggtctggggctgcgttaggagggaggtggggctcagggactttaaatagagatcattgtgaaatggttaattgggaaagtcaggtccagcctgcctttgtcttccctgagtgccttgcacacactcaaagttccggaaacgcttgttagttgcttgatgggttacattcctaatgagtgtgtaatcaacccaagaatatatggacatagaataggctgttgaatgttttctttttcctccttatggttgtggagttgaactgtgtgtcacatatgttataggattatctagcatcacttaatagagaaagctgtaacatcagtgcagtgggctttctatatttccccgttaaaatataagaagtgctgggcacagtggctcacacctataatcccagcactttgggaggctgaggcaggaagatcacttgagcccaggagttggaggctacagtgagccatgatcataccactgcactccagcctgggagacagagcaagatcctttctccaaacacacacacacacacacacacacacacacacacacacacacacataaaggaagactgccccccaagccttttggggttttaaattacaagacacacacacacacacacacacacacacacacacacacacacacacacacacataaaggaagactgccccccaagccttttggggttttaaattacaagacttttggggtttaagcactgaagtgttgggaatgttccccactgaggcaaggagttgctgatgaagtgatgggaaatgcaagcggagccttgagccgtggaggtgaaggttgacggagcctgcgtgagcttgcccatcaacaagacagcaggcacagacaggccagctgttgtgagcttggctttaggactccattcagtaggcaggaggagagctgcagcagaggcgggctgtgggtccctgaagcacatcgctgccttcacagctgggcgaactcccatccagcacggtaagcagagccgggtaagggacctctgcgtttgctctcggggcacttcatcccagatgggaccggtttcaggacgcctgcgccgtttgttaggggtttgtagttcccagtggctcttttgttctgctatcttgaagggcaggttgcttgtcagctcacaatgctgtgggtaaggtctggtgaggtcggcgaatgtgttctcattgtttattcttctgcctgaagatgagaaataatgcaaatcagggtgcagattccggctcgagctccacaggcgtgcacgtatgtgtaagggcatgctcgccggtgctgcatgtcctcgtggatgcatgcaatttttacagctttgggattcacggttagctgaaagcacattggaactggaaggcggtgctcttaacaccgtgttctaggctggaagccgtagagccatcatctgctctgatgggactgcagcccttggtatgtgggacccttgctccatgtgagttctgcagatgggttccccgagggagctggctggaggacgccagcatcgcatgaagacctgcctgcctcgtttgccttttgtttttcagtagcagtaagaaacaggcattctcactacacaggcattgaatgcggacattgagaaaaaatggtgagtcagctacatcctcaagaaaaaaaagcggcgaaatcaggtgtgcatgtttagtcatgagaaatgttccctgagtgcgtttgcacatagcctgctgattgcagtgagataatttaaatagagaaaatggaatcaccatggttcttagcattttccagttcttttattttgctctttggtgtgattgtgacagtttaagggttttactatacatgtgctttttcccccattttatgttgtgataaaagaaagagatgattagttttggctatatttctaaatggttggaatgcctttgctttactaaaggaggcttttgtgtgtgcagagggtcgatggcattttcacagggaaattgatgcataaatatgtttgcacacacaggctgtctctttggtctgcatttactgactcacaagagtaggtgtcattttgaaatgcatgtttttagcggttgtgctagttgaaaggtaaaaaggcaaaggagtttgaagaaaggtttttggaaatctacctggtagcacttacgagtaaacagcctactgcctcgtagatggtcttaagatttataagatgaatggaaaataatattttaatgtatcatataaaaaaactgaagatttggtaccaagttgatgaatggttggcatatttcttttcattacggaatagaacctttgaggtcatactctacaagtatttcttattattttattgcggaaaagcattgcatgggtggtagaggcacatttctttcttttgtcacacatagtggcaaaaacattttatactttgtccctttctgtttctccgcctccacctgcgcccacccccctgcccccccgcccctcccgccccgatcaccaccaacccaaaccaacaccatacctcttaaggaaaaaaattgcaggggaattctcatctacagaggcatgaacaacacacacagagttttttacagagtgctaggaataaccatacacgttggtgtcaagcatataggctgcggaaggctctattgcccagccagagggacaaatgaccctggtgaatgcacgctgactgctgcttgttttgcatgggctggctgctcttccagagtccgcctttggattttggaggttgaggaaggaagggaatattttatgtggcctttggaatacatttactttacactacctttaattttttacctctcatatgcattaaatttttaagaagaccagggtaggggagcagtgggaagaagctgatgtcttgtatccacccatctttcccctgtcctcgggcactgatttccagctggcttttcctagagcaagtaagacagtcgggtcatttctggaaggcttgtagacatccttggatgtctgaagaggtcctagagttatttacttatttacctttaaaacatatttgccgacaccttatttaaaattcctgaaagttcacagtgcctcttcatatgtataccttgggtcctactatgcggttaccatcttgattttataataaagcaaactgggggcggggtgactagattctcacaaccagttagtgaagagccctcgtggggcagcatggctgattttcagtctggtgggctcctgcggactaatgggtcgaggtcctccaggtaaggctgaatgtagaactggcccaagaattcctagttattctcttagtaactttcacatcccttatccagtttgctgccagtgcagtgagaaggaatttcagtttggacttctgggagtgaagtacagaaacccgttaatcaggcagagacagcatgtgtgctcctcagcctgcgttggtgtggcttgcgaagccacctaagcattctgaccctccatttcttcatccataaaacaaggaacacagattaaattatttcttatttaaaaattatttattttttatgtttaccattaccttgatcttgaagtttaaattatttcccaggtcccttccagctgtagtcatttttggttcttagggagagaagccagggactcaaatttcccttcagtcatatttccagctctgtggggtgatttgtggctgcactgttttgctcatttgccgtcattatttccaggaacaaaagcatatgaatatatatgagacacacgcacaggggtaatagcttcgatatccatttacaaataaaatcagctctgtcagcaaactcaattttctgtcaacagggctttgttgatgggaatgcccttgacagctaagcctacttcggtcttcttgtggtaatgcctcataaagccactcactgccaaggtgctcttgggtataacttgcatgaaatttgttataaaattattccgttaaaaaaatctagctggcggacccttaaatgtacttggaggccattaagggtggaaaagctagaaattctaggaaaattttcaacatttatacacgtgtgtgtgtatacacatatacatgcccatacacatatgtgtactacacacattttctatagtaattatgcatataaagttaatgtcatgtacaacaaatatctgaagtctattggataaacaatccatttccgattctggttcagctgagttagaagataggcaggcaatgatctgagatggaaggtttccacagtttggggtcacgtgcaattgtgatagaaggaagattgagattttctcttaatttatgaagctgatatgctattctaactagtttttaatatatcttaccacagggccacccaaaattcaaaattactcctgattttgtaagcttcacatatgtttttgagaatgaggttttatactaatctgggattacagctttctaggctgtgatatacagtttttattaacatttcctattttaaaaatcaattttgctaattaaaacctttttattaagaatatatagaagttctgggaagcagagtgaggatattaacaaatcaccctcaatcctatcacccagagtctccgctgtggaacatggaagtatatctgctttgaagtccttgcaaatatgtttttacacatgcaattatattacacatactgtatgtaagctgcctttttctgtaacttgtatgtgtatggtgcatgacattctaaaatctaacaaccctgtagccatactgtggacatttagggctgctgttggtgtttgacgttgtaaataatactgcagcagatatctgtagtgaaatacttgtgctcttccatgttgatttccttcggataaaattctgggcatggagttgctaggcaggcgctagaaaatatcaccacgttgccctccaaaaagtgtatgcttactatttacactctaggggcaccgatcgcccaggacagtcctacttctcccaaaactttgtcaatattagacatttttaaaattctgtggtttgataggcaaaaaagttatttcatttttaacttgcatttcttcagggactagcaaagtcagacttttttggtgcactgactagccatttgtgttttttcttttgtacattactcttcagcgcgtgttcattttcctactgaagatgagccctttcttgattattgtcatttaggttgcagataacatccctaccgtgtgctgtgtgccttccagatgttagtgggtggttacagttcaacttttttgacatacaagtgtgttgaattttagcgttgtcgcccttgcacctggagcctctgtgtggccagttctgccttttggtggctactggcttctgttagttgtacattgccattactggtctcttgttaccatgtgtgccgcagaaggtgtagccaccaggagctctgtcagcatgaattccctaggaggtgtagacatccatctcggaaggctggtagaaaaattgtctctgtggaaaaattaagaagtgcccagctttccgacaaccctaactcatcgtagttcccatcttttgctctggttgacaggaaactcgtggtcctattggaagcacaaccataggacctctgtacattctcgtgtccggtctgctctttgcataagggtgcttgcccctgcttgtgcccttctgctttttgtttacatttgctctcactgtgatgtttttatgttcattttgatactcaagttgtgtgtttgttctcctgcgtgagacacttctaaacatttcatcatttagggtatacatagatcaaagtaagtggggaccacataaacatatgtagaaacacgttctgaacaccaaagagcttctcggtcaccagttaatattgtggttctttgttgttgttgttgttgttgttgttgttgttttttgagatggagtctcgctctgtcacccaggctggagtgcagtgccgcaatctcagctcactgcaacctctgcctcctgggttcagccagttctcctgccttagcctcccaagtagctgggattacaagcatgcgccaccacgcccagctaatttttttttgtatttttagtagagacagggtgtcaccatattggccaggctggtctcgaactcctgaccttgtgatccacctgccttggcctcccaaagtgctgggattacaggcgtgagccaccacacctggccaatattgttattacagtcactgttttatggaaaaacttagtgacctcatatcgttcttactgggcaagtgagcctaacacaatctgtttctatagtaattgtggaaatgtgacgttacagtggaagaggagagttgggacatggctgtggagtggagctggggctgtccacctctcacttagtatggaatcctctcctaggcccttcagctccagcacactggaagtctaaggggttttgtttgtctgtttgcccctatgttttaatcaccgctaggatcagaagaactgcagtctctgtgaacaggtcttcaggtgacatcagtgtgttacctccctggttagcaattagcattcccgaggtcgggtgctgtgctgcatgcaaagttgaatcaggcacagacagaaccttccttgaaggagtttgtcctctcttaatagtgaagataatatagaaattgtcctagccagtttacactcctaaaacaaattaccatagactaggaggcttaaacaacagacttttattgctcacagttcttctggaggctggtagtccaacgtcaaggtgctggcctgtggattcctggttcacagatggcactttctacctgtgtcctcacatgagggagagcagagagaggaagcaagctccctcgcatatcttttctttttttgagacagggtctggttctgtcactccaggctagagtgcagtggtgcaatcacagctcactgcagcctcaaactcccaaactcctaggctcaagcaatcttcccacctcagcctcctgagtaactgggactttaggcatgtaccaccatgcctggctaattttgtttgtttttgtagagatggagtctcattatgttggccaggagggtctcaaactccgggcctcaagcagtcctcccaccttggcctcccaaagtgctgggattacacgcttcagccacaatgctatccttgagtgcttcttatgagggtactcatccattcctgagggcttcaccctcctgactgcatcaccttccaaaggctccacctcttcatcctatcccattggggttaggatttcaacttatggatttgggaggcagggcacaggcatttagactgcaacataaatgtgaatggctgaggagcatgggattcagaaggcccgagcacatcaggctgcctgctttgctttctgctcctttcttctctcttccctcctcccttcctttgtttctttgttccttctttcctgttgactcagtgagcttttgctgcaatctgctttgtgccaggcattgtgttggacctggaatacagaggtagatgaggcaggggtgagcacagtcgtttcagctaggaggagagatactaaatgaaaataccacagaatggtgaagtgcagtctaggaatcaacaggtagagattcagtactgtgcaagttcagagaagaaaggcatatctgtgtcaatgggtccaggaaatgtttcatggaggaggttgcttttttttttttttttttttttttttgagatgaagtcttgctctgttgccagtctggagtgcagtggcatgatatcagctcactgcaacctctgcctcctgggttcaagtgattctcctgccttagcctcctgagtagctgggactacaggcgcccaccaccatgcccagctaatttttctatttttagtagagacagggtttcaccatgttgggcaggatggtcttgatctcctgacctcgtgatctgcccccctcagcctcccaaactgctgggattacaggcgtgaaccaccgcacccggccccgcatttcactggatcttcagaacaggaatggcttccttggggagggtcccaaaaagtgcgaatcaaaacagagatttgggaaccaccaggcatgcataggtagggcagggcatctcaactcactgcaacccatcagagagtacatctcaacccactacagctcatcagacagtacatcttaactcactacaactcatcagactgacatctcaaatcactacagctcatcacagagtacaactcaactcagtacaactcatcagacagacatctcaaatcactacagctcatcagacagacaaatcactacagctcatcagacagacatctcaactcactataactcagacatctcaaatcactacaactcatcagacatctcaactcactataactcagacagacatctcaactcactacaactcatcagacatctcaacttcactacggttcatcagacagacatctcaaatcactacaactcatcagacatctcaactcgctacaactcatcagacagacatctcaaatcactacagctcctcagacagtatatctcaactcaccacaactcatcagacagacatctcagctcactacaactcatcagacagtacctctcaagtcactgagttttatggtctgtgactgataccccgatagagttgtggaggtgaaaagaatacaggtgaaagtgtttggtaatatgaacacctcctagatccatcctagatgtctagaaattcacatacacatttgtggctcagaagagcatgtaggtgtagggaacaaggtgtaaggtaaactcaaattcatacattgcttgttacctctgcccagaccttagtagctttaagcttttgtcaataatagatcatacctaataaatattacacaacccagatgcttctaaaactattattgaggtaaatgaaaatgtctgccacagtaagatagtatttatcacagagattcagatatgattttttttctcttttaacctaaagaaatatagtaataacaaaaaagtcagctaatatgctataagcaattgttgggaatcttggcatgaaatccagttagggtactgattgtgcccatatcagatttttagaagcagataacctgatgtgtttatgagttttatttctggtctgctttctcctcaaaatttcctgtgtatacattgaaaacaaaaagccagccacagatcacttgatcattatagcataaagagtagaataattgtgttagttaccttgctgcataacaaatcgtccaccaatttggtggcttgaacaccactaaacatttattatctcatacactttctgagggttagggaggagattagctgggttattgtggctcagcatctcctgagattgcagtcaacacgtgggccaggacagccgtcttccaaaggcttgcttggagctagaggatccgcttccaagagggcacccatatgtctgttggcaggaggcctcagttcctccccacatggatctccgtatagggctgcttgagtgtcctcacaacatggttgttggcttccccgctgtgagttatcctcgggagagaggaaggaggaagttgcaatgcctgtgtgatctggtctcagaagtcacacatcggcacttctgccatacatttttaaaccaatttattgaggtataattgacatataaaaggctgtacatatttaatgtatacaacttgatgaatttggagataagtatctataagcctgtgaaatcatcaccacaatcagtgccttaaacggatccatcacctccaaaagttttctcccaccctgtcaaccctctttttttttgttgtcattgataagatctacccccttagcaaatttgtaaatgtacaatacagaattattaactacagacgctgcgctgtgcagtaggtctctgggtaattcatcttgcgtaattgaaactttgtgccctctcaccaatacctccctgtttccccttcccccatcccctaacaaccaccattcattctatttgaaagtttaaaattcttcacgtaagtgggaccatgtagcacttgtctttctgtgcctggcttgtctcacttagcataatgtcctgtaggctcatccatgttgtcacaaatggcaagatttccctcctttttaagtcttttctattcctctatatgcacgcatcacattttctttattcactcatctgtcaatgtctgcttaggtggcttccatgccttggcattcacaatataaatagttcacacaagtgaactattcacaatagttcatgtcgtagtaaacatgtgagttctgccatattttgcttgttcaaaaggagtcagagtccggcctacttctaacaagctccacttgtttgaaggaaggagtttcaaaggaattgttggaacttctttgtttgtttgttttttagaaatgagttctctgtctgttgcccaggctggcatgcagtgacatagtcatggctcagtgcatcgttgaattcctggattcaagtgatcctcctgcctcagctttccaagtagctgggactacaggtgcatgccaccatacttggataatttttttaaaaacttttctttcggtaccagatcttgctatgttgcccaggctggtctcaaactcctggcctcaagtgaccctcctgcctaggcaacccaagttgctgggactccaggcatgagccactgtgcctggctgattttgataactttatacacctcgtaatcaaaacagtaagttccagaaagctcctttgtactctttccaatgaaaccctgccccacaaccatccctccctgatgtgtgaccctagtgagtgttgcctcttcttgagcttcatgtaaactggaccctacttgtgcgttctttggcggttgacccttcattcagggtcgtgcccctgggacccattctcactgctgtgtctcggtagtttttctaaattactggctagtgttcccttctgtgaatacagcaccactggttgatccactcaccagtaggtgggcagtgtttggccaacatgaatgagggcttgtgttgtttctcttgggtgagagagttgtttctctgggagcggtggactggctgggtcgcagggcaggtgtgtgagagtctccttcctcacacagtttcactaggactcagaagccatggtcttttctctcctgtgaagggcttgagactttctggaattgagttcatgtagctgtcctcagcttttgatgagggacgtgtgtgtgttccaataacacttcgtttacaaaaccaggaggcagtggagagttggcccttggtttctagtttgcaaactcctggtctagaaggtaagacaaatattaatttttaaaacccgcgtgtctgtaattgctcattttgaaagcactgtgaagggaacactaagggagaggggatgggaagactttttacatgtgtgtggggagtctgatgaatttgtaaaacctatgattttataacttttctggcctctttttagttgctactgtgagcagtagtccatatgtgaaccagagtggacctccacaagctgccttttgaagttgttacagttagcagagacgaactggcccagggttcaagaagcctttctggctggaggaatgtggatcagtccctccaggcctggaagagggcagtggggggcggggggtgcactcaatcttaccattttcacagatgagagtaatttcatttcagaggggtatgccaaggcagcgatgaaaacttcaggaatagctttgaatatctaaaggaagtgggtaagaaagtgggaggttgggagttccggagggagagttcctgtaaagcagagattcccagggctggctcaacatccacattgcctggagggctttccctgaaacacaggcttgcaggcatgccagcccttgctatttcccacctctgcccaggcctggccctcatcaaggcgggagagcccagctcccagggctcacgctctggaaccaagaatgtggctctccaggcacagagacaatagaggcctggaacagatcctcaaaatgtgtgtgctgaagacatactcagggtccgatacttgagggccatctcacattatcatctccaaatctaggcaggttctgttattgggcattaacccctcgagaaatcagtgcctgtaactatgatttggatcatctgtgctttggatttctcttttaatcttctctgtctcctcccattcttaaccacaagtgatttatcagcctctctaattcaacttcattactctttgccatccaagtccctgcaagcacaaataaaacccaaaggaagcagcagacctttttatccatctgtgaagacactcaagaaacactaaattcatctgactttctagagtaattgctttccccacatggcactagaatcctggcatacagggagcagcttcagcagagacacggcagtagagaaatgactgactgaaggatggttcagggctgttgtcctccctgaaggtggttccaacaggacacaaaagttgcagcagagcctgtgagaacagctgtgtcctttgtcgtcactagctggtctgtctgttcattgggcaatttcagtttttatgactgaaagctgggcatgcaaaggacaaccaaacagcctctagcctgctgatgctcacagtctggaaagtcctatggtaaatcaatatttcttttttgcttttcagagacagtctcactctgttacccaggcaagagtgcagtggcatgatcatcgctcactgcagcctccaactcctgggctcaagcaatcctcccgcttcagcctcctgagtagctgggactaaaggtgcccaccaccatgcctggctggtttttcaattttttgtagagacagggtcttgctatgttgcccaggctggtctctaactccttgcctcgggcagtcctcctgccttggcctccctaagtgttgggattgcaggcacggggcaccacatccaggcttttttcatttgtttttagagacagggtctccctctgtcacccaggctggagtgcagtggtgtgatcatggctcactgcaaccttgaactcccagggtcaagcaattctctcacctcagcctcctgagtagttgggactgcaggcatgcatcaccatacctggctaatttttaattttttttttatttttattttttgtagagactgggtcttgctatgttgttcagagtggtcttgaattcctcccacctcggcctcccacagcactgggattataggtgtgagccactgtgctcagcctggtaaattggtatgtctaaggagagtgtttggtgccattgttcccaggtgttcacactgtttaaaatgtttctaatacatctcagcattgataggttggttgcttggttggtttcttgcctcttttgggctccatcgccttccccactgtctcctttttccacctcatctggcctttgtggagtgctgtgttggcaaaagagctttccacctgtgcctccccaagggtgtgtgtctgtaagagctgcccagggcctgggaaggacagtggagacaccaggtactcgttcgggagacttgtgctcaaaatgacatgggtgtgccggctcttagctgcctgacccgcattctgaggcctggtggcgccgtgcttcttcagcgtgtgaacacctgcctggcagcgtctgatacacctcaccaggctgaagggcagaccagctacctgtgattcctgataaaaattctgtgctttacagaatcccttctatttatgcccacaaccaatggaggagtgctttctagatgataacctcaaactgtcagtgttgagcttgagttgatgtttgagttactgagcgttccacgttccatgctcatggaaacctggctctgtttggaagcagcaatgctgggccctaccccagttgtcccatgagataattgtgctctgtgcacacagttccggtcccagaccctggctttgtagcatacattttcaaggaggactcttgggccaccacagatactgccctatccattgctatttttgatggtatgcttgtgtataatacgtttgtatatggcataagttagcagaatatgtaaatgaaaggaggaaacacctcaatgtcattatccacgggaagtgtgttcactctgtctcttcattgtaaaaatgaggcagtgccgttgcccagagctctcttggcaccttttatacccctcaccggctggcttggtcggctgcaggggtgcccttcccatctcattggctgggtgtgttgcatggtgttatgctttgggaagaaggttgtatggtgctggtgtcacagaggcctgtgtccaggtctgccccatcacagactgaccctttggtcttaggtgctcagcaggtgcctggctcataggaagcccacgcaactccatctcccacaccagggcctttatctgctgctagctcaccgccatcctatgcgatgtggcctgtgatcagcttgtacaggagaggcagctttctggggtgtagttgcctgcctgacgtcacatagctggcacgtgatggatcccgattggatgtgtctgcccggggaaacctcaagtcacaggcagctagcacagctcaagcgtccctaatcagaaggtctgaaatcttaaatgcttcaaagttcaaaactttttgagcaccaacatgatgccataaaggaaaaattccacagctgatctcgtgggatgtgtcgcagtgagaatgcaggtagagactgggcaagctgctgctgtttgctgttgctggcgcctcacagctgaggcgggtgttctggtgccattgccgtgctgcttacttaccctggacacattcctctctcactgtattgatggtatatcgtgcttttcactgttgagtgcttatatatcagtataggaaaattattgcttgttggcagcatataaattcagagtccggaatgacggagatgccagacaactacagattgtgcacatgggtggcagagagactgacacttttgctttatgatggttcggtggatacaaactttgtttcgtgcacaaaattattaagcatattgtataaaattaccttcaggctatctatataaagtgtatatgaagcaaaatgagtgtcaggtttagacttgagtcccacccccgagatgtctcattatgtatgtgtaaatattccaaaatccaaaaacgtctgaaatccaaaacacttctggtcccaagcatttcggaagagagatgtttaacccgtactttagaaagcactcaggcgctggagttcatcgcgggcagcatttcagcagcacctgtgttgtgtgtctgcaaatcagaatgcatccctatcccatcattgacaccaaaagtagttatgatgcctgtggcagtggctcatgcctgtactcccagcactttgggaggccaaggcaaaaggatcacttgagcccaggagtttgaggccagcatgggcaacatggtgaaccccatctctacaaaataatttaaaaactagccaggccatagtggcatacacctgtggtcccagctagtcaggagactaaggcaggagggtcacttgagcctgggaggtcgagactacagtgacccgtgatcacgctgctgcactccagcctgggcaaaacagcaagaccctatctctgtctccaaaaaaaaaaaaaaaaaaaaaaaaaaaaaaaaagtaggtgaggaggaccctgtggtgtgtgttccttaagtcatctgcaagattcagaaattttcccatcctccttgctaaagataattgttaaccctattcagaaaacagtggtggattattgattacagagcagttcaaaactgtttagttgtgttgggaacattcacacacaaggtcctttcacggagaacttaaccatggtgtcttgaaaaaatgcagcttctcaccttttaaaattccgcacaaaaaaagtgaaagtgattgaaagcaacaggtgcatttacattgtgttcaagtgagggcataacatgatgcatgtaataaatatttgcttgcaaggccctgaaggaaatagcccagatccctgccctctgtagaggtgctttcagcccagggaggagcgtggaggcaggtgagcaatgggatgatttgagagagtccccttgctggggcgtgacctggaggtggggtgatgtcagggcaggactgggggagctgagggctgtgtggaggcaggggcagtgcaaggagaccttgcattcagacatggggctggctgtctcgtcgtggaagcaaaaatagagtaatgccagcaggatctctagagtgtttgtttttttcctaacagtggtttcggtcctgtcatagcatgctgggtgactgagtacactaatggtggcccttcctgcaggtttgtccccttcatataagttctgtttggctttgaggtgctgttttagagcttcatgctctgtctccttcagtggcggccagcccagggagaatggcagggccgtgggctccatgtagcagatctctgaagccactgctgcttggagcctgccggccctctcccctctgggaactgtgcaagcagctgtctccttgggaacgtggcattagcatgttttgcatgagaatgaacaccaaccaaggctgaatatcaattggatcctagagtgcagctgcctttgaaatgttcctttgtgtggccgaacttcctgctgcagttgattcctggagcttgtgcgaagacacaaagtcttaagtcatcttagtgccttgcttactctatctctggatcttgctgtcaccatttattttatccttagaagtatggcaaagagaaatgcatacatatatgcagagacacatgtctacacacaggcacaacagagacacacgtacctacacatgcacacaacatatacaacccgggcacacactcacaacatgcatctccacacagacacaacacaggcacacatacccacacacgcatacaacgcacaacacaggcacacacatacaacacacatggacacagagacatgcatctacacacatacacaacccaggcgtacacatacaacatacatctacacacagacacatgtgtacattcagacacaacccagactcctacatctacacatgcaaacaaccagacatacacatacaacgtacatctatgcagagatatacatctacacacatacacagcgcaggcacacacacagtgtacatatagacagacagacatttatacacatacaacatgcatctacacacacaaaacatagacacagacaacatctacacatagatctgtacacatacacaccagatgcatacaacatatagacatgcacgtaacacatagacatgcatctgtgcgcaagcacaacatggaccactcacacacacaacctgcagagctgcctcttggaaccagttagaaacaaaagttggaatatgaccccagcaagtccccaatccccatttttggtccttttcttcgtttgtgttgttgaccctgatggcccagattcttatcaactgcgacaataaaaaccaattagtgattttatagtttgactttgcaaggtgggggtggggggcaaacttggtccagacattgctgtgctgctgcaggtctgaatgaagtgcagtgttgggctggagcgcgccccgtgctgcacttctggcgtgggaagtgacgatgcagcacacaccactcccctgagaacagagcacccagctcctgtagtttggccctctaggaagatgggaaggagcctgtgggcaccttctgattaggagagaagccaggagccagcctgccgtccactttctcagtgggtctcttgctccatgtcattgttcacttctcacagggcctttgctccctgcaggtgagttctctttcgtttatgggtggatctcggagcacttctgcagaaggcactttgcaaatagagttcctttttaatcagtgggtgaccaaaggcacttggattttagcaataaattataggtcatttaattatctgtttctgtgatgtggtgatgtgatatggtttggctgtgtccccacccaaatctcaacttgaattgtatttctgagaattcccacgtgttgtgggagggacccagggggaagtaattgaatcatggggcctggtctttcccctgctattcttgtgatagcaaataagtctcacaagacctgatgggtttatcaggggtttccgcttttgcttcctccgttttctcttgccactgccatgtaagaagtgcctttcacctcccgccatgattctgaggcctccccagccatgtggaactctaagtccaattaaacgtcactttgttcccagtttcaggtatgtctttatcagcagcgtgaaaacgaactaatacctggcgcttttaaataacaggtaccaggtgctttcaagtgggtctatgggtgatagatttcaggagttttcaaagggaaaaaaagtgcaagtgtacctcaactctttggcatgaaatgaattattgaacgctgaaatattgaggctgggcgcagtgactcacacctgtaatcccagcacttgggaggccaaggcaggtggatcccttgagtccaggagtttgagaccagcctgggcaacatggtgaaaccctatctctacaaaaatacaaaaattagctgggtgtggtggtgcacacctgtggtcccagctgctagggaggttgaggtgggaggatcatctgccaaggaagtggaggctgcagtgagcccagattgtgcactccagcctggacaacagagtaagaccctgtctcaaaaaaaaaaaaagaaaagaaagaaagaaagaaagaaagaaatatggaaatgaaatggaatattgaattctgaaccattgaatattgaaatgcaatgtgggggagacatctgacctgtgagagcgcttctcagaatgcaaatcagtttggcagtattttaatgtcattctgtgttttataaccagacaaatgtattgttctctaacccatgcatagctgtgttcaagttttgttttgttttgttttgtttttttgagacggagtcttgctttgtcacccaggctggagtgcagtggtatgatctcagctcactgcaacctccacctcccaggttcaagcaattctcgtgcctcagccttccgagtagctgggattacaggtacacgccaccatgcccggctaatttttgcatttttagtagagatggggcttcaccatgttggccaggctggtctcgaactcctgacctcaagtgatccacccgcctcggcctcccaaagtgctgggattacagatgtgagccactgtgcccagccattcaagttattttgataacacttcaagctaggagtttctgttagtgtctgtctgatgcacatgagaaatctgacttctttgagtggggttgctgttgtctgaagctgaggttgagctatttggttacagcttgttttctaagcctgtgctgtgtcttcagcctcctctaagctgagagcagaggaggctgccctcccaacactttgggaccagacctcccaacactttgggaggccgaggcaggtggatcgcttgaggacaggagttcaagaccagcctgaccaacatggtgaaaccccatctctactaaaaatacgaaaattagccgggcgtggtggcgcatgcctgtagatctagctactccgcaggcaggcaagaggatcacttgaacccaggagtttgagaccagcctgggcagcacagtgagaccccatctctactaaaattttaaaagttagccaggcatggtggtgggcacctatagtctcagctacttgggaagctgaggtggtaggattgcttgagtccaggagttcgaggctgcagcatgctatgatcacactgtactccagcctgggtgacaaagcgagaccccaactctttaaaagagcctttgttggtcttaattttcataatacaatactgattttcaaggttttattaaagaattgatttgcagctcatcttagaaaggtttacccctttgtatatggcaatttcccataagccacataaaaatactgtgacttgaagtaaatatttctgaatctagctgtatgtgagcatttccacaaacattaatgttgtttctaaagtttttgttcatttattcctgcaaaaacaaatgcaatttgtgtgtgtatgtgtgtctgtgtgtgatgtgtgcgcctgtgtcttgaatgcttcatgttcccttgtgggacatgccagtcgacagcctcatgttgtctgaggtgcgtcacgactccccaccttgcatgaggagttgcggtggcgacaggtgtgggaaagtgcatatggatttaactcctgaaagtggcttaaggggattgtgaagatccaggtccagtcccttgtggtgggaaggtattattggaatcgttgattaatttgtacttgttcttcctctagacaagcagatgcccagtgtcgggaaggcagcccaggatcacagcagcacccaccgagtcagaaggcaccgaacccacccacattctctgaactatctcactgccggggagccccagagctgccccgggagggccggggccgagcgggaaccctacctcgagattatagatactcggaggagagcaccccagcagacttgggaccccgagcccagagccctggctcacccctgcatgctcgaggacaagactcgtggccagtgagctcagccctgctctccaagaggccagccccacagaggccaccgccacccaagcgcgagcccaggagatacagggccacagacggcgcacctgctgacgcccccgtgggcgtcctcggcaggcccttcccaacgccatcccctgcgtccctggatgtgtatgtggcccgcctgtccctctcccacagcccctctgtgttcagcagtgcccagccccaggacaccccgaaggccactgtctgtgagcgtggaagccagcatgtgagcggggacgcatcacgtcctctgccagaagcactgctccctcccaagcagcagcacctgcgcctgcagacggccaccatggagacctcgcgctccccctcgccccagttcgccccccagaaactgacggacaaacctcccctgctcatccaggatgaggattcaaccaggtactgtcctgcgacggtgttccctccccatgaggctcctaatgtgggacgcgggttctcagtgggtctttctggggagtcacctgggcaccttgctttagctcaaggcgttggacttaaagtcagtactggggaataactgtgtggacagaaagtgaagcttcagtggtggttggatttttatctcactggggggctgctgtttcctgcagggaacaggggtagatgtgaataggtgatacatcttccccttcctccaagccagatgcatttatatctgcattacccacaggcatctgcagggtagaggtctgtttttttttgtcgttgttgttgttttaatgcagtcaatatttgtgattggaatcgagtttaacctaagcatgcgacctttaggtgaaattggtatttttcatggtgtccagtattttcttactcctttttttccagatttttttttaatgttagaaagctaagctggtatataccttttgttaaagcagaagaatactcattcacatttcatggtgctatcatcaggatttcaggcatggaattattgcgtccattgagatgctgatgaatgttaggcaggaacttgacctttcaagagcactaggcccagcatggtggctcacgcctgtaatcccagcacgtcgagagttcaaggcaggtggatcgcttgagctgaaggagttcgaggctagcccaggcaacatggcaaaaccttgtctctactaaaactacaaaaaattagccaggtgtggtggtgcatgcctatagtcccagcttcccagggaggaggctgaagtgggaggatcacctgagcctggaggtcgaggctgcagtaagccaggatggcaccactgcactccagcctgggtgacagagtgagaccctgtgcaaaaaagagcaccggctgtttagctttcttcacacacaaataccacctccttgagtgccttgaaggactgagaaatggaagaaggggagaatttctgtctcattctctggagcagtggctctcaacctaggaggtggagtgtgattttggcccccaggggacattaggcaatgtctggagacagtttttgttgtcctaagtgcgatgggagtggggggtgctctctgcatctagtggtggagcccagggaggccactcagggtctgcagtgtgtgggcggcccccacagagcattgtccgaccgcagatgccagctgctcttaggctgggaaccctgctgtagagccgcacgcccagcacaggacccaccatcacctgtgctgtgtaaatgtggggcaaagaaaaccaagtcgatgaatgcaggtcctcagtcacaccaggtgtggcgggtggctgccgtcctggacaggacagataacaggtattcccatcgccgcagaaaattctgtgggacctcactgctctagagtctcaagtaattttttttcttagcttctaaataactcagcagagaaagaacatgactgatactgatcctgtatctccagccgaggcattgtaaccacagttttctctgtgggccaaaactgggctttgcatcatttaaaatgtatctaaagatcattcagatatcccttgaattggtaacattgtaaggttctgaaaggaaagtgtcttactcctttcaggctgctataataagatctcatagactgcacggctcattaacaggagaaatgtgtgagttgatgagggctggtcgctggaaggtccgacccactgtgttctgtccttattttgaagtcaaggctcgtgaaactgttctcatgtggaagtcaagactgtttttaagaagagagaccatttctgttaaaaaatgatcaggaatagatgctttgttggaaagtgtatgtgaacccgtgggagataggagatttgttttttttccttcccggtactgtattttatattattatcattattattccctgtcgcccaggctggagtgcagtggtgcgatcttgacttttgggttcaagtgattctgctgcctcagcctcccgagtagctgggattacaggcacctgccaccacaccaggctgatttttgtatttttagtagagacggggtttcaccatgttggccaggctggtctcaaactcctgacctcaggtgatctgtctgcttcagcctcccaaagagctgggattacaggggcaagccactgggcccagcctctttcccaatattttaaaacctgtgaagggagatttgtttatgttgtttaatttgtttctattgtgcacatcaaatttctgcacaaaagggggaggataccaatacaggctgatgtgaaagtcagtaataggcaagcagagcttctcccgggagccgggggggcgggggtgaagggagtgcagagggttctgcgtttgctggtgcttggataaggtggccaggttttcctccttcttttattattattattattattattatttattattattatgtttttaacagagaggtggggaggtctcactgtgttacctaggctggtctcaaactcctgggcgcaagcagtcctcccaccttagcctcccacagtgctgggattccaggtgtgagccactgtgcctagccagggttttccttcataagtctgacctatctaaatggtattttccacagttagactttgtaaattgtcttcatgaggaagcagttgtgaggtgtctgtgagtccctagataaaacacatcagatgttgctgaaccctactggagagagggaggaaaatacgcagttagttcatctcagcctgagcaccactgccttgatagggaaagagccctcctgcattcccagtcaccagtgaaagagggaaaaacagcattaaatttagagcatcgtggctgccctcctgctgtggaaaattggatacatttgtgtaacatcgtaggggcagttttgggttgacttcattagaaacacatcctaatttggggttgtggagtttggcctgtttctttttgcttccctcctgaccaccagcatatggggctgcttctccagtgctctgaaaagctcttggctgagatggccctggtcagcatggtctagcacggtgccgctgagagcagcaggtgcagggctgccccagacaagggactgtggcattgctgggcctgttcctcctgttctctctcccccagtctcccagggatgctttaggtacctctctagtccctttcatccagaaacttttcttttttttttgagatggagtcttgctctgttgcccaggctagagtgcagtggtgtgatctcaggtcactgatctcagctcactgcaacttctgcttcccaggttcaagcgattctcatgcttcagcttcccgagtaggtgggattacaggtgcgcaccaccacacccggctaatttttgtatttttagtagagacagggtttctccatgttagccaggtgggtctcgaactcctgaccacaagtgatccacccgcctcggccttccaaagtgctgggattacaggcatgacccaccacatctggctgacacttttttaaaaaaaaagcaaaactgtgccctttggaagtaatacagaaccgatgactcgctgcttactgcgagatcgtatctcactggtgtgcaaatctgtgcaacgctagcttgaagcacagcgggcggggggtacaaggacagtgttgggtgggctgtcctgcatatggcacaggaggttctcccaagtggggtggtggggggctttggcctgactccaagcacggccactccggagaggagccctccccaggccctgagaactacgcaggaacccgcgggcctgcaccaacctaaggacggatgggaatcctggaaaatgcccatccactgcaggcttcccctacaaaagaacatttaacccaacagggcttgttgaagtttgcattatcatctgcggaatgacaaatggtattaaatagtcctcacagccctccacgaacccctggaggacaccttgggatgcctcaggggtggcattggcggtttgagcatagaaaggatgctgtggttggaaggcggaggtaggagtcagagggagcttcttgaggcctctgcctcatccaggatgtgggatcatggaggctccttcgagttgggtggctggctagtgcctttgagtcaggttcccatccagaggggagggcaggggacacgtcaatcagggtctgtggctggagcatgctttgcgatttcagcagactgttcatcttccagaattgagcgggtgatggacaacaacaccacggtgaagatggtgcccatcaagatcgtgcactcggagagccagccagagaaggagagccgccagagcctggcatgccccgccgagccacctgccctgccccacgggctggagaaagaccagatcaagacgctgagcacatctgagcagttctactcgcgcttctgtctgtacacgcggcagggtgctgagcccgaggccccacatagggcccagccggctgagccccagcccctgggcacccaggtgccccccgagaaagaccgctgcacctcccctccagggctcagctacatgaaggccaaagagaagactgtggaagacctgaagtcggaggagctggccagggagatcgtggggaaggataagtccctggccgacatcctggatcccagtgtgaagatcaaaaccactatggacttgatggaaggcatcttccccaaagacgagcacctcctggaagaagcccagcaacggaggaagctgctccccaaaatcccctctcctagaagcacagaggagaggtgagtaggcgtggcctcccagcttgggcgtgactctgcctggcatctcttaggcttgtaaagggaagggggtctgcctctctgttttcatgcgtgcttttggggaagacgggttttcataagggctcctcgatgcttagcactttttggcttttttgtgagcctccggaaagagaaatggagggttaacggctttgggcctgacatgaaaatacacactgcagaccaccaagctgccttggcctgaggccagcaggatttctgatgatgcccacaggtctcctttctcgtaagacagctgttctcagtgggggccgctgtctaccctgggggacagttggcaatgtcactgtggggaggggtgttccaagcatctggtgggtggagcccaggaacactgctcaacatctacagtgcacaggagggccccccccacagagagtcatccagcccccacgtgtccctagtgccaacatgagaatgaaggcttagattgaatatatatgtgtttctttatgaaatgtttttttaaaactttatttgaaatttttttacatctgcatttaaaaaatttattataatttggccaggcacagtggtgcacacctgtaatcccagcactttggctgaccgaggtaggcagatcatttaagcccatgaattcaataccagcctggacaacatggcaaaacccagtctctacaaaaagtacaaaaaattagccaggcgtggtggtagacacctgtagtcccagctactcgagaggctgaggtgggaggatcacttgagcccaggagttggaggctgcagtgagctatgatggtgccactgcactccagtgtgggtgacagagtaagaccccatctcttgaaatagaaatgaaaaaaaattacgacaatttacacctgcctgaacaaatgtattttaattggttttgtaagtagcactttcagcgtatctccttcagccacttgaccacaaaggcatgcgtggtggcatcttccctgctgctgacatatgttctgccagcacagcgtcattcatgggtaggaaggtggagtgggtatgacacacagccaaggaggagcagctggaccaagtggacccaggcaggagggcgccgacagggctgctgggaggaagggagaagggttggtgtttgtagatagcgtcacacatgtccttgtcctcatcaacccaggctcctggtagagatcatctgtgctctcacctctgtagcagagattcttagatattcctgcttatttgagtttttgccttttttaaaaactatgtttcatacacttacgagtatccatttgacagggttgatggtttttagttttaaccttgttacctacttacttttccccctttggctgtctcatctccctggctggtgtcctttcgtgagcaccagtgttgatttgtcacaacccagggggtggggcagaggggctgtttgcgtgcacagtcccagctcattgaagttcccacacctttacccaggaaagaggagcccagcgtgcctgcggccgtgtccctggccaccaattctacctactacagcacgtcggcccccaaggcggagctgctgatcaagatgaaggacctgcaggagcagcaggagcacgaagaggattcgggaagcgacttggaccacgacctgtcggtgaagaaggtaggagagtccattccaaatgacagcgtgtgcgtgtccaggcaggggcaggcatccggatcacaccatcctgccccagcgcagaccctgcaccacgtgtcccagggcgtttgtgttcagctttcactcaggacagtggaatttgaggtgatattagtgaagccctctgttgttagttctatgtcctaatcttgagccattccacaaacgtctctttgctgtttcaataggatccaatgtcaaattagtttagtcaccattctctttcattttatcttatttatttatttttgagacagggtcttgctctgtcgtgcaggcttgagtgcaatggtgcaatcatggcccaccgcagccttgacctcctggcctcaagcgatccccctgcctcagataaaggaaaattattttcaaattagaaagtggtaacttttttttgagatagagtctccctctgtcacccaggctggagtgcagtggcacactctcagctcactgcaacctctgcctcccgggttcaagcaattctcctacctcagcccctcgagtagctgggattacaggcacctgccaccaagccttgctaatttttgtatttttagtagagatggggtttcaccatgttggccaggccggtctcgaacctcaagtgatccacccaccgcagcctcccaaagtgctgggattacaggcgtgagccactgcttccgggctggaagatggtaactttttggttcaaggtattaaaaagggaaatgaaaattaagggtttaggtcttggggcttttacgggccctccatctggcacacggtaccattcgcttcattctggttgcacattcctcttttaaaaaataataaagaatccaaaacatgttcggtttttccacacagaaccaggaaaatcataccatctggaccatttgaatttgggtcacaccctaggtttagagaactgcattctttgctcgcatgcctttgtttttcatgatataatgaatttcagaagcggcatgccttgattctgccgccctcatctgtggggcactctgtccacctgctttgggaggctggagatgctgggaagccgcctcaccagaagtgtggctccggaactgagtgagtcactgtgggctggaagttggcctcactttagttcagcaagtgtgagttgggcacctgcaccagaagcacatgctgtacatcccagctctctatggtgctgatgactcagcggtcctgttttcctgcttgattggacaaagcggccactgctgcattacattttctccctgctttcccgcagccacacgcttatgatgtcgcacattcctgcaacgcgtgcacaggcggaggcgtgttcagggaggaagcgagcatagcgcagatggggacttagcaggccacctgctctgtagctgcttcaggggaacatatgagaccctaattccgtaggcttccaacattcccagggcgaccacagttgtctcagtcacagcattgctaggtggtcatagagctgagagccaaatcagggaaccctctgttttaggagaagactaaggacagagttgagagagtggaagccccaggcagggaggcagcagggggctctggtggctggtagagaagcatcacgcagagatgacaagatatggttttatacttggggcagctcagaaggactctgcccagaaaagagggcaccatgttgagttgaaccagatagctgattggtttaagtttagaatctttgagaattatggcttttccctggaaccaggaggtgagtgcagggcccagacagaatagaccttgtttcccctatagaagggaacaaaaggtggaggaagggaatgaatggcccagggctcattcttagtggagggatgagagtggctgtgtgcctggtctctactgttgcaggctcttacctgagcctcctggaaagccacgcactgcaagaaatagcagatgggcctgccagacagtatggaccacagtggtgagcccttcagcaccctgggtggtgtggacagccactgatctgttcactgtcccaggccaggtcttgtctcagaaatctttgaaagccaacggctgttctttatacaatggccctttaacaaaggggaaatggtttcaataaaaatttgcatatgacatgtaaaagaaccaataaagaaatctggactcctttcagagagcccagtttcaaattagctcagctgaggtaggttttgagggcacatgttcatgcaccagtataaaatctacatttccgtaattgctgaagaataatggcactgaaaatttcctgagcggccgggcgcggtggctcacgcttgtaatcccagcactttcggaggccgaggtgggcggatcacgaggtcagcagatcgaggccatcctggctaacatggtgaaaccccgtctctactaaaaatacaaaaaattagccaggcgtggtggcgggcgcctgtagtcccagctactcgggaggctgaggcaggagaatggcgtgaacctgggaggcggagcttgcagtgagctgagatagcgccactgcactccagcctgggtggcagagcagagactccgtctcaaaaaaaaaaaaaaaaaaaaaaaaattcctgagcagccctggcgggcgtccttccttatccacagttccctgcattgcttgcagtcttccttcaggctagcattggtatcaggaatttgggaagttcttcatgcctgtttcctgttttgtgcttttccctcaagtgatgactatctaaaatttggccacattctcagctgtgagattctcaacttaaacagtctctccagataggtagtgagtaggaaaaggcacaaaccacttttcctctgctctcacgccacagcaaccaacacagaagacttcggtgaccacatgtgtgaggggggtttcccacacacccagcgagcagtcacttctgcagcagacaccagctgggtggcctctgattcagttcagatgtgacactgtcaaattggaggtagcgtctcatcccacgggttgagggctcagtccccaagactgcaccccccacacacaccagtcgcaagtctgagtctcagggacttctgaccaaccaccttcaagttggggttcccatgaccccctctttagtttccattactttgctagagtggctcacagaactcagggaaacatttacatctatgataaagaatgttacaaaggatacacatgaagagatgtgtagggcgaggcatggggaaaggggtgcggaagagcttccatgccctccctgggtgctccaccctccaggaaccttcttgtcttcacctgtcaggaagtctccagccccgtcttcttgggccttttatggagccttcattggataggcctgatagaaatctgtgtagaaatgtgattggacaaaaagactacaatccagtcctaacagaccgaggagaaagccacaaggtctgcctgttgagattcttgttggcctctctgtgtagcgttccttccccctaggtgtgccgcaggacccttcaggaatatggggatcttaagacctgcattcattcaaggcggtggaggatttctttatggaaaggttggggaagattagatcttgctttgggcaggtaaaagtttaagaccagcctgggcaacatggagagaccccgtctctacaaaaataaaaaaattatctgggtgtggtggtgcatgcctatggtcctagctgcttaggaggctgaggtgggaggattggttgagcccaggaggtcactgctgcagtgagtggtgatcatgccactgcactccagcctgggcaacagagtgagaccctgtctcaaaaaataaaataaaataaaataaaataaatgcatccatgtgagggaaagacctcacgcaatcaggaaataggctgcctcgtatctggcacatgtttctcctgctgtggggttgacttttcctgcctaatgctcatccggctggtcattttacccatagattatggaatcagggcacgaccacttgaagccaggagtttgaggctgtagtgcactatgatcatgtctgtgagtagccactgcactgcaacttgggcaacatagcaagaccgcttctctaaacaagtagaaaaaaggtcatcatttagaaggctggtgggaaagggcatagagtgttagtgtctaatagttacgcagtttcagttggggaagatgacagagttctagagacggatggtggtgacaggtgcatcgcagcatgaatgtaccacacaccacagaactatgctctgaaaagtggtcaagatggcaagctttatgttacatatattttactacaattttgaaaacagtcatctgtttgcattttggtcaagttgaaatcagtaggttatagtaaaagactgttaagttcattcgtatccctttattggtcttaatttttatatgctagtattagcaattaaaattttttttctttttttttctctttagcaattaaaattttaattgctaggccaggcccggtggctcacacctgtaatcccagcactttgggaggccaaggcgggtggatcacctgaggtcaggagttcaagaccagcttggccaacatggtgaaaccccatctctactaaaaatacaaaaattagccaagtgtggtggtgcacgcctgtaatcccagctactcaggaggctgaggcacgagaattgcttgaacccgggaggccattgcactccagcctgggcaacagagcaagaccctgtctcaaaaataaaaattaaataaataaaaataattgctagtgacaataattatatgtacaggacacataactaatcacggaatttggtgctggacataagactcactactttctctctatgtgaatctttaaattagaaaattccaaaggacagaatacataggtctgtgactccttccaaagatatgggttgaaactgcatctaccatgacgagcatcggggccacaactccgacgttctctaatagggcatgaacagaacgagaacaggtttattttatttttaaatgccaatagtgccattaggagtcattcttctttcccttagtcgtataaatcccctattatttggtgatgcaaaagtgagctttcacgcaggtcagctgcacctttcacgtaggtgcgccaaggtggcagtgagcagtgtggccggggtgggggccggcctaaccagtgtctccgtgttcccttgccatcccgtgcccaacagcaggagctcatcgagagcatcagccgcaagctgcaggtgctccgggaggcccgcgagagcctgctggaggacgtgcaggccaacaccgtgctgggggccgaggtggaggccatcgtgaaaggcgtctgcaagcccagcgagtttgacaagttccggatgttcattggagacctggacaaagtggtgaacctcctgctgtcgctgtcaggccgcctggcccgggtggagaatgccctcaataatttggacgacggcgcttctcccggtgatcgggtaaatgcagatacgtctgacttggaaatggggggtggtctcgtgggaaggctgtttttcaagtgtcgtgaaagtcagctccttggagcctagcatagcttccacatggcctgtccacctcctcctgcagaccttgtcgagacagtgcacgctctataccctctccttccttttatatttctttagttgtttgtttgtttgtttgtttgtttgagacagggtctcattctgttgcccaggctggagtgcagtggtgcgatctcggctcactgcagcctctgcctcccgaggttcaagagattctcccacctcagcttcccgggtagctgagctcccaggtgcatgccaccatgcctggctaatttttgtatttttttggtagagatgggatttcactatgttggccaggctggtctggaactcctgagctcaagtgatccgcctacctcagcctcccaaagtgctgggattacaggtgtgagcaactgtgcctggcctccttccttttaattgaggggaaaaggtgcttatcagatgcagggagttgaaccgtcattggactgcagggttgcgggatcttctcaaagaactgttacctctttttaacatctttttagatattcctattgactcttactgataattgtctcttcttagaaaaatcatgttgttgttgtttttacttttcttttaccatgtataagtccgtaacagacatgcctgcctgctgacgatcgtaagtactcaatgatagctattttcttgtggtggttgtagctgtgatttaacaagagggcatgtatcagtctagaaggaagcagacagtgcatctaacttcaaggcgtttctcagtgggtctgtcttttcgtcctttcacatatgaaccaagagaaataatagctgcctcgttggcttttacctcataggccaaatatcagtaaaacagctagttttgtttgcacagaacaggccttcagaatgttcatctgtatcatgaataaaacatcttaacctctctcagaaggggagcagaagaagcacccttcccctttctccaggtgagggtgatttgggccacgcagaacgctgtcctggcgctgggcttggagacggtgcccttctgcactcagccgagtgcttagtaactgtgtcgtggaactagctaggtcagggtggcaccgtgcccgagggggctgctggccgacacccgtgcacagcactgcgtcttctccaccctcaggcttccttgtgtgcagatatgctctgcaggctcgggggcttctcctcctcctgccaggagcatttagtaagcctaccctgaattcctctcgagtccacccatgtggccagctgtcccacggtgttcccatggagcggaccttgacgccaagagggccccgcagtcctttgccctttgcagcatctcagaattctgtcgttgtgagtcccttggtgactcttctgctcaccattcgaggcaggtgggagagagtcaggctcagacagcaagaggaaacccagagaggcctgtgggcggcttctgggggcctcaggctggcccgctgcaaccatgagacacatgcccccaggccctgggccctgggtttgtctgtgtggaccccatcggatctctggtggcatcagggtttccatcgataagttgtgggaccagcccacaagttgccagtgtcttcaagggttggccagtgccccagctttcatcctggtcctcaacaggcttgtttgtctgtcaacagcaatcactgcttgagaagcagagagtcctgatccagcagcacgaggacgccaaggagctcaaggagaacctggaccgccgcgagcgcatcgtctttgacattttggccaactatctgagcgaggagagcctcgcggactatgagcacttcgtgaagatgaagtcggccctcatcatcgagcagcgggagctggaagataaaatccaccttggtgaagagcagctgaagtgcttattggacagccttcagcccgaaaggggcaaataagagaccagtccccggtggaggaggggcacggggcctccgagctccagctccgttcccaaggatactcgtgaagaccccatctgtgttcatggcctggaaagagacttctcccatagcaaagaggctgttataaaagcaataacttttgtgtttgtgtgggatgatttatttaattttttagtttcccctttgattgctgagagccattttcctttacacataactacacctgacaccaggctctgctggatgtgagtttccactgcatgggctgtgggctgggcctgtggtgcctgccgagtggtcactgtcagtgggaaacccgttgttcctcccgtcttcagatgctgagccaactgcttggacagcagccagcgcgtcatgacgtgcatgagagggggaccctggtgctcatcttctcttgtcattcatccaggcatgggctgccaggttttgtccctgctcgttcaacagtgtgagcatttgtctctgttatctaatgatgttctctgacccagcagaaatcatcatcatgatgatgataatttattaactttttggaagggtgaatagtttcctaatggttaaaaaccaactgtgaaaggaaccacctgtgtggttgggttcactcattctcagattaaattgccacttaaagaaataacgtgcatgctttaaaaaacacagtcacgcaccaagcaggcaaatagctttagtccttctcacctcacatcacagttgttctgcaaagtaaaattttttggttaagagcgtgtccagtagtaatgtgcttgttagctgtttctcaagaccaacagaagattttttcagttactttccccccatgtattttgtatgcatatgattgtccgtgataattggctacttttccattgtttcctccttaaatcgtttagcatggcatgagggccacattccatggacgggaagaccccttcctcttcagaggtcccgtggactacacagctcctgagcttgatctttttctgccatgaagtttaaagattctatgcccatttccttgattgaaatggcaggattctaaagagagcctggtttgttaaaagaaaacactgtcatgctgtcagttcccaattgacaagtcacagactgggagaaaatatttgcaaatcgtgtatctgacaaaaggtttgtgtccaggatgtacaaagaactctcaaaccggatagtaagaaaacaaacagcccaagtgaaaagcaggcaaaagacttgaatagacacttcaccaaagagcatacacgcgtggcaaacaagcacacgaaaagacgttcagccgccgatggcttggttataatttataacttacttatttttatctaataattgtagattcagtgtatttcttcaaaaaatgtttaattaaatgcatgttaatggtgagtgaatcccttgggtgacttcgtgtttaggtcgtattagggcatttgttggatcaacggatcattttaaccctgacttccccttattcccataaaagaagttttccagtggaatggagatttcattttgtcagcagcagtgaccacagccttaccaaagcagacgcgtgcgcgtgcacagatgcacacacacagatgtcttaaaagactagaatccacacttcctgagccagaggggccgtgttgacggtaatgcattctctatagagccaagtccaaactggcaagctcaatgatgcaggcaataaaccgcctttttggcagcctaccaatgccaaaaggataaatgtctttccaaaagtgtgtattcctgttaaattaagctcttgctaacttgaaaaatccctgttctgccagcgaagcttcctcctcctctccagctggtagtcacttgcgtgaatgctggtcagtctgaaaaggtgaagctggctgtgcacttacccccatctttctccctcggggagacgacccaaggaatttcagagtattttgtttggcagagcttttacctgttattctttgccctcaaatacagtattgtggtcattttgatgatatgtgtgtaaaatgtgaataatccaattggtgtctgtactcagccttttgatgtctttttaggactttctcttctacacagcaatacgtcgtgctcgagtatccttgtagcaaagcacatagagccagctgtcctgtcagttcccctgtttgcctctgaaacgtctggttagtggggacccaaagattctagtgagtcaacatccataactctgtatctagttgtattattcatagaaaatcaatctggtgctaatggttggccctggtgttgttgggtggcagctgctccttcgccctcttgtagtgtggctgtggagggctctgcctatggggggtggcctgtggcttgtatccttcagtccaccacagcaaatgtgtgtagatttcatgctcgacacttaccactcacctatcaacagatcatcctgcttgactgtaacaaaataaatagtgtctcttcaagtgaatggagatgtctttgatttacctactttacagcttttgtaaaaaaa

SEQ ID NO: 194 - DNA, 146737 bp, mus musculus
ccccggccccgccccctccccgccagccctccgggctccctccgccgccgggccggcactttctttccaagttacggcgcaagttctgcggcgctcggagcctcccttgcgatcccacggccgggactgcccggagtgcatgggcgcgggccagggacgctgagcggtcgcgccatggagggcgccgagccccgcgcgcggcccgagcgcctggccgaggccgagacgcgggcggcggacggcgggcgcctggtggaggtgcagctgagcggcggcgccccgtggggcttcaccctgaagggcggccgcgagcacggcgagccgctggtcatcaccaaggtaaggcggccgcggggcgcgggcgctgacagccgggagctggccgccctgcggggcgcgtcgaggtaggggcgcgggaggggcggtaggctcgcgcccccgggtctggcgcgcgcgtctgctggggtcacctgccgggcctgggcgccgggaccggcgtgggcgtgtgatcctggcggttccccgcgcctcgcagagtttaaatggctcctgcccggagtccctttcccctccccctccctcctccgggcaggggcctggccgggtcctctggcgctcccgggcccgccagtggcggcctgcacctgcggggctgcctggaggccagcgaaggaacgtgtccccgagccgtccccacctatgtttgcctctctggggtccctggttcggcaccccttggacccgtgcctgtgatcactacgaaatccagagtagcagctgtcgccagcgcaacttctcgattcccttcagcccatcaatgtttactgactttcggcttccagtcccagatccactgcgcactggatacctgcgcaaacttagagaaacctgaaagcctgcttcctaagagcaggacccgagttctaataataataaagaaattccagatgtatctcatcaggaatgttgtgtgtgtgtgtgtggtttgctttagaacattgaattttattgtctcaaaacaaaatccatctggaaacttaccagttgaacctgtatgaacttgtaaaagcaaacacataaacaacagtccagtcaccctgtgttctagttaaaagtgtgtagtggtcattttctctgggaagggttgagtcggacctttcgtgtggacgaagttccttttaaaatgtaaagattcttggcgactagaagcgtttgaagataatttactggttttctcggctttcctgcctctccacagcaggaagaaattaagtgattcctaacccgccgcactggtaatcagtttgggaagtgggatggctttgttgttcaaatagcaaatgagacaccagcgtcttccattctatattttctgtcgcttttatgattacaaaactttgtggagggatttggagaagccttgtttagctttgcactaaatttttgttgaactcaggaaagaggttgccattgttataaatttgaccaatgtgtaatcttttatcacactggcttctttggaaacatggtggacagtcataaagtgtgtatactctgcccagccagaacactcctcttttttttttcttttatttcttttcttttctttctttctttcttcttttttttttttgagacagggtcttgttctgtcagcctcctgagtagctgggaccacagatgtgcgccaccatgcctggttaattttttaaaattttttgtagaaacggggagtttcaccattttgcccaggctggtctcgaactcctctgcctcccaaagtcctggcattacaggcatgagccactgcgcttggctcagaatgtggattaatccaagctttgaatcttcctctcccaaaagctactgaaaagtcactggggctcattaaaaaatagctcttctaatcgtttttttttttccacttgtaattaaatagttacatattagagccctggaatactgtacaactcacttgctatttagcagactctgatttggggatagcttgcattaaggtaagagcgcaccttctctttatgataatgagggtatcatttgaaagcctcatgggagtgcgtgtagtagaactgggaggggtgtcaagaacaaggctggttcggtcctggtcttcagatggaattttatcagcccattttatagatgaaacagctgtggcccaggcagggcaaatggtgtatcctgaggtcacaaactgttgagtcctgggaaaggccctaagaatcagactctggccccagtgttcaagcctgctgctccccttcagtcagtgccatctgcttgggtctgggatctcctgcaatgccatattgaataccttcgtcacatcggttaggtgagggtttgccagccttggcattggggactttgtgagctgaatctctttgctgtggggctgccctgtgctttggaggatgctcagcagcctccccagcctctacctgcttgatgctactgtcacctctctccaggtgtgatgacaaaaatgtctccagacattgccaaatgtcctctgggggcaaaattagcctggttttgaatctcttttgttagattaaccatatatcacctttgctcttaaaggattcttgctcttaaaacttctgtttctttttgaatagactggcctttagggtggtgtgtttagaggcctctggcattgccagtgtttgcatggagagctgttttcctcccacgcgttggccctgagaataggctttatttacatagtcaaactcaaacaaatacttgcttcatctgcattttttgtagctggagaaaggaaattgaagcaggaactcccaagtgctgtgttttatgggcatccacagtggctgttcagaatcaggactgactactctctgggtctagtttgaagctaaagggataccaacttcagaggagtagcattcttggaatttggggtgcatgcatgaagcccagcagaacctccgctgacagatggcgacaggattcatcactcctcagtacgtttctgctgatttctgccttgaaattttgctacagttggtggaaaaaatgcactcaaacccatatttccatgctgttgttagagagggggcaggaataacatccatgctgtaggaatctatgtaacggaagtagagatggtggatatatgtgatcctggtgggttttttgcatgtttctgttcccatccattcaaccagtggaagtcttcagtggggggaggggaggggactgatttctaaaatgtcactagagtggcttgaattccacaaagctgtttgggggattcatgaggaagcgttaaatacaccagctgggtgtcagcagccccctgtggcctcaggaatgtttgttaagggagggaaggaatgaagccccagcctctcctgttcactatttcttagagtccgctccctcccccaaaaagaatgccagaagccttagcccgaagctccaaagaagacagtaacttgggcctggcctagccccaagggcagctcctttgggaacccattgattttcgggttgccattgggcaccagagctgttgtgtgcgacaagactgctgtggtctgggacgcttggaggtcccccccacctgactcacccaccccagggcttcagactctgagaacatttctctggattggagacagagctttgaaatgtcctttccagtgtgaatgccaaagacggaatcagggcatattttggggggcgtgcagccaggtggcaagtgtcttatgtaaagtgttagctgagtccttgattgcagagggcacagggctgagactggtggttggtgatgggcaggagtggaggccccgcgcctctgatgtaccttacttattggtttggaaagggggctctgcattatgggccatgccaagtcacctcgtgacccgaggaccggggagatcagagtgaccaccctggtcgggatcagttcttgtctcatatgccattatattggctcccaagagccaaccaagctctttgtgaaatatcagtaaaggttttgaaaaagagggacctgatgaattcagcagtgggtcaggagcgggtgactctcaactttgtggctgctggtggatttttgtgcccagatgcagtgtgcggtcaacatctgcacgagggagtgctgctgcttctccaggtgtctgagaaccagtgggtgagggcttggatctcccttgcctctgccatctctaagtgatgtccgagttgtaaagctttactcactttttgatgccagctaccatgttttcttcagctattaggataagtgtcattataaagatccatctgtatttaagaattaatagtaaggttaaaaaccaagaggtgagctttctttcctgtgctgaaagaccctttcagttggtaggcccgccttgccaactggctttcaagtctatctttattaccttttcccagcctgtgaattaatgtgaccctgctgaattctcatccttgttctccggcgatgttttgggcaagagtgtggagtcaggcagtgagcctcaagtcctattccagggtctgggagctggaggctttgagggtcagctctgggaggattcttcctctcttagacattaactcagcttgactcacgcctatgaatccagagccttctgcgattatgagaagctgtaaacataagctatgcatctcacttctgtaccaggatgcgttcggtcttcatggctcagttatgagtatttcttaacatgtcgtaacatttatcttttgaaaaaaaaaaagaaaagaaaactagtttgcccaagagctaaaggtagaatagtatgataatgaaaggctcagaacaagtagcagttttcaccttgtcctaatgagctgggggtttcttaatctacctttgtaattcatggtcaaaaaaactggcttgccacttgggaagggctggtttttctctttggaaagcattttggagttgtttgtccccttgccagagttgttttgtatcagcatgcaaataaacctggatttgtggccaagttcttaagggcagtggagaaaagctggggctctgtggaacttttcttcttgcacaccgggtgcagcggaaacattctacacgataatgttagaatgtaaaagctgaatggactttttattcaggtcttcttttactttcaagcactgtagtcagcagtggggcaattcatgaaggataaattctgcaggtttctgcaagccctcttcctacacatgcaagccgaaaactttaacccacatgaaggattttgaaagagttctgggttgcctgttgctcttttaggcctttaaaaaaatatcaccagtgccaggcacggtggctcacgcctgtaatcccagcactttgggaggccgaggcgagtgaatcacctgaggtcgggagttcaggaccagcctgaccaacatggagaaaccctgtctctactaaaaatacaaaaaaattagccgggtgtggtggtgcatgcctgtaattccagctactcgggaggctcccgggaggcagaggttgtggtgagctggagatcgtgccattgccctgggcaacaggagcaaaactccatctcgagaatagaatagaatagaatagaatagaatagaatagaatagaatagaatagaatagaatagaatagaatagaatagaatagaatagaatagaatagaatagaatagaatagaatagaatagaatagaatagaatagaatagaatagaatagaatagaatagaatagaatagaatagaatagaatagaataatcaccagtatctgatacagggagggtgtattctggaggaattgttgtcctttaccttgtgtgatgcagtatttgggctgtcctgtagtagagccagcctgttcccattatgggtgtgaatgttccagcttctctttgggggaacatgtcttagaaggataatactatatcattaaaaagaaaaaattggacaaacctcatttggttgaaccttagaactaggatgttctgaattgcaaagcaaaggtaacatttttttccccagataaggagcccctgggctgtttttttgtgttgtttttttttttgttgttgttgttgttttaaatccccagcgtattaagttgcaggcaatgagggctgcttcttttggatggaaagggaagaaaaacagcatcttggcttggctaggaagggctgggattatctttcttttggcaaaaggtgactttcagatcaaaggcaaattgttgaggtcaacaagaacccaggcagggtagactctgtgtccttgaaaggtaacacttcttactcatagaagggaaggggcaagcatgatagcgtatttttttttttttaagacagattcttgctctgtctcccacactggagtgcagtggcatgatcttggctcactgcaacctccgcctctggggttcaagcaatcctcccacctcagcctggcgttacaggcgcacaccaccacgccctgctaatttttgtatttttagtagagacagggtttcaccatggtagccaggctggtctctaactcctgacctcaagtgaaccacccgccttggcctcccaaagtgctgggattataggcatgagccatcgtgacacgctaggagtgtcagtgtatcttttatgaggttttattttatcaaagtggctcttgcacagtatgaattatcaagtagttcttcaagggtgcttatatgctactggtcatttggcctgactactgatcacttccccctccctagagacaactatcaaaacgtcttagctgatttcttttggtatttctgtccatatccctaaatgatggcttatattgtatattgctgcaacttttgtttattagcttgttcttcccaatgtaggatattaggatgtagccttttttccactctttttttttttttgaaagtctcgtcctgccactcaggccagagtgcaatggcatgatctcggctcactgcaacctccacctctggggttcaagcgatcctcccacctcaccctcccgagtagctgggattacaggctcgagccaccatgcccagctaatttttatatttttagtagagatggggtttcgccatgatggccaggctggtctcaaactcttggcctcaagtgatctgtccacctcagcctcccaaagtgctgagattacaggcatgagccactgcgcctggcccttatttccactctttttcattgctcatctaccctcccccaactactcaggcacaattcttggcccttcatacccctaatgtgattacatcataattttttggtgtggggccatcctgtgaattgtaggatcttgagcagcatacctagcctcttcctttctttttttttttttagacagggtcttgctctcttgctcaagctggagtgcagtgtcatgatcacagctcactgcagcctccatctcctggactcaagtgatccttccccctcagcctcctgagtagctgtgactacaggtgcatgccactatgcccagctaatttttgtattttttgtagagatggggtttcaccgtattgcttgggttgatcctgaactcatggcctcaagtgatcctcccaccttggcctcccaaaatgttgagattacaggcgtgagcaactaaggctggcctcttccccgctctgaggagcatggggttaccaatattcagtgtttattttggttgctattgctatcactgctgagtctgggggtacatactgtggagtcctgataagttagcatcaatgaagaagggaccccagggtgggggagaacaattgttctgagaaactgctaaccacaaacaactctgcgtgtagcttctccagcatgatcctataaaacttccctccagcccctgcctctttgcaaccccttctctgctgtgttgcctgttgctcccttgcaacatactttttctctaataaattagtcttctcttctcttctcttctcttcttttcttttttctgagatgtagtttcgctcttgttgcccaggctggagtgcaatggcgagatctcggctcactgcaacctccgcctcccaggctcaagtgattcttctgcctcagcctcctgagtagctgggattacaggcgcctgccactacgcctggttaattttgtatttttagtagagatggggtttctccatgttggtcaggctggtctcaaaatcccaaccttgggtgatccgcccacctcagcctcccaaagtgctggggattacagacatgagccaccgcgcccagccataaactagtttttctttaactgactactgtctcagtaaattcttttactgcccgtgactctggccccagccagtgtacccacaacacaagtttctgcagtcactagggttcaggatagttttctttgcttaattttcagtgcacttatccttgattcatccctcaaaccctccccagtgatgaaatatctcttaatatattcagacacaccgggggtcatcttttgagatcttctctgtctgaaaacagcatgatttttatcttgacagtaaattgtttgggcgtagtcctgaatggagacagttctcccacagcactctgaaggtggtgtccactctgctgttgtgcagtattgctggagggagatcagacgtttttgtttcttgatcttttgtactaggtctactttttccctctcatttttctttttctttctttctttctttcttttttttttgaagagacagggtcttgctgtgttgctctggctggagagccgtggctattcacaggcacggttatagccacactacagccttgaactcctgtgcttaactgatcctcccatctcagcctcccaagtagttgggtttacaggtgtgtaccactatgcccagctctcttattttgcatttctttgtatttttgttcttcctggaagattttgttcaacatcatcttctaatctttccattaagttttaaatgtatgtcctcatttttccctcagattctaaacttttaaaatttgtttctcaaatgttcctttttcataccatactgatcttgtttcatgattcttccatatctgtgacagtattaaactggtctctaaaaatgtcctctttttgcatagattgtttctgagctctgcttttgttgtttgttttggctgctttcttccctgttagaggttgtcttcaaatgtctagtgctccttggccgtctgctggtattgaaggttgcgttccccaaaatgctgtttggacactccgtgcatgggggtgagtgatcaggtgaagctgtttccctgggtattcctctaaggctgtatctttctctttttttttttctggaggggcagggaggcggccatgtttttgtcagatactttttttctacttaataaacttctggtgtagtacaggttgaaaagtaatgggaagtctgccagttgaggggatctctcctttgctcagctgggcgagggtgatcatctctgccccccaactttggctgtagtggttccagtttggagggaaggttaccactaggcagaggaggcagtgcttgcttgcttgcatccggagctggatcttgctctcagttcctaaccgtttctaatcagtaatcctctgtctgtccaactagaatcattcctattttattgtggtatcatggggattaaatgaggcaacacataaagctatctctagtaaattcaaattccccctcacttctcttcctcactttccctactcaatcctgattcattaagaatttggaactttgggaggccgaggtgggaggattgcttgagcccaggaagtcaagacaagcatgggcaacaaaatgagaccccatctctacaacaaatagaaaaattagccaggcaaggtggtatgtacctccagtcccagctacttgggaggctgaggtgggaggatcgctttgagccaaggaggttgagggtgcagtgagccaagatcacaccactgcactccagcctgggcgacagagtgagactctgtctcaaaaacaaaaaataaataaaaaataaaaataaaataaaaaatacatctaatgcccagcatcagtacatttcctatgttatttgtagcccaccagaagtgattctttcctctcctctaccaaaaaacttttttccagaataatagtgtttcttatttttataatattaataaagggagtagctctttcagatcaatgtggtattcagagtagggtttttatttgtttttttgtttgttttgatatggggtctcgttctgtcattcaggctggagtgcggtggtgtgatcacggttcactgcaacctcagtcacctgggctcaagcagtcttcccacctcagccccccaagtattaggactacaggcacatgccacctcatctggctaattttttgtattttctgtagaggtagggtttcgccatattgcccagggtggtctcgaactcttgggctcaagtgatctacccaccatggctaccgaaagtgctgagattactgatgtgagccactgttcctgggccagagtagggtgttaaaaaagtagttttgggaagtggcaatagtgggaaagatgaagattcagtatccctgtgacaagactctatttcttcactctttcaatctttggagtagaaaatctgttagggtttagagtgggacccacaagtgtggcagaaatgctgcctgcccgagtccttgttgcctcctcctctcagacactgttgggccacatttcccagcctccctagcagttagctgtggcctcctgacgcttctaccctggggagtgcagctgcagccatgcctgccattttacttttccccttctggctgcctggaatgaagatggccgcagggcagagttcatcagcgtggatccctgaatgactgcagaggtggctgcccatgctatggtcaccatccatggtgagcaagaagtaagcctctgctgtgtttgggccattcattgtatgttttttggattacttgctgtaacagactattctcacaaatgaaatgctgggagaaatcagaagttttccttctagcaaatatacccagctttaagaggcggaatatacggtgcttcttttacacccatgctggaaggagtgaggaaagcatcactgtgggtgtccaattagcatgaagcctattccctgcacacttattatataaaatgagacctccacgcccattggcgtctttccacctccttacccttttctctcagctggtaatttattcacccccaccccccacttgctcttccttctcctccccggggatgatttcctgggagccctggagcattggggcaggaggccgggagaatgcccagtctagataattagtcctaggtggggctggccggaggcacagtgggtggggtgggtggccagctgctgttaggatgatttcagggattggaccttcctcctggtggtggtgtcctttctttaactgccttggttaaaatgcaaatgttgcctgggagggctacacattgtcatcattaacagaactgccttcatcagattaattaattatagttctgtatggcagacttttttccccctggtagtagcacccagacacatgaattagaccagcaaagagaggagagataaagttgaaagccagatgaaagccaagtaaaactggcctcgggaggaaggtggagctggcggagtgggagtgctgaggaaagaccttgtctgttcaggtactggccgcctacaaagaggagttaggacagcctgtggaggaagctggtagggagagcaggggcccaagtccagctgaaaaccctccctggacttgcaaaagaggtgaaagagattctttacctatggcttgcagattctgaagctgacgaaattccacatctattggtgttaattgtgcatctgtttgcaaatttgtaaacatggtgatatttatctctgctaattgtataatgctttgtacagtgtcttttttcttgttgcacaattaaaatgaaaaaaattgaaaataaaggaaaagattgatccatagcccaaaacatgtaataatcttatttctgaaagtacagctgtattgatttttccccatctctgtggaattctttgctttgaacctcgtagatctaatttttaattgcttgaaaacccttaagaattacattgtcaacaatctttggaatcagatgaaaggagtttaattgtgtgtatgccacttgacgttttaagaaatggtatgttttgttgtggaatatatttttataatttaggtttttctagacaggcatatttttaaaaaccctaatttctggaaaacggagtgtactttatattggtcaaatatgtcagtctttcaaacaactatgcttttttgtatgtgcagcttttcttaacattttcattatgtttagatgccctgaatcttgaattaaagtttggaaagaaaacatctggacttgaaaagataggcctgctgctgcttcaatcatatttattttgtgttgatttaacgacagagctctcacatgctgatgccattagggtttgggacggagccatttccactccccctcctcatttttagtggctggtgttttggggacaagtaattaaaacttgtaccactattcatggttgtgaaatctcaacacaaaggtaaaattcctgaggatgcacctccttgtaccctgaggcaggaacttgtttgcctttacggagagtttaattcttttttttttttttttttttttttttttgagatggagtctggctctgtcactcaggctggagtgctgtggcatgatcttggctcactgcaacctttgcctccccggttcaagcaattttcgtgtcttaacctcctgagtagctgggattacaggtgcgccaccgcgcccggctaatttttgtatttttagtggagatggggtttcgccatgttggccaggctggtctcgaactcctgacctcaggtgatctgcctgcctcagcctcccaaagtgctgggattacaggtgtgagccaccacgcctggcctgagagtttaatttttaattcttaaattacccattaattaattaccattaattaagaatttttaatttttaaattacccatgttgtaattgcttcactgaaaaaaatgttcaattcctatgaaaactctttatttccccttctttctatttttacagtggcttacactggttcttttcctttgccatctactagaaggttggatttcttgaaggtccttttatctgtcctctctctctcatctaggtggtctcatgtgcttcctcgagataacgtgcatctgtttgcaaatttgtaaacatggtgatatatggtgcctatagacaatgctcatatctatatgtgcagcctcaacttctcttctttttttaattttcaatgaccattttaccaaatcaacttttcgtctgaactctgagatggcccttgtgtgttgctgaggccctttaaactcagcacaatccaaatgggaatcattcatcttcctttaccttctctaattctgaatttctaatcttgatcatcagtttatccccaaatctagaagtcgtccctgatgccttcctccccttaacctcccacagccagttgatcaccaatcctttggagcctaaatacggggtgtgcattgctttcttctcatgcccagcgtcactgcctccagtggtttgctccagtgactgcctgggcaatcacagtagtctgtaacatgcatactgctgctcacctcttcacatgacagactcttgagacctccagtagtcggtgtgccaaaacagtggtctacttctcatgctcttgctggaaaagcctcagtaattcctcatgggacaccttagctaggtatagaaggcttatttattttatgtattattattattattattattatttgagatggagtcatgctctgtcacccaggctggggtgcagtggcgtgatcttggctcactgcaacctccgcttcccaggttcaagtgattctcttgcctcagcctcccaagtagctgggattacaggcacctggcaccatgcctggcaaatttttgtatttttagtagagatggggtttcaccatgttggccaggctggtcttgaactcctgacctcaagtgatccacccgcctcagcctcccaaagtgctgagattacaggcatgagccaccatgtctgtccactttatttttattttatagagatggggttctcatctctgtcacccactggagtgggtggtatgcagtggtgtaatgataaatcactgtaacctcaatctcctgagcgcaagtgattctacccccaacccttgcctcagcctccgagatagctgggactacaggcatgcggcaccatgctcagttaattatttttattttttgtagatacagagtctcactgtgttgcccaggctggtcttgaactctggcctcaagcaatcctcccaccttagaaggctttttatgttttatcgatcctgcctattttccaccctcgtttgccagtaactcttcatgtaacactgtattagtctgttctcacgctgccagacatacccgagactgggtaatttataaaggaaagaggtttaatggactcacagttccatgtggctggggaggcctcaccatcatggcagaagaacaaggaagagcagaaggatgtcttacatggcagcaggcaagagagaatgagagccatgtgaaaaggaaaactccttataaaaccatcagatctcatgagacttattcactaccatgagaacagtatgggggaaactgcccccatgattcaattatctcccaccaggtccctcccataacatatgggaattatgggagctataattgaagatgagatttgggtggggacacaaccaaactgtatccaacactttagctgagtatgaaaagttcttcatgctttagcatctgtcttttccctggcctcatcttctgctgttacccaccttgatccttcagtcctgcattgtctaatatggtggccatttgtcatatgtgactgttgaacagttgaaatgtagctggttcaaattgagatatactgtaaattaaaatatacactggattttagacttagtctgaaacacaaaagatgtaaaatattttaataataatttattatgttggaattataatattttgactacattgggttaagtaactcaaatatattattaaaattaacctggccaggcatggtggctcgtgcatgtaatcctagcacttgggaggccaaggtgggccaatcgcttgagcccaggaattcgagaccaggctgggcaacatggtgaaaccccgtctctacaaaaaaatacaaaaaattagccaggcgttggtgactggcacctgtagtccaagctgcttgagaggctgaggtgggaggatcacctgagcccaggaggttgaggctgcggtgagctgtgattgtgccactacacgccagcctgggtgacagagtaagaaacaccctgtctcaaaaaataaaaattaaaaataaaaataaaattaatttgacatattcctttttactctttgaaatgtagctcctaaccaatttgaaggtagatgtgtggtgctcttagtctgttggacagctccgttttagcctttttttttttctttttttaaaagagatggggtcttaagctatgttgcccaggctggacttgagctcccgggctcaagtgatcttcccacctcggcctcctgatgccattggcactacagtcgtgcctcaccatgcccagctcgctgcagactcttgttaggcaaagtgtggtttttaggtcagcatatccgcatcacctgggagctcgttagaactgcagaatctcagcccctgccccatacctgctgaatcagaacccatattttaacaacgtgattcagtcacatggtaaaaagtttgctgagtgctgctttagagaatgatttgctggtctcccagcatcctctgttatttgaggctttgcagaggttctgagacattcacagttttgtggaaggctttgctcagaatacatcacccaggcgaagtggccctaactgtccatccccagtcatgtggaatgccctcggtggccctctgtaatcattggtcttgcagcatcctcaagcctacttgacccgggaggtccctgagagtggggactggctctgtttcattgctggtatcgcgggcatattgcctggcatgtaatagatcctcaaatattaaagtcctttaaacacagcttacacgtagccttgagatgggatgaacgactgcacattgttacactgttctgagcaccgttaggtcctttgtccccttcctttttatgaggaccatctaagacaaggtaacttgggctgagagtgatctgtctggatcatgcaggtcgtacatggagtcaggatccctgaagtctccatctgggtgacatcacagctgcagatttctttttttttttttttttaaatgaaacagcatcttgctgtgtcacccaggctggagtgcagtggcgtgatcacagttccctgcagccttgacctcctgggctcaagcaatcctcctgccttagccccctgagtagctgggaccacaggcacacaccaccccaacttctgacttggttttttgtttttttttttttgtggagatgggggtcttactatgttgcccaggttggtcttgaactcctgagctcaagcagtcctcctgcctcagcctcccaaagtgctgggattacagttgggagccaccacccctggtagcatcccagctctttctccctctttacctccttgctaaacaagacactcaagcctatcttactgtgtaagccacatgagccatacaaagacttcttaaaaataattttttaaaaatttgtaggctgaaaagattttagatttttttttctaaaacagaaatgcacacagcagccttgctttgcggtaacccttggttccatgggtatgggactggctcaggtgccagaggctgggtggagaggcaggcctccatgctgtctctttggtgcctgcccccaggactccagagaagggtgcccggcgcttttcccacccgatggtgctccgtgcctcctgtcaggaagaaagcagaactgactgccacacactaccagattcaggagcctctcctgtcttcctgggaaggtggttttgatgaggtactgatgaacttgggcctggtttttacaaaatgaacatagccatcagttgtgacattgcacacagccaactcttaggaggggccgccatcacagaccacctccggacacagaagtcaggattttagggttttctcctgtgcatgcagtatactccatgggcatacaagggaaaagcagtgctggtgagaatctgccagcactgttgggcagcacgggttctcgacaggtattgttttatgtgcgtgtggtggatataaggaccaccaaccagtctcgataacaaatctagccgtttaaacatccacagacattttaacggtcctaatctgtggtcactcacagtgtctggccttgggaagatggactgggtgggttaaggaaggcccactgggttaactagatcgtgcccgggttgggaggatggcacgttaaattctgtggtgtctgatgtctctttctgttagctccccgtcttcctttgacaactccccagtggatgaggtctttggagaggtggaggctgaaggagcatggctcatggtgcagcaggaggtggtgtgtgacttaacactccttcccaggactctgagtctcaagcagggcaaggctgggtgcagtcagctctgtggcctgctgtggctgatgggccggggcccagagacaacagcttggatgcaacggtctacaagcccagcctccccaggctccttgtctctggctcatttctgaccctttacctaagactttcaacaatccttacattcctggtagcatcttagtgaatcaccctttcgcttagatataggaattcatttccgttgcttgcaaccaagaaaaccatagcctgaaacagcctagtaggaagcctgcagacctgagatcagtgggaccttaccactttgttatttgtggccctctggaaacgtgccatctgacccactgcaaggaagagtctctgcttcagaaggtcagaggagcggcatcctgagactggctgtggtgagctggtgggtgcagctgtctcctgcacactgacctgggtggctgtccccagacctctgaaaattgggaggaaccagggtttccttttactttaccctcaccagcactgcccagtctggagccctggagggtggaacgttgtaggaatgactcctgggctctgtagaacccctactgtatgccagcagctttgcattatgccgtgagttcctgggctctgggaactgctgttgtcccgtgtcaccaagtcacatggcattggagtggtgcagtcagaatccacatagcagccaggcacagtggctcatatctgtaatcccagcactttgggaggctgaggtgggtggatcatttgaggtcaggagttcgagacgagcttgcttggccaacatggtgagaccctcatgtctactaaaaaaaaaaaaaatacaaaagttagccaggagtggtggtgtgtgcctgtaatctcactccggaggctgaggtagaagaattgcttgaacctgggagacggaggttgcagtgagccgagatcgcaccactgctctccagcctgggcgacagagcgagactgtctcaaaaaataaaaaataaaaaaataaaagaatccaagtagcatctgccaaatctccactgtgctccaggcactgttcaactttatgtgaacttcacagtggttctgtggggtaggtttatacagttgttattggtgctatgatctgaatatttctgtccccccaaaattccggtgttgaaatcctaacccacaaggtgatggtattaggaggtgggggccgggtgtggtggctcacgcctgtaatcccactttgtggggctgaggtgggcagatcacttgaggtcaggagtttgagaccagcctggccaacatggtgaaaccctgtctctactaaagattaaaaaattagccgggcatggttggcaagtgcctgtaatcccagctgctcgggaggctgaggcagaatgtagggctgatactggagttgggtcttctatagcggagggaagtcagggatggaggccaagatgggctgattttcctgctgctgctaaaaggaaaccaattaatgggagaagacttgagttgggacttaaggagagtatctgttgtggttctcacgagttggagtggcatcgcttgaacctgggaggcggaggttgcagtgagctgagatcacgccgttgcactccagcctgggtgacagagtgaaactgtgtctcaaaaaaaaaaaaaaaacaaaaacaagaggtggggtctttgggaggtgattaggaatggggtcagtgcccttataaaagagactcaggtagttcttcctcccttccatcctgtgaggacacagtgagaaggcgcctcctacaaaccaggaagtaggtccacagcagacactgaatccgccatgtcttgaccttggactcccagcctccagagctatgagcaatacatttctgctgtttttgagcctcctagcctgtggtgttttgttacagcatcttgaactaagacagttagtgaggagcgttaggcttagagaggttgagaaacctgcccgtggttatggcagggccagtctcttcactcgcacagcaggcacatcgctggggcccatgaacatgttctagttttcacaagaagaaaatgaacttttaggtccccaaaaatgtttcgagataacatttcaatatttaatgatttactatataatattaatatatataaaataatcaaatacatcaagttaaacagattaattgaaatacattaatgatctagattgtgtgtatatatatatgtatgtatatatatgtgtatatatatgtgtgtgtatatatatatatatctgtctccttgtgccagcacaatcatcacatgcaactttaatcctttttttttttttttgagacagagtctcactctgtcgcccaggctggagtgcagtggcactatccgggctcactgcaacctccagtgtatatatatgtgtgtgtatatatatatatctgtctccttgtgccagcacaatcatcacatgcaactttaatccttttttttttttttgagacagagtctcactctgtcgcccaggctggagtgcagtggcactatccgggctcactgcaacctccacctcccgggttcaagcaattctcatgcttcagcctcccaagtagctgggattacaagcctgcgccaccatacctggctaatttttgtatttttagtcgagctgggctttcaccatgttagccaggctgttctccaactcctgggctcaaggtatcctcctgcattggcctcccaaagtgctgggattacaggcgtgagccaccacgcctggcccaactttaatccttttttatggagatggggtctagggaaggcctgccgggccctgggtcgcagctggcaagtgaaggggttgggttcccacccattctgtctggattcaggagcctcatgaaggtccctgcctcgagtatgtctgagcctggatgatcccccagcagggtcacagccagccccgtcgccatgcctagcgcataacagatgctcagtagatgtttggtaggtgcaggaaagccagcctgtgaaagggcgctcatccttcctgcattcaagcatcaagcctggtcattctgctgctttgtttcaggcgtgcgagtttgggggcaaatgtcagagtgtccccaggagcaagcaggttgcacagggggctgtttccatgagcctgggctgaggggacctgttgggaggccggcagccctgggagacaggaacaggcttcaggtgtttctaaggatcaaggccttggcgtattgcaaagacattacaaaatcaggcttccagaggcctcatagcaacaggcgtgtcacatagcctgtgctgtgccacggaaataaaacccgagttcaggactgcatgctgcctgctggtctaggccgtaaaaaaagctgtccatgccccaacaaaaaagtaaagcagagaaattagactcctgagattaatttgcttttctttcctgttttccacattgcttgtagcaaggtgatgcttttctgtgaaaaggcatttctcactgtctaaagggagcccttctgtgatcctccctgagagcagcccttctgagtgtcctttcctgcccgccctaggctgccaggctcctgctgctaacttgactgcttctgaagtctctttttaaggttcaatgtcaaggggaggtcagagaggggcgtggttcagcaggaaaagaggaagagagcctgacttgtgaccatcctgggtgccaggcacacctgagcacatgcagccccgagcttttggcctggacaagcccaggcctggcaccgcagggagaactggtctgtggattgtctccacagcctgatttcctcccagactttgccccgcttggagcattccgatctccggtgtttgagggtttcatccagtaaatacggtagtacttcaccctctcagattaaaggtgtgctgtgcagcctgggagttcctttacttgggggtggtcggggaggctgaaggaagccttcctgcacttcttttttcttgagttttttaattattaaaaatggagactgtgcgctgtggctcacacctgtaatcccagtgctttgggaggatcactggagcccaggagttcgagaccagactgggcaatatagtgagactctgtctctacaaaaaaaaaaaaaaaaattagccaggtgtggtggtgcacacctatagtcccacctacttgggagcctgaggctggaggatttggcttgagtcagagagttggaggctgcagtgagctatcattacggcactgtactccagcctaggtgacagagtgagaccctgtctcaaaaaatttttttaaaataagtggatataatggttgggcgcagtggttcacgcctgtaatcccagcactttgggaggccaaggtgggtggatcacctgaggtcaggagttcgagaccagcctggccaacgtggtgaaaccctgtctccactaaaaatacaaaaattagccaggcgtggtatcaggcgcctataatcccagctactcgggaggctgaggcaagagaatcgcttgaacctgggaagcggaggttgcagtgagccaagttcgcgccattgcactccagcctgggggacaagagtgaacttcgtctcaaaaaaaaaataataaaaataaatggatgtaattcacatgtcacaaaattcgccatgttaaagggtacagtttagtggtattttttctgtatattcactgacttgtgcaatcatcactttaattccagaacatttttatcaccccaaaaaagaatccctacatccattagtactccctcccctttccctcccttcccccaaatcccacccccacactgatctgctttctcttattagtcagggttctctagagagacagaactaataggaaatatatatgaagaggagtttattaagtattaactcacatgatcacaatgtcccacagtaggccatctgcaagctgaggagcaaggagagccagtccgagtcccaaaactgaagaacctggagtctgatgtttgaggccaggaagcatccagcacgggagaaagatgtaggctagaccagtctctccttttcacgcctttttgtctgctttagattagatggtgcccaccagattgagggcagatctgccttccccagcccactgactcaaatgttaatctcttttggcaacaccctcacagacacacccaggatcaatacttggtattcttcaatccaatcaagttgacactcagtattaaccatcacaagtccaccccttgtcaatgtgagatcgtacataatcttcaagtaaagacaatggtaaggtcataattacgcctaacatgcaactatcctttgtataaccagaaatgcatcattccccaacccaaatactattacataaagctgataatacttaaatgctgatatgaagtcaataaatctttttttgagacagagtctcgctctgttgcccaggctggagtgcagtggcacgatctcagctcactgcaacctctgcctcctgggttcaagcgattctcctgcctcagcctcccgagtagctgggactacaggcgtgcaccacgatgccagccaatttttttgtgtgtgtgtttttagtagagacggggtttcaccatgttttccaggctggtctcgaactcctgacctcaagtgatccacctgccttggcctcccaaagtgctgggattacaggcgtgagtcactgcgcccagcctgaagtcaataaatcttatgtcacacgataagggaaaagaaaagaaaataaagatattttcctagcactagtacaagtgtatacatgcgcaaacatggttttagcaaaaggaggaggaaatactcatgacaattgcagtccccatgtctgcagctggtcacatggttgtagctggtactgatgactaccctcttctactacccattctgtattccctttgccttcagcaagcaccttagctggttgtgtgtttttttttgcctggtggagtgacccaaaccttcattcctgaagggtctgggtcatttgtagtccggcctggattgggctgttgtagtgtccccttgaccttaatcacagggcatggtaatactaagagacgccctaatgggtctcctgtattgcatgcatactcttccctagttccattgcggagtagtagactgattttatctgatagtctgggtcagtcaccccagccaacactgtaactcccttcttagcctgttgacttaaaggtaggaggagcccaaagcacccaggtggcaatctgaacttccagtttaatggaatcattgttgtgtctcctggtggcagcgttcctccctctggaactaagaccccctaggccagcagaacgtaatgttgcaggaacaggaagcaaaaattttgctagtggatcactaggggtgatggtgagttttgccacttctacttgcaccccttgatttctggactcgtgaatcctggctatgggagaaacagtaccatatattgggcgctgattcagagcatacatggccttctgaagaactttgccccagccctgcaaagtattgtcacctaattggtgttataattgtgacttcaaaaggccattccaccgttctattaatccagctgcttcaggatgaaggggaacatggtaagaccagtgaattccatgagcatgaacccactgccacacttctttagctatgaaatgagtgccttagaggcgatgctgtgtggaataccatgatggtggataaggcattccgtgagtccacagatggtagtcttggcagaagcatcgcgtgcaggataggcaaacccatatctggagtaagtgtctattccagtgaggacaaccctctgcccttgccatgatggaagaggtccagtataatcaacctgccaccaggtagctggctgatcaccctgaggaatggtgccatatcaagggctcagtgttggtctctgctgctggcaaattgggtacccagcagtggccatagccaggtcagccttggtgagtggaagtccatgttgctgagtccatgtgtaacctccgtccctgccaccatggccactttgttcatgggcccattgggcgatgacgggtggctgggaaaagaggctgagtggtgtccacagaaagggtcatcctatccagttgattattaaaatcctactctactgaggtcacctgttggtgagcactcacatgggatacaaatatcttcacagtttttgaccactcagagaggtccatccacatacctcatccccgaatttctttgtcaccaattttccaatcatgcttcttcccgtgaattcagcccatgaatcagtatataatcacacatctggccatttctctgtccatgcaaagtgcacaaccaggtgcactgctccaagttctgcccactggaaagatttcccttcaccgctgtccttcggggtgtcgtagaaaggggctgtagtggtgccactctctattttggggtggtgtctgcatatcatgcagaactgtctgtgaaccagaccctagtcttctcttcctctgtcagctgatcatagggaactccccatgagactattggtgcaggctgggggagagaagacagggtggcagagtggagaccatgggcatttgagccatttcctcatgtaacttacttgtgccttcaggacctgcttgagcccgatcacgtatataccacttccatttgatgatggaatgctgctgtgcacacccagctttatggctagatgggccagaaagcatccagttcatgataggtagttcaggtcgcatggtgacttgatgacccatagtcaaatgttcagtttctgccaaagcccagtaacaggccaagagctttatctcaaaaggagagtagttgtctgcagaagatggcagggccttgctccaaaatcctagaggcctccactgtgattcacttatgggggcctgccaaaggctccaaacagcatccttatctgccactctcacctcaggcaccattggatcatacggcccaagtggcagagcagcttgcacagcagcctggacctgttgcagagccttctccagttctggaccccattcaaaactggcagcctttcgggtcactcgataaatgggttggagtaacacacccaaatgaggtgttgcctccaaaatccaaataggcccactaagcgttgttgtgcctctttcttgcttgtaggagaggccaaatgcagcaacttattcttcaccttggaatatctcgacaggccccataccattggacccctagaaattttactgaggtagaaggtccgtgaattttagtcagatttatttcccatcctctggcacgcaaatgtctcaccaataagtccagtgtgtttgctacttcttgttcactggatccaattggtataatatcatcaatgcagtggaccagtgtgatgtcttagggaagcgaaaagcaatcaaggtctctctgaacaagattatgacacaaagctggagaggtgatataccactgaggtaggacagtaaaggtatattgctgctgaagacaaattgcttctggtgggccttgtggacaggaatggagaaaaaggcatttgccaagtcaatggccgcataccaggtaccaggagatgtgttagtttgctcaagcagtgaaaccacatctggtacagcagctgcaactgaaatcaccacttggtgaagcttacgataatccagtgtcattctccaagatccatctgtcttctgcacgggctaaatgggagagttgaacggggatgtggtgggaatcaccacccgtgtgtctttcaagtccttgatggtgacattaatttctgcaatccttctggggatgtgacattgtttttgatttactctttttctaggtagaggcagctctaatggcttccactgggcctttcccaccatagtagccctcgccctaccagtcagggagccaatgtgggggttctgccagctgctgagtatgtctatgccaattatgcattctggcactggggaaatgaccacaggatgagtctggggacccactgtaagtcggacctgagctaaaactccattaattaccatacctccataagcccctacttcaactggaggaccacagtgacgttttggctcccttggaatcaacgtcagctcagagccagtgtccagtagtccccaaaatgtctgatcatttccctttccccaatgcacagttaccctggctaaagtccagaggtctcattggggaaggatgggagaaagagtcaccacataaattgttcgtaatgtagtggggtccttcctcaaggggacctggcctcctcttcattcaagggattctgggtctgtaaactggctcaagtctggaaattgattgaggggctgtgattctctgtttttataattcaaattagtcttttgtccattcgacccagaagttttctgcttatataaattcagtaggaaggcagtaggcttcctatcgatttcccttctaggaacaccatgattaattagccagtgccagagctgtacacgagtcagactattctgattgccgctttgcctctgctgtccattatggtagctacgcacaccttgcctttgacggttgagtgtcatcacttggctcctgccacctcgggatccaattattcccatcatatttaaattttgtagttgcgtgactgcagttcccaccattagatctgacatacagggaagaacaattacagggctcttcaaagatgcaggtgctgccctcacgaatctattttgcaaggcattggttaagggtatgtcttctggaccctcccagctgggatgagtaggtctaaagtggctaatccactccaccatcccaatctccctaagcctttggatcccttcctctacattaaaccaagggagatcaggcatttccagctcactcccagtgggccatcttttaatccatagttcagctaaccaagcaaataaactcttagaacctttttttaactccccagctgcaacattaaaagcagagtccctacttagtgggcccaaatcaataaattcagcctgatccaactctgtgttctttccaccattatcccatacccttaatatctattcccatgcctgttctccaagatttctgtttatatcaattatagaactcaaatggttcttttcgagtgtagcgcacctcctcatgggtcacattctcaacctcacctctaggggcctgctgggactttagtgataggtctagaagcaaacaggggtgtcgggggtggctcctgagaagaatcaacatattttgcctggcaattgcctcaggggaggccatcactgttgcctcaggcagcacagggtttatctcctcagacaaaggtggaaaggctgatggcagccatgggtcagggaagggatgttgccattacaggggatggggaagctgttccttctggcaaaaaaggttcatcggagtttacaaactcagtgtccccagcttcatcagggttctccctcaccgtccccattccaagttgcagggtcctattcttttcgaatcaatgccctcactttaacagtagacacctggcgaggctgtgcatgcatctttcattgaaggtcagcccctcgcatgataagagcatgtgtctgtttttccacaatttcagctctttctctacaggagataagactctcactcagggcaatcttagcagatttgaggctcagtatctgcttttgaagccgggagacagaatccccaagttcatcattttctttcatcactttgcccactgaacttaggagcaaccaaccaacttcattatattccttggttttccacatatggtcaaaggtattatgtatagagtcactaaactccttgcctctcatgagcagtgaatcaggagtgtcaaatgcatttattttgcataactctctaaatggtttatgccaaggactatcagtgttctccatactatgagaagtggagtccttagcattttggagtctaatcatattaagcaggcaactccagaaacctcaacccacaaaagaacttcatccttaatattctgttcctctagaaccactctttgtaccaaaatctgtattagggttctctagagtgacagaactaataggatagatatacatattatgtgtgtgtgtgtgtgtgtgtgtgtgtgtgtgtgtgtgtgtgtgtgtatataatatctcctatatatctcatatgtatatatcatatatagagatccattatatatatatatcctatatctatcctatatctatatcctatatctatatctatatctatatctatatctataaaggggagtttattaagtattacatcccacaatcacaaggtcccacagtaggccatctgcaagctgaggagcaaggagagctggtccgagtcccaaaactgaagaacttggagtctgatgttcgagggcagaagcatccagcatgggagaaagatgtaggctgggaggctagaccagtctctccttttcacgtctttctgtctgcttaatatttgctgacagctgattagattgtgcccaccagattaagggtggatctgccttccccagcccactgactcaaatgtaatctcttttggcaacaccctcacagacacacccaggatcagtagtttgtatccttcgatccagtcaagttgacactcagtattaaccatcacagttactatgtacggatttgcctattctggacatttcatgtcagtgggatcgtagaatatgtggtcatttgtgtctggtttatctcagtataatgtttggagattcatccatgttgtagtgtgtatcagtcattccttttcatgtctgaatgctattgtcctatgggaatggactgcgttttgttcatatcctttgatggacatgtgggtggttctcctttgtgattcttgtaaataatgctgctgtgtggacaagttttcaattctcctgagtattttccttgtgtttcaagctttttaacctcagtgccccaggcatagcgcttgtgatttcctgagcacatgggtggcgcatccctgatgaatcaaaagaataggattggtcattttggcttcacggctgttgaagcaaaattaaaactcacaatttcaaaggtcataggatttttgtcctgaccccggtgggtgtgggcccctgcagggctccgacagaggtggtcagcatgtctgctgagccttcaggaagacatgcctggtcaccggcatccttgtggtccttgtggtggcagtttgtggttagctcagccttaccccctgctgctgctgctgctgctgctgctgctgctactttctgagcaggagcatgggagtctttcaccctccctgcgaagtggacatggggttgattctggggttcagacagcgagcggggtccctgtagcccaagggtgatagtgctcgggacggtgtccccccttagacatgagctgctctcttgtcatttcccactccttcacttcccagcaacaacacagcttcagaccaaaatcaaaaccttcacctcttcatcatttctggttatatttcagaaacccgtgctatagggggatccctcaacaaacttaaattttccagatttaggggacattggcagtatcttcatcataacattgtagggtttgtaaggttttctgttgaatatttttctttttcttttttttaagagacgttgtcctgctctgttgcccaagctggagtgcagtggtgtgaccttgcctcactgcagccttcaattcctgggctcaagtgatcctcctacctcagcctcctgagtaggtgggactacaggcacccgtcacccatgcccagctaatttctgtattttttgtagagacaggatttcacgatgttggccaggctggtctcaaacccctgacctcaagtgatccacccacctcggcctcccaaagtgctgagattataggtgtgagccaccacacccaacctccctctaactttttttttttttttcagtatgtctaaacattttggaattgtaatttaaatcataagggcaaaagctgaaaattaatgcttaggtttactagtaagtgcacccttccctgtttcccccaaataaaatcagtttattttttaattgtaccccaaagcaagttctctcagtacgaagcaactactgcgtacacacaaaatggttgttaatgtaataacttccctggctcacccaacgtgcagtgcacacgacttcaaagactacaatttagggcaagtatacatgaaatgagaaaacaactctctaagtttcaaaacctgctgttaaattatttctaggacactcaggtcatatttacttctcagtaggatgttgcactgtcatttggttatcagtctacctcgcagtgtacattaccagatgccaattggagggactagagataaaacttatgtagtactatttcttaatgggctgaataaggtaattacaaataagtttgccttacatcctgttgaagacctctttacagcctcagtacctaacaatatctagcagcctccaagaatgctcatcaggtgaaacgatgatgtaacatttgaaaatggagccagatacttcagcttaagtcattcagagccaaatatctgaagaatggccaaaatcaaatctttatttttataactgtataaatgtgatccaaatgtgtccaccaccagtttttcaaaaagaaacatgctataaataagcaaactacatctgctcactgatgtgtgtatggactccctggatgtctcattgagcttaattacagaccactcacagtaatggatttttagtgtatagtgtagcttgatgttaagccattttagcttttgcgcatacatgttgtgctggctggtaacggagaagaatttgcagcattacaatgttaagctaggttgtatccatcccattaaatggcatcaatatcaatgtcatcatccttgttgttggactttacagtttcaactttaggtacactggcagtcttctaatacaccacctcaatgttctcatcttcatcttcttcaccaccagaagattcttcctctgcctccattttataaatggttctactttgacacgaatctctttggcaggttcttttgagacatgtttcttaaaggcctttttccgaccagctgatgacgacctcttcttctaaaaaatctacatcatacatctccttcaagatatttggaatcttagagataagctgagcttggtgcattgctaccccacacgtaaagccatgaagaaggtaccattgagcttttttgttgttgtgacaaaatcataagaaatggtgcctgtatttcttatgtgttctctaatctcctctttaaaaagaacttcagtcagaacaagagggcccatggctttaacatccagtccttctgcttcagtaacaatttctttgtcacataaatcaatgataccctcttctttctttttcttcacaaaatcaaacaggatgttggcccgctcctcaactgttttttccaaatcatcatggagtatcagaacttttgcatgatcactgatttcatccattctgcacctttgagcttcctcagttgtatcttccccccagtcatcctcctcttcttccactgtatgtggaggagggctaatttctttggtggtggtgtctcactgctggatacggagccattttccttgtctttgccctttatatttttcttttccttttctttctttcctgtaccactgtcactattctcaggtgggtttttgagaatgaatgtgcagagtttatgatgtgtgtcaagcatgcctcgatagccacaggctttataagaattacctattgtttgctgctttggcttgacatgcatatctgtttcaggattctcacattcaggacagagaacaaattttttaatgagtccatccaatatgtcttgcagcttattggcctcctgagatccattcacaatgtaacaatgtatcccaccaaaatacttggtgggataccttggaggccaattaagcgcctttgcagtgtcagtcatgttgactataactgtcttgattccatttcctttgccctcaaccttggcaatcagacagggcatcttgtaatagaactggtctgatatgctggggttgacgttgacagacattttggcttattggtggctttatcaataagatgaagagatctttgattgcagcttttttatatcttctgtctggagaagaagggatgacataaacaactgcaaaagttctcggtctctaatgtgaaaacattttcaccactgaggctgtaagcgtcttgcttgtatgctatgtttccccaatacaggtactaatggctgcgcaaaagctcttctggtgaaggcctccctgctctcccacgcttgaaaagcgctgtccttcatgcttccctgtcaccttgctcctagcaggcatcacgtcgagtccaccctgccagtttatctttttttttttttttttttcttgagagggagtctcgctctgttgcccaggctggattgcagtggcgtgatcttggctcactgcaacttccgccacctgggttcaagcgattctcctgcctcagcctcctgagtagctgggactacaggcacctgccaccacacccagctaatttttttaatttttatttttagtagagatggggtttcactatgttgtccaggctggtcttgaactcctgacctcaagtgatctgcctgcctaggcctcccaaagtgttgggattacaggcatgagccaccgtgcctggctccctccacctttaaaattttttttttttttcagattatgtttttcgagcctcaagatttattttattgcagtattttttttttttttgtaaatatgaagagttgtccagtagagtctcatcatatgtcgactgaagctggcaccatcctatggcccacagaggcttctgtaactgggtcttcaacatgtggccctccctccatcctttcccaccctctttgctccagccacagccagcttccagcttctagaagcagcctgcattcctcccccacccttttttaaatagagtcttgctctgtcacccaggctggagtgcagtggtacaatcatagctcactgcagtcttgaattcccgggcttaagcaatcctcccacctcagccctcccaagtagctgggactacaggtgcaccaccgtgccctgctaattaaaaaggttttttttagagatgagttctcaccatgttgcccaggctggtctcaaactcctgggctcaagtgatcctcctgccttggtctcccaaattgctaggattactggtgtgtgccactgtacctggccttcctttttcttttgaaaaaatccttaggttttaataaaattccacgtcctccattctctgaaatctgtatgaagtaccagaagtctcaatttgacaatagacatggtcaggatatttctaatgtttggatgatcctctgcaaactagaggccagcagacttctgtaaagggccagagagtaaatatttttggctctgtgggccaaattactcctctgtgctgtatagcatgaacgctgctgtagacagtatgtaaatgaaaggattgtgtgccaataaatctttatttacaaaagcaggcattgagcagtaattggcatcctggctggggcttgctgtccttggtaagcagtggttttcaaagtatggttcccagaccagcagcatcagtatcccctgggaacttggtagggatgaaaattcttggaccccactctagacctaccgaaccccaaaccagaagttaggaatcatctgggtgatgctaatgctggctccacacagcagagcagttctctgtacaactgctctacagagatgtggcctgtctgccatttgtattctaattagcatgtgcaaaacctcggaatcacggttgctgggacccagggacctgaattttaacaactggctcagatggttttatacacactgaaatcggaaccagtttctaaagcagcacttctctgaaccagtagaggacgtgggggaggcgtcagggaagtttttcaaactacagcctgagcttgcttggggtactttgcaagaaggagggggtaaatgtggaaaatgggagcagttgtggctttttgttagcttattgtgaactctgcccctggtacctggtctgggaaggtggatttatttcttttctcctacatgtaatgcgtgttttgaaacccaggaatttctgaaattttaaagcctgttggttgtaataaatattgcaccccaccacatttgctaccacatttgcgaacttttatttagtatttgaagtgaaaacgggttgagaaatataccgtatgatccattggtatcaaatatcttgaatatgcaaatgcttcaaatgcttgaatatgcaaaggcagcaaaatggtggttaccggggcggagtgcagaggggagggtctgccagcaggcgtggggtttctgttggggtgatgaaaatgttctggacttagagagtggtggttgcacaactctgtgaatatactaaaaaccctttgattctatactgtaaagaggtaaattttatcgtatgtgagttatactcaagaaagcagttatttaaaaaaaggaaatgggtcgaggtgtgtgttcagccttattcttgaattgtagagacctcactgagaggaggctgaccctgaaggcccctgttagagcccatcctggggcagttcttcagtggccctgaattcgtgtcacagggatcatcactaagctgtgatttttggtgctggatctgacccaggagcagacaggcctgggaaagagtgtgtgttgtttaaggagcctcacctctgagtgggtgaaccccgattgagggagaaactcacatggtgttcctccagggcatgtagctggaaggccccctgggctgaggagctagtggcagcctgcaggttaggggaaggggggaggaggctgcagtgggggaggtgggcaggagccagggccttgctccagggcagtgggagccatggaagacttttaagcagggtgtggtggcaaagaccacttgtaatagaagggcaaatgggtacaggagttacagggaggaattaggaagccttgtcctaccagcagtgatagagaaaagttaagggatgcgagtggtaccaccacggcacagtatccgcatctggtgcagggatggagaatcctggtgcctgaacacacgtgtgcatctgtgcatgactgcttgcctctccctccctccatcccatctgcctgggggaggcgagggctgagcagggatcagtcctgggagtcctggctcctggatctgtgctcagtgccacgcaggtggcagctccagaaagctctgcggagggaatggccaaatctggtgcagaccagctcctctctgcccaggtgtggctaggctgcttcaacatgcttgcttagtgccaggaggaggaggaggagtgctcagtgcctccgggcaggagcggacctccctggggctctgtcccttctctgaggactcccagcaaacactggcagcgggggtcttcaatgcactgtcctaactgcttgggcaggaaatgaagcaatttgttggaaaaactcaattttgagaataagaataataattcttcttcttcttcttcttcttcttcttctccttctccttctcctcctcctcctcctcctcctcctcctcctcctcctcctcctcctcccttctcccttctcctcctccttctcccttctccttctccttctcccttctccttctcccttctccttctccttcttccttcttcttcttttcttcttcttcttcttctcctcctcctcctccttctcctcttcctcctcctcctcctcctcctcctccttcttctcttcttcttcttcatatttttagagacagggtctcactcttgctcaaactggagtacagtggcatgatcattggtcactgcagccttaaactcccaggcttaagctatcctcctgcctcagcctcccaagtagctgggactaaaggcttgtgtcaccatgcctggctaatttttcgatttttagtagagacaaggtcttgctatgttgcccaggctggtgtggaactcctggcctcaagtgatcttgtctctgccaatttcatgttattcttaaacataagattttatttgaatggtcaccataaatagatcttatttttgtagttatgtcttcactgcatgtaaaattgtatagtgtgctaggaaaacagaatcaggtagtagttacttctcccaggaagaggcaggatctatacgaagtcatttttgctttttgctttgtttttggtaataatcatggaattatgctccagatttacatggagaaacaacattttttttcttttttcttttttcttttttctttttttttttttgagacagggtcttgctcgtttgcccaggttggaatgcagtggcgcaatcacagctcactgcaacctccacctcccaggctcaagtgatcctcccacctcagcctgctgaggagctgggactataggcatgtactaccaagcccagctaattttaaaattttttgtagagacaaggttttgccatgtttcccaggctggtctcctgggctcaaagtatcctcctgccttggccttccaaagtgctgggattacaggcgtgagccactgcagcgtcccaagaaataacatttgggtatgaagtgaatgaggctcgtttacattccaggttttcccccaaatctttttagtttaaacaacagcttaaaaattaaggtcggccgggtgctatggctcacacctgtaatcccagcactttgggaggccagggtgggtggatcacctgaggtcaggagttcgagaccagcctggccaacatggagaaacctcgcctctactaaaaatacaaaaaaaaaaaagctgggcgtggtggcaaatgcctataatcccagctactcaggaggctgaggcaggagaaactcttgaacctgggaggcggaggttgcagtgagcggagatcgcaccattgcactccagcctgggagacaagagccgaaactccgtctcaaaaataaataaataaatagaataaaatacaataaaagatcatggatttctagtaagagaagagaatatgtaagctggaaagcataaacctagaaatcttccattccatagattttgcccctctcttcctcccctccccacaaagaaataagtcatttggagcaaagcaattgcttaaacttttcttagctggtttccggagctccctgggaagaatgagggtggaaagctggaggggcgttctgggtattggaatgcaagccagtggatctgtagcccgctgtgcttctgggagcctgacacgacacacaaccggcacacaaccgttgtgcccttttgaactgtgcagggtcttagctgggctgggcagtttgacacggctgttttcaccatcaggacgttcacttatggttgagtacctggcaagggtagggagagaggaatgttcccagccatctcctgcgggacacttgggcggctttctccctgggacccccatctcgagatggcctcgggattgtggagggggtggcaggggtgctgggtttgctttcatgaaagagcaaagcagtttcccttctacttatcttgttttcagatgtagtggaataagccaggaaatatttctcctggatgaaaggtcattcttcttacattggaagctttggaaaaatctccctaaatatcaaaatacaaaggttatggaataatatgtgcttcgaatagcttaagtggttaaaaaattctctttgcagctcaatattaaaggaaaaataatagactgttcttggacaaaaatgaaagggatcacgaagaatgtgtttccagccagcttcctgcactggggttattgcaccaggactgtctccctagtagaggccctgtttactatgttgcttagtccttgcttcacaaaagcaatatttgaaccaataatcccacaacagcatgacattttaacttgtaagactttgggttttcacaacatggtgggagtctgttttggtattttgttctataaattcagttggggctgacaaaattaatgaactggcattttagagaaagtgacattgtaacttcccctcctcttcgcatgtttacatccacactgataaagatgcaatcttgtctgtagctcattctccaggaacttgagtgtcaaggacagtctgcacggcccttgggaaatgggcattccctggcattgagttgttaattggacgctgagtgctcgagctgcatttatggttccatatgtgggtgtatgtttgtgtttcagtgaggaagatagtagctgcttccctcccacagccttgtggaccctggctgcacatttgagttgcctgtttgacgctgtctgaccctttcttagccagtttctggagctccctgggaagaatgagggtggaaagctagaggggagtcctgggtattggaatgcaagccagtggatctgtagcctgctgtgcttctgggcacccaacacgacacacaaccgtgtgtgttcccacagaacctctgtgtgtgtctgaagccctctgggtgactccacctgtggccacagttgggagcaagcctgcctgggcctccgcctcctgcaaatgtgatagtccccacccagggtgggtgcatgtgcctctcacggtagcaactccatggcttgcctgaggtgggccaggttcttcgggggctaatgtctcaccgccctgtccagttctggttctcagtgaatgtgttatgccatcatgacctttgtcactttcttccccttgccttgtttttgcacattggaatttgcaagcgggtctgtggtcatccgaagttgtgctcttcatgcataacctggcctccacgcctcactgctgggctcggatgacacaggtgggagacttctgaatattagaagtttattggaacatctaaattgtattctaaataacctttttctttttttgacaggtatcattttcctttttttttaatctctatttctaagaataactttatcttcagctcttatccatcatttaaaaacaataacaaaagaggctggatgtgatggctcactcctgtaatcccagtgctttgggaggctgagctgagaggatcgcttgagctcaggggttcaagagcagtctgggcaatatggtgagaccccatctctacaaaaaaatacagaagatgtagctgggtgtggtggtgcacgcctgtagtcctaggtgcttgggaagctgaggtgggaggatcacttgagcccagggaagtcaaggctgcagtgagctgtgattgtgcctctgcactccgtccagggcgacagagagctaccctgtctccataaaaaagaaaaagaaaaacaagaagaaaagaaaagattactatgtacattctcatctttcaaagaacgaacaagatttgggaaaatgcaccaaggctcaaacgcttttgaaaggtggacagtggtagagaatgttgagtctttgggcctctggtcagcttttaaggccagggtgaaaacagacccttggaaatgttactgtgtattcagttaaataaaagaagggggatgactccattcctccagtgcagtggtgaaaccttggctgtgctccctgggggagctgcgaagcgctattgatggccaggctgcaccccaggccagttagtcaggagatggaggggcaggggcaggtattggtgattctaaagaacaccaggagagtccagtgtagcctggatggagggttatggtcttacatgttagccttgacatttttctttttctttttttttttttttttgagacagggtcttattgtgtcacccaggctggagtgcagtgacgtgatctgggctcactgcagcctcaaccacccaggttcaactgatcttcccatctcagcctcccagagtggtgggattacaggcatgagccaccacgcccagctagccttgactcttgttggcaggttaacagacaggcaccaagcattctctgcaaagctcatggtgaacattgagtccccccggccaggggcctgcctgagtttaatgaatgggtgtgttttctgagctcgagggggccacattggttctctttggtttgaggcgagggagcacgtcaacctttggtcaggctctggtggccaaggtgtcacaggaagggaaaaggtgtagtctgtgctgaggctggggccgagggattttcaagcagaaggagctccagggagtatggaatgcactctcctgccttggggagcagggagaccaatagacccaagcagttctgggaaagtaagtggtgctgctgtgtggggaggtggagcaaggaggagggaggaggccttcctccgctgagagaatagggtccttccgggtcggggtggttgggctgcattgtatggggtactagcgaaggacctagcaggtgccaggctaaatgctttccagcagggcttctctaagagtgctcttcccatcagcagcatcagcttcctctgggagcttgtccaaaatgcagaggctcaggtcctgccccagtcctgccctttaagggcagggtttcacactgctataaagaattacctaagactgggtaatttataaagaggcttaattgactcacagtttcacttggccgggaaggcctcaggaaacttacgatcatggtggaaggggaatacgcacatcttacgtggcagcagtcgagagagagcaggcaagagcagggaaaactgccttataaaaccatcagatcttgtgagaactcactatcacaagaactgcatggcgggggaatgcccccattatccaatcaccttctacctggtccgtcccttgacacatggggattatgagaattacgattcaagatgagatttgggtggggacacagaaccgaaccatatcaagggccttctcgaaggatgcttctgatcataggctggtgcttgggaacctcagcctgatagactttctcttatccattcctcatatgtgttccagggaagaagttattgttcttcttcttattattattgttgctttagtgacagagtattgctctgtcagagtaagccttacccaggctggagaccagtggcatgatgttaactcactgcaacctccaactctcccacctgagcctcccgggtagctgggactataggtgcctgctaccattcccagttaatgttatttttttttgtagagatggggtctcactatgttgcccaggctggtctcgaattcctgggctcaagtgatcctccagccttgcctcccaaagtgctgggatcacaggtgtgagccactgtgcccagctttcctgtctgtctatatctgtctatctgtctcttcatccacacatacaattttacgaatggcaaagcaacggttatttctattttgaacaggcaaatgacacctcagcagggtgtagcgtaaggaccatagcgctatctttgagttagtaaaccagatgctaatcctttgtgttgattgactttggatttaaaacctttgagcacaattttcacatatctgaagttgggaaggtaatgcttcctggggttgtttgtttttgtttttgtttttgttttttaaacagattctctctctgttgcccaggctggagtatagtggcacaatcttggctcactgcaaccttcacctcccaggttcaagtgattctcctgcctcagcctcctgagtagctgggactacaggcatgcgccaccacccccggctaacttttgtatttttagtagaggcggggtttcaccatgttagccaggctggtctcaaactcctgacctcaggtgatgcacccacctcagcctcacaaagtgctgagattacaggcatgagccaccacgcctggaccctggggctgagtagctgtcgccagtctacacatgccagctgttaccagcagcactagtcagagaccccacttttccagtgcccttgcagtaggtgtgattgctttgttggctaagagctgaccccagaggtttgtggtgacaaggaccagagccatcctttggaggtggagttccaatgatgcccaatcatgatgggggccgctgttgatccgtacacactccgattccttttcagcccttagggtggcagggacacattgagattctagggccaagagactgggagccagtcctagtacaaggcatttttttaaatatatggaaacaaggatggtgaatctggaagttgagaaattgcggttgcctgaaggtgactcacaagcgaaggtatttctaagccagaagaaagtatgattcagattgaaaacagaactcacacctgccggttgcggcagagtgatctgaacatgctcattacgacagtctagttggggtaggtacaaagcttatttatcatgcatgctttcaggatgagaaaaccaagggctcagatctaatacaatattattcaggtttcaggttcagttgatgcttttaggagagcattttggcccagttttttttatttttatttttattttttaagaatcattagctaatggtttcagaaaatacattagattatttcagattcacactggcatgtcttgggctctgcaagtctccctctctcacacacagtaagaaggtggccttctgcagtccaggaagagacccctcaccggaacctgattatgttgccatcttgatcttggacttcccagctccaggctgtgagaaatacgtttctttctttttgtatgtgtgctgggattacaggcatgggccaccgcacctggcagaaatacgtattgttgctattccctgctcccctctgcccctggtagcctctattccactttctggttctatgagtttaactgcttgaatctctttttgccatgtacacggagcagggggagtgctggcgcctggatggtggcctgaattttcttgctgcctagagtcgctgatccaccacagccatctgtctggaaagtggggtcagctgaattggaagtggcatcctgatgaatttccgacatagagcttgataattcttatccttcacccaaagattaaactggaagaaagcagcttgtggctaagaaaattgatcagtttagctgttacagggtctcaagtgaacccctggtttcttttttttttttttttttttttttttttttttttgagacagagtttcactctagttgcccaggctggagtgcaatggcgcgatcttggctcaccacaacctccacctcttgggttcgagcgattctcctgcctcagcctcccgagtagctgggattacaggcatgcaccaccatgcccggctaatatttttgtatttttagtagagacagggtttctccatgttggtcaggctggtcacgaactcctggacctcaggtgatctgcccgtctcggcctcccaaagtgctgggattacaacccctagtttcttagataactgtccagcctgttggcaaaggccagacattaacaccatgtgttgaatgcatgggtctcacgagaggcatcttgtgagttctgagtttaggcagaaggcgagagaagtcagattctgttgtgcgttagaggaaggcttaaggttgaacccatggaactacacacaggagagtggggagggaaactgaggaaaacactgacttttgtcagaaaagactgtttcagaggggaaaccgaaatagctggttagtgccgtagatgtggtttgtcaacatggcactatcgacatttggggcttgatgattctttgctgtggggacttttctgtggattgtaggatatttagcaacatcttggcatctgtctccaaatgaggacaaccaaaactgtttctagacattgccaagtgtctaggggatggggaccacagtcactgtgtcttggtctgttcaggtttctataacaaaagaccatagaccagttgacggtggctcacgcctgtaatcccagcactttgggaggctgaggtgggcggatcacctgaggtcaggagttcaagaccagcctgaccagcatggagaaaccctgtctctactaaaaatacaaaattagccgggtgtggtggcgcatgcctgtaatcccagctacttgggaggctgaggcaggagaatcgcttgaacctgggaggcggaggttacggtgagctgagatcgtgccattgcactccagcctgggcaatgagagcaaaactccatctcaaaaacaaacaaacaaacaaaagcaacagacatttgttgctcacagttctgggggctggaaatccaagatcgaggcgtggcagattcagtgtctggtgagggcttcctggttcacacagtgccttcttgctgtatccatgcatggtggaaggggcaacagagctctctggggtccctttaataagggcactaatcccattcatgaggctccaccctcatgacataatcacctcccaaaggccccacctcctaacaccatcaccatgaggatcaggatttcaacatatggattttgtgggtgggggaacacacacattcagtctgtagcacacgccagttaggagccactgctatccactgtcagattctccctaatgtgtcatccttcccttggccttagggctgggacccctagggaaccttagttaaggtcttcgcaccttcttctttcgtgtgttctctttgtgctgaagtttgcttcaggtgtttaagagagtctggtccttgaagaggcaggatgaccttggcaagacctggaggagccaggggtgcctgtccagaggcagggagctccttaggcctgcacagtggggcttggccagggatccatcctcaggacttggttctgctatgggaggtaacgcccaccctgtgtctctctagcccgccgagcccctccctctgcagcacacccctccttgctggtcttgcactttgtgtttgtcagggagcatgactaggttggtggggagtggaaaggaaatctccagtcctgagggatgctgtcccgtggccatctcttggtcgagtcttttggaattgtgtgctggctccctcgaagtagaatgcatgtgaccatgtggcacatgcaggcttagtagttaggaaaccgtttacccagtaggcacatgggatagggagcgggcacagctagagctgggagtgccccagcacactagacgaaccagcaggagcctgcatatgaaccggctgagctccccagctgaccgctgagctcacttgcaggtcaatgtgtcctggggcttgcttgttgaacactaacgtgtgtgcaggttgcaggggtaagggtggggggcgggtgcacctcactctgagcccgcttctctgatggcccctgcttgctggtctaccaggtgttcctctggccaaggtcaaaacctcagatatttgatatttcttgttttgtgtataggaagtactagaaatctactttgtaatgggtcagaggaaggggaaggacttatttgtgttggtttttgaagcaggaagtggccacatgcaaaggttttcctgtgactgggcagtcacagaggggagatgagatgggaggaggagttgccggcacaatggaaagtgctttacttctacttaacaaatgtcttctcgcgtccttgtggagaaggaaaacagcaggtggccctgggactctgttgactaggaaatgacagacggaacaaaaccgcagcctcagagcaagcatccctgagccccttcactgtctgtgtgtgggaacacattggtcctcattccgtaacgggaatctgccagttgtggagcgggcgttttattacctgtgaccgccccatgttgaaatgaatacactttttgtccagttttctctctggctcttgtgttagtgtagtgacccgcagtctctcctctccaaggcagacttccacattttcccaaagtgctggaaattctcttctcctaggtcatcatgaagaaaatgaatcaaaatactgggagatgtttgctctgcaggctacttttgtttaaaactatattatgaatcactgtacacattttcagctaccccacccctgcatcggacctcctaattagggacctcataactaagcacttagttactaggacattgagcgctgaaggactccactgacaatgaagagacacacaagtagactctgtgtgtgtgtgtgtgtgtgtgtgtgtgtgtgtgtgtgcatgcacgtgcacacatgataacagaattccagacaactccagacagccagaactactttggttgcaagtgacagaaatacagcctagaccattagcttccgtgggagagggactgcattaactccccagctagaaagtctcgaggggcttcaggcatgctggaggacccactgtgtctccctgtcccaccccactgagatccgacggcctccttcctgctggcctagttctccagcacatttcccacagtggccacacgtgtccctgggcttgtgttctacagacctgcagcctcaaaggaaggatatgttcctccctgacaagcctcgctgaggttcccatctacactagtggttcacaattgggagtgactttgctccccagacatttggcaatgtccagaggtatttttggttgtcttaagatggggggatgccactggcctttgtgggtggagagcagggatgctgctcaacatctgccagtgcgcaagatgccccccacagcaaacgggggtccatctcagtgtggtggtggtgctgagccaagagctgcagcgctggacctgtcaccctatcccaggactgtggcccccagcatgggttgagtcccatgcaccaggagagtgctggggaagcctgtcaggaggaggtggtgtcctccagagggaggaatctgctggaagaaaagagaggctcagacactccgtgtggtgttgcatgtcctccagaatgttgtgcgcatgggaaatgctgtataggtgcctgcagaaccgagccggcaagacagggaggcagagctccctccaaaacagggagcagagctcggtgctcactgctttgctcaggtgttgccaaggcagctcgtggaacttcacctggaagaggtcaaggggaagccatgggctcattgcgaagtaaattggtgttgctcatcagtgctcttggccattcctccccagtgctctttctccaccttatttatttatttatttatttatttattttctttgagacaacatctcacaaaaagtaaaaaaaaaagaaaagaaataaaaagagcatctcactgttgcccaggctgtggcacaatcatggttcaccttttaccttgatctcccagggtcaagagattctcccacttgggttttccttgtcagggagctgagccaggtagagaggggtgtttgcaaggtgcactgcccgtgcctgcaggatctgattactggtgcagagcccatggtttagctttgtgctggctttgttctaaaacttcacccagcatctgccactgtgcagaaacaggtggcgctccatcaggaggtggtgctgtcgtgtcctacccaaggtgccagtcaggggagtccctgttcatcctcattgattctgatgtccagaatcttacagagaatttttttctttatgtaaagtaggttttattgtgttcaccttgaaaacaactcactgatgggaaaaaacacactgacagtgttgactgcaaatagagtgacctcatatcatttcaaactgggagtcaggaaactagacctgcagggcagagaacctgtgctttgcagttgcctggaggaccagaagtccacaggaagaaagggccagttgaatatatgcacggacagatgtgtatggggcaaataattcccggggctctgtctccctctcttccctcctccctgtccagcagttttaatgtttcgagccttgctgttctaaggaaggaagcaagagcagcagcagcgtcatccccttggaagcacattagaatgcagggcaatggggagaaaccatgtggctgcactagcgtttaggaaaacgttaattcttatgccatcttacagggcctggctacaaaaagtaaaatgaagaagaaaagcagcattagcatacaccattgtatacctcaaagaagggttgtgtttttagcaccagcgtgggccaggaggattctgattttagaaaaccaaacttttaaggctttgggagagcacctgccctgccctaggggggtactgggtgcagaagcccagcactgcttttgcccgacctcactggctctcttcatgtttttttttttttttggttgttttgagtcaggctctcgctctgttgcccaggctggatggagtccagtggaaccatcataggtcactgcagcctccaactcctgggctcaagtaatcctctcatcactggagtagttgtgtgccaccacgcccggctcagttttctgtttttgtttggaggctgaacacagaggttccctgaagaaagttggttggagctggagttgttctagaacctctcactgtcaagtaaagaaccctgctgagcagctgagcctggaagcttcttcgcacccctgagcacctttcctgagccacgtacagcccacctgaaggcatctgcacacctggagagcggggaggggaggggcagcagacccgggcaccagatcagccctggcccaggcccaggcccaggcccaaggcagccgtctttgcacggtgcagtggggagtggaaaggcccatgtcccctctcccagctcctctttttagtggacagctgcccttgggtaaaagtggaccatgctcagcctcagttttctctctaaaaagaggggaacccctggcagcatagtgtctggagtctgcagggcctcagagattgctggacacatagacagcgctcaacagataggaactggaggtttctaagaacatttctgggcccggtttagcatctttgcaatgtctgtgtgccctcgcttctctccctctctagctgtccttcagcctcagcctcagtctaccccccagcttctctctctctctcttttctccctctctaccccctccttctcccttctctctctccctttccctcccactgtttttcttttacagctttatcgagatatgtgattttctttctttttttttgttaagagacagggtctcactatattgaccacaccggtcttgaactcctggcctgaagcaatcctcccatctcaacctcccaaactgctgggattacaggcgtgagccactgttgccggccaatttctacactataaaattcacccattttaagtatacaattcagtgatttatagtgagttcaaaggtgtgcatccttcatcatgattcaattttagatcctttccatcacccccaaaagattctttttattcctttaagccatcccttctggttcccaccacagccccaggcaaccatgaatctcctttctgtctctggacttgcctcatttggacactccctgtacatggaatcctgcagtatgtggtgttctgtgactggctttttgactccgcatcatattttcgggattgatccacattgcaggtggtatcggtactccattcccttccggtgccaagtgctggtccttggtgcagactgaccgcatggtgctgaccagtgtgtcagctgatgcacggtctcattgctttcccgtgccaccctgacaagagtggttcccacttttgtgggcacacgggagggggtctcggctctggaagtgaccagctttgtggtttgtggggaggctggtcgcataagtccttagaacatcaactgtcacttgggagccgggattgttagcataggattgttcaaaaaatctaataagccaaatattttaaaaacgtgtttcatgttgcctctctctgacctcaggaagtaagtcactgtcaattattgtcgtgtgagcaaaaatctccagcttccttcaactgacagttcaagggatagaggcttctagaagcatgttctccatgtggttctcctgatgatgaaacgtgtggtgtgcacatgtcccatcctgccctcccgacagggcggcatgcggaaggaacataggggaccagccctgttttggtggcggggaggctcacaggagagtgggcgctgggctgtgctctgagaccgttccttgtcttgcttggctttttctttggccaagtggagacagcaccaggtggccagactgtgttgggcctggtcgtgtgcttgatctgctgtactggggatgtcgcctcatacccctgtgcccagctccttgcggctgggtgggtctccttcaccctcctgtccttgctggctcagtgtttgtgtgcctggccaatataatgtgtggcaggttcctcacatccttcttgggccaggcggggtgccttcgctagggcactgcagcctcagatggtggtagcacctgcccccatgtatggatcaggccactggggcatcggggtcaccattagtcagcagaacagctggaattgggtggtcctggacatttccttgggaagcaagagcactgagtaagctgaagacttaaatcaggagtttttctgtgtgtgtgtgtggtttttttttttttttttttttgagacagagtcttgctctgtcacccaggctgaagtgcagtggcacgatctcggctcactgcaagctccgtctcccgggttcacgccattcttctgcctcagcctcccgagttgctgggactacaggtgcccgccaccacgcccggctaattttttgtatttttagtagaggcagggtttcaccatgttagccaggatggtctcgatctcctgacctcgtgatccacccgcttcggcctcccaaagtgctgggattacaggcatgagccaccgcacccggccttaaatcaggagttttaaggtcacgagctggctgggattgggttgttgccaacacccacggcagctaaaaactgcttaagaaatgcctgcttgtgggacttgcagggagcctgggaattcacaacccctaccatatagtagatcaagccttgactactaaggaaggaggggttatggtaatctgcaggaaagtatctcagtagtgacgaactcatcatagtatgtcgtatagcctttgtttcttctcaaaacttttacagcaagttcaggatggcttcatccagacacccgagttaagcaagcaagcaagaaacaaaaagccttaaataagagaagttgaagacagtgtgccccttcgtgcctgaatttggctaggaaaacattggcatgggagcgccaccaagggctggcacattctctgggccaccttcagaggtttaacttctgtgtgagagaaaccatccactgggatgcagcttttacgccacatactgccggattccacgtacagggattgtccaaaagaggcaaatccagagacggaaaggagattcgtggttgcctggggctgtggtgggaatggcttaaggaatacaaaggatcttttgggggtgatggaaagggactaagattggaccctttccttccctgtcgcacgtggaaggaaatcagaaaccaagcaagagagctgggggtatgaaaggaactgtgtcattttcttgactgaaatttcaccaggtggcactgggtgttgagatacatatcactgagcaatatcaggtcacacaatacaggagtattgtttctgtcacttccgaattggtgtgcttgaccccaacagctattttgtatgcattatgtgggcaaacccaagtgggtattgttgggttttcatagcaacgaggcagcagggcagagacgcgtttttttaccatcaccctctgtggtgtgggtgcattatgtctgagccattggtcatcttttcttgtcacccacatctccctgggtctggaatctgaccagaaaggaagccgcatttgctcatctgacaagtcctaaggtcagagagctcccgcctccatgaaactatcactgtggggcagatgatgagcaaaccacacacccgaaacatcacacatgcgcccccttgccatcttctttctcctgcctgtgtccccagcccaagcacggagctgctttctgtccctttaggtcactgtacattttctggacttgtatgtagatggagtcctgcagcaggtgctcccttccacctggctcctatctcttggaataaccattctgagatgtgcccgtgttgtcagatggatcaagagctcattgctttgcattgctgagtattagtgcagtgttgggtagcaagttacatgctggtggcattttgtgttaatattagaggctagtttttagaaaaccgttgcaaggagagcccacagggagaacaaagagagtgtcctgtgaaagctatctcttgaccctgatggagagaagggcgctccagcctgtgcagatgtctgtttccggtgccatcgagctctaacttcaaccttgactctgctttccgagtttgggtaagacttgtttcctactctatttgaggtcatcggagaccatcactttatcatggatgggaaaagttttcaggtgatgaagggctgtgctgttgatttggaaagaggacacaagactggacacttcctttcagggtaccatttctaggccctcttgatattttaatatgttttaaaaattaagagaatgtctgcatatgtactagaggaagtcctgttacacaggaaatactctaaattcaactcacatgcagttggttcccattttcaattcttgggaatatgttagaaaacaaaaattttaaccttggagttaaaatctgttgctattttcttttctttttctttttggagacagggtctatgtcactaggctggagtgcagtggcatgatcatggctcacctcctgggatcaagcaattctcccacctcagctccccaagtagctgggactacaggtgtgcgccaccacactggctaattttttgtattttgttgtcgagacggagtttcaccatgttgcccaggctgatcttgaactcttggaatcaggcaatccacctgtctcagcctccgcaagtgctgggattacaggcatgagctaccttgcctggcctgctattttcacagatgctaaatgaaaacactcagaattctatgaaatcattcagactataaaatattctttagcaattcaagctgctgtttatgaggtgggctgtttatagtagggtagatgcttctaatctaatgtagaattgcagctgcagcatagaaagggaagaagaattgagagtacaccaagatgttaaatgtttgtcttttggttgtggaatatgggtgagctcccccctcacttctttatacttttatataatatagaactcttggttcttctgtagtgaatatttatttttaagaaagcagataaatgttgcacataacttgctttggaaaacttttcccattacggttacttgaagactgaaagatttttgttgttgttgtttttgttttttgagagggagtcttgctgtcatcacccaggctgggagtgcaatggcgcgatcttggctcactgcaacctccacgtcctgggttcaagcaattctcctgcctcagcctcccaagtaactgggattacaggcatccgtcaccacgcctggttaatttttgtatgtttggtagagatggggtttcactgttttggccaggctagtctcaaactcctgacctcaggtgatccttccgcctcggcctcccaaagtgctgggattataggcattagccactgtgcctggccattttttttttctatttttaaaatccttcatatcttccatggcagtaaatatggtaaaataatatgtatgtgaggatttttataatgcataaaatattgtagaagataagttcttgtacatgcttttgaatcgtttcatttgccttctctctttggcttacataataaataatgaaaactgcagtttctgacttgggccatctaacattcctaggaagggaaggaggaggcaggagggagacactggaagaggtggtagaatcacagtagcttttgtttttgctgcatgccagacacaaaatgcgaactcacattatccaggctgatgagtcctgcaggtcagaccccacagcataggcaggcagttatagttggaggccttccctcattgctaagggagttccttagcagaccaattcggaatgagttatgtgtaaaaatgagcacagaatgcttaatgcagtgggccacagaatcacatctgatgttcaaacattctaatgaggctaggtgtgatggctcatgcctggaatcccagcactttgggaggccgaggtgggaggattgcttgaacccaggagttcaagaccagcctgggcaacatagggaaactgtctctccagaaaaatttaaaaagaagcaaacaaaaaaataattagctaggtgtggtagtacatgcctgtagtcccagctactgggaggctgaggtgggaggatcacttgagcctgggagttccaggctgtagtgaactatgatggcgccaccacactccagcctgggtgacagagtgagactttgtttctaaaataaaaacatcctaatgatgtgtggtgatgctgtgttgtatactgtctgcatgctatagtcatttggtaacctaattaagattttaggttgtaaatttttcatttataacttcctgagattcatttcttttaatactcgttaaggcaacataaatttagagtttggatcattttcctcttaacttgttgttttacttcacgattgctgcatttagaaaacttttaaaattttatttaaaaaaatagataatcccaaggtgttgatattacaggtgtgagccactgtgtctggccagattcatttcacttaaatccctgaagatccacatgggattctgacagatcgctctgagacatcctcctgttgtttccttttcaccactgcaggtctccacctgccctggtgtccttgggaggaaacccaccgtggtagggcacacagcggctgacttgtcctggtaaatcataagcatggtgggctccgcaggtgcctccctcctttctgtccttgagtctgaagccagcaccttctttgatgacacaaacgtctgtggtttagggttttcaaaggaattccccctcttcctctcccaccacaagaaaggctgctgtggggagccggtagcttgcaggctgggttgtctggtcgtttgaattccacaagaaagccaacctagctgtcctggcttggggcgaggcgggagggcaggagtcctggatctgcctgtgtctgtctgtccctggctgtctgcccctccctcctccttccctcccctcttgcttggggttgggtggggtctgtcttagggagagaaggagggcagggagggagagagctggaatttgaccccagagctgtctgcagcttcccaggagcccttttcagaccctgtctggctccttagaaaggctgtgtggctcctgcgtggcagggccacctcattaaaaacaccggctcaggggagggtgctggtcactcttggggccaaccaggatgtttgcatttgtcctatgcacacagtacaaagttgttgttttttaaataccattttagaggagttttagctctacagagaaatgcagagatagtaaggagaattctcacctcccccacactgggcttccccctattgttttttttttttcttccaattaccatatatccctgccatcccctattgttaacatctcacatcaccatggtatatttgtccaagcaatgaaccaatattgctacattatttgttgttaactaaagcccaaactttgttcctatttccttagtttcccagtttcccattaatgtccttttctgtcctgggattaaccacatgacttttttttttttttaactgagacaaggcctctctctgtttcccacgctggagtgcagtggcgtgatcatagctcactgtggcctctgccttccgggttctagggatcctccagcctcagcctcctgagcagctgggattacaggtctgcaccactacgcccagctaattgttttgtgtttttagtggagttggggtttaaccatgttggccaggctggtctcgaactcctgacctcaagtgatccacctgcgtcagcctcccaaagtgctgggattacaggcgtgagccactgcgcccggcccacatgacatttagtcttcctgtcaccttaggttcttcttgactgtgacagtttttcagaccttccttgttattgatgactctgacctttttgaggagtactggtcaggaattttgtagactgtacccctcttgggattcatctgatgattttctcatggtagaatgaggttatggctttttgcaaagaagaccacagaccattctcattacacacgatatgttttgttttttagttttgattttctaacttttcttaactgtaggaattaatgaagatttttccacaattcctatgctttggaaaatttcctttgatgatgaaatttctttagggaaaaaattatttttcttctgaaagtgtttaggcagagaaactttgttactgaaatattagtgatcagagctgctaagttatagcaaatttgtagagataattgtcccagacaggagggtctgctgagtatgtcctgtggatatgttatttatcttattctgtgctgttgtgcaccctaaaaataaatattttaggctgggcatggtggctcatgcctgtaatcccaacacattgagaggccaaagctggaggatctcttgagccctggaattcaagaccagcccaggcaacatagtgagacggcatctctccaagaaatttaaaaattagccaggcatggtggtgtgcatctgtgatcccctgcttgggaggctgaggcaggaggatcacttgagagcttgggaggtcggggctgcagtgagccatgatcacaccactgcactccagcctggtccacagagcaagaccctgtctcaaaaaaataaaaaaattaaggccggatgcagtggctcatgcctgtaatcccagcactttgggaggccaaggtgggcagatcacctgaggtcaggagttcgagaccagcctggacaacatgataaaaccctgtctctactaaaattataaaaaaattagctgggtgtggtggcgggtacctgtaatcccagctattcgggaggctgaggaaggagaatggcttgaacccgggaggcaaaggttgcagcaagctgagatcgtgccattgcactccagcctgggcaacaagagcgaaactccatcttaaaataaataaataaattaattaattaatttaaaaaatggtagatttcaaaatagtgtttgaaagttcttggcgaattggtgtgctcctgcgttcctctcaactcccactcttgctcagttgcctaccatcacctccaatctcctgatgctggatttgcaagttaaagtatttctctagcgtgggagttggcaagtgtcttctgttaggagcccgtaaatgttttctgtttgggccacttgttctctgtgggactcctcagggttgttgcagtagcaggaagcagccacagccagtgtatacatgaaggtcgtggctgtgttccactaaacctttattcaccaagcaggtggcaggccaggtttggcccaaaggctgtagttggccgacccttactttattgcagaagtgtatactgccaggacttttttcttgtttttgttttgctttgttagggagtctggctcatttggcccatgtttatggggcactgactctgttgtttagcaagcgctgtgttgctaaagaatgttttcgagagatttagacccacccagtaaacctgaacaagaagccagcctgagcagttagccggggtcacagttctccataacttctccccctgcttcctgctggaacagctcacttttgaaatggcaggggagtcattccaagctagcatctcccatcccaccttgtcacccacccccacccacctttttgttttttctggaaaacaaataaaggcttttattgtatctacttgggcaggatgaggggagtggtagttccagagacaaaggactcagagccaggacctggccctcacctctgcgcacaccagcccacactggctcccgtcaccctcctttctgtccgtctctgctcctctctggtctcaccccgtctgctgcagacagtccctcttcatgagttgagaaacataattcctggcagctgcagtgtcgcaaccccttcctctacattttgtggaatgaacacagctatgtaactcgctacccagatcaagagatggaacattcctatttatgttttaggaatgttctagctccccaggggtgcccttgagcctccccaaccccccaaatataggactgtcttgaatgtccacactatagatgaggttagcctctatttggcctttatataaatagcatcatctagtatggactcttttgtgtctagctttttcagtcaacattacttttgtgagattcattcatattgtttctggtggcagttgtagtttattcatttttgttgctgtgaacctcagtttgtttggttttggttttggtttttgagacaggatctcactctgttgcccaggctggagtacagtggtgccatcagggctcaccgtagcctcaaactcctgggctcaagccatcctcctgcctcagcctcctgagtagctgggaccacaggtgcatgccaccacgcacagctaattcttttatttattattattatttttgagacggagtctcgctctgtcacccaggctggagtgcagtggtgcaatctcagctcactgcaacctccgcctcccgggttcaagtgattctgctgcctcagcctcctgagtagctgggactacaggcacgtgccaccacacccagataatttttttgtatttttagtagagacggcgtttcaccgtgttagccaggatggtctcaatctcctgacctcgtgatccgcctgcctcagcctctcaaactgctgggattacaggcatgagccatcacacccggccaattattttatcttttatagacatggggtcttgatatgttgcccaggccgctctcgaactcctgacctcaggcatgagccactgcctccagtctgtgtgtttttctaaagaattcttagtggctaaggaaggttaagaccttcctatcgtctctttcatctttccccagagatgagccattttgaacatggatttggcatctgtgccgcctctgagcccatgcttggctgatctgtggttggcgtctgccttccagagaattccttgttttcccacagtccctttgcagctgtttcatggagcacggggacgcatgctggctgctgccaccagctctgatggctatgaaggtttgagacgagtctcataggtgaaatctgggctctaagacagcccaccttttgaaaggacaattcagccaccagaatatcatcttcgatctgctggttttctcattttggtttccaaaagcctttagccattgttattattccgtgcttgtcttggtgttagctcagtatccatgaaacccgacaaacctctttctagaatgaggccggcaaaccagtctcataatgttcaaccccagtgaagaggaactaaacctcaaaattgttgtaccacaaactctattggccttttattggtggggattttgtttttattacaagaggggtgactgctacagtggcctttccggcaccaggccgtgcctgacggatgagaatgctgtgtcataaacagtcttttgcaatgactaaccgtgctgggttggaatgcagtgcacaccaaaggaaggtaggacttttagtggttgtcacaatagctgtgcgaatccaaatatggctggaaaatgtcaacatactctccagattatcagctccgacgaatgtaagagacatagtgttagggggatgtctggataagttgaactctaatcagagggaaaagggggttggaggaataatgaatgagggaaacacttttattgggagaatagcttgcaaaacggccagttgcataaagtgtcctgtcctaagaagtcctagtgtaagcctcggccagtcctaaaatatgaatgagacctaggacttattttacgtattgctgttatccttactagcacttttggagtctgcattctggtaatgcctaaatgcttgtgctgagttacatgtggaaacagctctacacaacattccctagtctcttggacacttacagtgttggccagtccttttctcgtgattttttccctctgatttactcgtgttgtaacaaagttatcacttttttattgtttctctttgctttcatcctttgcatctgtggctgctcacttgctatgcccagggaaggggaagatggagaaatagattatggatatggcactccagggcctgtttaccaacaacctgaaaagcttatattctcagcaggtcaatactccccatgtctgagggcgaatgttgtgtggattaacaggcaaaacatgttgcatagatttgcagatccacgtttacagattccccactgtatactgaggccatcgaggaacctgaatttgtgtatcccttgtggctattgatatgttgctgaagtcaagtcaggtatgtattgaaaagcatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgactgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaagaaaagcatgttctaagtatctaagtatttaagttctacatgtctagagataaaactctctttatacggggatgtgaggagaggaactaggaggagactttatcatgtgctgatttatgctctgccggtaatgagccatgcagccctaagcatgttacctcatatctctgggacgaataaagtgtctgtcctttggccaattttttagcttcccgaatcagtttatcgacaagatggggacatgcaggtgtatctgccagggttaggggaagctctcaatagtaacgtgtgctgagaaccagctggtgccctgcgtgagtgcagcgctccgtgaagaacattgtgttatgaactcctgggatgcctggattcccttccattcatccactttgttcacctaaagggccagagcaaacaaccgtccactcaggtaaacattcccaccccagagcgaccgtttgcatcctccaggagttaacagtacagctggactcacccgtgggtctcctggaaggcactgtgtcggaaaccgagcttctctcctgcttcccttgctgtggcctatctgggaatctatagtctggagcatcccagggcggcctcctttggcagatggtgtaggagtgctgcaagccctcctggatgcacccaaggacccaggaagatgggagcgtggatctctgtgcctcagcacagaggctgggaggagagacagcaggcgccggctggcaggagcagtccatgtgggagcttctgtgtactcccacctctgcttcacctcctgttgatctctcctccctctgcagcacattctgccctccttccccagactcctccccacagttcgccctgaaacaaacctttccatgggattgattttagaggctgcccatgtgggaccagggctgcagcttccctatgggggtgctggtggccttgtggcacttgctaagctgggcgggcgtggctaggagtttgagcagtaaccaaagtttcctctctgctgagtgctcctggggtccatccctctggggtgatggcaggcagctttacacgtcgccttagagcatgtctttatttgctcctggatcaagaaccttttgccatcaatgtagggctgagcacccccaccaccacacatgccctgtccagatatctcgctctggggtagaaggaggcagttgtgggaagaagtttcctcatcacattagctctaggtaatttcagagaactttgccaatctcttccctagcttgtaggtacaatgaagataacaccagcagacaagataggatactctttcttgagtttaaaaggcatcaaaatagttgcatgcaatttagcaaggaatggatacattagattgtatttaagagagtgcctgttgctgtacagtttttaacaacacgttgaagcagagcaggtacctctcagatactgttttggtggggaggattggggacagtggtttcctgctgtcacactggggagaactgaaggagagaacactgctgcacctgagcggagactgacacttttgaggtgagcaccctgaaccttgggtgtgtattgtccctctcatacctgctgggcatcttggggccaggctgggctgcgtggcagctctgtgggatcattcccgtctgcagcacccgggggcgctgctcattgtgtagaccaaaggccagccagcggagatgcccacttgctgaccttcttacatgcctgcttttctgctacaagctgtcattttcttttattgattggttggctgtcattttcttttattgattaattggttggttggttgacaggccacatcactgcagctttggtatagtcacttctctaatctttccaaaaagtcgcttcaggttatgaagtgagttagcggcctgctccctggttgctccatgagagttcgccctctcctcacagttgtacagcgggccagcattgttgtttggcttcctggctcatatgccccttctctgtggcaccccatgtccttatgaaaatgacctaagccaggcgtggtggtgcacgcctgtaatcccagcactttgggaggccaaggcgagtggatctcttgagctcagggagttcgtgaccaccctgggcaacatagtgagatctcgtctctgcaaaaaatacaaaaattagccaggtgcggtggcacacagctgtagtcctagctactcaggaggctgaggtggggggatcacttgagcccaggaggtcagtgagccgagatcgtgccactgcactccagcctgggctagcggataagactctgtgtcaaaaaaaaaaaaaaaagagaaaacaaacagaaaaacttgtaccctggtattgataagtcttaatgggagggcccctgcctctcaccacagccttccggaagtcagccagatccctttgtttccagcccctggtagaccagcgtggccttatgatcccctctttgtcagtctcatctcttcctctctctttttttagagacagagtctcactctgtcacccagactggagtgcagtggcagaaacacagctcactgcagcctccacctcctgggcacaagtggtcctcccacctcagccttctgtgtagctgggactgcaggcacactccaccaagcctggctaacgcttttaatttttgtagagatcaggtcttgctatgtggcccaggctggtcttgaactcatggcgtcaagcagtcctcctgccttggcttctctaagtattgggattataggtgtgagccaccatgcctggcctctttttttattttgagatcattatagcttcaggtggcaatacagagagatgccatgggtcctgtacccaggttccccacgtggcaacagtaccttttttgtaatatgatggtaacaatgtttcaaccaggatattgcttttttttttttcttttttttttggatagagtctcattctgtcatctaggctggagtgcaatggcgtgatcacggctgactgcagcctcaacctcagcctcctgggcccaagcaatcctcctacctcagcctcctgtgtagctgggaccacaggtgtgcgccaccacacctgacaaatttttgtatttttttttttttttgtagagatggggtgttgctgtgttgcccaggctggtctcaaattcctggtctccagtggtccttctgccttggcctcccaaactgctgggattttacaggtgtgatattgacatagagaccgtcaagacacaagacatttccatcccaagaggttccctcacattgccccttttaacttctctcttgctataaagatatcaagttcaaaactttattatatagtaaaactctgttaatcaattgttgaccgtttaaactggaatttaactgagagccaaggatcttccccaggtgactgaagtctgatgtatcccttcaacttctagttttgaattaacaggagttcagtgtatttggagagaggcctgtcactcccttgttctgttcctttaaagagttatggtccagtagagagggcacgctcgttaaaagcagtctctcgtgaagtggatcaagatgtgttggaatgtaaggcatgactgctagctgctgagcaattcacatactttggaggaggttagtgcccatgaaaaggtagatgcggtaatcagaaaaaactccaggctacctccgggcaacatatttggctaatgctttgattaattgaaacatttaattaactagattttttccccatgctttgcttttaggaaggatccttcactttctgccttggcaggggagtggggaccaaagatattaccctctgattcccagaccacctgcaggcgttttccagctgggattagtctagctccttgctggcttttcatggcacctgaagcttagttcttattgccatcaccttgaaggtctgctccgagctgggtctaccaaaggctttctctttctgttatgcctggtctccagtggtccttctgccttggcctcccaaagtgctgggattttacaggtgtgatattgacatagagaccgtcaagacgcaagacatttccatcccaagaggttccctcacatcgcccactttccccctgggatacccagtgcaccttattggtgcaaaaatttgtatgaattgcaattttaaagacagtcgaatttgacctgcaataaaaatgatgattgtaatttgtcatggcagaattgtaaagctagaaaagatctttaggattgaactgatcattttatggataaggaaactgaggcccagaaaaggtcattggtttgcttctaatgtgtgtttctatctctggggagagctggaaacataccctctttagccagtggtgcccagcccactcaagttgttaacaatggatggatgtagacctactatgtgcctcactctgcattctccggtatgcagtggaaccaatctagaaaagccggcatctttacagccttgagagtgtgcttctcagtgggattgtggatggtttcctctttaataggaaagcctgtttttatatagatgtatttcttgggtgctgacagacccagcaccaccagctcctaagcgagccccagtgttttctgctggggacaggatccagaagcatcccgtggaggggttgggtaccccagatccacctgccaggactccgggagaggcgtgtgtgagcagccagtgagcccccagctgtggaggactgaggcttcctgatctccttctggaacattcagtggccacaccagcagttctttgtgctcacttactagcccatttcttgtagcaaatggaggctacatctgtttcgtagggctgtcataacaaagtacctagcacaaagcttaaagcaacaggaatgtgttgtctcatagtaaagaggcctggaggccagaagtctgcaatcagggtgtctgcagagcctctttctgaaggctctgggggaagagccttccttgtttttcctgcttctgtgactccaggcattccctgacttgcagatgcatcatgccaatctctgcttccgtctccacatagttctcccctgtttatctgtgtccaaatttccctcatctgttgtggacaccgttattggattagggccctccctaattcaggatgacatcgtcatcaccagttacacctccaatgatcctatttccaaataaggccacatgtacaggttccagaggtgaggcttcaacatatctttttgggagacataattcagccccataacaaagggtaataaaatgttttgagagagaatctaggtacagaaaagtgctcacatggtagcatagacattgatgaattttcacacagcaaatcatacttgtgaccccacccagatgaaggaatagaagagacagtcttagaaaatagataccaaattccatgccttatggagaaagccaaggctcgttagtctggtttgtgcttttagggttaaatcaggtacgttgttgacacttcagaccaggtacacgtagggatgtgggtattatgctgcaaatcacaaaggacagtttcactttttaaccccagtggcttcctgagaactctattgtaaagcgtactgttataaactaaattgcattttgaataggaataattagatttaagttagagattctgccaaaaattgctttatcagatcggacgtgagcagttacatcataaaaagaagaaatgccactcaaacctgtgattgccagtttaggagaggctttgcctcttgggccattgcttcatgttcccattttgggtgccttgtctataaaggggaggaaggggtgtcgggatggctctctgggttggatagcgggaggagactgcagcccacatctggttccagcctcttgtcacacagttgagggagtggagcccagctgagattgacctgctgaaggcacctggatgggggtcatagttgccatccctttattttgcattttctcgtgttttaaagctttggtgcccaccgattccagccctgctgttcttgtgaaagtcgcatacacagagtgactgtcacagcaactcattactcttcacggtcctgagtttgcttttctgtaaaattgagaaagaaataattgcctgacctctcatcccacgattgtttttaagagtgggaatcacagcttggggggcagggagttgagagcttctgctgtagtggtgtgagcaacacaggatggccatatttaaattgggattgtactgtggagagttatattaaattcataaggtcaggagaaacagaaacacgggagttgggccttattgcagactcctcctcggtgattttatttggagtaaacggcacacgtaatcttagcatgtctcatgtcaaaatcacttcaaagaatgccacgggtgagtctgcggcagatgttcagggcatctttttaaaggagaaccaaaaaattaaaatttatttcctttttaattgtggctgttttaaactttgttactttaaaaattacatatgtgtaagtggtccactctttttaaaaaaaaaaaaaaaggcatcctcattgttcaactcctggacacagggagggaaacatcacacaccagggcctgtcggggagttgggggtagagggataacattaggagaaatacctaatgtaggtgacgggttgatgggtgcagcaaagcaccatggcacgtgtatacctatgtaacaaacctgcacgttctgcacatgtatcccagaacttaaagtatagtaaaaaaaaaaaaaaaaaaaaaaaaaaggcatcctatcatatcttggcaccctcgatgtcaaaatgtggtaaaaaggacctttgcccattgtgttatgcattttagctctgttcagaatctgtcactgttacctacgcttattttgtttttagaatttgggggcagaaattttttttatctgtcatggaaaatagctgatgccccaatttttgaactcgataaaaatcccaactattcccatattaatccagatagatagatagatagatagatattgcatcagattttgtccctaaaaggactgagtacagtacaggatgtggagtgaaacaaggctgctacggtttcagaaacagctttggagctgagactttgccaaggaaagtgggaactgctctgcgccaggaagaagcgatgaacccatccttgacttgtacgaccatcgggtgtgtcagccgccttgtcgctgtgctctgcaaactcttgcccaccacgaactaggcacacgcttaactcagtgttgtggcagatggatgactaattcgggttttaacttggaaaagcagaggtgggcagattccaccatcctggcagaaggttgcatacccgccaaagcgcactaaaaatcttcctaagttactcggctttagctgaggctgagtgctgctgtctcagaagaattaattactttgaatgggagtcattttttaaagacttaagaatgtttccttttttttttttttttttttaaagcaaaaccgaatgaacttgggggaaataaatgctttgcctttgagagttgtctgctggaaaaagtcaacaaagggcttctgggttttgttcagtggtgtcttgattagagtggcataaatcttaagtactttcagaggaggcttacaaattagagaatagtttggctgttttggtttgattctaacaagagttcagcatggagaaataataccactgatgagatgaggaatgtgtttagcataataaaaaaactacctccgtgtagccccatttttcgggcagatgcaatttgtgtcttaaagaaaaacataaaaacagccagacattatcatttttctttgcttgttcctcagacgcattaatagattatacccctcaatctattgggattgagatgttttatattttaattacacaagtgaacaaagttttgctgtttagaactattctgttgagtgttggtttttaagttataaacattaaaggaaaaatcatctggacttatataatgatgagtcttgagaaatgtcagtgttttctgggaagagttgttccattcttctaactgcctcactggggatcctggactggagcgtttgcccctgggatgcagcgccggggcacccctacttctgggcaagaggctgtgctgttcctggcctccgtgactcttcaggcctttctctcccagttgcatggtagctgctgcatccccacgcatcctgtctttgtttaagaccagaagaaaagggaaagggtggtaccagacatttctgcccctttgattgcagagacaaaggctctcctcaagcctgcagctgacttctgcctttcccccatccgctgggaccgcacatgccaccctgcgctgcaagggggcacgaggctgctccagtctccatggtggattcagatattaaggagggcagggctgatggctgccagggatcctctgatattagtaatgggggagagaggaggacgtcagttccaaaaggtgcggtcttcctggagaacgtgggacttgaatgaagccctgatagagaagtcaaatttgaagaggcagaaagaggacacgaaggtgacatgctaatgaagtctaggatgaagagaaacagtgagggaacgttgagaacaccaccttggtgtgtagggatcctgcatgacactgtggattctaacacaaaaataatgcggaaggaattgatgtttatacagagtggggtgtgagtttcctgcaccagagcatgccagttggtggttacacgtttgacccttggacatgattttagggggagtggggatggcctcacctagttttattttttaattaagaatttttttttttttcagagacatggaatcttgctctgtcgccctggctggagtgcagagtggtgcagtcacggctcactacatcctcaaactcctggtcttaagtgatcctcctgcctcagcctccagagtagctggaactacaggcacacaccaccacaccctgctaatgtttaaaatttttttgtagagatagggcctcaccatgttgcccaggctggtctcgaactcctggcctcaagtgatcctcctgccttggcctcccaaagtgctgggattataggtgtgagtcactgtgtccaccgtgctttcacttagttttaaaagcaaaaagattgtgaacatttgcagacacagggagattacccaccccgcccccgaaattccagattttcagctgcattaaacacattgcaaaattcgtgcatcctggctgctcatttccccatgagcagtcactacccccgacactgggtagtggctgctccttcagaaggaaggaccctgtcccttcaccacaatgcccagtgctcgaggctgtagaccccatcctgagggtgtgtgttctatacatgcagcccctccacttgcagcggcccctcccagcctctgcgagcgctggcgtgtgcactccagggctttatgttttccccgtgttgccttcttaggctctgctgcctaggctgtgacaaaggcatccctgaagagagttgttcaaaaaagaaagatagcccttgtgacgggtgagatcatccatatgttacccaataaaaagtcaaaggcttgaggggccctttgagttcactccagagaaaggtgcagcagcctcggctcagtgccccctaggcctccctgacgttgcacggcggcagcattagattatctcactgaacaaggcccgtccctttgaaatagcagtaggatgggaatgtccattaaagtaaacagctgtgcgttctgagaagcggggacactttgttctaatggccagcagttccttttcctgtttcttggttgcctatcagttctttcagatcgccttttcactttgaaaatgcaaaattaagtaatcccagttatctctgtttaagcgggtgcttcagtgatgtgatgacttgctttcaaaagctcagtgaggccgcgcacggtggctcatgcctgtaatcccagcactttgggaggccaaggcaggtggatcacctgaggtcaagagttcgagaccagcttggccaacatggtgaaaccccgtgtctactaaaaatacaaaaacaattagccgggtgtggtggtgggcacctgtagtcccagctacttgggaggctgaggcagaaaaatcgcttgaacccaggaggcggaggttgcagtgagctgagaccgcgccactgcactccagcctgggtgacaagagcaatactctgtctcaaaaacagataaaaaagctgagtgagaaggggtgaggatctgggcaggtctgcgttctgtgttggctggaagcctgctggcggtgctttgactaaacaattcttgatacttctaagatggacttgaggccgggcgcggtggctcatgcctataatcccagcattttggcaggctgaggtgggtggatcacctgaggtcgggagttcaagaccagcctggccaacatggtgaaaccttgtctctactgaaaatacaaagattagctgggcgtggtggcaagcatctgtaatctcagctactcgggaggctgaggcagggagaattgcttgaacctgggaggtggaggttgcagtgagctgagattgcgccactgtactccagcctgagcaacagagcgagactccattgatggacttgaaagaccaggaatatggtacaggttttgttttttcctcctgtagtgctaagatgaaagcagggctttagacaacgtcgcttatgttcgatgattctttttctctctgttcatcctctccagaaacattgcctattgcattgcgaccagcttttgtataggaagggaagaaacagatatcatttgggttttgtcatcagtgagatgctagtcttgttgtgggatgagaagcataagctggtaactgtcagcagggttaggagcagatagtggccatgtgctccaggcactagggaggctgggagatgtacagagtcccttggtggagacggtggggttcaagatggcgtcctgagggctgaatgtgggcgagctgggcagagtgtgtgcacagcagcgatgggggtgcatggtgtttccagaggggacccagtaaacaaagctctgcaggcaagaaagaccactttctctagggaggaaggacaaagggcctgttgttgcgggtgtgtgatgtttgggcagggtggggatggtgtccagaacagcaaggcttgttttacatggtggtgagtaggacttgattaaatgcagtgcctccctccctccccctcacctgatcaaactgctcttttgcgttgctgctagaggcgagagagaagatgatttgcgtgaggaagacggctgcctgtttcctgccgtggtaaatggattttacagggcaggaggttaaagcgtgactttagaggtgccttggttttgttttactgttccacatgagccatgggtgaccatttctaatacgttatcctttctctggaatattggtggttctcccctgggggcagttttgtcctccaggagacatgtggtaacatctggaagcatttgaattggtcacaactcggggcaggagggtgctactggcttctagtgggtagaggccagggatgctgctgagtcccctgcaatacccagggcagccctcacggcaaagaatgatccggccccaaatgtcaatagtgctgaggtggaggagcgtggtttggagtgtcctattgtttatccatgttttatctattggacatttgggtaaaataacccatttgtagctcttacagatggtcctggtatgcacattcttctgtgggtcttgtggttaacatacatgcacatcactgagtcacttggtctgttttcccagtcatgtcaatatttttttttgagacagggtctcactctgtcacccaggctgcagtgcagtggcgtgattttggctcactgcaacctccacctcctgggttcaagcgattctcttgccttagcctcctgagtagctgggattataggcatgtgccaccatgcctggctaatttttgtatttttagtagagatggggtttcaccatgttgcccaagctggtcttgaactcctgacctcaagtgatccgcccaccttggcctcccaaagtgctgggattacagacatgagccaccgtgtctggccactcatatcaattttggtattcaccccgtattcaggagttgaaggtgtaggaagcagcgcaaatggacattgacagacgagtggataaagagaatggagagtgtacatacagtggaatattgctcagcctcaaaatggaaggaaatcctgttacctgtaaccacatggatgaaccttgagtccatgatgttagctgaaataagccagtcctacaagggcagatactgtatgattctacctatgtgacatatctggaatagtcaagttcacagaggcaggaataaaatgcaggttgccagaggcaatgggggattgttcattgggtactgttgtggttttgcaagttctagagatctcttacacaacaatgcgattatagttaatgctactgaactccatgcaattaaaatggttaagagaacacatttgatattatgtttttgttgatgctgttgttgttagagatagggtctctctctgtcccccaggctggagtgcagttgtacgattataactcacggtagccttgaactcctgggctgaagtggtcctcctgcctcagcctcccaggtagctgagattacaggcatgtgccactgtgcctgactaactttaaaaacaaaatcatagaaacttggtttcattgtgttgcccgggctggtctcaaaactcctagtctcaagtgatcctcctccattggcctcccaaagcactgggattacagatgtgagccaccatgcccggcatatataatgtgttttttaataccacttaagctctgatttcctcgtgttatgatgaaaacggatactttgtcactgtccctgagagtggagcagcatagcctaggttccactggcagtttggacatgaagaaattataacaacagcagaataagttgtaactgtacttgtagcatactttagagtttgcaacatattttcataattgtttcactgttatcctcctggtcgtcctaggatgtaagacaaccagctcttaccaccatttttggggtgataaaaccaagagtaggaagcatttctccaaattgtgtacgtaagtggcagaggcaggtcttcagtaccagatcattcctcatcttttgaaacgctccgtgcccccaccctctgatgtgattattccctcctgtctgccaccaggggatcctgtgcatgtctgtcactgcacttgcctcatgggatttgtatcagccaggatctagttaggagacggaagccacacagtagttggaacaggagtgcttcataggaagcgggatttcgtggactgaccaaatcccaccatgcccccgtgcttacggcttttctgtttacagaagcaaggttgaacagttgcacagagatcgtgtacatgcaaagctcaaaatatttacattacggctctttgtgaaaaagtttgctcacccctaatgtaaagaactattaacttgtggcagtttattatctattatcgacgaattattaactagtagctactataggtaaggagaactctaaagaatacgagaatagcagatagagggagtggccactccctccagggctggggcacagagtacctgaggaaggaataaatttggaactattctccccaccccctccaaagctgagattcgaatctcgatggaagatggctcactaggtagtggagaaagtcgctgagggccaccgctggctggagagtagggagccacccccggcatgccactgaagctcactaggaagctggctgggggtgtctgtgggactcggtggaaagccaccgaggaattgtctctaaaagtcgctgggaagctgcccgccagagcaccagtggaacttgctaggaggccgcccttggagcttagtgccactgtgtgtgccacatgactgccaggtcccactggagcaggcagggaggaaagcacgctggaatgatgaaggcaagccctttccaccgcccgcgtgcctccaccgccctctgctgatggtgctcaccaggtgccagcactggagaaacgcccacagggtcctgctccaggatcaccatgtgggcagtgaaggtgcatttgggatgcagaggcaatgcattgctaactggcaatgttgcaacaggttgtcttcagagctgcactgtaaattcctctgacacacgatggtgttccagaaatcctccctgaacgttgctccccattaaccatctcttaggtggatctcggcctgtgctctgtgaaattcagggctgacatggtggtcaggatttggccaagtcctgaggccccaggatctttgctacatgtggagaggaggcacacacctttgggctctatgctgacctccctccaagaagactgtcaccccttgccacagaatgcacactcttcttccggtcccgtccagttggcctgcattctgacgctgcagctctcacctgcccagggcacattccacccctgcccgtttctcccagtcactcctgggacagtcagcttgccttccgttgctctgtagaaatgctgtctgccaactcagtctccaccacctccagatcttcacctcatctccctccacatttttgggagccacatgcccccttttcacctagccgatcacccagccgtaggttttctgtcatgacactcccttggcctgtgtgtccattagcatggctttgtcacctggtgcagccacgtcctcgtcctctcctcatgcctcatcctcgcgcctctccttgccatggtgcctcgtgtggtgcagccctcattttagggagagatgaaacaagggctagacctttgtggactgaatacctccttgagcatctagttccaaaacacacgaggagggttttggtttattttgttagtgttatttattatttttttttggggggggtgtatatttcttaagagatgggtgtctcactatgttacccagacaggagtgcagtagctcttcagaagcgtgggcatagcacactgcagcctccaactcctaggctcaggtgatcccgccatagcctcctgaggagcttttttgtattgtattatcatttttcttgctttcttactaattttgtcaactatgaggaaaggaattttttctttcctaatagagattttattgatactttggaagatcaatacaaagctgtttcaatgtgtatcctgttgttaatgtccttacagaaaatctaaagagctgtgtcattggattcttttccaggtactccagcgaccttctagctgaaaacttggaggcaaattttccttaaaaggccaggaattaggattttttgaagtctcagcacctttgggtggtggtttccatctttaggagcacgagtctgtctccgggcgaaacttcagtgtagatgcatgttctcaggatatttcacaacttgctgccttgctggatgggtcacatttccttccccaagcgccggtaccttcagatgttgacgagctgtcacatcagaagtcacagtcactcaccgttatcagcaacactgcatactcaagttttcagcctttcatagcacattaacagagagattaggaaaaccgactgccacgaccagaagactttcagggtgcatgcctctctgatagggagagccaggatcaaggagtccttttccttccgaaacagttctactaaaaaacaacccatgggctcacacctataataccaacactttgggagaccaaagcaggaggtcaaggtagtaggattgcttgaggcctggagattgagaccagcctgagcaacatgctgagacctcgtctctacaaaaaataaaaataaataggccgggcgcggtggctcacgcctgtaatcccagcactttgggaggccgaggcgggcagatcacgaggtcaggagatcgagaccatcccggctaaaaaaaaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaataaataaataaataaaaataaataaataaaaaattagccaggtgtggtgacacatgcctgtagtcccaccttcttgggaggctgaggcaggaggatcgcttgagcctgggagttcgaggctgcagtgagctgtgatcgcaccactgcactccagcctgtgcaacagagcgagacccagtctcaaaaacaaaaagcaaacctatgagtataagtaatttaagctgctcaagacatattaaaggcctgaccatgactgcaaattgccagtcagtatgctttgtgctgtaggatatgaaaactgtccacccagcctagcacccaagacagtcaaagcctctcataaaatatataccaaaaaacaactagcaaatgatttcacctcttttaaaaaaagcatttatgcttaaaacatggaattaggtgggattctctccttaaaaatgtttacagaactactaaaaaacttgcatttacaaaacagttgctgaaagtattcccctggcatatatgggaagggagacaggggctgctgagcagtgtatgatagtaatcaggtttctttccctcctgcttcctgggagcctggactctacttgcatttagactccgcttcctgcaggtcaatcttcaggttcctgctgagccacttcagcccatttgccctttgctcccccttttctcttttgtgctttttttccctaaggatttatcctttcctgctgccttttttttttttttttttttttttgagttggagtctcgctgtgttgcccaggctggagtgcagtggctccatctcgactcactgcaagctctgcctcccaggttcacactattctcctgcctcagcctcccgagtagctgggactacaggtgcccgccaccacacctggataattttttgtatttttagtagagacggggtttcaccatgttagccaggatggtctcgatctcctgacctcatgattcgcccacctcaccctcccaaagtgctgagattacaagcgtgagccaccgcgcctggcctcctgctgcctttttgggcttcatttccacttctgcagaagcaggttgagccgacagcctggcggacctctgggctgtgccttggccacccctggggctgacctgaccttccccttgggcatcttggcggtgcctggtgcctgctgcccaaaagccttatgaatctggatgcaccgcaactcccttccctgccctggcctctgggaccacagcaggggccaggaattttttttttttttttttttttttaagtctcaacacatttgggtggggatttccatcttctaggggcttccctgttatcggagcacaagtctgtctcacagagaaccttcagtgtggacaaggtgttctcatttatttcccaacgtgtctctttcctggatgagtcaggtttcctttctgaagacgccgagctcaataaattaagcagactgagaggtgacttcagtgcttgtcctcatcatgcagatattttatctctggaaagcgaagcattgttgaggtggtcagaattgatcaattgcaggtgtgactcatagcccttgaaatatgatattggacttaaaaaaaaactgctttctctcctctcattttgatttctggtcactgtgattttccaaatccctcaagctgaaaaccctgcggcaggtgacatgtccagatcttccttcccagcctctggagttggtgcattactcccgtgatttttctctgcctcttaccccaggagttctgcagagatgtaggggtagtgcccatcagggtcgttgtccttgtcgttttattcttattgccaaataaattcatttgtgtgtgactataagacgagtcttccagaagcagctgctgtagtgatgagttcactcctccactgccatggctgccttcgctgggcccccactgcctgcaggacagcgtccagattcccattccagggcggggtcctcgtcttcccccacttcggccctatcttcagacactcccctgcacacacactcatgcctcaggcctcctgcctccacgcccttcttcacggggaagcctctgcggaaggccttcccagctttttctagttgccgtttctatttggaggccttcttatctccacccgagacagagggtcacatccccctcatgctgccactgcagggaccccattcttttcagcgtgagcctgctcccccgctgcactcaggatgcccttgcccttatgggacttcatttggattgtctcttcaacgaagtatcaacaactttgttccataaaagactttgattaactgtttttttcctgctgttcctagagaaaacatttccatgagaacaatgaggcattctgcacgttaggagacgttgaactctaatcggggccataagagtgagtttccacacagaatatcagttaataactaaaacaacagtatttgcccgggtgtgtggacttggtgctttgggtctgtgagtgcccatagcatggcacctgggccggcatcgtcatgggtcggggatgattgacttcctagctttttgtagaggggctttttgaggttagagcaagtgagagcaaagatttttcctaagtactacaggacagaacttcctcatttgtggctctggcactccacagacattaagcggctgtcactaatcggtgcagtgccaagtgcttccttaccttgtagacctgggactgtgacaaaatgagcatcattgtgatgctatcacgcatgcggcaccttccctaaggtgcctaattaagcctaattaattctactgaacttgagaagttcagtggggcaaagagaatagaatggaggttttcaaagctgctgctgcttttctgactacttttccccatagcaccataaacatgtagaggtactttatctggataaggaagccaggggaaaaaatgaagacttttatctcccaaaccaaaacacatttttgctgggaaatataggtggagtgtggtgggggaaggctgatggatgttgtggaatgcgtccttcatatctagaggggaagctttaggaatccttgcagatgagaagaaacagcatcatgttgtcctttgcagtgaagtcagagcaactgacagccctttctgagagtccttcaggacttgcttacacacgtgcttgtgggaatgagacacattcccaccgaaaaccccacccggtcaccactgagtcagacacagaactgtgtcaccctgaagaagtgctgcttcaaaagctgtcccaagaccctgcaagccatgagtctttatggttttgcctaaagattttcctgtgatacttaaattcaaacatgtcattgtggagagaaggacacaacttcatttatttttatttttatttttatttttatttttattttatttatttatttatttttttagatgaagtctcacgctgtcgcccaggctggagtgcagtggcgcaatctcagcccactgcaacctccaccttccgggttcaagcgactctcctgactcagtctcctgggtagctgggattacaggagcgtgccaccaagcccagccaatttttgtatttttagtagagatggggtttcaccatcttgggcaggttggtctcgaactcctgacctcgtgatccacccacctcagcctcgcaaagtgctgggattacaagcgtgagccaccgtgcccagccttttatttttatttttttgagacagggtctcgctctgtcacccaggctagagtgggttggcatgataacggctcactgcggcctcaaccctctgggctcaagtgatcctgctgccttagcttcccaagtacctgggtgcctcctgagtagctgggtgccaccatatctggctaattttttaccctttttttttttttttttttttttttttttgtagagacaggatttcttttgttatattacccaggctagtctcgaactcctggaatcaagcgatccttccacattggcctcccaaagtggtgggattccaggcatgagccactgctctcagccctagacacaattttaaagttcactatatatcactcttatactgggtcaaaatagtttccttgattttattttaatttttttaattttaatttttcaagacagagtctcactttgtcgcccaggctggagtgcagtggcatgatattggctcactgtaacctccacctctcaggagcaagcaattctcatgcctcagcttcccgagtagctgggattacaggcatgcgccaccatgcccagctagtttttgtttgtatttttagtagagacagggtttcaccatgttggccacgctggtcttgaactcctgacctcaggtaatccgcctgccttggcctcccaaagtgctgggattacaggcatgagccaccgcacccagccccttgtttttagatattgaggaatgcataactttttattatggtaaaatacacataatatgaaacttatcttcttaataattttcaagtgtactgttcagtgatgtgttaagtacatttacattgttgtccaaccatcaccactgtccattttcagaacttgtcatcttcccaaactgaacctctctgcctattaaacactaacttgccattccctcctctccccagcccctggtaatcaccattccactttctctgtctatccttttgatgactcaggtacctgaattcaatcgtatagtgtttctccatttttgactggtttatttcacttagcataatgtcctcaaggttcatccatgttgttgcctgtgtcagagtttctctccttttttaaggctgaataatattcccattatatgtgtatgtatatgccatattttatttatccattcacctgttgattgacatttgggttgtgttcacctagaactcataattgtttaaaggcaaaaacaaaataaggctctgtcctttgaaatttattttttattgttgttgttttttaatgcaaatttatgaaaaaagtatcaaggttttttgttttaatttttgtgagtacgcagtaggtgtatcgatgtccttagaaatttgtgatgatagaattatactttgtaaatgtgcatttttgctcatgtttgtaaccccagcactttgcgaggccaaggcaagtggatggcttgagctcaggtgttagagaccagcttgagcaacatagggagacccccatctctacaaaaaaaataaaaactaaaaattagctgggtgtggtggtgcatgcctgtagtaccagctattcgggagactgagatgggagaattgcttgagaccgggaggtgcaggctgtggtgggccgtgatcacgccattacactccagcttggatgacagaatgtgaccctgtctccaaaaacacagtgcatttttggacacttcaaaatacaggctcaattagttttctaagcagttacttcatcagcatgtgactggtattatttttctcacaattctgttactttagtcaatatttttatgctttgctttactacgtaaaatgttggattcttccccttagtaattgtctatgcttttctccagactcattaaaggtataaattaaattctgagttttacaccatgtttcctttggcagtggaattaaaattgggaaaaatcatctatattcatagagattaatggtgaagtctcttaaattagatacatgtctataaatatatattaattgttttcttttgctgctttactctggagcaaattttccaaaattgtaacgtgaagtacagtttagaggagaaacatctactatcagaatgtacttaaagagaccaatcttttcacctctttgtagtaaattggatgtttacattgtcatgagggtatctctcttggaagaaagaaattattctttattctgaggtcagttatagacagtttcagctaaaaattatgaggaactgattggttatgtctaaaactttgagttgggtttttgatacttgacttgttttgtatattcgtgactataattaatagcatctgcatggcaggtaagctatgttatccattgtgaatacaaggaaacgaggaaaaagagaccagaagtcttagggtccggagttggcagccatggatataacacgtggatagaaaaacacttctgtggtctttcaacaaggtggaattcccgacaggcaagaaaagccactaaagacccgaaggctccaaaacaaaagaccagctccaggatgccaagatcttccttggaatccctggacccccagatgtctgtaacttgcctccttatacacacctcatttttactgtctttcccaccctgcctggatactcttatttggttcagggggcaatagaaataagcaaagtcagccacatcaacacttaggctttctagcatcgaaatacagatgtgcgggcgtcattccagccacagcacttagcagtgacctagagaaacagatagcgcccttcatctctgatccatcctcctgaggcacagccctggaagaagcctttcctctgtgaagaaacctggggggagggttgctccagatccccagcctcctggccggccccttggtctccctcttggggcatgtcgaaacccagtctcccccaggtatcgcctgccttttgctatcccttggctgtgtgtgcaaccttagtgggtggaagcttatttacagtctgtaaagacatcaggataaaatcgtctagaacttttgaaaccagttggtgactgaaaaaattgctgcatatttttgttaggagtgctttttaaaatttgtttatggtattgactagcagtgaataattgctttattcacaaaagttcacttgtcctcagatctaggtggagatttcaggaaaatatgcagcttcagaattgaggcattgtaagttacttagcacctagcttctcctgaccccccaccccaagaagtaagcttgaatccaaaacacttagcttttcaactgccagaagaatggacggcattagcttcaggctcactcttggaagttgttcttgggttagccatgacatgcagctggctagcagtggattcaaaggctgtatgctgatgtgcttgtaaccagtgatttcttctcactggttttcctagcagtttataaagctttttggtgtaaaacagttggcaaaccatttttggaacaagcccagtagtaaatatttttggctttgtgggccaagctactcaattctgccctgtagcaatatgtaaaccaatgggtgtgactgtattacactaaaactttgggtggtgggagggggaaagaaagctggctggattggctcactggccacagtgtgccagaaaatggacagattaactggaatgaattgctgttgagttctactttactgtataggaaaatctaggttaataaaagttacagaatgtaggccgcgcacggtggctcacgcctctaatcccagcactctgggaggccgaggcgggtggatcacgaggtcagaggagttcaagaccagcctggccaatggggtgaaaccctgtctctactaaaaatacaaaaattagctggacgtggtagcgtgtgcctgtaatcccagctactcaggaggctgaggcaggagaattgcttgaaccaggaggcagaggttgcagtgagccgagatcgcaccactgcactgcagcctgggtgacagagcgagactctgtctcaaaaaaaagaaaaaagggaaaaaaagctgtagaatggatggcattcaagctgttacggagtcagtcaatacacattgggaggatactgtgtttagcactgagtagtgaatatcttaacatacacggcatggtataataatcggattagggctatgacaaaaaacagatacgtgttagcaaggatatggagaaattggaaccttcatacaccgatggtgggaatgtaaaacggtacagctgctgtagaaaacagcctggaagctcctcaggttgttaaatgtagttatcatagggcgcagcagttccactttataatagccaaaagtagacactgatgaatagataaaatgcggtctgtccatacaagtgaatgttactcaaccataaaaagaaatgaagtactgctacatgctacaacgtagataaacttagaaagcatcgtgctaagtgagagaagccagacccaagaggccacatattgtattactccatttatgtgaactgtctaggacaggcaaattcatggacacagaaagtacatttgtggttgccagaggctggagggattggaaaccgagtagtaatgagcacaaggtttctttcggggttaggggaaatgccctaatattgatggtggtgatggttgtacaactctgaaaatactaaaagccatgctttatttgagtgaatatatggtatttgaattacatttctataaagctattacaaaaacagtctagttccaggattaatgtatgagaaataattaataagtaatttaaaatggtcaaaaattattgtctggttaaaggagatctagaaaatgaatcagtatcttcaggtcccctgttttccattgtgtgtgttctcaagctttcccattccctggataaacaggagtcgtgtccagggaaggcaggccagggtgaggggtgtagtgcatccctgatcccctgagtggtaataaggtcagcccccagggcccattcccgccaagtgtgaggtatgtctgctgcgttccgaggacctgctctgcctcaggaattgctgctcgtggaaggctcatggaacatgcttctctgttacagattgaagagggcagtaaagccgcggcggtcgacaagttactggctggagatgagatcgtcggcatcaatgacattggtctctcagggtttagacaggaagcgatttgcctggtgaaggggtcccataagaccctgaagctggtcgtcaaaaggtaagatctgagcttcctcccacatttaccacgacacacaggaatgagtggaacatcaaagtgggaagccagttgtcctgcccacatcactacagagatctcgattgggacatgcacttagagttatatgtctcggccaagcatgggcccggcatcaagagtctgaacggttcctaattttattacgacgatttttataaattttaatgtattaagtggatttgaatactcgtatctttcctttgtttatatgtagattattttcttggcaggcagaaaacggtgcttatgctcccagtgaggtgacatgttgttgcctgtcttgtacacaaggtggcaggccactgcgctttctgttttcatgctagaaagagagtgactgtcacgaagatgccagccaccaagggtttagagcactgtgctgaggtctggagggagggtctggagggagctgtctgtctattcctgtacattacgtgtcagttggagcttggatggttttaagaggttagaaagtgaacttggggacatgatgcttttatatacaggaactaaagcaatactccaggtaccacaagagtgttggtgatatgtcgctttcaaagagaaataactctccaccttggttttaaagttggcttattaacaggcaagtgcttacacatccctcttgacaaaattagcatgttcttttgaaggctggctgtaaattttaattaattgacccacatttatttccatttttagtacagacatgaagatatcttccttgttttgaaaaaacaaaaatttttttttcaagtctggtcaagtgaagtagtgtgcgtggagaggaacaaagaaatctgtaactggttgtgactaattatttgtaaacaccgctgcactcaaaccagccaagacaaattcctaaaggcttttttgaagtgggggtgggtggagatgccaaaacagtatccaaagaaaagattcagaaatgaggaagggccagacgtgctggctcacacctgtaatcccagcactttgggaagccgaagcgggaggatcacttgagcccaggagttcaatcgagaccagcctgggcaacatagtgggaccccatctctctctcaaaaaatttttttttaattagctgggcatgatgatgcacacctgtggtcccagttactcgagaggttgatatgggaggattctttgagcctgggaggtcgaggctacaacgagccatgattgtgccactgtattccaggctgggtgacagagcaagaccctgtctcaaaaaaaaaaaaaaaaaaaaaaaaaaaaaaggggaggaaggaaaaacattttttgcctcatgaatttagcaaagtcaattgtaagtggtacatgctattcctgagcacccttttaacaactctttgtagatcagaaagtaaaatctcagaatggtggtttctgagccattggggagggtggggcacaagaggcaccatgacactgtgttatggttcctctgtgatcaccgtcttaaccctcctatagcagcacgtttgttcttacacgattcagttaacttagtggaatgccggtggtggtgagggaagcttgttctgcagaggtaagacgaggagttataaattggctctgggggtcatcatcccgctgccaaggctgactgcaactcccttttcttctgtctcctgtactgtctcgttctgggctcccagagaccccaaaaacactgggctgtgcttgtggtcttactgtgtgtctcttctttgatggagacaccagcttagtcagcatagctggccaactttgtatcaccagggcatagctatgcgtagaaattcctagcatgggagttcctgagtcggaaggtgtgtccgttgtgaatgttcagagacatttctgagtttctcagaccctttcacatcatctctagcataggatatttgtagtttgtttgtttgtattctctgaatgtgataggtgaaatatggttttctatttacatttgcatttccgtagttatgggagtgaagtcaggtatcattccatatgtttagaagcaaggtagatgtgattctttttttgagctagaagtacatatttagtgataaagatagacagtctaaaatctgttcaaaggaaagccatgccacaggagaactggttggtgggaggagagagcgaagcctcagggcatctgctggctggtttcactgagtaggtacttaaaagactcttgggaaaagggattaaacttttgccctgaaggatctccaggagccactgtgtagaatccccattttgtgttctgcagacccactttcctttaaatgagagatgtggacaaaatgataatgtggtttaaatagaattttatttaagtagtatgtgtaacgagatataaagcagcggagtttatttacaaatttttatttcccaacacactttcaataaccgtgttaggaaaaaacccacaagctgtttttcctctgctctcacacaacactcaacacagaagacttctgtgaccaaatgtgcatagaacttctaatactccaactacctttatgtggttttccttactacaaaagcaccaatgggtgctttcaaaattgttcttcttaaagccagaacacgtattcttctctatctaaatttaaatctctatttaaatctccccgccctcctctttctccattcctaggcaaccactaatctgccttctgtctctatggattaggtagcattttctggcattttatgtagagctccaggatggagcatgtacccttacaagtggctagttcatgaaaggaactctgcaggtagttcatagattgagacaccaacatattcatattctatattgctctgcttaaaagcgtgatcaaatggtaaactagcttgcccaagccttgtttgacttgttgcaattgtctgcccccatctgcaaaaatgtgatgagggaaagaggtatatacatctctgtgtaaagcacaggaatccgtggttttttgtttgttaaagacaggttcctgctcttttgcctaggctggagtgcagtggtgcgatcatagctcactgcagcctcgaactcttgggctcaagcgatcttcccaaagtgctggaattacaggcgtgagccgtcgcacctggcctctccatggttttttaaacatgatttgaatagtggttcacggataaactcccctccctgtagtgacagctgctacacgtcttattttgtaggctcattttatctttgtatgtgtggggaccaggggaccaggcagccaggataggattgcgatgggccactttcacaaagcggtggcatcttgtttcacaggcatgggcaacgtggaccttgtggtcgttgagaagctggtgctgggaaagcgatgcgggaggagacaggcggatcactatctccgcagacaaatgagggccagcgcttcctctcgcccagggcagtgggagctggagacaaagaacttgtaacaatcagccctaccaagtgcatgtatgttcttccttgtgaggtccaggtggcatccacggcccgagatgtcaggggaggggtgctgcccaggagtcagatctgtcggttaggtcaggaggagaggctgaggctggcagttttgcttttctctttcttcccaggcggtttgttgttctgtctctacttggcaggggagtgctccttgcaggaaagttcagggcagacatgtagccttttattatgtgtatgtgtgtgtccagtttttttccactgcactgttttcctaggtgcccaggcccacccctggagagtcctgggcaggtcttgaatggatctgggctctggaatcttcacacagagccacaggctatttcgctgggcattagcagcggatctaccgcttgctggccttaagcacaagttcttgggaaggttaaggccagaaaccgggtgaccctttggcattttcctcattaacttagcccagttgggttagtgcaaaagggaggtctgcctgatgccctcaagctgctccggaggagaggaagcagggttgggagggtggggaaggaccgagaaggggacggcagctcctagcttagctgggctcatcctatccactcggtgccagggaccgtggctgttgcctgttgctgtcttctctctgaaatctgcgttaacagctctagggacagagtcatccatttttctcccttcagaggcaaatggctgttaagttcagcttctaaaaagcacctgtaatttcaaacaccctagggaaaatttcttttaaatatcacatcataaattattttctaaagctttgcaattacccttttggctttttccccaaatatgcattataatattagttttgtttacagcaaatccacctgccaccttgtcacagaccccactctgggcagtttctcttgaaccggtcatgtgttgcgagtcattttgtgggggccaaatcgtggatagggttgattcatgtcacttcctgcctctttgctggcagccctaaaccctcttgtgaatctaattacatccactaagcttgcattcaggagcagcttagcagcagagggaagggttttctgcatcaggctgcaagggtttgcgagaccatgtggtgtggtcctgcatttgaagagaagaggctgcatgtcgagggagagcactcatgtttgctaggagctggtttcttacaacatgcgtcccgtcttgggcattgctaaggtgccctgactgctgctccaagcccacattgtgctgtgcccccctctgctgctggctccttggagctgtcctggagcaggtggccctgcagccctaaggttgattagcacagatgttccgggagctgctactcgcaacggtggcagcagtaaggggccgcctaagacgtcagcaggtttacacccccaccccactcccccagcaccccaccccctccagaactactcctgaggcagaaatggtgcatggtcagatggagggcatgctccttagtggggacactggaggacgtcaggtgaaacccatgccttcgaggctgtctgatgtctttgtctgtgattcaggagtgggtatttctattctgtgagcatttggggtctaatggctgtttgctactgtgcttattttcttgttaaaacaaaggagaccctgactggtttaggctattttccattattgtttttatttcatttatttattttattatgagtgaaggaaagaaaggagagagggagggagggaggatgggaaggaaggaaggatgaaatcttgctctgttgcccaggctggagtgcggtggctactgacaggcacaatcatagctcactgcagcctcaaactcctgggctcaagtgatcctcttgcctcagcctactgagtagctgggactacaggtgcatgccaccatgcccagcttattgtttttatttttttttatttaattttattttttctatttttttgagacagagtctccttctgttgctggagtgcagtggcaagatctcggctcactgcaaccttcgccacccgggttcaagcgattctcgtgcctcagcctccccagtagctgggactacaggcgtgtgccaccacacctggctaatttttgtatttttagtagggatggggttgcgccatgttggccaggctggtcttgaactcctggcctcaagaaatctgccccacttggcctgccaaagtgctgggattacaggcgtgagccactgcacccggccagcttattgtttttattaagtaaaatcaggagaaaaaagaaaaccacatagatcagaattgttttattttggggaaagttacttctattggggttttgccttagtgtgtggtttagctaatttaatcagatgaatcaatgtttgcaaatagtgatggtttctaatatagtaagacttacagagaatgtttagcttatttttgtgttgttttggggtctctggaggacctgtatgtgctatgcagtgggatccacactgtacaggttaagtttattttgaggttcaaggaattgagaagttagcattagccttaacgatgaagtttaaatgacttttatttttttatcggttccacaaatgatgtagacttttattttttaaaacagagcagctgtaatgagatccaccaaattgaaagccctgagctttaggagaaaaggttgatctacactggttgaattcccagtttgctattggcttggaaagaagagtgttctggtgagattttgagagcagactctgggaatgtcctctcttgagacttgagggcgcagggatctggggacaggtcttggtgtctgtcatctgggaggtagtgtcctgcgagaggcagcagcccagcagacaccaagggcccctgggatcacgtgctgacctcttagtgggcttagcagggcaggaggcccacatgtggcttctgtccagtgtgccactcgcccttgcagtcacccctaaaggacaggtagatgaggcctttgcaggtcgagacgtccccaaaggctctgtctgtcccacatggagcacactgagcgggtcccctctctgtccatcccgtccttggctgtggtggcactggcacgctgtggcatgctctgccctgcactggccgctttgtccagatggagacaaacgtgctttcagtgtgttgccaaggggcagggagaggtgatattggcagagccatgagcgatggctgcccggcaggtcataaaggcggagtaaatgtcgcctcttcttagaactgtcacctcaagcccggttaccactaacacccattggttccaaggtgggagagtttgggggaagaaatgaagtacccgacacagccttggccctttctacaaagtgaggggcataccttatctgtaacaaaagcctgttttttttgttgttgttgtttgtttgttttaatgtcacttgctaatttattcacacaaagaaaatgctccataatgaaaacaacttcatcccatgtctccctcccacccacacacactcaaacccctcctgtccccaactgcaagatgcgttcctacgtcttggctatctgaaggtacttttagaaccaaatcctcataaaaaccatttagaatagttgcctgataacttggttttattgttaaagaaagcctgtttgtggcagttagagtccaaaggcctttggaatggaatggagtggcatgtttaaggagagtgctcagaaggctttgctgaatggtagtcatgacagcattgatggggaggtgaagtgggctgattaaataactcgagtagttccgacgtccagaccatgttttggtaaggtagccagcgtcatggacagggcaggtagcaacagttctctgcaccacggagggtagttgtaccatttactctgctggttgtgggtgtgcttgcctttaatagtacggaaagcaaggtcattggtctgcagttatagtaaatgacaaagaagaggaaggaatcagatctttcttcagtgatttcactactttgatttgccaactatgacatggtggtttattaaatgtaaagacacagaggaatgttctctggctcaatgcccttgcaaagaaaaggatgcctgccaccctctcggtgagatgataagtgatcaaataagggaagatttttatcagccattcggcatatgtcgatcccatgtgagtggacgtctggcttaccatagtgaccacatgtgcagtggtatttaatagttctctgaatgtgtataggatctgtaaaaagtttggaataaaagcacaagcttcctttggagaaatgtgatttagttgtaatagcatttcactactgccacattcagttcacctgtggtggtagtgcctgtaactttgcattcagaggaattcgtggaccttcctccctctgcctccccgattttgccactgagtttcatctcttttcatggtctgggctcaatgtttctttgctgtgctgtgactgtaaagtctcttttattggttactttccctaaacctcgtatctcttctctataccttggtttttgtttttctatgaagagtatcttcttaactcttctagtaccttgagtaaccatgggctctgggaagggaatttgaggacaaattgagtaaaaatacagtaaattattatgggctttatgtaatgagcagaacatcagaaagggctaggtggggatattgtttgctgagctctagtgggcagaattccacaaagggctaggggagattgtttcttgaaatctctttcctttccctttgcgtctatttacatggctagagcgctttatacatagcatagcatttagagaacagcagtctgcaatcccttgttgcttttttttttttttttttggtatggcttttgccatgtgtatactgatatgttgactcaacaagttaaactttttgtgtcttttttcttatatccgtggtgttcatccttagggctatataaaacgagtcatattaatgactgcacacttgaatgtgctgagtttctttgccaacaaattcattctgttgaaacatagccaggaaattgtgtgggtgccctttttaaaacatcaagctgaatgaaatgatgatttgacacctggggcatatatatggttgaacacaagtggtttggatactgggacagcgatcgtctttttttttccttttctttccaacagtaatgggtttatagaaatgaacattacagaggttaatgggaaaaacaagtcattcgggtctgctccactcctctgttctgtgccgctcggttctgcctgtggcttctgtggcattcctctgcagtcttttctgccataggacccaggttgaacaccagaggtggaggccagaggcggggcacgctcttgctaggggtgaggcaggcaggctggccaggtggagagcaactctggggctctcaccccacgtgaatgctgctgctgggccctggcgtttgcttacaatgaggctctgatgtctcagtttcagctacttaggtcatttgggaatttttatcttgcctcagttctcttcatgtttaaaagcaggaactacttgcctcttatctcctaggaccatagactttatcagacatgatgtcaccattcacgcaggcattgccgcaccactgcctgggaaaagacactgcatataaatcttcccacagtgcctttagggggcgacttttcttatagaaaatacatgcagagttaaccatttctagagtgctctggcgtacttgtatacattcatgtgatgtatgtgagaagcactcccaccacgtggttaaaatcattcctttaggtcccgtcttccaggagcttgcagctgagtgggctgaagagctctcacaagtgcggactcagagaggaaggaagggtggaagttgatccaggaaagtctttgctgaggacaggccagcggagcgatcctttgtagctgagccagttttgagaggcagatataaacgtctgccagccatactaggtgctccaaagctggaagccatagctggaagttctagtgagaacagtagagggggaggcttgggagagggaggtggaaacgtaggatggggccagcacccagtggctcacacacagctgctcaggtggtgcagacactcctgtcccactgcagcccagacttccttggtcttggggaaatgagaatttgctttatctgccaagaccctagatgctacagacgctgccggcccagggagcatgctctgagaacccctggactagaccacagagaacctaggagcatggacttccttttgtggaaactgggagcagctgatggttctagagtgagggcaagacctggccagggctgtgttgcatgcagggagactgatctggcaggaggtgcaggcagactgggagaggaagaagccttccggaggattggcaggaaaaggaaggaagcagagtcagagctggggttcatttgatgtttgcagagaggtggtttttgtttaaaggattagaagagtgtgagcaattgccaggtaaattcccttctccccagaccctggggtctgacatcaggaagcttgtcacagtccctgaggcccccagactgtttccagggcttcccatcctggaccggtatctgcaaggcctttccaactgcagactcttctttcaaaacctgctcttccttatctccaagaagcccttagaaactattatttatctgttttcccacaaaacgttcctcagctcccagtgtaggccaaaagccccccacgtatgtaataccaccaacaccccccgccccccatcgcagtttccaggcagggggaccaggtgggcctgtgtttcagaccgtaggctcccagcaggccaaggcgcctcccctcccagaccctgccttggcctccagccagtgctcttactgtgcacttagttagctgggggcacgaaacacaaactatttgtcttgggaggaggtgcttctttgctttcttctaaaaggttaggaaaataacccaacactcgtgattttttttttcttttctttttttttttttttttttttagtttgagggaagggaaggaattctgctctttgtgaataataaagatttcattgaagcagttcttgtaataattccttttaaaaataaaacaggatatttgatatctaatctgttctttctttttttttagagatggagtcttgctctgtcacccaggcagaagaacagtggtgcaataatagctcgctgcagccttgaactcctgggctcaaacatacagctgttgttcttaatgttcaatgacatcctagcatttttttatatttgtgttctaaaccctgtcctttaaaaaaaaaaaaaaaaaaacccaaacactacctagcatataaaattactctaaaaaattgaagtaagtttcaatgaagtttggtatacaatccatggggaagggatttcaggggaacccaccattagaatgaatcattccatctggagtaccagaaaactcgatattgtcgataccatggtgttttgttatatgaaaggaatagtatgcattggctaaacattatgttttggaagaatgataatggcctgggctgggtgtggtggctcatgcctgtaatcccagcactttgggaggccgaggtgggaggattgcttgagcccaggagttcaagaccagcctgggtgacatgatgagacttcatctctttaaaaaatttttgaattaaataaataaaatttttaaatgataatggcttgggagaatgatcacaaaaccaggcagactggggaaagaaaggcactcgtcaagtctgcaggatgaaagggaatacacagaaacatgtctgtcctgcacatgagacccacggttctagggactaggtggtttaaagtgtttaaagagtgcgtggcttgtgcaggaggaaacaccacagccttcagtctactcaagtccttctgggagcccttgaaactcagccagagggaccgggagtgtaggcgggctctaggtggcgccagagcactctgtccccaactccacgggtctgtgattgagcgaccagcatgtaggggctgaaggtcctccccaccatctccttatcaacaccaatccagccatttcagaggtgccaacaaacagaaaccactctgaccccggcttgatccccaaatacattcattatgcaccaggaaattcagaagacttgagaaaaaaagcatatatattagtaaattttcactgtccacagtaaccaagatatcttcagttaaagcagaaagagtgcaactcttttcactgtgtgtcttcatttgcttatttaaaaaattatccctaggccaggtacaggggctcacgcctgtaatcccagcactttgaaagaccgaggcaggcagatttcttgagcccaggagtgtgagaccagcctgggcaacataacgataccccatctctcattatacaaaaagttagcttggcgtggtggtgtgtgtctgtggtcccagctactcaagaggctgaggcgggaggatcacttgagcccaggaggtcgaggctgcagtgagccatgattgcgtcactgtactccagcctgggtggcagagggagagcctgtcaaaaaaaaaaaaaaaaaagccacaattcgtataagaactgctgaccgtgtcatatgtaagaacacatatatctgtatattatctttttaaaaagcagcttctgggtttgttttcattttttcattgcctcatacagcattgctcattctcttcagacagtttggaaagagtgtgtgcttgtgcaggaataaaccaggtgagatgcattttctgaaggcatggaagtctcacttccaggcaggttccctgcctgcctccgacaactcccacccaagatgccttctgcacatgcattcccgtccatggggagccctcttccatgccatcagcctctctggctgtgacgcccctgttcggactgtcctatcttcctctttccctggcctgcattttgacctcaaccctgtatctttttgtccccgccgatggacacatccacagggatgtcccatagctatgggagatgcacaatatacactttgggtttttgttgttgttgataattatggtaaaatacacataaaatttaccatcctaaccattgtaatgttcagtagcattaagtgtattcacatcatacaaccaatctccagaaacttgtttcatcttgcaaaacagaggctctatatgcattaaacagcaacttctcagtctcccctcccccaccccctggcaaccaccattctactttctgcattcatgattttgacaaatcaggtacctcatataagttgaatcatacagcatttgtccttttgtaactgtctaatgtcacgtagcataccatccccaaggttcttccatgttgtagcatatgtcaaaatttccttttcattgacaagtaatattccattgtatggaatagaccacattttgtttgtccattcttccacccatggaacagtatacgttttgactaaatggccagctgttaaagtctgtattagatataagctgagtatcatcattatagaataaacttctaaggtaaaagtaaatctgaaatgatattattattacaattttgttttaaaacataatgttccgatttcaacagaatgattttggtccaggaacgggattgtttagccttctcagctgctagaaggcttctgtggtcactgccttattcatttgcaacactgaattaattcttattttagcctgaggccagtggaaggttgagatgtattttgggttttttggctaactgctggtttaggttaatgttaccagcaagctgctgtctccccgatgtaactgaccaagctaaagggctaatttctcttcatacttggatttaaggaatcggtgcatggggatgattcattttatttgaaacagttctgcaaactgaagctttgtgtacatggggaggaagatacttcctggatattttcagaagcagatttaaggccgagcatggtggcgcatgcctgtaatctcagtgctttcggaggctgaggcaggagagttgcttgaggccaggagtttgagaccagcctgggcaacatagcaagacctcatctctacaaaaaataaaaaattaaaattattatgtttttaaaagcagatttaagatgattactctccattttgatcatctttgctgcatgaaaagtggccccaaaattagtggtgtcaaacagaagttctagttgtaaaattgagcacaaagcaattggcctatacggaggtactcagaagcatgctatgtgttagggctggctatttcaagatttaaaaatatgctctagaaaatctctaaaaggtagttatctgcacatgatagaagggttggggagggaggcggtgtaaacagtcactgtgctagggttgcaggcagcagacagtcgcaggggcgtagcagcattcctgccatgcagctgagatggggttactacatctctaagccagtgctccagctgcagggctgcagatgttccatatctgtgctgcccaggcagtagccactacccacatgtggccattgagcactcgcaatgtggccagaatgaccaaggaactgaactttggattttgtcactttgaataaattaaccacttatgaataaggataagtgacttccctcctccctcttgactcgtcagtggctacacccgggattgatgtccatctgtccagggccaaagctaggaatagaggcagggcacagctgcgactcactctctcccttcccccatgacaggggccttccgcggggctggcttgagcagcagcagatgcccagaagctttgggccttggttctggctgctggctgggttcctcagtctttttccacgttgcctctgcaggggccatacgtgcaaatgacttccttctctcctgtgtctggtgcgtggggccaggaggttgggcgacagctggggctgcctggtgtcgctttccatacggccttatccacgtggctcacttgggcttcctcatgccatggcatggcacggtcactggattcctcataatctgtcacacgtatatattttttaaaagacagggtcttgctctgtcccccaggctggagtgcagtagcgcaaacacggctcactacagcctcaacctcctgggctcaaatcatcctcccacctcattctccctagtagctgcaaccacagatgcgcgccaccacgcccggctgatttttaaattttgtgctgagatggggtcttgctatgctacccaggctgatctcaaactcctggccgaaagcaatcctcccacggcagtctctcaaagtgctgggattacaggtgtgagccacagcacccggccatttgcatgcatactttgtgagaacaaaatctgttgctaatattcttatatgtgcttgctaatgatagtttatctgggagaacttttattgtacccatggagaactgctgaccctctaaaccagctagtagcccagttattcccgaagcagggctgaactagcgtcgtcttgagtgtcagacgttttcttttcctagccttctctttttctcccctttcctccagtttcagtcagtctagtttattttcttcattaattaactataaaggaagatgaaagaagttgtggatgtcatagcacagagaaagccagctgaaaatgaaattcacatggccagaaccttccttacgaggattttgagaaattccatgaggtacagtctgggttttacaattgctttccttccatggggtgctgaatttgtcttttatactttctctttggttcctgggaaactgtcataaagtcagcatgttccacattttgccacccgtatacttttcctcgttaaaatgatctgagtcatcgaaaggtttgtgttatacatgcttttcagttttattttgtaaaatgttctttattgcataatgttctttaatgtttttgcctgctgggaaaaacatctgatctccacaaagtatttaaagaggcccgcttgagctcgttctccattcttgattgggttatcagctgtcagttctgtcccaaattagagaaatgtaaagctggcttcctaccatgaggctggagaagtgagctcgggaggaggatctcacgcccagcagtgttcccctggaggccctattgcattaccgacatccattgggatttctaaccagacacacctcatcacatctgggcagatgtggccaagacactaagaagccacacatgggatggtggggactgtggcgggggagcccaggaaagctcgtccatattcaggagccctggctgaagggactttagccttttggtgtgggttgtcatgactccctggggggatctttggttgactaagaggctcaggggaagatgcggctactagtcttagttaaccagaaggtggctgtctttactttgttacctaggtaaatagacacagataagctgtctgaactgtgtgtgacccagccgcctgagggacccatataccttttctccagcaaaagataggagatgctgtttgtgttcatactggggcagggagagggcaacatttgcttacttatttatttagaataaatgttctttatttatttttacatttgtaagattttaaattgacaagttaacagttgtccatatttatggaggaacacattttagagataagggctggctgagtgtggtggctcacacctgtaatcccagtactttgggaggccaaggtgagtggatcacttgaggtcaggagttcaagaccagcctggccaacatggtaaaacctggtctctgctaaaaatacagaaattagctgggcgtggtggtgagcgcctgtaatcccagctacttgggaggctaaggcaggagaatcgcttgaacctgggaggcccaggttgcagtgagccaagatcatgccattgcactccagcctgggcaacaaagtgagactctgtctcaaaaataaaataaaaataaagataagggctgctgcacatctagagcctgtgattcccactctgcgttagggcaaatgggtggtgaacaaaaatctaaaaagaaggtgtgggtttggattcagctggcaacccctgaacatggtgccgtgcacctgcctgagttgctgtgatcagtgtcagtctctgcactgtttggcacaagcgtgcgcgctgtgcgcattccctgaaccccctgcactgtttggctcgagcgcgcacgcgctgcttgcggtccccaagccccctgcactgtttggcacgagcacgcgtgcgctgcgtgcggtcctcgagccccctgcactgtttggcacgagagtgcacgtgctgtgtgtggtctccaagtcccctgcactgttcgtttggcacacgcgcatgtgctgtgtgcagtcccgagccccctgcactgtttggcacaagcgcacgtgcgctgtgtgcggtcctcaagccccctgcactgtttggcacgagcgtgtgccctgtgtgcggtccccaagccccctgcactgtttggcacgagagtgagcgctgtgtgcagtccctgaccccccgcctcccctgcgttcttttctaggaggagcgagctgggctggaggcctcactcctggcatgccaccaagttctctgacagccaccccgagctagcggcctccccattcacctccaccagcggctgtccttcctggtccggccgacaccacgcgaggtaggcacccattcccgtccaggatgccaggtttgttcagccttctgcagggagcgcactcctgactgcagaatgattttgatgtttctgatgagactgggccaccgacacataatcacagttggagggctctgaatttttgactgaaccggcaagcgtgtgacacaaaatgaaatggcaagacaaggcatgagcaagaaggggagcataggacttgggtttcagccaagcttctttgggattggccaggtgggatgccaggcagtagggttctgagccggtggggtggcatccacggcacccctctcctttccagggttttacacatggactggaaggcaggagatatatatggggtggcaggtatatcttgtaaaagctcccaagaggttctttaagctttggtagcctctcctcaaccctcttggagttagtggcagtatcctcactagtctcctgttaagaggatggcggtaacagcagatagtctgcttttggtgtgcgtgtgtggatgtctccctgcttgcgtgagtgtgtgtgtgtatctgtgtatgtttacgggtgtgagtgtgtgggggggtgtgagtgtgcatgtgtatttctacacgtttgtgtgtgtgtgtctttgtatgtgtatgagtgttcatgtgtctgttcgtgtgtgcctgtatgtgtgcctgtgcatctctttgcttgtatgtgcatgtgtgtgcacatgtatatgtgtatgtgagtgtgtgagtatcagtgagcatgtttggtgtgtgtgtgtgtgtgtgtgtgtgcgcgtgcgtgcacacgcaggtatgtgtctgtgtttggagctaatgtaaccactcagtttttggctgttaataaatgctggtcttggctgggcgcaatggttcatgtctgtaatcccaacactttgggaagctaaggtgggaagattgtttgagttcaagaccacccgggacaacacagcaagaccccatctctattaaaaataaaagaaaattagctgggcattgtgtgcacacctgtagtcccagctactcaggagactgaggcagtaggatcactgaagcccaggagttcgaggctgcagtgagctatgattgcagcaccgcactccagtctgggcaacagagcaagacctcgtctcttaaaaaaaaaaaaaaaagaaaagaaaaaaaaatactggtctgtaaaattgcaaggtaaagatttatatgacacgaaggaaagacaactgaaatataacattacccctaaagtgacaaaagatgatggtatttagagcccagtgtattttttggggaaaaaaaaaacacaaaaaaacaaaaagccacagattctcaactgagtagtaacacttaagtgaacagtgggccttttattttattcctgaagtgacttaaggtgatgagatctccattaagcccatttggcagtctcttgatgaaagaaacatgcacactgcccacatctgtgtggaaacagtgctcagagttctctagatctgcttggacttgggatctcacagaaaagtcccttccagaatactggtgggtagtcaggagcatgccccgggtttgaggatacgtggtctgttcttacagaagatgggtgggaaacccaaacagtcctctccctcccatagatgacagccagttgttctccagtgttctgtcctggtcacacggttctctcatcctcactctcccccaacctagtggagccacagcttcttcctgttgaagggtgaacatctcagctttgttgagctttaaagaaagcacttaacatcctggataaatagtttcaccattgagagctctcagtcacacacagttattaccttacagaggaatcaatgtgtcaactcaccgtcaatttcatcctcttagacaccatcctgtttaggagcctgtgttttttggtgtgagtgtcaataactctgtagggtataaccagttagctgaaagctgaacacagcagtgtgtgatattattattattattattatctttgaaacagggttttactccattgcccaggctggagtgcagtggcgcagtcacagctcactgcagcctcaacctcccaggctcaagccatcttcccacctcagcctcccaagtagctgggactacaggcatgcaccaccacatccagctaattttttaaaaagtttttatagagatgggggtctcactatattgctaagtaaggctggtctcaaactcctggcctcaagtgatcctccagcctcaagtgatcctcctgccttagcgtctcaaagcactgggatttcaggtgtgagccaccaaacctggtctgtaacaggctagctagtaaatgcttttggctttgcaggccgcacatctctgttgcagttactcagctctttcattatagcccaagagcagccacagacactacgcagacacatgggcacagttgggttccagtaaagcttcatgtatgaactgaaatttgaatttcatatcattttcacaggtgaaataggagaaatagtatgcctcttctcccaccataaaacatataaaaaccatttgggctgggtgcggtggctcatatctgtaatcccagcactttgggaggccgaggcaggcagatcacttgaggtcaggaattcgagaccagcctggccaacatggtgaaaccccgtctctactaaaaatacaacaaaattagccgggcacagtggcaggcacctataatcccagctactcgggaggctgaggcaggagaatcgcttgaacccaggaggcgaaggttgcagtgagctgagatcacgcgtctgcactccagcctaggcgacagagtgagactgtctcaaaaaaaaaaaaaaaaccaaaatcaacaacaacaacaacctgagttgtggtgtggccacccctgcgcttaactgttgattgaccatagacgtgtaaatgcagacgttgcctgccaacgatccgggcatcaggctgagaatgtgcgctagggttgcaaggcatctgtttggtaaaagccatgtaacagggaggacacagtcttttcagcctgtgcccagtttctccgtgtctctactaaaatccagatgtgctgagctgcaacctcagcctcagcaacatcaccgtgggaaattactgtttggcattttggtatttccacagagggtcagctgcgtccaccgccttgccctttgccattgctgttgctaaagcacaccatgccttgtccttcttctcattcttgcagttcttcctcccacgacctgtccagttcctgggagcagacgaacctacagcgcaccttagatcacttcagctccttggggagcgttgacagcctggaccacccctccagtcgcctctcggtggccaagtccaacagcagcatcgaccacctgggcagccacagcaagcgcgactcggcctacggctccttctccaccagctctagcactcctgaccacaccttgtccaaagccgacacgtcctccgcagagaacatcctctacactgtgggcctctgggaggctcccaggcagggtggccggcaggcccaggccgcaggcgaccctcagggctcggaggagaagctcagttgtttcccgcccagggtccccggtgacagcggcaaaggccccaggccagagtacaatgccgagcccaagctggctgcccctgggaggtccaattttgggccagtctggtatgttcccgataagaagaaagcaccatcatccccacctcctccccctccccctctccgcagtgacagctttgctgccaccaagagccacgagaaggcccagggccctgtgttctcagaggcggctgcggcacagcactttacggccctggcccaggctcagcctcgtggtgaccggagaccagagctcaccgatcggccttggaggtcagcacacccggggagcctcgggaagggatcgggaggcccgggctgcccacaggaggcccacgcagacggcagctggccgccctccaaggatggagcttccagtaggctgcaggcctctctgtccagctcagatgtgcgcttccctcagtctcctcatagcggccgacaccctcccctatacagcgaccacagccccctctgtgctgacagccttgggcaggagccaggggctgccagcttccagaacgacagccctcctcaggtgagggggctcagcagctgtgaccagaagctggggagcggctggcagggtccccggccctgtgtgcagggagacctgcaagcagcacagctctgggcgggatgctggccttctgacacagcccttggagccctcgagagtcttcccccacccacggtgggccagagcccacgccatcacctacctcagcctgagggtcctccggatgcccgcgagacaggacggtgttacccgctggacaaaggggccgagggctgctccgcgggagcccaggagcctcccagggccagccgtgcagaaaaagccagccagaggctggcagccagcatcacgtgggcagatggggagagcagcaggatctgcccgcaggagacgcccctgttgcactccctgacccaggaggggaagcgccggcctgagagcagtccagaggacagcgccaccagaccgccaccgttcgacgcccacgtgggcaagcccacccgaagaagcgaccgctttgccaccaccctgcggaatgagatccagatgcatagagccaagctgcagaagagccggagcacagtggctctgactgcagcaggggaggcggaggatggcaccggccgctggagggccgggttgggaggtggcacccaggaaggacccctcgctggcacctataaagaccacctgaaagaggcccaagcccgggtcctgagggccacgtccttcaagcgccgcgacttggaccccaacccaggagacctatacccggagtcactggaacaccggatgggggatccagacactgtcccccacttctgggaggcaggcctggcccagccaccctcatctacaagtggcgggccccacccgccccgcatcggaggccggagacggttcacagctgagcagaaattgaagtcctactcggaacctgagaagatgaacgaggtgggcctcacgaggggctacagtcctcaccagcaccccaggacatctgaggatactgtgggcacgtttgctgacaggtggaagttttttgaggaaacgagcaaacctgttccccagaggcctgcccagaagcaagctcttcacggaatcccgagagacaagccagagaggccgcggacagcgggccgcacatgtgagggcacggagccctggtcgcgcaccacctcccttggggacagcctcaacgctcacagcgcagcggagaaggcagggacttcagacctgccgcggaggctcggcacctttgcagagtatcaggcctcttggaaggaacagaggaaacctctggaggccaggagctctgggcgctgccactcagcggatgacatcctggatgtgagcctggacccacaggagaggccgcagcacgttcatgggaggtcccggtcttcaccgtccacagaccactacaagcaggtaagcatggagccacagcccccttgaccatcatcttaacccaaggacaggacacacccagaatgcagtggctgacgccagggctactcagctccagctgtgcgagcatttaccttttccagatctcctagtgtcctctgttagaggtatttggggacaaagttgacaccttcaaggcaatttaaactgccatattcccgaaaacccacatttttcattctcgttctcgttgccataatctctggctttaactgagtttccccttaagtagcttgctcctaccttcatactcagcaaagaacttggagggagaaactatggaaaatgataactaacgcctctgacatggaaatgtgtggtttatgtaaaagcttaaaatgacatacagtagccacttttcaaacactgatggatgacctttaatatttatagtatttgggtttttttagtattctgttttttatttgcaagtattttcaaggattgctctgggacaaaatgtatttaaaacacattaagtgattgcactttattaaggtgagagttttgatggtgagagttaatgtccagctttctagaaaactgcatatttcttagccctgcttcaaagtgaacagtctctttctctcttgcacctaccccctttgaaagctttttctccctattacatctgcacttgcacatctcaaagaaaaaaatgttccacaatgatagatgcagtttctttttaaaagaatccagggtgggtgcggtggtgcatttgcagttctagtactttggaagaccgaggaaggatgatcacttgaggccaggagttccagaccagtctgggcaacaaagcaagaccttatctctacaaaaaaaaaaaaaagaaaaaaaaaacttaagacaggtgtggcggtgcccaaggaggttcaggttgtggcgaactgtgttctcaccactatactccagcctgggcaaaagagcaagaccctgtctcaaaaaaaaaaaaaaaaaaaagaaccactagtaatttaatacaagatacctaataagtgcatggaaagaaggctgctggtttgctctgtggcgtcccagccctgaaaatccacacagatgctgtgagtgtttatttccactgttggataccctggcttgtggctattcagcatgacctctgagaattccatgcttgctctgtcaggagcaaagaatcccaggctctgacgagtactagagcttgaggcttcaccgctgtaatttgtgaccagctgtattttattttatttcttttggccaattgtgccacacggttttacaggcttcacgtaggagttgtttcctgcccagaacagaagtggacgtggggtcttatttcagtcatctcaatgaaatgctttgtagaactgccctggcaaggcaaacccacaaatgagggctttcataatcacagatgtcctgaggaaggcagcttgaggacttggtgtctcattatgttgccctttgcaggaagcttctgtcgaactgcgaaggcaggcaggggaccccggcgagcccagagaagagcttccctccgcagtccgggccgaggagggacagtccacgccgaggtgggtgaaatttggattcagagttactgaagaggcgtctgagggtgggcttctgtacgatgggtgggtgcttggttaacatggctagatgtctggcttttgccaaacccaaagcggctgaaatccggcgtgatttctagcatccctgacgtactggaggtctgggcagagcctgtgcaccctgcagccctgcctggagacacatcccagggcggggaggccttcttacacggcggtgacattttttggttcttaaaatggctactgtgttttccgcacggtgagactgcttatggagacataatgagaagtccagttgaacatactggagctgcacgctttgcacagagcgccttatggaagggcagctttagctatctagcacacagctgtgtgcctagccgcggcctggaaatcagagttgcctctaaggattgttagtaagaaaggaacagggcaggccttcctaaattggacctagttaatgagttaattttgagctttaaaatagaaatcgagttagtcacctcccaaagagaggcttcaagcatctgcaggaactgtggcagcagcaggagattagagcgttttgtgccataattccagaatgtgcgccgtagccgcttagttgagacaaggacagggttagattaaatacatagtataatctgtgctgggtgtggtggttcacacctgtattcccagcactttgggaggctgaggcaggtgaatcgcttgagcccaggagttcaagaccagcctgggcaacatggtgagatcccatctctactaaaaatagaaaaaaaaaaattagccaggtgtggtggcagatgcctgtagtcccagctaccctggaggctgagctactcgttcaagcacgagaatcgcttgaacctgggaagtggatgttgcagtgaatggggattgcgccactgcactccagcctgggcaacagagcgagaccctgtctcaaaaaaaaaaaaatagtataatcttccccttcatcacacgaggagggcaggcagagagtgtgcgtctctacagaagatgtggtgcaatcttgtttcaaaaaggcggatggagggatgggagtaaatgcacgacagggtccccgggtgtggatttttctgtcgccttgagaatgttgtgtgattgccatgacattcacattaaacactgacctcaaaactcaaggttctgttgcagaaattaccaatttaaaagtttgctttcaagagcctcatgtaatggggttttatttcatttggccttaaacagagctgttatccttctacaaggggatcaaatatttatgtgactctgcaacgacaggattgatattgtgtgtgtgcttgtgtaggaagtctctgcagttacttaacagactctgaggctgaaaccaagaatgcgtgggtcagaaaggccgacgaataatccacctacagaatttagctgtgtctgagaagcacaattagagctttatgactgtggattccaagtaggtcacgtgccgagcaccagctgcagtctgttttccaagccagctcccaggccgttgaggctggccgtgcagtgcatcgtgggcagtgctcgatgggctctgcacatgcgggccttgctttgcccgatgccaccagtgtatcatctgtgcagagggcacccgtgctggtgagagtgtatagctctgctgtgcatggagggggtcgccctgaacagctgtcacgtgcaggctgtgtgtgagtgagtgaatggcactgtcgatactgaaagggtcgagaggaagcggggccccctgcttcattcatcaaggccatgtctcccagcagactgcataaccactccaaagaaattagttccagaaactctctgcttttgagctaccaacccagcaattttcagaattgttgggtgcggttttttttttgagtggtgaggcgcgatgaaattcgagaatatgtaggttgaaaagttgttttcaacttttttcagagactctttaatttctgaaggaccagcaagaaagaatacacttgaaaaatttcaatggagaataatagaagtcaaagttcaggcaagggattgttctttgcccaccaaaaagaaaatctagaatacaaaggtttgaagatacccagtgttttgcataagtttcaaataacgtaaacatgtctgtgtaaatcatatgaagtgctgctctgataatcgatgcgtagcaaaaagtatgtattgtattctgtttggataacaaaagaatgttgagatcggaattgttttttgttgttgttgctcatgtgaaccaaatagagataacattttttgtgaagttcaagatcctgttaatataaagacaagtagggcagattgaagtgatgatactttttttttaagttacatgatgtttcagaagctcagaggagatagagcaaagtgacttctggctgggttatgggagaaacaggtggcgtttgagctaaaatagaactgaacctgagggagcagacccagcacgtttgcttccctccagctcttctgtcctgaacagcccaccgcaccccagcccccacccccactgccatcagaggcttcacctcagacccacaagctcaggcatcatagccagctggagcctgctttggggaaatgctctctcctgctgacttggggccccttgaatgctgggtctgtttcctagtgtggccataacaaactccccaagactgggggactcaaacaacagaagtggattctcccacagtcctagaggctggaagttccagagcaaggtgtgagcagggctggttcctcctggggcctctctcctaggcttgtagatgccgtcttctccctgtgtcctcacaaggtcgtccctctgcgcatttttgtatcatttcttcttataaggaccccagtcctattggatcagagccctccccaatggccctaattacctaattttaccttaattacttcttctaaggccctgtcttccaatacagtcacattctgagatactaagagttatggcttcagcacattgattttgtggggcacagttcagtccctaacactgggagaaatgtccctgcttctccattctacctttatagtaaccacttctacctgctgtcagctctctcaggaagtgtcatcctacccttgagctgatcaggctttacgttcatgacagatgtgaaagcctttaagatgaagggaagagggagctgtcaccctgtgggtggcacagaagaggggcatttggcaaaacctgactggagggctttttgagaaacctgtctggagggttccttggcaccatgcaactgaaggctgacagctctgcacaccttctggttcagtcaatccatctttaagagtttaccttgaaagtggacatccactgccccatgaatgtgctaacctcttcaaactgggatggtttggcagggggacagtgactcttaaactcacatcacggatgtatttgtacaccttcactattccttgctgtctgctgggctggaccgttggctcctggaagatgggattttactttttcatttctcagtaccccgtacctgacataattcctgcacagattacatgctcaataaatggttggatggatggagggactggtggatggacagatgggtggttgagtagacagatggatggaccagtcctcaggtagatagttggagggtggggagggtgggtggatgaatagttggatggatggaagggtaagtggatagatggatggatggatgcatggatggatacatggatgagatgtagggatgcatggatggatagatggatgaatggaagagtaagtggatggatggatagatgggtgtgtggatggatgcagaggtgtatggatggatggatgggagggtaagtggttggatggacgaatggaaaagtaagtgggtgggtgggaggatggatggataagtagatggatggatgaaagggagggtgagtgggtggatagatggatggatagaggggagggcaagtggatggatggatacatgggtgcatggatggatggaggcatgggaaggtggatggatgagtgaatgggaagatagaaggatgggtaggtggatgtataaacagatggattggtggctgaatggataaataccaggctgaccttccttgagttagtctttcttgattgtggtgaataatctttccatattggtacattgtgtgtcctaaaattttatttagaattttagtttacacactagtaagtgaaatggcctttatttatccttctgcactagcatggcatttggaatcaagaagacataaacatctcaaaataaatttggtagcacagatttgttttgggtatgagattttagaccttgtaggaaagtttagaggtaccacatttgttcgttgctcctcaatttcgagaggccttgggtgaggactgtgttctgggtggctccagagactggcactgaaatgagatctgggggcggccccctggagctgtgggtgctggcagtgtcttccttctgtgccttcttgcagccacttccgcccccgcctgcaggagccactgccaagcactgatgagctggcactgacctcaggcttgtattttgttgggacagatgggaggggaggcaaagaaagagagtatatcctaaatcccaataccagctgcaaaattgaatgcatacgaaatagagctctttagggaaaaatttgctttcatataatatgtataaacaagctaaatgaacctgagggtcatcttcctggatgttttccctgagaggtgacttggtgtacagagattcatgtgaagaccaatttttcatttacaaaacaagctccttcatgtagatttcagaataagtaacagagatttatcatccaagctctccccctcatttgtcactttagggcagatgtttgctttccctggccttcaattagctcagggcaattgaagctttccattctgagctgctgtgctaggtaattatgaatagactgtgctggatcgggtcaggataaaaaggtgaaacttgatcttggaattttgtcagggcagagcccagcattctgcatagctttgtacagtgtagtactgcatgctgagcagaaaggttcttgtgcagggagtacttgcggatgtaacaccctcaccccagaagggataaacggtagctgtaggagagagcctgcggcatgggtctagcggacttccctttatgtctttttttgatgttgttttttgagacagggtctcgccctgtcacccaggctggagtgcagtagtgcgacctctgctcactgcagcctccacctcctgggctcacgtgatcctcccacctcagcctctggagtagctgggactataggtgcacaccaccatgccagctaatgtttgtattttttttgtaaagatgaggtctcaccgtgttgcccaagctggtcttgaactcctgggctcaagcgatccacccatctcagcctcccaaagtgctgagattacaggtgtgagccaccacacctggccttgtttttatgccttactttgcaactacaatttccccttacatttatacccatggggactttaagaaacccaggaccgagacaggcggccacccgtttgtttactttttggtttggtcgcgtgattctagattatttagaaggaatagctttcaggtgatagtttatggttacaggatttcggctaaggaggagaagcgggagcagggaggcagatccacaaagccctcgtgtggagggagaagtgtgcaaaaggagggtgaaagtgaccaatgccccaagatgccagagctgagggaagccagagggaaatgcagaggaaaatttaactcaggcatctcagttctagatggggcaggtaagcagtcttctacaaacagaatttgtgtcattgagcagggcacagtggcacgtgtctctaatcccagcactttgggagtctgaggcaggaggatcacttgagtccaggagttcgagaccagctggggcaacctagcaatactctatctctacaaaaaatacaacagttgctgccccatggttgggtgccaacatacgtagctgtactcgcacaggatccttgatccctcatgtgactcctaggctgtggcctgagacttgcctttccagaagaatccagccctgtggaaagctgcccctttgtttcccagcagccccatccctggagcccccagcggcctctcttgggggagagactcccgtagcacgtgctgacgtggcagccccgctctgctctgcctctcctctggcctcctttcttgtcagctggctgcgttcttcaaagctctcagcctctgggccgaccttggctgcgttcgcatgttacgggatcctttggggctttcacctttctccagagagctacctggaaacatagatgtccattctcccctttagcttcttccagcctccattcctcttggctgtgtcctagtccagtcctccacccagattgggctgaggtgacacagacatccacccagaaggctgtacagattgataaccgattgattcattcaaagggtcttgctctgtcacccaggctggagtgcagtggcacaatcatggctcactgcagcctcaacctccaagctcaagtgatcctcccgagtagctgggatcacaggcatgcgccagcacacctagctaattaaaaaaacaaaaaaagtttttgtagagaaggccttgccatgttgctcagggtggcctcaaactcctggcctcaagtgatcctcttgcctcagcctctcagagtgctgggattacaagggtgagccaccacaccacacccagccaatgtgttcatttttaaagtttgacttaagagtcccatagattcagtgtcttatgtggcagttaggtccttgcagttagtctcagaaatcgatttagctcatctgttttctgaaggcccacacatttgaaataaaaaaggaaatagttctgagtcacctccttctcaatataaatagaaaatgcattcaaatattcccacaagttttgtgtcttttaaatctgcacaaacccaaagaattcctagaggaggccgccagagctagcagcacgtgtcaggtctgcatcccaccgggccagctgagcaacccgcttcaggcccctgcataccacacagctcaccaccgcctccaacgccaggagagtccagaaggccggagggcgagggaggactgacgcgtgggcggtgacggcgcgggagccagtgatgtatttctgctttgggctttctcgcacgtggcacttggagcacatccttgggaacatgtctgtcctctttgccagtttaaatttttgtgtgttcgtttccatactagctcttagaatctaaatcaagtgttgtggatggtgtgcaagaccatggctgtgtatgtgtgtgtgggagtctcattgaccacagtgctgacacagtttcccttggtggaagtaaagagtaagttcaggactcccctgtaaatgatgtgctccccatggatgagggacaggaagaacatcagggtaccgtgccagcagagctctgtgccctgttagtcgaaacaaaagtgatggctgagatgagtccttctgtggcacccaggaaactttgatagctgggccaagaagcagcggcactgcagtgccctgggccgcgagcatcatggtttatgctcagcaaagccacatcacctgtcatatagacctgacatcagctttacagttttgcttgcatataacttgcaaattttgttttgtgttttatagcctaagaaccattaaaataaggaaacagattttatatagagacatttagcagtctaataaaaaaaaataaaaatcacatattgtatgatgccatttatataaaatgtccagaataggcacatccgtagatagaaagtagattagtggctgccaggggttaagaggggagaagtgagggagagactgttcatgggcgtggggtttctttctggagtaatgaaaatcctctagaatctgatagtggtgatggtgactgctgtgatatactaaaaactactgaactgcgctgtttcaaagggcacattttatgatatattttatctcagtctttaaaaaaaaatctcaacactgggaatccataagaaaactttttttaatttaaaatgggtctgtcaggcagggcgtggtggctcacgcctgtaatcccagcactctgggaagccaaggcgggtggatcacctgaggtcaggagtttgagaccagcctggccaacatggtgaaaccccgtctctactaaaatattagccaggtgtggtggcagtcacctgtaatcccagctactcaggaggctgaggcaggagaatcgcttgaacctgggaggcggaggttgcagtgagccgagatcgtgccattgcactccagcctgggcaacaagagtgaaactgtctcaaaaaaaattaaaataaataaataaataaaatgggtctgtgcattaagcagctgtagttcagagattgacaaagtttgcggaagatgagatgataaatatgtttggctcagaggaacatagtgtccctgctgcgaccactcagctctgccgtgatagcgcaaaagcagccacacggtgaccaggttgccctccctgcaggcctgctaagaggactctggctagattccagcccttgctggtccccctggcgttggggcaggggggaggcgggcagcatccctactgtcccaccggacccagcagccacaggggcctttcgcttctccacattccttcctgccctgccctaaagcaggaagcaagacaaggaaacctctgagtcaggtatgtggatgtcctctgcagaactcgcctggtcccttccttcaagtcatttgtttctttctgtgagtcagccctgcctcctgtttaccaggcacaggtagttttacctgtggctccctgagcagaactggagccggtgtaacacaggctgtgtctctgaatagaaagtctccacactgccgtgccgctctccactctgtgtttgcccactgtatgcaccagagcaccctcccggctccccttctcctaagcaaatcccacacacctgcatcccatccttcctcagatcacttccggaatcatctgcagagtttgggtttcatggtttgtgcgacactctcaagcagctcacccaaatcgggtggtgtcagatggtaaagggttgaggggtctaggtcagggtcacttggaaacaagttcctgggggagcagagcaactttcttctctacttggaagaatatgataaagcacccctagactcactggtttcgagttctagggaagcagatattgatgactcaacagaggaaaggattgtgtaatcattgctttagtcaggggttagcaaactatggtccacaggccaactctggccccctgtctgtttttttaaataaagttttattggcatgcagccacatccgtttgctcacaggcggcctgtggctgctccctctctataatggcagagagttgagtcattgcaacagatcggatggctcctagggctgaaaatatctgccatctggtcctttacacaaaggtttgcttgccgaccatgttgggcttagtggaggggtgtaagggatggtcttacatgagtgtgcttccagcacagggagcatggaacccagtggcagtctgtctggatgttttcaaagaggcttctttgtaatagttcgcgattatcttgcaacatgatatccatctccccatccctagtgtggttaacttggggaagtttgctttgtccaagtagagggggctgtagcttgttcacagcccaagaatgcaggagcacgcaggatgctggagcaccagcttttctgacttgttagtgatagcctgggttagggaaggttgtccttggaccacatgggctgggcatgcccctcaattcatggaaagtgactcagaaaagttcaaggtttcaccaagactaagaggtgaggaggaagttctttcagaacataagggtactagggtggtgatttcattctgttctttttttatgtgtggactttttcaagggcacaaatgttttgtgtcaattaaaagcagatttgtatgcattttgttacaatgattatgattttaaagtcttaatagtattatactatacaatctacaaaaagatttgagcatcttataagccctgataattatgcctcgctctaagaaacatgggtatctggaaagccacattataaactttaatattataaatgtgctttctgtttagaaggaattcttggagggtctcctttaagagtggattcctaggccaggcacaggggctcatgcctataatcccagcactttgggaggctgagaggattgcttgagcccaggagttcaataccagcctgggcaacatagtgagaccccatctctacaaaaaaaatttagctgggcatggtggtgcacctgtagtcccagttatttgggaggctggattgggaggatcgcttgagcctgggaggtcaaggctgcagtgagctatgatggtgccactgcacttcagcctgggtgacagtgagaccctctctcaaaaataaataaataaataaataaataaataaaaacaaaaataaaaaaacaggattcctagagcacagccagcatgcagaacttgttttctaaggcttttctccaataaaaggaaccagggctcctcagaggaatgactgagtctagggttggggcagggactgtacaagatgagcctggagtatcttatagtgccagaaaataagcgctcaaatacacccatatgtaaacccagcggtgacaacagtgtgggtatgtcatagggacacaggaaccaacaatgaccaaaggcagaacaagttaagcagcaaaattaagtagtagtggattataatccaatatataaaatgaatccacagcccagactgatacgcaggatggttgaataaattaacaaatgaagaatagagaaatctgctgtgcagaaaattgcaaatactttatgtagctactgtgcccttaaggaggtggagcatagctcccccgctccccgctcagtgtgggctgccaacagtaagctccctccaaagagtacagtgtggcaaaggggaccgaggagaggaacatcacagtggagaaactggtgtataccaacttcaccaggcgatcagggccaacgttgacaggtaagtcacattgacagcatgccccttgatatcataggataacagtggcacttcacttccatggtctctctcccagaagtcccaggctaatcataaaaacacatcagacagttcccaattgagagacatgctgcaaaatgccggaacagacctcttcaaaactattaaggtcatcaaaaacaaggaaagcctgagaaactatcatagcctattcaggctgctataataaaacacctaagattatatgatttataaacagcagaaatgtatttgtcacagttctggaggctgggaagtctaagatcgaggcactggcagattcggtgtctggtgaaggtgctttctggctcacaaatggctgtctctctgctgcgtcctcacatgatggaaggggagagggagctctcaggggtcccttttatgagggcactaatcccattcgcaagagctccatccttatgacctcatcacctcccagaggccccacctcctaacaccatcacctgggggttaggtttcaacataggaatttgggggtggggggcacaagtgttcagtctaaagctatagcaccctcacagcaagaggagtctgaagaagcaggcctgagtatgatgcagtacctggatgaggttcaaagacagaaggagaacattgattaaacagaaaatttgaataaagtgtgacctttagttaatattaatgtaccaatattgattcattaactatgacaaacacaccccatagtaagtcagatattaataatagggggaagtgggtagagggcatatgggagctctcgcctggctgttgcaattttttagtaaatctaaacccattctaaaatgagatgctggccaggcgcaatgggtcatgcttgtaatccaagcactttgggaggttgaggcaggaggattgcttgaagccaggagtttgagaccagcctgggcaacatagcaagaccctggccaggtgcagtggctcacgcctgtaatcccagcactttgggaggctgaggcgggcgtatcacttgaggtcaggagttcgagaccagcctgaccaacatggtgaaaccccgtctctaataaaaatacaaaaattagctgggcatggtggcgtgcacctgtaatctcagctactcgggaggctgaggcaggtgaattgcttgaacccaggaggcggaggttgcagtgagctgagatggtgccactgcgcttttgcctgggtgacagagtgagactccatctcaaaaaaaaaaaagtataatgaaatatttattttttacaaatttttatgtagagaccaggtcttgccatgttgcccaggctggtctccaactcctgggctcaagcagtcctcccgcctcggcctcccaaaagtgctggggttataggcgtgaaccaccacacccagccctataataaaatatttaatcagccatcagctgattgctgttccgtgtgtggcctggcagtatgtgttgagcatttgagaaaaggtgatggcccggggtgaatggcaccctctcttagagacagtaacatgtacttggtaaagtaatacgtgaagatgaaaagtactggaaagaacacgggcttcggagttgaagacacaggctggaatcctcattctgcctctcagtgtaagtgtgtcaggtcccccaagcttgctgacctcacggccctggatcatggggatatgcagagcaaccttgctcgcagacttatttacatgcttaagggatataacattaatgaatcagcacagtgcctaaggttaagtgtcgatatgggggaaaaaaatctaaaatagcagtgatacagtataggctgcaaagcagcatatgttatttggagaaatgagcaagagttggaagtaattgctatgaatgtagaagagggtgacaggaacaggttggaaagagaaactccgtcctggtggctaagcccaggatgtgggagggtgggatagggctgtgaggcgcagtggctggcgacgctgcttcctggaggggctgtggtgctgaggtctggggctgcgttaggagggaggtggggctcagggactttaaatagagatcattgtgaaatggttaattgggaaagtcaggtccagcctgcctttgtcttccctgagtgccttgcacacactcaaagttccggaaacgcttgttagttgcttgatgggttacattcctaatgagtgtgtaatcaacccaagaatatatggacatagaataggctgttgaatgttttctttttcctccttatggttgtggagttgaactgtgtgtcacatatgttataggattatctagcatcacttaatagagaaagctgtaacatcagtgcagtgggctttctatatttccccgttaaaatataagaagtgctgggcacagtggctcacacctataatcccagcactttgggaggctgaggcaggaagatcacttgagcccaggagttggaggctacagtgagccatgatcataccactgcactccagcctgggagacagagcaagatcctttctccaaacacacacacacacacacacacacacacacacacacacacacacataaaggaagactgccccccaagccttttggggttttaaattacaagacacacacacacacacacacacacacacacacacacacacacacacacacacataaaggaagactgccccccaagccttttggggttttaaattacaagacttttggggtttaagcactgaagtgttgggaatgttccccactgaggcaaggagttgctgatgaagtgatgggaaatgcaagcggagccttgagccgtggaggtgaaggttgacggagcctgcgtgagcttgcccatcaacaagacagcaggcacagacaggccagctgttgtgagcttggctttaggactccattcagtaggcaggaggagagctgcagcagaggcgggctgtgggtccctgaagcacatcgctgccttcacagctgggcgaactcccatccagcacggtaagcagagccgggtaagggacctctgcgtttgctctcggggcacttcatcccagatgggaccggtttcaggacgcctgcgccgtttgttaggggtttgtagttcccagtggctcttttgttctgctatcttgaagggcaggttgcttgtcagctcacaatgctgtgggtaaggtctggtgaggtcggcgaatgtgttctcattgtttattcttctgcctgaagatgagaaataatgcaaatcagggtgcagattccggctcgagctccacaggcgtgcacgtatgtgtaagggcatgctcgccggtgctgcatgtcctcgtggatgcatgcaatttttacagctttgggattcacggttagctgaaagcacattggaactggaaggcggtgctcttaacaccgtgttctaggctggaagccgtagagccatcatctgctctgatgggactgcagcccttggtatgtgggacccttgctccatgtgagttctgcagatgggttccccgagggagctggctggaggacgccagcatcgcatgaagacctgcctgcctcgtttgccttttgtttttcagtagcagtaagaaacaggcattctcactacacaggcattgaatgcggacattgagaaaaaatggtgagtcagctacatcctcaagaaaaaaaagcggcgaaatcaggtgtgcatgtttagtcatgagaaatgttccctgagtgcgtttgcacatagcctgctgattgcagtgagataatttaaatagagaaaatggaatcaccatggttcttagcattttccagttcttttattttgctctttggtgtgattgtgacagtttaagggttttactatacatgtgctttttcccccattttatgttgtgataaaagaaagagatgattagttttggctatatttctaaatggttggaatgcctttgctttactaaaggaggcttttgtgtgtgcagagggtcgatggcattttcacagggaaattgatgcataaatatgtttgcacacacaggctgtctctttggtctgcatttactgactcacaagagtaggtgtcattttgaaatgcatgtttttagcggttgtgctagttgaaaggtaaaaaggcaaaggagtttgaagaaaggtttttggaaatctacctggtagcacttacgagtaaacagcctactgcctcgtagatggtcttaagatttataagatgaatggaaaataatattttaatgtatcatataaaaaaactgaagatttggtaccaagttgatgaatggttggcatatttcttttcattacggaatagaacctttgaggtcatactctacaagtatttcttattattttattgcggaaaagcattgcatgggtggtagaggcacatttctttcttttgtcacacatagtggcaaaaacattttatactttgtccctttctgtttctccgcctccacctgcgcccacccccctgcccccccgcccctcccgccccgatcaccaccaacccaaaccaacaccatacctcttaaggaaaaaaattgcaggggaattctcatctacagaggcatgaacaacacacacagagttttttacagagtgctaggaataaccatacacgttggtgtcaagcatataggctgcggaaggctctattgcccagccagagggacaaatgaccctggtgaatgcacgctgactgctgcttgttttgcatgggctggctgctcttccagagtccgcctttggattttggaggttgaggaaggaagggaatattttatgtggcctttggaatacatttactttacactacctttaattttttacctctcatatgcattaaatttttaagaagaccagggtaggggagcagtgggaagaagctgatgtcttgtatccacccatctttcccctgtcctcgggcactgatttccagctggcttttcctagagcaagtaagacagtcgggtcatttctggaaggcttgtagacatccttggatgtctgaagaggtcctagagttatttacttatttacctttaaaacatatttgccgacaccttatttaaaattcctgaaagttcacagtgcctcttcatatgtataccttgggtcctactatgcggttaccatcttgattttataataaagcaaactgggggcggggtgactagattctcacaaccagttagtgaagagccctcgtggggcagcatggctgattttcagtctggtgggctcctgcggactaatgggtcgaggtcctccaggtaaggctgaatgtagaactggcccaagaattcctagttattctcttagtaactttcacatcccttatccagtttgctgccagtgcagtgagaaggaatttcagtttggacttctgggagtgaagtacagaaacccgttaatcaggcagagacagcatgtgtgctcctcagcctgcgttggtgtggcttgcgaagccacctaagcattctgaccctccatttcttcatccataaaacaaggaacacagattaaattatttcttatttaaaaattatttattttttatgtttaccattaccttgatcttgaagtttaaattatttcccaggtcccttccagctgtagtcatttttggttcttagggagagaagccagggactcaaatttcccttcagtcatatttccagctctgtggggtgatttgtggctgcactgttttgctcatttgccgtcattatttccaggaacaaaagcatatgaatatatatgagacacacgcacaggggtaatagcttcgatatccatttacaaataaaatcagctctgtcagcaaactcaattttctgtcaacagggctttgttgatgggaatgcccttgacagctaagcctacttcggtcttcttgtggtaatgcctcataaagccactcactgccaaggtgctcttgggtataacttgcatgaaatttgttataaaattattccgttaaaaaaatctagctggcggacccttaaatgtacttggaggccattaagggtggaaaagctagaaattctaggaaaattttcaacatttatacacgtgtgtgtgtatacacatatacatgcccatacacatatgtgtactacacacattttctatagtaattatgcatataaagttaatgtcatgtacaacaaatatctgaagtctattggataaacaatccatttccgattctggttcagctgagttagaagataggcaggcaatgatctgagatggaaggtttccacagtttggggtcacgtgcaattgtgatagaaggaagattgagattttctcttaatttatgaagctgatatgctattctaactagtttttaatatatcttaccacagggccacccaaaattcaaaattactcctgattttgtaagcttcacatatgtttttgagaatgaggttttatactaatctgggattacagctttctaggctgtgatatacagtttttattaacatttcctattttaaaaatcaattttgctaattaaaacctttttattaagaatatatagaagttctgggaagcagagtgaggatattaacaaatcaccctcaatcctatcacccagagtctccgctgtggaacatggaagtatatctgctttgaagtccttgcaaatatgtttttacacatgcaattatattacacatactgtatgtaagctgcctttttctgtaacttgtatgtgtatggtgcatgacattctaaaatctaacaaccctgtagccatactgtggacatttagggctgctgttggtgtttgacgttgtaaataatactgcagcagatatctgtagtgaaatacttgtgctcttccatgttgatttccttcggataaaattctgggcatggagttgctaggcaggcgctagaaaatatcaccacgttgccctccaaaaagtgtatgcttactatttacactctaggggcaccgatcgcccaggacagtcctacttctcccaaaactttgtcaatattagacatttttaaaattctgtggtttgataggcaaaaaagttatttcatttttaacttgcatttcttcagggactagcaaagtcagacttttttggtgcactgactagccatttgtgttttttcttttgtacattactcttcagcgcgtgttcattttcctactgaagatgagccctttcttgattattgtcatttaggttgcagataacatccctaccgtgtgctgtgtgccttccagatgttagtgggtggttacagttcaacttttttgacatacaagtgtgttgaattttagcgttgtcgcccttgcacctggagcctctgtgtggccagttctgccttttggtggctactggcttctgttagttgtacattgccattactggtctcttgttaccatgtgtgccgcagaaggtgtagccaccaggagctctgtcagcatgaattccctaggaggtgtagacatccatctcggaaggctggtagaaaaattgtctctgtggaaaaattaagaagtgcccagctttccgacaaccctaactcatcgtagttcccatcttttgctctggttgacaggaaactcgtggtcctattggaagcacaaccataggacctctgtacattctcgtgtccggtctgctctttgcataagggtgcttgcccctgcttgtgcccttctgctttttgtttacatttgctctcactgtgatgtttttatgttcattttgatactcaagttgtgtgtttgttctcctgcgtgagacacttctaaacatttcatcatttagggtatacatagatcaaagtaagtggggaccacataaacatatgtagaaacacgttctgaacaccaaagagcttctcggtcaccagttaatattgtggttctttgttgttgttgttgttgttgttgttgttgttttttgagatggagtctcgctctgtcacccaggctggagtgcagtgccgcaatctcagctcactgcaacctctgcctcctgggttcagccagttctcctgccttagcctcccaagtagctgggattacaagcatgcgccaccacgcccagctaatttttttttgtatttttagtagagacagggtgtcaccatattggccaggctggtctcgaactcctgaccttgtgatccacctgccttggcctcccaaagtgctgggattacaggcgtgagccaccacacctggccaatattgttattacagtcactgttttatggaaaaacttagtgacctcatatcgttcttactgggcaagtgagcctaacacaatctgtttctatagtaattgtggaaatgtgacgttacagtggaagaggagagttgggacatggctgtggagtggagctggggctgtccacctctcacttagtatggaatcctctcctaggcccttcagctccagcacactggaagtctaaggggttttgtttgtctgtttgcccctatgttttaatcaccgctaggatcagaagaactgcagtctctgtgaacaggtcttcaggtgacatcagtgtgttacctccctggttagcaattagcattcccgaggtcgggtgctgtgctgcatgcaaagttgaatcaggcacagacagaaccttccttgaaggagtttgtcctctcttaatagtgaagataatatagaaattgtcctagccagtttacactcctaaaacaaattaccatagactaggaggcttaaacaacagacttttattgctcacagttcttctggaggctggtagtccaacgtcaaggtgctggcctgtggattcctggttcacagatggcactttctacctgtgtcctcacatgagggagagcagagagaggaagcaagctccctcgcatatcttttctttttttgagacagggtctggttctgtcactccaggctagagtgcagtggtgcaatcacagctcactgcagcctcaaactcccaaactcctaggctcaagcaatcttcccacctcagcctcctgagtaactgggactttaggcatgtaccaccatgcctggctaattttgtttgtttttgtagagatggagtctcattatgttggccaggagggtctcaaactccgggcctcaagcagtcctcccaccttggcctcccaaagtgctgggattacacgcttcagccacaatgctatccttgagtgcttcttatgagggtactcatccattcctgagggcttcaccctcctgactgcatcaccttccaaaggctccacctcttcatcctatcccattggggttaggatttcaacttatggatttgggaggcagggcacaggcatttagactgcaacataaatgtgaatggctgaggagcatgggattcagaaggcccgagcacatcaggctgcctgctttgctttctgctcctttcttctctcttccctcctcccttcctttgtttctttgttccttctttcctgttgactcagtgagcttttgctgcaatctgctttgtgccaggcattgtgttggacctggaatacagaggtagatgaggcaggggtgagcacagtcgtttcagctaggaggagagatactaaatgaaaataccacagaatggtgaagtgcagtctaggaatcaacaggtagagattcagtactgtgcaagttcagagaagaaaggcatatctgtgtcaatgggtccaggaaatgtttcatggaggaggttgcttttttttttttttttttttttttttgagatgaagtcttgctctgttgccagtctggagtgcagtggcatgatatcagctcactgcaacctctgcctcctgggttcaagtgattctcctgccttagcctcctgagtagctgggactacaggcgcccaccaccatgcccagctaatttttctatttttagtagagacagggtttcaccatgttgggcaggatggtcttgatctcctgacctcgtgatctgcccccctcagcctcccaaactgctgggattacaggcgtgaaccaccgcacccggccccgcatttcactggatcttcagaacaggaatggcttccttggggagggtcccaaaaagtgcgaatcaaaacagagatttgggaaccaccaggcatgcataggtagggcagggcatctcaactcactgcaacccatcagagagtacatctcaacccactacagctcatcagacagtacatcttaactcactacaactcatcagactgacatctcaaatcactacagctcatcacagagtacaactcaactcagtacaactcatcagacagacatctcaaatcactacagctcatcagacagacaaatcactacagctcatcagacagacatctcaactcactataactcagacatctcaaatcactacaactcatcagacatctcaactcactataactcagacagacatctcaactcactacaactcatcagacatctcaacttcactacggttcatcagacagacatctcaaatcactacaactcatcagacatctcaactcgctacaactcatcagacagacatctcaaatcactacagctcctcagacagtatatctcaactcaccacaactcatcagacagacatctcagctcactacaactcatcagacagtacctctcaagtcactgagttttatggtctgtgactgataccccgatagagttgtggaggtgaaaagaatacaggtgaaagtgtttggtaatatgaacacctcctagatccatcctagatgtctagaaattcacatacacatttgtggctcagaagagcatgtaggtgtagggaacaaggtgtaaggtaaactcaaattcatacattgcttgttacctctgcccagaccttagtagctttaagcttttgtcaataatagatcatacctaataaatattacacaacccagatgcttctaaaactattattgaggtaaatgaaaatgtctgccacagtaagatagtatttatcacagagattcagatatgattttttttctcttttaacctaaagaaatatagtaataacaaaaaagtcagctaatatgctataagcaattgttgggaatcttggcatgaaatccagttagggtactgattgtgcccatatcagatttttagaagcagataacctgatgtgtttatgagttttatttctggtctgctttctcctcaaaatttcctgtgtatacattgaaaacaaaaagccagccacagatcacttgatcattatagcataaagagtagaataattgtgttagttaccttgctgcataacaaatcgtccaccaatttggtggcttgaacaccactaaacatttattatctcatacactttctgagggttagggaggagattagctgggttattgtggctcagcatctcctgagattgcagtcaacacgtgggccaggacagccgtcttccaaaggcttgcttggagctagaggatccgcttccaagagggcacccatatgtctgttggcaggaggcctcagttcctccccacatggatctccgtatagggctgcttgagtgtcctcacaacatggttgttggcttccccgctgtgagttatcctcgggagagaggaaggaggaagttgcaatgcctgtgtgatctggtctcagaagtcacacatcggcacttctgccatacatttttaaaccaatttattgaggtataattgacatataaaaggctgtacatatttaatgtatacaacttgatgaatttggagataagtatctataagcctgtgaaatcatcaccacaatcagtgccttaaacggatccatcacctccaaaagttttctcccaccctgtcaaccctctttttttttgttgtcattgataagatctacccccttagcaaatttgtaaatgtacaatacagaattattaactacagacgctgcgctgtgcagtaggtctctgggtaattcatcttgcgtaattgaaactttgtgccctctcaccaatacctccctgtttccccttcccccatcccctaacaaccaccattcattctatttgaaagtttaaaattcttcacgtaagtgggaccatgtagcacttgtctttctgtgcctggcttgtctcacttagcataatgtcctgtaggctcatccatgttgtcacaaatggcaagatttccctcctttttaagtcttttctattcctctatatgcacgcatcacattttctttattcactcatctgtcaatgtctgcttaggtggcttccatgccttggcattcacaatataaatagttcacacaagtgaactattcacaatagttcatgtcgtagtaaacatgtgagttctgccatattttgcttgttcaaaaggagtcagagtccggcctacttctaacaagctccacttgtttgaaggaaggagtttcaaaggaattgttggaacttctttgtttgtttgttttttagaaatgagttctctgtctgttgcccaggctggcatgcagtgacatagtcatggctcagtgcatcgttgaattcctggattcaagtgatcctcctgcctcagctttccaagtagctgggactacaggtgcatgccaccatacttggataatttttttaaaaacttttctttcggtaccagatcttgctatgttgcccaggctggtctcaaactcctggcctcaagtgaccctcctgcctaggcaacccaagttgctgggactccaggcatgagccactgtgcctggctgattttgataactttatacacctcgtaatcaaaacagtaagttccagaaagctcctttgtactctttccaatgaaaccctgccccacaaccatccctccctgatgtgtgaccctagtgagtgttgcctcttcttgagcttcatgtaaactggaccctacttgtgcgttctttggcggttgacccttcattcagggtcgtgcccctgggacccattctcactgctgtgtctcggtagtttttctaaattactggctagtgttcccttctgtgaatacagcaccactggttgatccactcaccagtaggtgggcagtgtttggccaacatgaatgagggcttgtgttgtttctcttgggtgagagagttgtttctctgggagcggtggactggctgggtcgcagggcaggtgtgtgagagtctccttcctcacacagtttcactaggactcagaagccatggtcttttctctcctgtgaagggcttgagactttctggaattgagttcatgtagctgtcctcagcttttgatgagggacgtgtgtgtgttccaataacacttcgtttacaaaaccaggaggcagtggagagttggcccttggtttctagtttgcaaactcctggtctagaaggtaagacaaatattaatttttaaaacccgcgtgtctgtaattgctcattttgaaagcactgtgaagggaacactaagggagaggggatgggaagactttttacatgtgtgtggggagtctgatgaatttgtaaaacctatgattttataacttttctggcctctttttagttgctactgtgagcagtagtccatatgtgaaccagagtggacctccacaagctgccttttgaagttgttacagttagcagagacgaactggcccagggttcaagaagcctttctggctggaggaatgtggatcagtccctccaggcctggaagagggcagtggggggcggggggtgcactcaatcttaccattttcacagatgagagtaatttcatttcagaggggtatgccaaggcagcgatgaaaacttcaggaatagctttgaatatctaaaggaagtgggtaagaaagtgggaggttgggagttccggagggagagttcctgtaaagcagagattcccagggctggctcaacatccacattgcctggagggctttccctgaaacacaggcttgcaggcatgccagcccttgctatttcccacctctgcccaggcctggccctcatcaaggcgggagagcccagctcccagggctcacgctctggaaccaagaatgtggctctccaggcacagagacaatagaggcctggaacagatcctcaaaatgtgtgtgctgaagacatactcagggtccgatacttgagggccatctcacattatcatctccaaatctaggcaggttctgttattgggcattaacccctcgagaaatcagtgcctgtaactatgatttggatcatctgtgctttggatttctcttttaatcttctctgtctcctcccattcttaaccacaagtgatttatcagcctctctaattcaacttcattactctttgccatccaagtccctgcaagcacaaataaaacccaaaggaagcagcagacctttttatccatctgtgaagacactcaagaaacactaaattcatctgactttctagagtaattgctttccccacatggcactagaatcctggcatacagggagcagcttcagcagagacacggcagtagagaaatgactgactgaaggatggttcagggctgttgtcctccctgaaggtggttccaacaggacacaaaagttgcagcagagcctgtgagaacagctgtgtcctttgtcgtcactagctggtctgtctgttcattgggcaatttcagtttttatgactgaaagctgggcatgcaaaggacaaccaaacagcctctagcctgctgatgctcacagtctggaaagtcctatggtaaatcaatatttcttttttgcttttcagagacagtctcactctgttacccaggcaagagtgcagtggcatgatcatcgctcactgcagcctccaactcctgggctcaagcaatcctcccgcttcagcctcctgagtagctgggactaaaggtgcccaccaccatgcctggctggtttttcaattttttgtagagacagggtcttgctatgttgcccaggctggtctctaactccttgcctcgggcagtcctcctgccttggcctccctaagtgttgggattgcaggcacggggcaccacatccaggcttttttcatttgtttttagagacagggtctccctctgtcacccaggctggagtgcagtggtgtgatcatggctcactgcaaccttgaactcccagggtcaagcaattctctcacctcagcctcctgagtagttgggactgcaggcatgcatcaccatacctggctaatttttaattttttttttatttttattttttgtagagactgggtcttgctatgttgttcagagtggtcttgaattcctcccacctcggcctcccacagcactgggattataggtgtgagccactgtgctcagcctggtaaattggtatgtctaaggagagtgtttggtgccattgttcccaggtgttcacactgtttaaaatgtttctaatacatctcagcattgataggttggttgcttggttggtttcttgcctcttttgggctccatcgccttccccactgtctcctttttccacctcatctggcctttgtggagtgctgtgttggcaaaagagctttccacctgtgcctccccaagggtgtgtgtctgtaagagctgcccagggcctgggaaggacagtggagacaccaggtactcgttcgggagacttgtgctcaaaatgacatgggtgtgccggctcttagctgcctgacccgcattctgaggcctggtggcgccgtgcttcttcagcgtgtgaacacctgcctggcagcgtctgatacacctcaccaggctgaagggcagaccagctacctgtgattcctgataaaaattctgtgctttacagaatcccttctatttatgcccacaaccaatggaggagtgctttctagatgataacctcaaactgtcagtgttgagcttgagttgatgtttgagttactgagcgttccacgttccatgctcatggaaacctggctctgtttggaagcagcaatgctgggccctaccccagttgtcccatgagataattgtgctctgtgcacacagttccggtcccagaccctggctttgtagcatacattttcaaggaggactcttgggccaccacagatactgccctatccattgctatttttgatggtatgcttgtgtataatacgtttgtatatggcataagttagcagaatatgtaaatgaaaggaggaaacacctcaatgtcattatccacgggaagtgtgttcactctgtctcttcattgtaaaaatgaggcagtgccgttgcccagagctctcttggcaccttttatacccctcaccggctggcttggtcggctgcaggggtgcccttcccatctcattggctgggtgtgttgcatggtgttatgctttgggaagaaggttgtatggtgctggtgtcacagaggcctgtgtccaggtctgccccatcacagactgaccctttggtcttaggtgctcagcaggtgcctggctcataggaagcccacgcaactccatctcccacaccagggcctttatctgctgctagctcaccgccatcctatgcgatgtggcctgtgatcagcttgtacaggagaggcagctttctggggtgtagttgcctgcctgacgtcacatagctggcacgtgatggatcccgattggatgtgtctgcccggggaaacctcaagtcacaggcagctagcacagctcaagcgtccctaatcagaaggtctgaaatcttaaatgcttcaaagttcaaaactttttgagcaccaacatgatgccataaaggaaaaattccacagctgatctcgtgggatgtgtcgcagtgagaatgcaggtagagactgggcaagctgctgctgtttgctgttgctggcgcctcacagctgaggcgggtgttctggtgccattgccgtgctgcttacttaccctggacacattcctctctcactgtattgatggtatatcgtgcttttcactgttgagtgcttatatatcagtataggaaaattattgcttgttggcagcatataaattcagagtccggaatgacggagatgccagacaactacagattgtgcacatgggtggcagagagactgacacttttgctttatgatggttcggtggatacaaactttgtttcgtgcacaaaattattaagcatattgtataaaattaccttcaggctatctatataaagtgtatatgaagcaaaatgagtgtcaggtttagacttgagtcccacccccgagatgtctcattatgtatgtgtaaatattccaaaatccaaaaacgtctgaaatccaaaacacttctggtcccaagcatttcggaagagagatgtttaacccgtactttagaaagcactcaggcgctggagttcatcgcgggcagcatttcagcagcacctgtgttgtgtgtctgcaaatcagaatgcatccctatcccatcattgacaccaaaagtagttatgatgcctgtggcagtggctcatgcctgtactcccagcactttgggaggccaaggcaaaaggatcacttgagcccaggagtttgaggccagcatgggcaacatggtgaaccccatctctacaaaataatttaaaaactagccaggccatagtggcatacacctgtggtcccagctagtcaggagactaaggcaggagggtcacttgagcctgggaggtcgagactacagtgacccgtgatcacgctgctgcactccagcctgggcaaaacagcaagaccctatctctgtctccaaaaaaaaaaaaaaaaaaaaaaaaaaaaaaaaagtaggtgaggaggaccctgtggtgtgtgttccttaagtcatctgcaagattcagaaattttcccatcctccttgctaaagataattgttaaccctattcagaaaacagtggtggattattgattacagagcagttcaaaactgtttagttgtgttgggaacattcacacacaaggtcctttcacggagaacttaaccatggtgtcttgaaaaaatgcagcttctcaccttttaaaattccgcacaaaaaaagtgaaagtgattgaaagcaacaggtgcatttacattgtgttcaagtgagggcataacatgatgcatgtaataaatatttgcttgcaaggccctgaaggaaatagcccagatccctgccctctgtagaggtgctttcagcccagggaggagcgtggaggcaggtgagcaatgggatgatttgagagagtccccttgctggggcgtgacctggaggtggggtgatgtcagggcaggactgggggagctgagggctgtgtggaggcaggggcagtgcaaggagaccttgcattcagacatggggctggctgtctcgtcgtggaagcaaaaatagagtaatgccagcaggatctctagagtgtttgtttttttcctaacagtggtttcggtcctgtcatagcatgctgggtgactgagtacactaatggtggcccttcctgcaggtttgtccccttcatataagttctgtttggctttgaggtgctgttttagagcttcatgctctgtctccttcagtggcggccagcccagggagaatggcagggccgtgggctccatgtagcagatctctgaagccactgctgcttggagcctgccggccctctcccctctgggaactgtgcaagcagctgtctccttgggaacgtggcattagcatgttttgcatgagaatgaacaccaaccaaggctgaatatcaattggatcctagagtgcagctgcctttgaaatgttcctttgtgtggccgaacttcctgctgcagttgattcctggagcttgtgcgaagacacaaagtcttaagtcatcttagtgccttgcttactctatctctggatcttgctgtcaccatttattttatccttagaagtatggcaaagagaaatgcatacatatatgcagagacacatgtctacacacaggcacaacagagacacacgtacctacacatgcacacaacatatacaacccgggcacacactcacaacatgcatctccacacagacacaacacaggcacacatacccacacacgcatacaacgcacaacacaggcacacacatacaacacacatggacacagagacatgcatctacacacatacacaacccaggcgtacacatacaacatacatctacacacagacacatgtgtacattcagacacaacccagactcctacatctacacatgcaaacaaccagacatacacatacaacgtacatctatgcagagatatacatctacacacatacacagcgcaggcacacacacagtgtacatatagacagacagacatttatacacatacaacatgcatctacacacacaaaacatagacacagacaacatctacacatagatctgtacacatacacaccagatgcatacaacatatagacatgcacgtaacacatagacatgcatctgtgcgcaagcacaacatggaccactcacacacacaacctgcagagctgcctcttggaaccagttagaaacaaaagttggaatatgaccccagcaagtccccaatccccatttttggtccttttcttcgtttgtgttgttgaccctgatggcccagattcttatcaactgcgacaataaaaaccaattagtgattttatagtttgactttgcaaggtgggggtggggggcaaacttggtccagacattgctgtgctgctgcaggtctgaatgaagtgcagtgttgggctggagcgcgccccgtgctgcacttctggcgtgggaagtgacgatgcagcacacaccactcccctgagaacagagcacccagctcctgtagtttggccctctaggaagatgggaaggagcctgtgggcaccttctgattaggagagaagccaggagccagcctgccgtccactttctcagtgggtctcttgctccatgtcattgttcacttctcacagggcctttgctccctgcaggtgagttctctttcgtttatgggtggatctcggagcacttctgcagaaggcactttgcaaatagagttcctttttaatcagtgggtgaccaaaggcacttggattttagcaataaattataggtcatttaattatctgtttctgtgatgtggtgatgtgatatggtttggctgtgtccccacccaaatctcaacttgaattgtatttctgagaattcccacgtgttgtgggagggacccagggggaagtaattgaatcatggggcctggtctttcccctgctattcttgtgatagcaaataagtctcacaagacctgatgggtttatcaggggtttccgcttttgcttcctccgttttctcttgccactgccatgtaagaagtgcctttcacctcccgccatgattctgaggcctccccagccatgtggaactctaagtccaattaaacgtcactttgttcccagtttcaggtatgtctttatcagcagcgtgaaaacgaactaatacctggcgcttttaaataacaggtaccaggtgctttcaagtgggtctatgggtgatagatttcaggagttttcaaagggaaaaaaagtgcaagtgtacctcaactctttggcatgaaatgaattattgaacgctgaaatattgaggctgggcgcagtgactcacacctgtaatcccagcacttgggaggccaaggcaggtggatcccttgagtccaggagtttgagaccagcctgggcaacatggtgaaaccctatctctacaaaaatacaaaaattagctgggtgtggtggtgcacacctgtggtcccagctgctagggaggttgaggtgggaggatcatctgccaaggaagtggaggctgcagtgagcccagattgtgcactccagcctggacaacagagtaagaccctgtctcaaaaaaaaaaaaagaaaagaaagaaagaaagaaagaaagaaatatggaaatgaaatggaatattgaattctgaaccattgaatattgaaatgcaatgtgggggagacatctgacctgtgagagcgcttctcagaatgcaaatcagtttggcagtattttaatgtcattctgtgttttataaccagacaaatgtattgttctctaacccatgcatagctgtgttcaagttttgttttgttttgttttgtttttttgagacggagtcttgctttgtcacccaggctggagtgcagtggtatgatctcagctcactgcaacctccacctcccaggttcaagcaattctcgtgcctcagccttccgagtagctgggattacaggtacacgccaccatgcccggctaatttttgcatttttagtagagatggggcttcaccatgttggccaggctggtctcgaactcctgacctcaagtgatccacccgcctcggcctcccaaagtgctgggattacagatgtgagccactgtgcccagccattcaagttattttgataacacttcaagctaggagtttctgttagtgtctgtctgatgcacatgagaaatctgacttctttgagtggggttgctgttgtctgaagctgaggttgagctatttggttacagcttgttttctaagcctgtgctgtgtcttcagcctcctctaagctgagagcagaggaggctgccctcccaacactttgggaccagacctcccaacactttgggaggccgaggcaggtggatcgcttgaggacaggagttcaagaccagcctgaccaacatggtgaaaccccatctctactaaaaatacgaaaattagccgggcgtggtggcgcatgcctgtagatctagctactccgcaggcaggcaagaggatcacttgaacccaggagtttgagaccagcctgggcagcacagtgagaccccatctctactaaaattttaaaagttagccaggcatggtggtgggcacctatagtctcagctacttgggaagctgaggtggtaggattgcttgagtccaggagttcgaggctgcagcatgctatgatcacactgtactccagcctgggtgacaaagcgagaccccaactctttaaaagagcctttgttggtcttaattttcataatacaatactgattttcaaggttttattaaagaattgatttgcagctcatcttagaaaggtttacccctttgtatatggcaatttcccataagccacataaaaatactgtgacttgaagtaaatatttctgaatctagctgtatgtgagcatttccacaaacattaatgttgtttctaaagtttttgttcatttattcctgcaaaaacaaatgcaatttgtgtgtgtatgtgtgtctgtgtgtgatgtgtgcgcctgtgtcttgaatgcttcatgttcccttgtgggacatgccagtcgacagcctcatgttgtctgaggtgcgtcacgactccccaccttgcatgaggagttgcggtggcgacaggtgtgggaaagtgcatatggatttaactcctgaaagtggcttaaggggattgtgaagatccaggtccagtcccttgtggtgggaaggtattattggaatcgttgattaatttgtacttgttcttcctctagacaagcagatgcccagtgtcgggaaggcagcccaggatcacagcagcacccaccgagtcagaaggcaccgaacccacccacattctctgaactatctcactgccggggagccccagagctgccccgggagggccggggccgagcgggaaccctacctcgagattatagatactcggaggagagcaccccagcagacttgggaccccgagcccagagccctggctcacccctgcatgctcgaggacaagactcgtggccagtgagctcagccctgctctccaagaggccagccccacagaggccaccgccacccaagcgcgagcccaggagatacagggccacagacggcgcacctgctgacgcccccgtgggcgtcctcggcaggcccttcccaacgccatcccctgcgtccctggatgtgtatgtggcccgcctgtccctctcccacagcccctctgtgttcagcagtgcccagccccaggacaccccgaaggccactgtctgtgagcgtggaagccagcatgtgagcggggacgcatcacgtcctctgccagaagcactgctccctcccaagcagcagcacctgcgcctgcagacggccaccatggagacctcgcgctccccctcgccccagttcgccccccagaaactgacggacaaacctcccctgctcatccaggatgaggattcaaccaggtactgtcctgcgacggtgttccctccccatgaggctcctaatgtgggacgcgggttctcagtgggtctttctggggagtcacctgggcaccttgctttagctcaaggcgttggacttaaagtcagtactggggaataactgtgtggacagaaagtgaagcttcagtggtggttggatttttatctcactggggggctgctgtttcctgcagggaacaggggtagatgtgaataggtg

SEQ ID NO: 195 - DNA, 35285 bp, mus musculus
tcgctgccttcagtccctagtgtctgggtccccgccctccagccgcctttgagtcgtgcctgggtcctcgcccttgcctcagaaccgcgaagaaaggaagctcgcgtgtttgctagaaaacctagttgggagtgcgaggcagagaacgttcagcacctttgttcctcccgaaccctcgggacagaggcagggttctgagggcagggattccccctcgtcttggccccaccgcccgggctgggcactaaactcgggccgcggcggggcgagcgaggcgggctccggagggagctgacgcctgatgatggcgcaggtagacacacctgccccttctcgggcggaaataaagtcttgttttgtgttcgttaaactttcgccgctaggcctcttatggcttccccggaggccactggtctgttttcagacgttcacgttccctctgccccgcaggtaacctataaccattttgtcttttagtccaacatgtttaccgtggctgatgtgttgagtcaagatgaactgcgcaaaaagctataccagacgtttaaggatcggggtatactggatacactcaaggtatcggatttaggcgtatctgtgtcagcttttacaagtgtaacctgtaacaggtagttcaaattcaatcaaggtttaggttttaataatcgtatgatacatagattgtattggtgaattacatttttatattcccgaataactctgtatcctgaaacattacagtctcttgaaaatgtttgagaaaatgttgagtttgagtcgtcttaaaggagcatattcaaataattaattgaactgacaataagataggagaaggaaatatttgtataatgaacacagtaagattaggcttgttttataaatatggcttataggttcctaaattaataagtgggtttgtaatacatttggatgaaggacattgacaccatatagaaaatactagtgtactgcttaataatagtttgggaaatgaaaaattttatctttaaactatattgaaatgtatgaatgtttagtttgggcagaaaatacctattagtatgctttatatttggattaacagccaggagtaggattagctcaacgtgttttcattgaaatatgcatttcaaaagcatattttacgtttaaaatatgtagctatatcctgtgtatgtatccttttttaatttaaattatatggtgagcatttccctgtttccttaaaagttttttgaaatcttcattttcagtggcaacaggcttatctttggatatttttgtaatgtatatagcagtcccctgttgttgaatattttggttatattctccaacagtccacagaggtgtgatgaagtggcagaattttttcctatacttaatatcccaatcgtaagctgctgaaatgggcttctagggaagtgaagttatgagtctgcaagtggatctggctaaccacccgtttcatttggaagctggggaaagaaagctttttctagaacccactggactgcttgtctcacggggtaagacaaagtgtgcaggggaaggtttctaacttctggccatggatctagaaccattatggaaatagaaggaaggtttccaatgaatgtagctcatctgtgtatatctctaatgaaacagtcctgctgaaatttctttcccttgtgtttcttttttatttttgtttttattttatgctagacacaacttcgaaaccagctaattcatgagttgatgcaccctgtattgagtggagaactgcagcctcggtccatttcagtagaagggagctccctcttaataggcgcctctaactctttagtggcagatcacttacaaagatgtggctatgaatattcactttctgttttctttccagaaagtggtttggcaaaagaaaaggtaaagtctttccttttctgtttctgaagtttttattaacaggttcttcctctgctgacagtaaagtgctgtatgatagctaagtgctcctcgactaggtccatttctgtttcctctttgaattcacattgtacctgcacataatatatttgttatataacaagtgggtactaaatttgaaattaatttcttggcgtctcatttagtctcacataaaacagtgatgtatagaatctctaaatgtttcagacctataattgatctatctatcctctatcttgtctaataagactctgccaatctgctgaatgtctgctgtaagcttggcactgtgataggcacactgcagatgttttgtgtgttacggatgaggaaccagactctggagaggtgaatcaatttgcccaacatcaagtaacttttaagtgacaatgcagggtggtaaatctagatctctaacatgagctctttttttcctgcactagtttcttcagatgtttctctttgtaattagataagtgagaaatacgtaatttaaaaaatctgtaaagttctcaaatattaaaaacacttgttttttttttttactacttttctaattattttaactatatttcttcaccattactgttgaacattagtactactttattattttaaaggcagatacagcagactttccctgtggatatgtgcgtgtttttttttttttaatagactttattttttcagagcagttttgggttcacagcaaagttaagtgggaagtacagagaattcccatatacctgctgcccctacacactcatagcctcccccactgtcaacatcttgcatcaaggtggtacatttgctacaatctataagcctaccctgacatgtcattatcacccagaggccatagtttacagtgaaggttgcagtgagccgagatcatgccactgcactccagcctgggtgacagagcgagactgtctcaaaaataaaataaatttcactcttggtggtgttcatatgtttttactttctttgtgttttctgtaattatccaaaagtttcatattccaaagttttagtgacacaagcttagtacagtatttgaatgaaaacttaaataatttgcatttcttcataagcaaccaaattttatttgtcagcattaggaatttatttattaatttatgtttttgagacagagtcttgctctgttacccagtctggagtgcaatggcgcagtcttggctcactgcaacctctgcctcctgtgttcaagcaattctcctgcctcagcctcccaagtagctgggattacaggtgcccaccactacacctggctaacttttttatttttagtagagaggaggtttcaccatgttggccaggctggtctcgaatcctgaccccaggtgatctgcccacctcaatctcccaaagagctgggataacaagcatgagccctcgtgtctggcctggaattcatttttgatacatcattctctaactttctaatcactttatacttttacttattgtgtaatagtcaataatacaattatatagcaggaattaatcctattcatacaacttaacggtttctactaatgtaaaatgcccatgcagaatatttactttaaaggaaaaccaattgaaaacaaatatcagtgttctcagagcagacatagtgaatggtatatactgtagtagaaatatattttaatagctacccaaaatgtctgttaaacaatattttaagtacactttaattacggttttaaggacagtaaaaatctatttacatttttaaacaatgaatactttttaaaaaattgtaattgaatgacccaggaactcagtcatgtagtcattggttcatcagatatttcagtgtcatctgtaaggcattaaacatttaggcatatcatctttgatgtgaagtacttagaagttaattagatgataaagatattttatccttttgaccttgatatgtttatagtaatttatttaacagtgtaagaaagagcttgaaatttgctttattagcatagttataatcttatttaatctgaaggatgtttcttaatttcatattcagaaacatatcctaatttatcatttaaacactgatataaaaatatgtctacttagtaacctattttttcttaaggtatttactatgcaggatctattacaactcattaaaatcaaccctacttccagtctctacaaatcactggtaagatggcttagtttctgtaatctactttggtttgttaattataactgaatagctgaataaaagtgaaatattttcttttaacaggtttcaggatctgataaagaaaatcaaaaaggtaggagccgtcatctttgtagagaacagcaacagttttctatgtactttttcctctaaaagaatgaagcaaatttttagggagaagagtaaaatttaatttgatttaaattatttgatttctgcaggtcatttcccctatatttccatttttgtaataacttttagatattcaattaaaaaaactgtagacagtatcaaaggccctacagacaggctgaaagatactgtttgtaaaaatacccactgttgggaatatttctgcaaaaaaaaaaaaaaaaaactaataacttttaggccaagtgtctttgtatactaggtatccctctcaagtataattggtagggtattagatgtattaatatttccttaaagaatgagagttgtgttcagtaatgtgttatatatcttttgttcttaaatgtttatacaggccgggcgtggtggctcatgcctgtaatcccagcactttgggaggctgaggcgggtggatcacctgaggtcgggagttcgagatcagcctgaccaacctggagaaaccccgtttctactaaaaatacaaaaaaattagctaggcgtagtggcgcatgcttgtaatcacagctactcaggaggctgaggcaggagaatcgcttgaacccggaaggcagaggttgcggtgagctgagatcacgccattgcactcctgcctgggcaacaagagcaaaactccgtctcaaaaaaaaaaaaaatgtttatatagacctaataaattgccttaattttggccttgataatagccattcatagagtccataactactgtgggtttcaggccattggttagacttgatgatgggctttgtagcatgaacataagctggcaacttggctttgatgcatagttattctttaggtcttttaaaataatctgttagtaatagtccttttgtgttggtacacccttggattttgtctgttgcctgcactatcatccccacaaggacattcatttattcatccattcattcgccaattcatttagaacttaatcatttgaatacttattttctgccagccattaagtctgtgacttaatcgccaagtctcttggtagtaatgttagcagaatataaataaattggagcacaagatattctggactgcccgcaaactagaccatctctactgaagttcagtatggtaaatgatcctatattctgtactctaagtgtcgtccagtgtgactctctgtgattatggaaatgtctgtgtctatgctgtttaatgtggtagctgctatcctcatgtggcttttgagccttgaaatgtggctagtgtgactggataactgaatttttaatttacatttaattagctacacttgcatagtgactaccatattagcataattctgaggtatatagctagtatcttttgcttaactattacttcaaaaggaaatttgtggcttgaagggatattaagaaataatctatgggccaggcacggtggctcatgcttgtaatcccagcactttgggagggcaaacctggctgatcacttgaggtcaggggttcaagaccagcctggccaacatggtgaaaccccatctctactaaaaatacaaaaattagccaggcgtggtggtgagtgcctgtaatcccagctacttgggaggctgaggcaggagaatcgcttgaaccagagaggcgaaggttgcggtgagccaagatagcgccactgcactccagcctgggtgacagagctggactccatctcaaaaaaaaaaaaaaaatctatgtagttactatagatacattatccttaaaagtagtttttccatggccgggcgcagtggctcacgcctgtaatcccagcactttgggaggctgaggcgggcggatcacgaggtcgggagagcaagaccatcctggccaacatggtgaaaccccgtctctactaaaatacaaaaaaaagttagccaggcctggtggcgtgcacctgtagtcccagctatttgggaggctgaggcaggggaatcgcttgaacccaggaggcagaggttacagtgagccaagatcacgccactgcgctccagcctagcgacagagcaagactccgtctcaaaaaaaaaaaaatagtttttacacagtctctttaaatgcatctggttcagaaagacatctggccgacagcccttaccagcttcacctagcatcccagtaaaatttctggaagccagaaaaactatgagtagcagataggtcaggcatcctagtgccaaaatttggatagaactcttagctaacaaaatagctcctggtaagataaaatttttttaaaaattggtgtcttctaattaagtaacagaaaacatgtaggaagatattgtgtacttaaccgttgtctgtcccctgactcagacctatggtcttatcctaccatatctatgctcagggggtgctaagctgttgaatggccttggtacttttcctcctagattctagtcacccattcttcccactgctaattttcctttcagagataatgatatctgttatgcgtgtctgtgtgaagagaccaccaaacaggctttgtgtgaggaacaaggctgtttattcacttgggtgcaagtgggttgagtccgaaaagagagtcagtgaagggagataggagaggggcagctttatagggcttgagtaggcagtggaaagttacagttaaaggtggttatttattgttagcaggggagggggtcccaaggtgcatggtggagagatcttgggactcattgtccagaagaagaatgtcacaaggtcgattgatcagttggggcagggcagaacaagtcataatggtggaatgtcgtaaggttggtcagtcagttaaggcaggagctgtttcacttctgtggttttttagctggctcctgcaggccatctggacgtatatatgcaggttacgggggttacaatggctgagcttcggctcagaggcctgacaatatccagaaaatgatgtgcacaaaatttggatgagggaagaaaatttggacatcggccctttgctttttggaagtaaaaattcttatctgcaattggcaaaagaataagacatatacatcaatggggacagaattaggaagtccagaaatacatccacacaaatatagtcaattgattttttttttaacaaaggtgcaaaggcaattcaatagaggaaagatagtcttttcaacaagtggtgctgtaacagttggatattcatatgcgcaaaaatgaacctagacacagatcttatttattataccttacacaaaaactaactcaaaatgaaccatagacctaaatgtaaaatgcaaaactataaaacttccagatgagaacagtagaaagtctgtgatcttgggtttcgtgatgagatgtaacaccaagagcaagatacatgaaagaaaaaagtagatcagttagactttattaaaattaaaaacatctctgtgaaagacactgttctttttgttttgtttttgagacggagtttcactctgccacccaggctggagtgcagtggcgtgacctcggctcactgcagcctctgcctcctgggttcaagtgattctcctgtctcagcctcctgagtagctggaactacaggcgcctgccaccacgcctggctaatttttttgtgttttcaatagagatggggttcaccatgttgatcaggctggtctcgatcccctgacctcaggtgatcgcctgcctcagcctcccagagtgctgggatgacaagcgtgagccactgtaccctgccaaaagacgctgttaagagaatgaaagacccagtgtcgaaacccatagagctttacgtcatcaagagtgaaccttaatgtttgcaaatttaggtcaggtgatcccaggatggtatgcagactgtgacaaaatctaatccccttcctgaagggagtgggggtgggggaaaaggtgctgagctaactactgtttttagttccaagaaactaaacatttcttaagtaatttatgcttgtggtttaaaacagtttcaaactattcagaaggatataaagtgaaagcaaagtagcagtttctgcccatgttctctaatctcacgctccactgataactagaattaacagtttcactccactgataactagaattaacagtttcttgtttatcttctagaattgtttgaggttaaaactatgtatttgtaattaaaacacaatcaattgggattatatcgtagatactgtatgcaatttgctttttttaatccaccaatgtatctttctgtagcagtatagactaattatttttaaataatgtatttaaccccctattgatggagatctggttgttttattgtttgctttttgccattacaggtaacctatgtgcagtgtgcaccctttgtgcccttgtgaaagtatacctgtgtaaattcatagaagtggaatgactagattaaagggcacatgcatttcgaatatatataagcactgacaaatttctcttccaagtgaatgagtatagctatatatccactcccttgccaacacttagcattatacaagttttaatcttagcagtgttatagggaaaataatggtttctctgttgtattaatttgcatttatgattttgttcatgtttattcagcatctaaaaattgtgttcatctttgacaatgtagttttttctgcaaactacccatgtttttccccatttttctgattttttttttttaaactgatttgtaagagttctttgatgttatgaaaatgtcatcactttagtcttggttatgcctccatattattgcaactatttttcccagtgtgttatttttttattttatgccatatgtaagttttcagtttttatgtagttagattgataaatatttctccttattccttccaggttctgtatcatgcttgggaaggccttttctcagatttattaaaagatatgactgggcacagtggctcatgcttgtgatcccagcactttgggaggcccaggcaggaggattgcttgaggccatgagtttgagactagcctgggcaacatagcaagaccctgtttatacaaaaagtaaaattagctgggcgtggtgggtggtggtgtgcacctctagtcccagctacttgggagactgatgtaggaggattgcttgagcccaggaggtcgaggccgcagtgagccatgattacaccactgcactccagcctgggtgacagagcaagacttttgtctctaaaaaaaaggaaagatatataatgtaaaaaatgataatgtcctaaaactaagattgtaaaaacagtgactgagcagtggttgaaagttctgaaacaaaactgtatgcatatgttttttaggttttcttatgcattttttaaaagaattggcagaatatcatcaagctaaagagagttgtaatatggaaactcagacaagttcgacatttaacagagattctctgggtaattatagccttctttcttaatttcagttctgctgttttcattttgaatgaaggaaattatctgatttaccatattgtgtgattgctccttgaactggagggatgcagccggcaggcaacaagggaattcatttctggaatcatcttgggggaccaggaagtgctctccagtgtcattccctagcctcatgaatgccagggctacactggccaaatcatgcagggattcaaaggcccatattcttccttgtttgttgagtttgacttctcttaactgggaggttcttcctcgtgtcttgtctaactttacagccacccagttagaagattataaactacttgctttgcaaagtactagagaagtcagtgacttatcacttcattttatagttgaggaaaccgaggtcctcagaggaagagcaacttggaaacactcagtctgcatcagaactaatagtggagtccaagttctcccatccatgatctggagctttttgtactatccagctggtctgcagtaccatcctgtctgtcagtttcgtgctcagtagagatgggaaatagctgtttaaaacgatatgcttaatggatttcttggcccttccttactcttaaatggtaacttgcaagaagataagttcataattcataaaatgtattatatgactatgcctttaagtgtatttttaattcaattagaaacatattacttgctaattatcaagcagtgctgttcagtggtgtgagccacatacataattttaaattttctagtagccacgttgaaaaaagtaaaaagaaacgggtgaaatttgttttaataatatatttaacccaatacatgcaaaatattatttcagcatatattcaatataaaaaatactaagatatttcacatttattttttgcactgtctttgaaatctcatgtgttttttacatttaaagcacatctcagttgagtctggtcacatttgaagtgtcaatggccccatgtggctggagagtcctgtgttggacagcatctggaaaatacagaaaagtagatggaaaaacatgtctaaagtcatccctaccagagataaacactatcgatgttttaatctacttctgccagcctttttcccctctgtgcatactttttgggtgggcgttatacacggttgagattgtactctgggttcagatttgcactttgctatgtggttgattctgatccatagttggtttgagggccatggactaagggaagagtcagtagacctcactttaatcctggttatgctgtcatgtagtcacttattaagctatatcagcatttgttctttatgtgtaaaggggaggggttgatatacgtgatctttgattcttttaaagttattgttttgaatatgtaagtcagctttaaccagagtccaataaagagctctctgccttagcacttagagagtaggaagagactccagtattttctgacttaaactgtactcttggctttctttttcctctaacatttcatgatgaacattttcaaacatacagaaaagttgaaacaattttagcgaacacttgtatacccaccacctagatgtcactattacacttgtgttatacttgcttcatcatttttatctgtccatccattcatccaccttcctttttttgtatttcaaagtaagttgcagataatccctacactttcccctaagtatcctctttacttttgaaccagaggtctggcgtcttacgcacctgacgatgtttctatgtcctaatttgatgtgttattttttaatagctgagaagcttcagcttattgatgatcagtttgcagatgcttaccctcagcgtatcaagttcgaatctttagaaataaagctaaatgagtataagagagaaatagaagagcaacttcgggcagaaatgtgtcaaaaggtaagctttatcttgttactgtaaacaagagtgatgtttttgtttgtcttctaaagtcttaaccataggtatatgggaaaatatctagaacttttaataacgaatgggatactgtactgttgtgcaaatttttttttatttctggtgacatttgtttatgccttttgagtgaatcctacaaatagagtgaatgagataaaactaacatgaaataaatatatttggacagagcattaatgttaaacctagatgtagagagagaacttgttcctgtttttatagtataatagttggtatttttaattttttgtgatcaatttgcagttgaagttttttaaagataccgagatagcaaaaattaaaatggaagcaaaaaaaaagtatgaaaaggagttaaccatgttccagaatgattttgaaaaagcttgtcaagcaaaatctgaagctctcgttcttcgggaaaagagtacccttgaaagaattcacaagcaccaagaggtggtatttacaaatattttatgggtggctatttcctgcagctattagtaggttggctcgagatccagcaacaggatggtacagttgatggaacaaggccccagaagagcaatagggactggggccaagagtgcaaatagaaggatggtccttgaaaaggatacacaaatttgcttcctctgagactgatggaaaggcgagaactgtggaggtgaacaatcaagttgggattatgagaaacacaccctaaataagctccatctcctcaggcagattagagggttagatcttgggttttaggagcagattggaggtgcagagtagttcctgtgggtaagggaagaacagccctttaaagcagagaggactgatcacctgtattgagggctcagctgtggttgggggagcctggaattgagagaggtcaaaccaggtgcttgtaagtgagttttctgttctagttctggggaggatttgtaagtatctctctgtccctttcagtgagggtggaaagatggagatgcttgggaagtagagcttttcagagccttatttgactagagaaaggcagcctacttaatcgaagattctggggctctcttgggtagtgaagggaagcagaggagagggcaggtggctgctaacctagggggaaaggaagggttgagtggcagtctcagtgatcaaggactcgatctggatagactggtaggtggaagaatgaggatggtccaagattacagaattgcaggatgaggtttcaggtggagactagaaaccaaatgcagtatgctgccattggagagagccatggaaatgagcaagggtgaaggtccctggggtaaaggagtcaccacaagggtcatccatgtgaccatttgatcttgtcaccccagaaagtaactggacaggagacagagagggtgaggagtgagagggagtccatgttggcaagcaggattggatctactcctttaaatcatattcctttcccaagggcgtgtcttagaccaaactagatttacagcactatttccaacatacatccagaactactgctgtcagatgttgaaagtaggaatgcttccccctagtgtccactctcgcctggggcttctcaataagacctagttgtttaatgctaagggcaccccctctaaaattttgtatagcatttctgggaattgggtttgcttcagctataaaaatgaatgtcagaagcacatatctttgagatgattggattgtgtttagactaataacttcaaccttcaagataggtgactgactagatccctgtttatttatctgatcatctgaaggctttgaagaagattgtcatcctcataagaagcaccatgtctttattccctcacctggactgtccatccccttctctccctgataaaaaccatagtgtctttcaagacccagcttggatgtcacctgggtgatgccgtccctgactcccactgagcgacccatttaggcctcattcctgcatcagtctttatgtacttcagttacaaaatcatcacatcttagtgtgattgtttctcactccctgactaaattgtgaggtctttagagatgaggactatatctgtctacctttttatatccagttcccagtatgctgcttgacatgtcataggtagttagtaaattctttctctgtgaacacacaaatggaaggatggcccattcttttaggagttcatatgagcttgctaactctgagtcagaatgacccgtgaactgaaacattcagacgacaccaccactaaaaaccatggggattcaattcttttggagttttactgctgaatgtacattttgcttaatttttctttctggggaacttgccaaaatttaggtaagggcgccaggtgtggtggctcatgcttgtagtcccagcaccttgggaagccaaggcaggcatatcgcttgagtccagaagttcgacaccagcctgggcagcatggcaaaaccccatctctacaaaaatacaaaaaatcagccggacttggtggcgtgtgcctgtagtgcctgcagctactcggtaggctggggtgggaggaccccttgagcttgggaggtggaggttgcagtgagccaagatcaccccactgcactccagcctgtgtgacagagtgagaccctgtctcaaaaaaaaaaaaaaaaaaatttttttagataagggactgagagatgttaaagaactaaatagcataaatttcacatggcatgttaggactgtagggtaatggtagtttaacagtcattgggggagtaaatttttatgcaactagaatacgcaaaaagtataccttgagtcggaatctcttgaaggtgaaattgttatcctaaatgtctgtactttgctttttggaatgtaggaagcagtatattcattcaaatctgttttgctttcattagcttgcttgctaaaaattaatgcttttctatacagattgaaacaaaagaaatttatgctcaaaggcaacttttactaaaagatatggatttgctaagaggaagagaagcagagctgaagcaaagagttgaagcttttgaattgtaagtaatgcatgttcattttggatattcagaatgatgagattaaaaagaattactaaatatatatctaaatattctaatgttcattgccaagtagagttcttatttgtaaaggggatatcacctagaaggtacaaattaagaggaacaaacactagggttttgtttttgaaatattaaacattaagatgaaaagacgaatgagatgctatcatcaggctacagtaagaccagacagattatttggagaagctgttaatactggaacagatcgtatgttttgcagttacattcagtccctcagatctgatagttccgtgtgtgtatgtatagtaactgaattccatatatccaggcctgcagcttttaccagctgtgtgctcagaaaaggaagtatggtggtccaacttgacttgtacttggtgaaaccatttctttgttactcactgtttctaagtgctcacaaatgtttcatccttgagatcttacctgggattgatggcaagttcacctgtctatagtttgtgcaataagccttctcttcctttgggaatctgctattgacacccatagatactccaggaatcttagttcattaaagaatttggctccattaatgtttttttctcacttctataggcttgatttgtttgatttcaactctctgtctaccttactctctttttggcaataatgaaaaggtaaattgatcaagagagaggaaataggcacaaaattggggcagagagagttcatcattcctttacctccattttctctactcttgttccctccttctcagcatataaactaaataaatgtagtttacctctccatggctttccagattaccagcagagggagctaatacctagagcctttacctgttcttagactagtcagcattttgtagcacttctcaggatggctggatctcaccacccatgaacctacctccctggctaaggagttggtgctatggttgatttaaagtctcactatgaagaccattctattcttcagtatttggaagccctgattgatccatctatcttttgccctctcttttggtacttttttcaatattcaatcaatagggttttttgtttgttttgttttgtttttaagacacagtgtctctctgtattgcccaggctggtctcaaacacttgggctcaagcaatcctcctgcctcagccttctgaaaagctgggattataggtgcgggccaccacacttggctaaagctgattggttattaaatgacaaaaacacatattgtaccttgaatatgtatggactaattaattaaatcccacagttagaaacagcattatagaagatttaagcacataagtacacttatttgttactttgtaactaataatatcattatttcatcccaggattgattttggctatttatcacctataaccattgtttgagtgtttattttcagtgagaaaccacttccctcttgagactctcccactcccctcagcccaaagcacagtcaattctgctagtttcaatatgctgtaactaggtcagttcataaaatacactgaggacttctggctctttccttctacttcccagtagtgatatcatgtagcagttttagtctgtggaactagacacatgtgattttttcctaaatttgttagctcagctatggtagtttatttactttttatatttttgttaatttcaggaaccagaagctccaggaagaaaaacataaaagcataactgaggcacttaggagacaggagcagaatataaagagttttgaggagacctatgaccgaaagctcaagaatgaacttctaaagtaattgtttagcatttttaaataactaatatgtttaaattaaattggtagaaacataacaaaaactgacaaagtagtctgtaacttaggcaaactttagtgtttgaaaaaaaaaaaacatagttttatcgatacagtcaatcctttcctgcatttgagttaggatagtttttaaaagataagggccgggtgtggtggctcatgcctataatcccagcactctgggaggctgaggtgggcggatcacctgaggtcaggagtgcaagaccagcctagccaacatggtgaaaccccatctctactaaaaatacaaaaattagctgggtgtggtggtgggcacttgtaatcccagctactggggaggctgaggcaggagaatcacttgaacccgggaggcagacgttgcagtgaactgaagttgtgctactgcactctactagcctgcgtgacagtgacaatccatctcaaaaattaacaacaataaaaaaatacagagaagcacatcctctgcgcttcttatggcttctctaacgtttattgtgggctgtgatttgctttaattttcaggacaccttgtgacttgcttagcttgcatagttgataagctgtaaaattggaattataaccacttttagttatcttttcctctacctcactcatacagtcagaaggatggggttatctgacaatatataaattatactagtggtcatagtatttgtcagtgaacatgtgccttgtattccttcaagattcagcaaagccagaatcaaaagagctaaaattaactatgtgaggcaaaaagtgatatagggaaaggaaaatatggacaactatggtaactttggcttttctgtagtctgagttttgtgtatcagtgaataatatctcagtgctacgacattatgcccatgtggtaacatttctcttcagtgtgtgggaaagcatctggcacataaaaagtgctcagttaatatttgttgtaaatgtgtcacgaggaaatgattcaactcaggtgctctgggcatttcttatttggcctcttttattgcctttctcataatttgtcatcgatattccattacataatattgcaaaggtttcttgaggtaatcctttaaacaaatcctatttttaaaaaatatggcagcttttttatctattgattttgaaatgatgtattttacccacatcttctatgtcagtttctatactaaaatagctaaaatggaagtgtctgtagttgctgaatttttaggaataaatgaattaaagtatgtgtgttaattttacatagttatggagctagtgaactatttggtgtcattgtgacagcttccacaggctgcatggtgtctgcctggctttgggaatcctcatatgactttggcaggtgttggagtttggaggctcttcgccacaggagtgcttctatttccttttggaaccaaaagggcagctggtaacagctgggaaagggaagtgaaactgtgaaaatgtgccttttggtattgctaatccggatataatgctcttggcagttggctctcaggactgtgcttagtccctgagcacaaaagttcttaccttggttgggggtgggcagatggtacaggtggattggaagtgaccgtctgattatcatttgggattgagtctgttgtgtgctgtgtaaatttaatttacccctttgctctttgtgtcagttgagaccaactgaaaagtgattgctttcagtaagtaaccttatgataacacgacgcttcattttgtgtgattgagttttgggacccagtttataggatcaaggaagggttttactgggcattttatgttcaggggttatatccctggctttagtattgaggactttgaagtttacaagttgtcatgtttagcaccctcaggtgctcctgtgccatagataagctcctgcactgataacagtctttccagaaaaatgcctgaggagctcatatttagtcattctgattctcaggtatcaacttgaactgaaggatgactacatcattagaactaatcgactgattgaagatgaaaggaagaataaaggtgatgtttggggggaaaataagctgtatttttcagttctgctgtaggttattagcttcccaagttgggtcttttctatattctaaaaaatacagcttacacttcattgttcatacaaaattacacattttttgtaattttaattttataaattaaaaatcatggtcttcactgccttttgaggaaccttcatgtttaatagtttgtatattcacaaaggccagtgatttatcatggatattttatccaactttatttcatatattttgataaatctgcaattgtcaggaacgtagcagcaacttattgctgtcaagtacgtattactcctaaccatgagagactttatttttcacttacggaaaacttttaacttctctgtcctctgtgacctagtttcttatttcttttgcttctaatatatttttatgctttataatatttttacttgatgtataaccttctgaactcttgtgtacattggcctgagactatggaagttgaataatttttcaatcttcagatgttttacatttcagtgtatttttttttttttttgagacggagtctcgctctgtcacctaggctggagtgcagtggtgcgatctcggctcactacaagctccacctcccaggttcacgccattcttccacctcagcctccccagtagctgggactacaggcacccaccaacacgcccggctaattttttgtatttttagtagaggcggggtctcagcgtgttagccaggatgatctcgatctcctgacctcgtgatccgcccgcctcggcctcccaaagtgctgggattacaggcgtgagccaccacgcccgacccatttcaatgtatttctaggaaattgctgtaacaagaagttgaagttttggtggaaatttcaagtagattcctgggaggaaaccagggttagatagttgatgttgaccagatacccaatgtgtggctactgtctttttttttttttttttttaagagacggagtcttgctctgttgcccaggctggagtacagtggcacaatctcagctcactgcaacctctgcctcctgggttcaagtgattcttgtgcctcagcctcccaagtagctgggactacaggtgtgcgccaccatgcctggctaatttttgtagagagagagtttcaccatgttggccaggctggtctcgaactcgtgacctcaggtggtccgcctgacttggcctcccaaagtgctgggattacaggcgtgagccactgtgcccagccccttttactatcttgtggagactaatacttcttttatgcattaataccattacgtatgtaacaaattatggtttgatgatatatctacatagacttgtgttagatgaagtgaaaactacaaaatagtaactacaatatagtaacagacagatctttgtcttcaaggaagttaagagctgtgggtattagggccctgtgctttgagcacatggtataactctggttagcatgtatagcaagtggaatttcaccacatatatgacagttacagcttcacatcacctgttgggtaacagggtttatttcttacttgcccgctacatctgctatttggattgtgaaatagtggtcattaggtctgacatactggccataaatattaaatggcttttgtattcactaggaaaacattatggtgtttaattggtgggctcttttttcagaaaaagctgttcatttgcaagaggagctcatagctattaattcaaaaaaggaggaactcaatcaatctgtaaatcgtgtgaaagaacttgaggtaattgttaagcatgttggtttttgaaatagattttaagcaatatatgaaattttagtcatacataatttatcctaagtcatcctgttgagatgtttggactgccatttatatggctaagaaggtgttagctgaagttaattcaatagttcttaatttcagtcagtgtcacataggaaagtgtagatagagctttgggtcctggagtcctgcccacatcctgtctgtgtctctaactgcttgtgtgtcgctaggtaagttctgtgactgcaggttcctgagctgtaaactaggatgttttccacattatagggttgttgagggaattcagtaagctaacttatgtgcctagttcatagcaggtggccattactattagtttctacatcagcctgttatctccttccatcagcagcaggtaaacaaaattcctgtcattacattgttatcttacagattaaaacaaaatgaggtacatttttcacatatcattgcttctttacttttctgttcattcgtgtgcttgctgtctgaaggatgaagctggaactttaggtacttacaacatattttgtatatgaaatttattttagcaactgtgacttatgtgagaactttgtaggctttttactcaaatatgagatatactaagaaaagggaagcacttcacaacattttacagaatcttttttcctttctttcccttttttttttttttttttttttgagacagagtcttgttctttcgcccaggctggagtgcagtggtgtgatcttggctcactgcaaccaacctccacctcccgggttcaagtgattctcatgtctcagctcccaagtagctgggatttcagccatgtgccaccacacccagctaattgttgtatttttagtagagatggggtttcaccatgttgcccagggtggtctcgaactcctgagctcaagcaatcctcttgcctcagcctcccaaagtgctgcgattacgggcgtgagccaccatgctcagccatttttatcttacctttcatatttaaaaaatatatattgctatgatgtgtgattattgttgggttcttggttgcctctggaaaatgggatgataatcttagaaggacttgcttcatgggatgcggcctataaaagttctgccccaactgtagggcggaagataattttcgttattgtagttagagtcttattgtagagaatcagacttctgtctagtgaccttaattaaattgtgacaccatgcttaaaggagcctgccagcttttacttttgcagtactgtaaagtcattattcaaatgtaaattttcctttttgaattttagcttgaattagagtctgtcaaagcccagtctttggcaataacaaaacaaaaccatatgctgaatgaaaaggttaaagagatgagtgattattcactactaaaagaagagaaactggagcttctggcacaaaataaattacttaaacaacaactggaagagagtagaaatgaaaacctgcgtctcctaaaccgtatgtatttttcttttcttctgacttgcgtgttttagtaattcgcattaggtcagtattataaaactatgctttgtacttgtataaggtagggggcttacattgggaagatttataaaattaagattcttggattaaactctgcaaacctgcctataggtggtatcaaagcttcccttgccctctgactgctgattgggtttggccagtggggacaccagcctctacatacagtggccctaggctggccactgtgcctcatggccaagtgaggccatagtgcctgcgattacctcttccaagtgctctgcaccaccaccctgtctctagtgctgagaatttctccctcctctgattccccaggcccaaggagcgctaacagtatggccctgttactagcccacccagggaactccaccatcctttgtgcataccctgaataagtcaacctttattaaagggttcttagatgaccttgaccgtgagagccatctgccttctgcctggatcccaactgctgctgtcagatgcccagatcatattggatcccagggctgtcatcaacaggtagaccagatagagagctccttctgtgcacagtagaggagagaaacaggctttcaggttaatttgagaatttgaaagagttcttttacttggagtaggactccaagggtaataaagtttgcattaacatgcactaaattcttttgttgtgaaatttgagagtcaggattgctctgagctcatttaatagaattattatcatatttattgagtcagtacaaagcaaagaacactttaaaacccctttaactgtttttgttaagttaaataagaaaacttaaggttggtaatgactaggattttttttttttttttaccttcttaggcctagctcagccggctcctgaacttgcagtctttcagaaagaactacggaaagccgaaaaggctatagtggttgagcatgaggagttcgaaagctgcaggcaagctctgcacaaacaactgcaagacgaagtgagtattgctcttcttcagttctagtgtgataccagtacacttcatagttacgtaaacttggcacaagtcacactagtgtaaatcagatttattttaacatcaaacattactcccccaaatatgctaaaggtatcctttctcatctgagaaaattctgcagtgataacgtgactttatattcgtaatagtaataaaatggagaagaaagcaaactcacctaaacataaaattttctgagtgcctgatggtgcccactgttatctctcgattctcaccctgataagtattacaaacattcactgtcttctgatttctgcctgcatgccctagagttctttgatatgactgaaaaagatggtgaagaacttgtttgtgtgttctgcttgtgtttttttttaatagggaccctgttgtttactgtcataaagcttcttggaattggcagaacaaaaagagtacaaacatgataagagaacttttccttttgaagcaagctgtgatttgttttacattgatttcttttcctattctgaatcttttcagattgagcattctgcacagctgaaggcccagattctaggttacaaagcttctgtaaagagtttaactactcaggttgccgatttaaaattgcaactgaagcaaactcagacaggttagagacgttttaacccataaatatttttgtatgtataaagcttctggtgtctgtgaaaatgtaatgatcataatttattgaatattaattattgttttaggggaaaagccatagaaatatgtgtcatcttagaagtaaaactccctatccattttggtaataccatctggatcatcagcaaaagtattttgcttcataggtgcctcatggcttgggagagtctcatgccccaataggaaaggcgtggtggtaacatagaagtccccatattcattataggatttccttttttatttgttaccccaatgttaacaccaattcagtagttttacggattccttgatagatatataaatatacaggacaagcagggtggtttagcaaaaagaatattgccttcagaatcagaactgttcttcttttggacccgttttgaagttgtttgaccttgggcatgttactttaacttccttgggcctcagtctcctcatttgtaatggggataataatacctactgagccatgatgaaaaagatgaaatgggtttcagtccagtgcctgggacataaaagacactcaggaaatggttattggtatcattttattattgtgtcttcactgtggatgcatctctgccccttcctacttcgtaagaaggatattaaagttcagatactttattcttcagttgctttcaagttcaaagaaagtacgtatgtgttaccagttcaactgggtctgagccttccttgttcccacctgcattgtttcctcatcagctccttgctctcttctaccagcacttgttttatttttatctctactcgtttctgcttttttctgttcctcattttctttcagttctgtttgtgaaacttctcacagctgaaatcatagcagtctcctatcaataaaaaatagttgaatgaggatagaactctttcgcatgcatgtgttgccgagggcaagcttctttcttgtagcatcacggggaggcattgcaggagagaggggcaggtgcactggctttgcattaggaaagcccagtagctcttagacttgctaaccgtgtgacccagcctcagtaagctttagtccccccatctgtaaaatgggagcagtgagagtttcttgaccacagtgttgttgtgaatgcaggtcctcacttccttatatgaaactcgggccatatgctgtggatttcgcaatagccctgggagttctgaacagcatcctatagtaaagcacattaattattttgcagtcaactgtatgaatattcatgctgggataaataaagattataaatgggtttacatcagttcaggtcaaacttttcaaccaaatgagttcaagtctggttgggctttgccaccaaataaattatgaataaattttcagttctcagagccttgtggctttcaaaattgtgcataatggattctgaaattatatcatgttacaaaagacatacaaagctgtagctggtacaataagctctcagtaaatgttagtggttatcgttaccatggcttcagaaactgtatagtgcaagtttgtccttattactctcttccatttttcaaaaaaataatattctcaagtatattttcttctctgccttgtccacttacttctgaaattggctttttgtaccctgcagccctagagaatgaagtgtactgcaatccaaagcagtctgtgatcgatcgttctgtcaatggattaataaatggcaatgtggtgccttgcaatggtgagataagtggggatttcttgaacaatccttttaaacaggaaaacgttctagcacgtatggttgcatcaaggatcacaaattatccaactgcatgggtggagggtagttcccctgattctgaccttgagtttgtagccaatactaaggcaagggtcaaagagcttcagcaagaggccgaacgcttggaaaaggctttcagaagttaccatcggagagtcattaaaaactctgccaaaagcccactagcagcaaagagcccaccatctctgcacttgctggaagccttcaaaaacattacttccagttccccggaaagacatatttttggagaggacagagttgtctctgagcagcctcaagtgggcacacttgaagaaaggaatgacgtcgtggaagcactgacaggcagtgcagcctcgaggctccgcgggggcacttcctccagacgcctctcttccacaccccttccaaaagcaaaaagaagcctcgaaagtgaaatgtatctggaaggtaagccacccgcacaaagggttgcggggtgctctggagttgggtagccaccctgcccacgacacagggttgccgtgagggtcagcgggccagagtggcaaggtctagtgtttggcacacagagctgtttagagagtgatagttgccttgcctttgctgcctgttggtttcctgcattttattattgccactgcaatttaatttaggtgcttgaatcattagttttctggatcttatgcatcataattggctatttgtgaggataacagtttattttcaaactagtagagctctttagaaaccacgttggtatcttctccgtgcaattggtaatattcttgccttggttctttctgcaccttaggtctgggcagatcacacattgcttcccccagtccttgtcctgacagaatgcccctaccatcacccactgagtctaggcacagcctctccatccctcctgtctccagccctccggagcagaaagtggggtaagtataacgttctgattgattagcttcagctgaataatgttacttgctctgtcagccttcacttgttttactgggattttttttttttgagataattattatagatcatgtggcagtatagaatttgcaatcagattgcaaaatgatatgtcatctttgagaatcatctaaattacctggagggaaaaagattgcttttagcaaataagtggataatgcttatttgctaaacttgatatatggaccatgcaatctggtattaataagcatcttcctagttctgtgaatagatttggtttattaagataaaaaacaaatgtacaaaatctgaaagcaaacaaatggaggttatttataaagttggaacaattttacacatcattaaaaagtcatttttaaaatattttggcattgaaatataaacagataaggttctgacctgcatatcattgaaataaattcaaacgtggtagcaggctctggtgtatgattgttgaaacaggaaggagtggatgtttttagaaactagtccactgggtcagccaggctatgatttgagtcatgagcagactcctacccatacctgggccccacagcagagggaactgactccttagctccaggctcgatctcgggcatctgcatgttaatgtagttctctgccacatgggcctgtcgtagtcctaaagctttttttttttttttttttttttgtgataagccaaaaggaaggataagacacacacatatgctgagttagggcgctttgctcactcaaggttgtggtgttgcatcttcatctggttcatgctgatagtgtgcagaattttttttcagaaatgttttatggttatttcctaggaatagcattcagagtacaacattattctttattaacaactgtagtacctacttcacagcatgaaatagttacaaggagtaactgattaaacaggtattaattgctgagaacaatgcctagtggtggtggtgaggtggagctatttacaagacaaagagaaagggaattttgtagagccttttcttgagtcacaaaaggctttttgtcaccttgtactctttggttttccattattgaaacttcacgagttttatccttccaatctagtctttatcgaagacaaactgaacttcaagacaaaagtgaattttcagatgtggacaagctagcttttaaggataatgaggagtttgaatcatcttttgaatgtaagttcaaatataaataccagtttttatatgttgaaaatctagaaagcttagttttggtgaaacgtatccattggtttaaaaagaaaagcagttacaaattgggtcattattattttgtgatacaaccacaagtacagatgtatcacctcatttttctaccatgatgattttcatgtgtgtgtttactttttaaaaatttcagtatgactaataatttcagagtttgagctaagcttataaatgaattattaacttatcagattttaaataagtgatttttatttattttttcctttgatggaatacaagaatgtttatttttatttttttgagatggagtctctctctgttgcccaggctggagtacagtggtccgatcttggctcactgcaatctccctcctcctcccaggtccaagtgattcatctgcctcagcctcccgagtagctgggaccaaccacaggtgcatgccatcacacccagctagtttttttgtatttttagtagagatggggtttcaccatattggccaggctggtcttgagctcctgacctcaagtgatccgcctgcatcggcctcccaaaatgctgggataacaggcatgagccactgcgcccggcctaaggatgttattttttaaatatactgattcagttgattgcctcagatttagaaaacctcatttttagtaaaagaatagagataaaagaatattaagagtccagaaactggtgtcctggctatggccctgccttagactgtcttactttgtagccactttgtaagtgtaaaataagcatgtagagcctatcatctctaaggttctttccagcttgagaaatctttatatttgcatataagctattggttagccttgtaaacttcatcttcaaatctgaaagtgttaatattttgaacagttaaatgagagggcttggtaaattttgtaaatatttgttaaagtctttgtgttaaatcattgatattttaatagaattcaaatgatgatcagcaagccaattgaattcttcactgtcactgggttgattttcctgttgggtaacgaatctcattttgtaaacaaagttaattctttcaactacgagaacactctgacaagcaaatacgttgccaagtggttatgttgggaacttcatagaatcctgttaggaaagggcgcacccagttactttggcttcagttcccgtgctccagtcagttgcccccacactgcactgcccttctttgtcttggtgttattattaaggactcatgggacaattgtgcctcatgcagctgcagggaacatgccaaggcagttggaaatgggcgggctttctcctgccggggatatgtctcatgtggacgctgctgcagctgctgtgcccctctcatatcagcacccaagtaagttctttttttgaactaacagtcagcagggtcgcatactaaataccagtccgtgtgctctgtgaattatttcatgtatcactgaagtcatcttgtaggtgtaaattagtcaaaatcttgggttgggggttataggtgtcattatattgttaatgacatttctgaagtaattcccatgtgaacatgtaaagacagtgctgagaaaggacacgttggaaggaaaggcttctcatttaggcttcccaggccagttgcttaaaaagtgttttcatttactcttcagtgcctggcatagtagttggacttttccccaagactcttctgcaaaaactgttccttgggaaccttaaagtttgggaaatcacagtgaaaaattgaaataataattaactcccagcatatatctttaatatgattgtaacatttaaatattatttatttttctatctacttgtttcctttgtgtcttaagaaattaggacagaaaaacttcgtatttcaatctttggaaaagctgtgacaccgagttagcgtagcactggaggaaaactggccatcagacttctcttctctggcccacttcctctttttcctcttctcctccagattacccacttccctccctgcgggtggagggagacgggaagagagccgtgggagctttgtgctttgttccagggctcagccaacagccaggtccttttcttcttggaccaagtgtttaatcctcaaatctgaaaggaattttctcaagtaaagccacctcttagtccctcccaaacgttggaaaaacatcatacccaaaacccctgttagcagtttcttggttttagtcatggtacccaggaacatataaaataactgaaagaggcaagagattttgagagggttgatgttgctgattccagagtaaatctgctttggaaagcattcagtgagacatgatctagagccttgtctctgctgggcactttgctcagcgctgagcatatagctcaagccctcgccttcctggatttctagcaggggaggcagatggtcagcaggccatcacccaggaccgcagcagggaggggctgcagcagctgagtaggggccgtggccacaagagggagtgtctacaggcactcatttggcacagacctgagcgagggaatacaaataatgtgataggataagggaaatcaactgagtaactaggtgttctgctgctgagatggaacatagattataatatttgctttaaaaattattaagcagcatggcgagtgacattttagttattgagaaattgttatatttgtcatttcatctcttcatctgggcacaaagggaattcaaaaaggttgaaatttggtgtctcggaggtgccccgtggacatgcttccttcctttccccttgtgtccaagagatttctgtataccaccctgcagctacaaaatatacaccagagtagagaagcagctcactcttcctctttattttgtaattggtgcttaaacaacattcctattttgagattactattccatataagaaagcaatcttgtttaggagtaactattttttcttctctagcaaggaggaagttgcatttctgcctgtggaaatgatcagctgtctcctctggtattttaatttcatgagaaggattcagaagagatgggggagagagagaagaaactgtgttgcttctctcctattagtaaaactcagttcctgctgatcactttagaacaaggcacagcaaaaaggttcaaagtcctctgctgaacctatgaatttttctacttattagcattgcttgggttgaaaaaaaaaatgtaggttatgggtcagagccagaagagaaaggtcagcataattgtctctgggattggggtctaattaaaacttttgagatatagggacctgtgccaagatgcagagggaacagacaagtaattaaagtatggaccttgcctggaaggaatagaagtggaagaaacaagtacatgtagtttttgacagatcaggtacaagatatcctgcaagtgagatgctggagtggttagttgtcacttcaggaataaggaggaggtggcatttcagttgggtcttgaatagcatttcagactttgtgagagcaagggagtgctacaggctgaggagacagtgaaggtgaatgtcaagcaaggaagatagagccacggccaggccccagtgagtgggttggtacagatgaaatatttctcgtacaaagttggtggtgatgtaggaaatcaatctgggaagaaaagggcaggttgtcagagcccagactaccatggcgtaggactcttatcagagcggagatgctgcacagcagatccacatcttcccctcaggaaatgcctggtgcagatgaccacaggttgttggaaggcagagactggcttcaggaagagccttgactgggctgtttcagtagtccagggagatggtgagaagggcccctgttgcagccacaggacagggagtgtgaacctgcaaacactggtggctgagtggatagagggtagaaagagcatgatcgaaggaccgggatgatcatgcctgggacgaagctagtgctgtggggtttccacatgcggatggcaaggaactatcagaaatgtggacgcgaggctagggagagagaccaggagtagaggaaaagatagggaaaggatccatatacaagtgatggctaaaaccccaggaagggctgccgtcagtttggaggaagtggggaatgaacagtgagatggctggaatggcggggggagggcagtggtgtgatttctgttctgttttgttggggtaggacagacttgagcatctttatgggagtaagacttctaaaactactgtgtacagaaatagggattaatggctcagtctgggtcctaaagataggggagggattataatcaaaggcagaggcagaaatgcagggtttgccttggaaaggagggaggagatctgtgaagaggatgagaacatgtgacatggaaggaggacagttggagttggttatggtgagggtgacgtatttgtctcagtcaagtgaagtagggtacagttcaaggagtggggtcgggagcttgaagtcggtgaaaatgaaatagtgacttgaagcaggtcacagagtcaactaaaagccaagcagagtctccgtgggtcttggcaagggctcctgcagactggtcctgcattcatttgaataatctgatactggaagctactctttattttctgtcctattaggtgtagatcagaaacaaattgaagaacaaaaggaagaagaaaaaatacgggaacagcaagtgaaagaacgaaggcagagagaagaaagaaggcagagtaacctacaagaagttttagaaagggaacgaagagaactagaaaaactgtatcaggaaagggtaataagtatgacttgattctctgaactggttgctccattgtacacctttcgtaagtacattgagctcagggaggggagtcaattggtgtacaaagtcagaggtgcggcagatgccttaaaaggcatccctgtcctctccttgtcttaaaagcagtgggaaaggctgcacagaatgtgaagcttaggagttttgtagtaaaggatagtttttgaaggtaatttttgtacattctcatctgatccttaaaacaagcctgtaaaaaaggtagactgtgctttgctgcagaactttgctttgaaaacagggtttaaagaagagactgtcagtgccagctagctgggactagaacccaagggaggagtggctgccagttcacagttgcttccaggggcacacactccctccctccttcctctatttctcttcttgccttctgtgtcccaattctagtcctagcagatggattactctgtccacttaacacacctgctaagtcttgcttgaattactctaacatatgaatgttccttggactcttggttaattcaagtccaaagcacaggacacttgccaattaataccttccttcattgagatgacatatttgtcttcctttgatgatagcaatgacttcaattttaaaaattagtcctctggcatacaggctgtacttgaaggatcgggattaatattagtgcatttttaaaacacttaaaagttttacaaatgtatttgtgtattttctgttttggtgcctgttttatagaagatgattgaagaatcactgaagattaaaataaaaaaggaattagaaatggaaaatgaattagaaatgagtaatcaagaaataaaagacaaatctgctcacagtgaaaatcctttagagaaatacatgaaaatcatccagcaggagcaagaccaggagtcggcagataaggtgccagtgccatgggcagggcaatctgtgggtgggggacatccagggcttccgtggcttaacttcttgggacgggaatccgtcttctccattgaagacaaaaaggtgaaaagtatagaaaatccaaagttcaaatggaaccttgagtcttttaaatatactattcttttgacaaaaattcatagcttttttgcttaaggtaaaagatttaagagattttaatttgtaaaagttggggtggctcattaagaaagaaaagatctatcaaatgcattaatactgacattaatattttatgtaagtctgaagtattatgggtgttaaatgcataccctatagtttattttgatgtgcttgctaaatttcatgtttaaaagtcacctcttttttagacttttaaattacatatatatttcaaaaatggttcttaaagtatttcatgaaattaatgcatatctaatttcaaaattttccaccctctccatgtaatcagagctcaaaaaagatggtccaagaaggctccctagtggacacgctgcaatctagtgacaaagtcgaaaggtacctgttttccctacacactttcatacacaaactgttaattgcttattttgtcagccaagagaaacagatgtttgagattgcctgtaagaagttattgaatcagtcaaaattagtgactataaaaacaattgagttttttgacttgtgaaattgatcctgatataaattgtaaactagggcagaaaccccccagggaaggaattgagaacattatgaagatagcaaataaacttgacacaaatttttacattttaatttttatctttccctaatttagtttaacaggcttttctcatgaagaactagacgactcttggtaaccatgtttgctgcccagcttctaacttacataccgtgagaagttacgtaacatttactcctttgtaaatgtttccctatcatcagacaaaactcaataaaaatgtgtgtaatccaatgtgggtttttttttccataattaattttgataccatagtgtgtgaaccaagaataatctagtcacgtgaaacctcttctccagtcatagtatttctcattcattataataaaagtaactggcttttaacctccttatttttgtcttaaatttataaatgagtataacctatcttactgctcaactgcaggcctacattttggaagtataagctgtgttctttcctctccaaagttgggctgccacctgtaaaacaggaggtcatttttcctagcacactcctgttttgtccctgaacataaaaacagatttttctaggcattagaaatagtaagaaagatactgcctctggtctttacttctgatgtctgtggtttgtatgtatgtgtccctccaaaattcatatgttggaatttaaacccccccgtgtgatagaattaagaggtggcaccttttgcaggtgactaagagtgggattagtgaccttataaaagggctcaatggaactagctaggcccttttgcccttgcaccatttgaagacactgcattgatcccctctggagaacacagcaacaaggcaccatcttggaagccgagaccgggccttcaccagacatcgaacctgccagtgccttccttgatcttcgacttcccagcctctaaaactgtaagaaatacatttctggtctttgtaagttacccagtctaaggtattttgctatagcagcaggaacagactgagatagcatctttattatggaacctttggtcctcatacttaatgaatgggcgtatttcctttgtttttaaatgaatgggctccttccct

SEQ ID NO: 196 - DNA, 41919 bp, mus musculus
tgggtctgctcatttcctgcataggaagaaatcggtgacatttgggtggatacagttcccagccaatcgccccgagttccctcgcccactggggaaagaggcagagcttccgctagtctttcatcttcaaaggaaatcaagcttctaaaaagcgggccctgccgaattggctaatagctactccttttctccactaggggagcgttcgcaaggggtgtggggaggtggccagcgcttgccaatcagaggaggccagggctgtcccctagcgggcggtgaccaatcgccggggccggccagagcgcgcttccttagtaggtggatggtggtcggagcgccgactcccttctcgtcgtcgccattttgagctggtgactgtggccggctgggagtaggcggcagtgagtttccctgggagggcagcgcgcttggcgcttctcccctccccccgatctgcctccagtctcggacttggttgttgcgcgctccggctccggctgagctgggagagttggaggaggtggcggcgggcagaggtgatgtctgggagcccttccttgacagcccgggccgagaaggtgagcgtcgacgctggtcgtgggggcggaggtaaggggcccggggcggggacgtagaggaggcgcgagggcggacttcgggtcgggggagatgcgcggaacggaggggttggtgcaatgtctcaacccgggagggtttttttttttttggttttttttttttttttttttttttttggtgtgagcaaaggcgcgtgcgcgactgggacatgggatgggtgcatgcgggttgggggaagggagggacggatgggagtgggctactgtggatcactgtgtcggctacatcgaagtttatcagtggggaagcggttgtctgcgactttgagtttgtgcataggagaggggatgctgctctgtgttactctggtgtttatcggtccatggggaaatattctgtggttctggtctctattcctgggggatcggaggggggatgtgactctggtctttaccctttgagggggggcggtctgtgactctgatccttatccatggggcggggcttgggggacgactgtcttttgattgaccctaacccacttattgggtgggaaggggcatgcagggaatgtgtgtgtgactcattgccccttcttttggggagtttgtatctgtgacactgacgctcatccatggaaaggggacccactgtgtaattgtggtccttactgtgtgttccttctgtgatgtgggcccgtagttatttggggctcgtgtctgtgactggcccttggctgtggtggatgttactgtgtgactctggcccctttgccagagtctcttgaaggtttttgtgctctcagacgccagtgcctctgtgtgattctaactcttgcccacctgggagcaggtaactcgggttccctgtggcttgaggaggaagagaaaattggagtgtgtttgtctgtgtatgtgtgtgcacgagcatagagcaaaggtgtggcagcaacctagtgttgagcaggtgctattattgcctggctttacctgcttcttattcagagggtggggcctgaagatctgggattcatcctgacctctggctgggtcacagggttctcaggactccctgagttctcaccacagccctgagggttggatgaagtggctgctgctccatcccaatagaagagcacagtggttcagaacagcctccaaaagggccccttttgcctctggaaaccgggcttgagccctggggagggaaccaccttaggaccgggctgcacataagagacagggctcagggctgagccagttgctgtgtgagggccaaggctgtgttggccaggagcccagggaggtggcagctgtctcgtcgccaagttcgccccttcacacacccccccaagagcctttcatggtcttttgctgccttataggggacagccagcagcttgttgggaggatgagatggtcccttggggcctgtggaaggagcctggggcccccattgttgtgaagtcttgtctgatgtgctgaatctcaggcaagactttcagccctgagagtcccctacccccaccctgggatgcagccccaggcttgaatttgtctacctgtcttaggtggcaaagccctgatcacactgtgggtggccccgccaggtctctctgcaagatgccccctgtctgctgaagtccttgctgttttctagggcagtgggctctagccttatgtttgcggggaaagggaggagcaggccaagtaggggctaccttcatactgtgatgcacaggagtgctgggagctggaagacaatgtccctgggctaaggggcagcggagagccttgacaataagagtttctcaaggaggccctctcagtcccaacagttttgacccctttcttccctccactctccccagagtccctgcaggaagcatcacccaggctggcagatcatggtagcagcagcgggggtggctgggaagtgaaacggagccagcggctgaggaggggccccagcagcccccgaaggccctatcaggacatggagtatgaaagacggtgagttatctgttctcagcttcccagacagcctaggcttgcgtctatgtgagaattgatccaagaaggtgctaggatggggcttctgggtagaggaaacagcatagcagatgatgggtttcttttcagcagacaggtgtttggcacctgttgtgagccaggacctgtgctaggctctgatagtgcagtgatgaatgagacatgagattgcatccttctcagtactcagggtgtcacagggacgctatgcagttaacgggtgggaggttgaggttggggctatagcctggggtatgagggatgggtgggaatggcaccatcagagtcaggatttgcccgggaccactaggggacaagccaggtcagatagtggaagactccagggacagtatgggctacagttggcatgatacttgctgggaatggatactctcagacagttatttcttcagctctgctatgaacaaggaatagctggaacactgggtaaaatacagaaatcctgagtaaaattcagtgatccctcgccatccaggtgattccgaggcaggtgacccagccatgacacttgaagattgcctagaaaagcagacctaactctctcagaaagcctctattaagactcaagagtcaatagctttataaaaagagaaaataatttttaaaatgttttacgaagtgtttcttctaccaccactccttttaaaaatgtagaattgtaatattttgttttctgaaaagtgagcccaaatttgagataaggtcatcacctagtgttattcagtcttggctttcattagaaatgttttttgaaagacatttgattttggacggtattcactagaagtgctctgtggccatttctgaatttgagtagctgacatacatactttgttcaaactttattaccaagtaaaaccattgacttttaaaagccctcaagtgcagaggtttgagttcatcatactttccagttcaaggtaggtttctgtcataggtcagcaaaaggcttcctcttgtcatgtttattttttcatttttattcccaattcccacctctgtgggcagctgctctgtcgtgtttgatatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatcatagatttatcatatagatcattttcatataaatgtatcatatagatacatgtatcatataaatacatacataaatgtatcatatagatacattttcatagaaaatgaaaatatgaagtgttgttttgagtgactgtgttttcagttgacacacatggcatggtgccacagtcttcgttttgtttcctgaactttgtattactcagagtgggaggttttttttgttttttgttttttgttttgagacagggtgtctctatgttgcccaggctggtctcaaactcctgggctcaggcaattctcctcccttggcctcccaaagtgctgggattaaaggcatgagccgctgtaactggccaacagtgctgtttttttttgtttgtttgttttgttttgttttgtttctttgttttgagaaagagtttcactcttgttgcccaggctggagtgcaatggcgcagtcttggctgaccacaacctctgcctcccggtttcaagcgattctcctgccttagcctcccacatagctgggatttcaggcatgtgccaccacgcctggctaattttgtatttttagtagagatggggtttctccatgctggtcaggctggtctcgaactctcgacttcaggtgatcctcccatcttggcctcccaaagtgctgggattatgggcatgagccaccacacccggcacagtgctgtatttttaacatctgtctgtattgccatgtatatgttactactttgtttctaattgctggcaagggcatcatggggcatgtctactgagttttacttaatacttcccccaagagtagatgcctgttgttaattttgatgtgctagcatcattttttttttttttttttttgagacggagtttcgctcttgttgcccaggctggagtacaatggcgcgatctcggctcaccacaacctccacctcccaggttcaagcaattctcctgcctcagcctcccaagtagctgggattacaggcatgcgccaccacgcccagctaattttttgtatttttagtagagatggggtttctccatgttggtcaggctggtctcgaactcctgacctcaggtgatccgcctgcctcggcctcccaaagtgttgggattacaggcgtgagccaccgtgcccagcccaacgtcaccttttttgctttatctgttaatgtatagtgttttttgtttgtttgtttgtttgttttgagatgagtctcgctctgtcacccatgctggagtgcagtggcacgatctcggctcactgcaaacttcgcctcccgggttcacaccattctcctgcctcagcctcccgagtagctggtgctacaggcgcccgccaccacacctggctaattttttgtatttttagtagagatggggtttcactgtgttagccaggatggtctcgatctcctgacctggtgatccacccgccttggcctcccaaaatgctaggattacaggtgtgagccactgcgcccagcctaatgtagtttttaccttttgcattcagatctttaatccatctagattccactcttgaatatggcatacggtaggctccggttttattttcttccatatagtaggcagtttttccagtaccacctcctaaatagtccattctttctttattgatctgtggtacctcatctgatttcaggttccctcatgtacatggatccgtcttgagtgatgtgatttgttccattggtctatttgcacattcttgtgccagcaccttactgtttttattattatggctttatagaatgtcttagtagctcctttgcacttatttttcaaagctggtttaatcatttatggggctttattatatatcaaaagttatcaaagtccctcaaaaacaacaagaattttgatcgatgttacactgaacttctctattaatttggggaaaattatctttgtaagtagtcatttcatctaagacctttgtagagaatattttgaaatttatgtaaagagcataaaaagctttcattttcataaatggaaatacaggtcttatgtattctttgttaaagtaatccctaggtacttcagtcactttcattatctttttttttttttctcgagacttggtcttgctctgtcacccaggctggagtgcagtggcgacctccacaggctcaagtgatcttcctacctcagccttccaagtagctaggactacaggcacgcaccaccacgcccagctaattttttgtagagacggagtttcaccatgttgtccaggctgatcttgaactcctgagctccagcaatccacccaccttggcctcccaaagttctgggattacaggccattatcttattttttaaaaaatatttttcatgctggtatttgctggggtagaggaaagctgttgatttctgtaagttacccctgctgtatgcccttattatttctaatacttcattgttgattctgatgttctttctaagtagttggtcatattgtatgcaaatctatcctgtcacttatttatttttcttcatttatagtattgtccaggacttttagtaccatattaaatagtataagtgatactgggtacacaaattaagatttactttggctggttgtggcagaaagtccaaaggataatggcttagacaagatagtttacttttctttcccataaaggcagtctgcagaagagcaattaatctagggctgacaggcagccccttctgtgtagccatcctcagcacatggcagttgagacagtaggaagaagggagaggaataaaagggaatgtgtctaaagtttctccattaagtatggtgcatgcagtaagtttttagaatgtatcctttaataaatcaagaaaattatctaatcttcgtttgctaagattgaccataaataagtattgaacttcaaaatcctgtgctttttttctccctttgtccattaatttcataaattgtggcctggcatggtggatcacagcaccttgggaggccaaggtggttggatcgcttgaggccaggagttcaagaccagcctggccaacatggtgaaacctcatttctactaaaaataaaaaaatcagccaggcgtggtgaagcatgtctgtaatcccagctactggggagactgagacatgagaatcgcttgaacctgggaggtggaggttgcaataagctgagatcgtgccactgcactccatcctgggcaacagagtgagactccatatcaaaaaaataaataaaaattttgtaaattgcattaaatgatatccttggcattcttgagctataccccacttgatcatggtatgtatgtatatgtttatgacttcttactttgaaaatatctcaaatttacagaaaggttgcaagaaaaagtataatgaattcccatatatcctctactcagaattacttgttttaagtattttgccacatttgctctatcactctatatctttttttttttttttttttttttttgagacggaatcactctgtcacccaggctggagtgcaatggcgtgatcttggctcactgcaacctccgcctcctgtgttcaagcaattctcctgcctcagccttccaagtagctgggattacacgcgcctgccagtacgcctggctaatttttgtatttttattagaaacgaggtttcaccatgttggtcaggttggtctcaaactcctgacctcaggtgatccacctgcctcagcttcccaaagtgctggaattacaggcgtgagctaccgcgcctggcccaccctatagctctatatctttacatagacacacacacacacacacacacacacacacacacacacacacgttttttttaatcgtttgagttggtggcagccatgacttttctttttgagtcagagtttcactcttgttgcccaggctggagtgcaatggtgcaatctcggcccactgcaacctcttcctcctgcattcaagcgattctcctgcctcagtctcccaagtagctgggattacaggcatgcgtcaccacacccagctaattttgtatttttagtagagacaggatttttccatgttgatcaggctggtttcaaactcccgacctcaggtgatccgcccatctcggcctcccaaagtgctgggattacaggcatgagccaccacatccagcctgacatgaccttttaagtctggcagcatgtacgtcttaagaacaaaggtgttctcttccataaccacaatatacttatcaatatcaggaaattaaacaattatatagtacttttattctatataaagcccatattcagatgttatcactcttctcaataatgtcctttataatggttttccccaatccaggatccagtccaagatcatgtattgcattgagctccttgtctcctttaatctgaaacagttattctatctttgtcttttatgaccttgtcatttttttttttcctgaacctatggattatattgaaagcatgttttaaagttagttgttttatagaatgtttctcagtttggatttttctgatgcttactcatgagtttttggcagaaatgttatttaagtgatttatgtatatttttaaaaccttgttagattttattagccattgtatcatctaggatatctacacctgtatttatcagtgaggtagtccaatatttttattttcagtatttatctggcattggaatcaaggtagcctcattacatgaattgggcagcctttgttattctctctttattggagaaacttgtataagaattatctgtacctcgaaaaacttggtaggactcacctttaaaagcatctggaggctgggcgcagtgggctgaggcagttggatcacttgaacccaggaattcgagacgatcctgggcaacatggcgaaactctgtctctacaaaaaatacaaaaattagctgggcgtggtggcaggtgcctatagttctaactactcaggaggctgaggcaggaggattacctgagtctgggaggttgagactgtggtaagccatgatcatgccactgcactccagcctcagtgacagagtgacaccctgtctcaaaaaataataaaataaaagcatctggagctggtttttgattaccatttcatctcttctgccaattttagcattttatattttctagaaatatactcattttgtgaagatcctcatatatgatgattcagtccagcatcctagaaatgctttataaaagggatatgcctttggaaggtgtttgttcagagtgctttggtggccaattaaaaatattcctttctatccaaatatgttcccttcctgagtttagatagcaagagttcaatacctgaatttatttggtttggatattggatgtcaagagagttcaggataatttcatctgaaaatttataaatttattcatatctgttcagttcttgattttttttccttttttttttgtttgtttgtttgtttgtttttgtttgtggagatagtctcactctgtcttccaggctggagttcagtggtgcgatcttggctcaccgcaacctctgctttccaggctcaggggattcttgtgcctcagcttcctgagtagcaaggattacaggcccgtgccaccacacccggctaatttttgtattttagtagagacggggtttcaccatgtttgccagactggtctcgaactccgtacctcaggtgatccactcgcttcagcctccgaaagtgctgggattacaggtgtgagccaccatgatggcccagttcttgaattttgatgactacagttcaaattgattgtatcaagaaccttataactactcataccactgacagtgatttcttctctaggcatttacggtagggaaacaatttggggccaggtgtggtggctcacgcctgtaatcccagcactttgggaggccgaggcgggtgaatcacgaggtcaggagtttgggaccagcctggccaacatgatgaaaccccatctctactaaaaatacaaaaaattagctgggtgtggtggcaggcacctgtaatcccagctactcgggaggctgaggaaggacaatcgcttgaacccaggaggtggaagttgcagtgagccaagatcacgccactgcactccagcccggaggacagtgcgagactccctctcaaaaaaaaaaaaaaaaaaaaaagagtttgggttccaagctgagttcgtggggacagggactttattttgttcacagcagtatccccattacctagaacagtacttatcgtatagccaatgttaggttaatatttgttgaatgaatgcatgaacaaataattgtttaaaaaaatggaagtcaaccaaaatgtttgaaaacatgtttaatggatatttgccccatttgttacttatctttatggtgttttccatagtttagtgtgaaatttcaagcatgtagcaaagtttaaagaattttacaatgggcctggtgcggtggctcatgcctgtaatcccagcactttgggaggctgaggtgggcagatcacgaggtcaggagatcaagaccatcctggctaacacagtgaaaccccatctctactaaaaatacaaaaaaattagccggctgtggtggcgggcgcctgtagtcccagctacttgggaggctgaggcaggagaatgtcatgaacccgggtggcggagcttgcagtgagccgagatcgccactgcactccagcctgggcaacagagcgagactccatctcaaaaaaaaaaaaaaaaaaagaattttacaatgaacaccatatatacccatccactagattctttttttttcttctttctttcttttttttttttttgagatggagttttgttcttgttgcctaggctggagtgcaatgacacaatctcagctcaccgcaacctctgcctcctgggttcaagtgattctcctgcctcagcctcccgagtagctaggattacaggcacgcgccaccacacctggctaattttgtatttttagtagagacggcgtttctccatgttgctcaggctggtctcaaactcccgacctcaggtgatctgcctgcctcggcctcccaaagtgctcggattataggtgtgagccaccgtgcccagcccactagattctactattaacgttttaccatacttgctttattacatatttacttctaagtttctcgtattttttacactctatagagatttataatttttacaaagccagatttattcattttccttttatgactgctgggatttgtcttgctgaggaaggccttccccactcttaaggtgatacatttttttcttatgttttctaatatttgttttctttttttaaaagttcaacttttattatagattaaaggatacacatacagtttttttttttaactcagtgaagatgtctgcacagcaggaatcatgtgggatgggatggccctttttcctaacgctggaccacttgatgttctcttccatcttcccccaaccctcatttagatcatgacatcagaaaatcaggttaaagttaagaaaaagaagaatcagatcattggggattcttagtagtagcatcgccattgggagctgctagcccagcgggtattccccatgccacccctctggatcttggctccatgggtactgggaggaggccttgttggccagggaggccacgctgtgctgctagaagctgggcgacatactggtggtgcagcagagtctcgggtgcggcagcttggaggtactacccacataggcattggccttccagggtgcatcctggcccatcatgctgctgcagcagctgtggctggtgctgcatgtctgcttgcctgctaggctgctcgccggcttggccaggagcttgctgtgcctcagtggggccacatcccctgtggctgctgtggctgtgctctggtcttggaaaatggtggcgatgtggttccagaggtctgtgaagaacctgctcacaccctcgtaggctgggaaggcgttgatgtcgatgacggcatgctgccccatctggttgttgatgatgatgtcggtgccgaacagcaatactcccagtgcctgccgcagggcccgggggagttcccggatgacctctttgctcggctgctcttgaacagaccagaccccttgatcttgtccagctccatcaggaccaatgatgactctggctttgacacactgtggctattgaggaagatggattcgtggtcacattgtgtccgcggagaatttcttgagcaagggcctctggaccacggtgtaggacttgctgaccacgaacaccttgtacagaacggtgttgtggttgatgaaattctagaccacacagggtggctgtatgccattcaggccctcctgattgaatacagtagacatctcgtgagagttggtgccgtgagccactctagttttgcacatgaacaggaaagccaggctgttcttctccagcagccacatggtgtcatccccgcacaggcttgtgacctccatgaagggcagcaagcagatcctgccgccttccatgtagatctcaatcttccagatgagtttgcaggacttggagcggtcgagcagggttctgacggcagggaaggagtccaggacgatggtttcagggtgggcatcgatgtagtcctgaaacctgtgcaccagctccagggactggctgtcattctggtcggcttcaaggatgacatcagtcaacttgtgaatgatgacgtccaggggtccctgctcctcgattggccggctgaggttcagctgcatgacttttttttttttttttttgagatcagtctcactcagtcgcccaggctgaagtgcagtggtgtgatctcagctcgttgcaacctctgccccccaggttcaagcgattctcctccctcagcctcccgagtagctaggattacaggcacttgccactacggctagtttttgtatttttagtagagacagagtttcaccatgttggccaggctggtcttgaactctcgacctcaggtgatccacccgcctcggcctcccaaagtgctgggattacaggcgtgagccaccgcgcccggcctcagctgcaccacttctatccctcacttcctgcacacctccgctaaagccgggaaattgagcttcttgattttcttctcatgcagccagtagccaactctcttccctttcataaaggtctatatcttcctcctcgggcaaggagcctgggtcctgaggaaattgcccataggctgagtctgttggccagtgagcgctgggagcgtgcgggcaccccctggtggcaggggtgtggaaagggctcggggtgcggggttagggccgcgtggtgtcacggtctccacaacccccccacccctggccacccagctggagctcacggcccacatacaggttgttctttttttcatacgcagtttcactctgtcgcccaggctggagtacagtggtgcgatcggctcactgtaacctccgcctccctggttcaagcaattctcgtgcctcagcctgcccagtagctgggactgtaggtgtgcaccaccatgcccagctaattttggtattttttagtagagacgaggtttcaccatgttgcccaggctggtctcaaactcctgacctcagtgatctgcccccctcggcctcccaaagtgctaggattacaggcatgggccaccgcatctggcctgtacaggtttttttacatgggtaaattgcgtgacactgaagcttgaggccccgttgatcccatcacccaagcagtaagcttagttcccgacagatggtccttcagcccatgccccccttcccaccttcccggtctagtgatccccaatgtctgatattccaatatttacattcatgtacattcaacatttaactcccatttataagtgagaacatgcagtacttggttttctgttttcgtggcaggtggcttaggataacagcctccagctccatctatatggctgtgaaggacatgattttgtcttttttatggctgcatagtattccatggtgtatatgtaccacatttttctttatcctgtccactattgatgggcattcaggctgattccatgtccttgctattgtgaatagtgctgcagtggccaggcgccatggcccatgccagtaatcccatcactttgagaggccgaggtgggcagatcacctgaggtagggagttcgagaccagcctgaccaacatggagaaacgccatctctactaaaaataaaaaattagccaggcgtggtggcacgtgcctgtaatcacagctactcgggaggctgaggcaggagaatctcttgaaccaggaggtggaggttgcggtgagccgagattgcaccattgcactccagcctgggcaacaagagcgaaactccgtctcaaaaaaaaaaaaaaaaaaaagtgccgctttgaacatgggtgcatgtgatagaataaattattttcctttgggtatatacccggtagcaggattactgggtcgaatagccaaagcaatcctaagcaaaaagaacaaagccagaggcatcacattgtccaacttcaaactatactgtaaggctacagtaatcaaaatagcatggtcctggtgcaaaaacagacacataaaccagtggaacagagtagagaacacagaaataaacccgcacacatagaaccatctgatctttgacaaaatcaacaaaagtaagcaagggggaaaggactccctgttcaataagtgctgggataggtggctagccatattcagaagaatgaaaccggacccttacctctcaccatatacaaaaattaagatgtaagacctcagactataaaaatcctagaaggccaggcgcggtggctcatgcctgtaatcccagcactttgggaggccgaggcaggcggatcacctgaggtcgagagttcgagacgagcctgaccaacatggagaaaccccatctctactaaaaatacagaattagccaggcgtggtggcgcatgcctataatcccagctacttgggaggctgaggcaggagaatcacttgaacctgagaggcggaggttgcagtgagccaagattgtgccattgcactccagcctgggcgacaagagtgaaactctgcctcaaaaaaaaagaaaaaaaatcctagaagaaaacctaggaaatgccctcctcgatacagggtttggcaaagaatttatggctaagtccccaaaagcaattgcaacaaaaccaaaaattgacaatttggacctaattaaacagcttctgcacagcaaaagaaactaccaacagagtaaatggacagcctacagaataggagaaaatcataagctacacatctgacaaaggtctaatatccagaatctacaaggaagttaaatcaataggcaaaaagcaaaatttccaattaaaaaatgggcaaaggacatgaacagatacttctcaaaagataacatacaagtggccaacaaacatgaaaaaatgctcatcatcactaatcatcagagaaatgcaaatcaaaaccacaaggagacaccgtctcatgccagtcagatggcaattattaaaaagtaaaaaaaaaaaaacatgttagtgaggctgcaaagaaaagaatgcttatatactgttggtgggaatgcaaactagtttggtcatgggagaaagcagtttcgagatttttttttggagagagagatttctttaatatttttatggtttctatttgggaatttaagttttcacccatccataatttatttggcgtaagaagtgaggtaaactttgttttcttagtgggcaacacttttctgtgaaggatcagatagtaaatatttttggcattgcattgcaggactgtctctgttgcaactaaactgaaagcagtcacggacaatttatgaatgaatgaatatagctgtgttccagtaaaactttatttaattaattttttttttgaaacaaggtcttgctgtgttgccctggctggctggagtgcagtggcgcgatcagagctcactgcagcctctgtctccctggctcaagggatcctcccacctcagcctcacacacagctaatttctttctttctttctttctttttttctttttccagtagagacgaggtctgactactgtgttacccaggctgggtctggaactcaagggttactcctgccttggccttccaaagtgttgggattacagatgtgagccactacatctggcctccactaaaactttatttaaggagactggatttggtccactggctatagtttgctgattcctaggccagatagttattgtaactattatttattgactaatttgttttccccttgttagtttgaaatataacctttggcttatactgaatttccaagtgtgtttttgtatgctgtagattctattctatttcactgatctgtctattcatgttttaattaatttacctttataatgttttaatatttgctagagttcctctcaactcattagttttttttttttttttttttagtgagagagagagagagagagagagagggtctggctttgtcgcccaggtgcagtggcgcgatcatggctcactgcatccttgacctcctggcctcaagtgattctcctgcctcagcctcccaagtagctggggatacaaacacgcaccaccacgcctaactactttttgtatttctttgtagagatgaggttttgccatgtcacccaggctggtcttgaactcccgggctcgagcgatccgcccacctcatcctcccaaagtgctgggattaggggcatgagccactgctcctggcttatcctttgttttttgtttttgtttgttttgagacagagtctcactctgttgccaggctgtagtgcagtggcgcaatctcggctcactgcaatctttgctccctgggttcatgagattctcctgcctcagcctcctgagtagctgggattacaggcacgcgttaccacacccagctaatttttgtatttttagtagagacggggtttcaccatgttggccaggctggtctccatctcctgatctcgtgatccgcctgccttggcctcccacagtgctgggattacaggcgtgagccactgcgcccagcctgtcctttgttttttaaaacaatgctacagtaacttttttgtacatgtgcaagtatgtgtatactttaaattcccagaagtagaactgtgggtcaaagggtatatagatttttagttttgtcagctattgccgaattctcctctataaggattattccatttttaactcctaccagcaatatgaaagtacctgttttccatacagtcttgctgtttgttttcaaacattggactgttgtaaatctgttagattaaaaatgttctatcaaatcttccttactagtgattattgtatagtacaatactatattatttaatagttatcataaataataattttaatataactccaaataatgtagatactccctcctctaggaggtagagcttaattaccctccttttgactgtgggctggtcttagagactcacctctaaagaatagagtatggaggccgggtgtggtggctcacgcctgtaatcccagcactttgggagggcgaggggggcggatcgtgaagtcaggagatcgagaccagcctggccaacatgatgaaaccccgtctctactaaaaatgcaaaaattagctgggggtggtggcaggtgcctgtaatcccagctacttgggaggctgaggcaggagaatcgcttgaacccgggtggaggttgcaatgagctgagatggcgccaccgcactccagcctggcaacaaagcgagactccatctcaaaaaaaaaaaatagagtatggagagagaaatagagaaattttacagggaagaaacctggcagacagcaccttaactaggtgatcatggttaacatcaccagagataagtcatgttgttatcatgtactcttctgtgatatgatcagaagggcatttcactatctcacttctgttgtatgcttctccaaaaaaaaaaaaaaatccataatcttaggtctaatcatgagaacacatcaaacaaaaccagttaaagggcattctacaaaatacctggccagtgctcttcaaaactgttaaggtcattaaaaacaaacaaggacagactgataaaccttcacaggccagaggagactgagggaacatgacaactacatgtaatgtaatatttaggattaaatcttggatcagaaaaaggatattaacgagaaaattggtggaatcctaatataatctgtagtttagttaattccttagttttgacaaatgtgccttagttttgttaatattaggggaagctgggtgaagggtatacagggattctttgaacttttctgcaaatgtaaaattatttcaaaataagaagtttgacttcatcaaaattagaaacttttgtttatttttgttggttttatagcgatgagttttcggtatgttgcccaggctggtctcaaactcttgggttcatgtgatccgcccgtcttggcctcccaaagtgctggaattacaggtgtgagcccaccacgcctggccacaattagaaacttttggaagtctctctgaacctattctggttcagggactgctggtaacaacaacaaaagattagaaacttttttttttgagacgtagtctcactctgctgcccaggctggagtgcagtggcgcgatctcggctcactgcaagctccgcctcccaggttcacgccattgtcctgcctcagcctcccaaatagctgggactacaggcgcctgccaccacgcctggctaatttttttttttttttttttttttttttgagacggagtctcactctgtcgcccaggctggagtgcagtggcgcgatctctgctcactgcaagctccacctcccggattcacgccattctcctgcctcagcctcctgagtagctgggactgcaggcgcccgccaccacgcccggctaattttttgtattttttagtagagacggggtttcaccgtgttagccaggattgtctcgatctcctgaccttgcgatctgcccacattggcctcccaaagtgctgggattacaggcgtgagtcactgtgcctggccgattagaaacttttatacttccaaagacactatcaagaaagtgaaaagacaacccacaatgggaaaacatatttgtaaataatatatctggtaagggattaacatccagaatatatgaactcttacaacaacaaaattatccaatttaaaaatgggcaaaggattcatgaccagcttgacttaacatggtgaaacccctgtctctactaaaaatacaaaacatcagccaggtgtggtggcaggcgcctgtaatcactgctactcgggaggctgaacctgggaggcagaggttgcagtgagctgagatcatgccactgccctccagcctgggtgacagagttgtactccatctcaaaaaaaaaaaaaaaaattggcaaaaggacttgaatagacatttctccaagaaagatatacaagtggccagtaagcacatgaaaagatgcaaaataacaagtgttggtgaggatgcggggaaattggaacccttgtgcaacactggtaggaatgtaaaatggtacagctgctgtggaaaacagtttggcggttccagaaaaagttaaacacaggattaccatatgatccagcaattccactcctagatatatacccaaaagaattgaaagcaataattcaaacagatacttggacaccaatattcatagcagcgttattcacaatgtccaaaataaccaaggggtggaaacaacccaagtgtgcacgaacagatgaatgaacaaaatatgcatactacaatagaagagtattattccaccataaaaaggaaggaaattctaacatactgccttgtggatgaaccttgaaaacatgccaggtgaaataagctagacacatagggacaaatatatgattccactactatgaagtacctagaataggcaaattcattgagacagaaagtagaatagaggctgtggggtggggtgagaattgtttaatgggtacaaaggttttgtttgggatgatgaaaaattcctggaaaaggtgatggttgcataacattgtcagtatacttaatgccactgaattagataattaagaatggttggctgggcgcggtggctcatacctgtaatcccagcactttgggaggccgagacgggcggatcacctgaggtagggagttcgagagcagcctgaccaacttggagaaaccctgtctctactaaaagtacaaaattagccgggagtggtggtgcatgtctgtaatcccagctactcgggaggctgaggcaggagaatcgcttgaacccgggaggcagaggttacagtgagccaagattgcgccattggactccagcctgggcaacaagagtgaaacttgtctcaaaagaaaaaaaaaaaaaaagaggctgggcgcggtggctcacacctgtaatcccagcactttgggaggctgaggcaggcggatcacctgaagtcagaagttcgagactggcctggccaacatggtgaaactccatctctactaaaaatacaaaaattagccaggcatggtggcacacacctgtagtcccagctactcgggaggttgaggcacaagaattgcttgaggcccggcccagtggctcacgcctgtaatcccagcattttgggagaccaaggtgggcagatcacgaggtcaggagttcgagaccagcctggccagcatagtgaaaccccgtctctactaaaaatacaaaaattatccgggcgtggctgcgtgcatctatagtcctaactactcgggagactgaggcaggagaatcgcttgaacccaggaggcggaggctgcagtgagccgagattgtgccactgcactccagcctgggtgacagagcgagactccatctcaaaatttaaaaaaaaaaggatggttaaatggtaaatgtatattttaccacaatacaaaatgatctagaaaaaatatacaaaaattaaaattttaagtttattttaggccatgtgcagtggctcccgtctgtaatctcagcactttgggaggctgaggcgacaggctcactttagtccaaaagttcaggatcaggctgggcaacatagtgaggtcctgtatctacaaaaaatttgaaaattagctggatgtggtggtgcattcctgtagtcccagctggttggggctgagatgggaagattgcttaagcccaggaggtggaggctacagtaagctatgattgcaccactgcactcagcctgggcaacagaccgagaccttgtctcaagtaaaataaaatttattttgaaacagtctatccaatgtagttttaattctcatctttctctctctcttttttttttttcttgagatggagtctcgctctgtcactcaggctggagcgcagtggtacaatcatagctcactgtaacctagaactcctaggctcaagcagtcctttcgcctcagcctcctgagtagctgggactatagatgtacaccaccatgcccaactaatatgttgtggtggtgatggtggttttgtaaagacgggatcttgctatgttgtccaggctggtcttggcctcgagcaatcctcccactttcaccccgcaaagtgctgggattacaggatgagccatctcacctagcaaaattttcttttttttttttttttgactgagtctcgctctgtcgcccaagctggagtgcagtggtgcgatctcggctcattgcaacctccgccttctgggttcaagcgattctcctgtctcgccctcccgagtagctgggactacaggtgcgtgtcaccacacccagctgattttttttatttttagtagagacggggtttcaccatgttagccaggatggtctctatctctggaccttgtgatccgcctacctcaccctcccaaagtgctgggattacaggtgtgagccaccgcgcccggcaaaattttcatctttcattatgagtgagatagagcatcttttcagatacacatcattgatatttttatctgtgaattctgtttacttcctttccccatattttttcctagtttattgtcttttgacttggttaatgatgttttttatttttctgtttttttctccaagcaaaagtattttatttttatgtagttgaatttagtaatcttttctgtggcttctggatttggattataggtttccccatttcaagattataaagaaattattcagttattctatattttcttttatgatttcatttcttttttttttttttttttaagacagagtcttactctgtcacccagactggcagtggctcaccgcagcctccgcctcccgggttcaagcgattctcctgcctcagcctcccaagtagctgagattacaggcgtatgccaccacacccagctaatttttgtatttttggtagagatggggtttcaccatgttggccaggctggtctcgaattcctgacctcaagtgatctgcccacctcggcctcccagggtgccacccacgcctggcctatggtttcatttcttatgtttaaatctttgatctatttcaaatatatcctggtatatatgtgaagtatagtcataatatcttgcacatgtctaggtatttaacctttttgatgaattgtacttgggacctttctattttctaaacagtggttacattaatttgtacccagcatccttactgatttattatttataacaagtttttcagttgattctcttaggctttgcaggtatactctcatatcatttacaaataatggtaattttaccttctcctttccagcttttaacctcttttcttccttccctgtttaattgctttagctagtgtctttagaataatgttaagaatgctgttgataacggacattctaatgttgttcccgaccagaattggaatcctgttagtatagtagcattcttctgtggcatctagttttttctattttaaataaacatatattggttgctcttagaatgcttttttagtcattatttgttcaaaataattgttgagcgcctactgagtgctagggaatatggcagtgagctaagggtcccctcatttcctggagcccatattctagtaattttttaactcaccaaagaaacacagattaggccatgcacagtggtggacgcctgtaatcccagcactttggaaggctgaggtgggtggatcacttaagcccaggaatttgagaccagcctggcaatgtggtgaaaccccatctctacaaaaaatacaaaaatgagctgggcgtggtggtgcgtgcctgtggtcccaactactcaggaggctgaggtgggaggatggcttgagcttgggaggttgaggctgcagtgagccctgataatgccactgccctccagcctgggcaacagtgccagatccattctcaaaaaaaaaagaaaagaaatgcagatgaaatcagctttgagatcattattttacagttattgcggtaggagaaattttaatgaaagagctgctagtgtcggcaaggtgacagtgaagcaggggcaggggacgtggtgcaagacagggaggaggagcctcacccccggggatcctgcaagccgaatgagaccttggtgagcattttggtatttgatcctgagactgagggggagccactaaagggagtgagatgggtttgagtggctttgccttagaaagcactcacatttgggatttgggatgtagagactgaactggggaggtccaggtagaagtgaggagaacagccaggccacaaccaaggtgccccatgagggaagccagtggcatggaccagagagtgacatagggatggagagaggcaggttgcacttcagagatgtggagcagggatttaggaatccctgtatgggggcgggcctgagggcttccaaagaatagagtagggggagggaaaaatagaaagtttacagggtgagaaacctggcagacactgccttaaccagatgaccatggttaacatcaccagagctaagtcatggtggtatcatgtacttctttctctgataggatcagaagggcacctcacttctgttgtatgctcctccaaaaaaaccaaaaccctacgagaacacatcacctgggcctcttgcaccttttagaaagggcaaccttctgatccctccccatccttcttcctccactagtggtggtcgtggtgacaggactggccgctatggagccactgaccgctcgcaggatgatggtggggagaaccgcagccgagaccacgactaccgggacatggactaccgttcatatcctcgcgagtatggcagccaggagggcaagcatgactatgacgactcatctgaggagcagagtgcggaggtgaggagggggcgcgctgcgccaggcctggctgggatgggctcccaagggccctctgtgtctggctgcagcaccgtgtgcaggcagctctccactcccgtgccttcagactgtgctcggtggctttgcctcacctggagggcctgttcccactcccctctctgagggctcctctcccaacctgggtctccctggcttccacatgcttggctctgtacttctgagggcccctggccaccactctttccctttctccctgttgttcagttcgggcccatggctcactgtgaaccctgtactgcccgctcccagccaacttgggcacttgaagagcctcttccatgggacccggcgtctggggttgggaggacaacaaggggactgcagaccaccaagctgaggagctctgggaggccagccatgggcattcccagtggtgatagagcccctagacagaagggaaggacccttctggagaagccagtgccatgttgggtagttcaccctagcctgcgggatgaggcgcgatgtttacaccatcagggagcccccacccgaggggaagaaacaggcttgccttaggggaatcccagttggaggggcagtcagggacctggtccatgcgagcaggcagctctcctgtccagcaggctgggaagggagttcttgcaagcccagccctggggggcagtctgtgagctgcccactgccctctggagggtccagggcaaaaacccctttggtggactgccaggcttctccagtggcagctgtcaagctgtgcccagacgtctccaggagcactgggccctggccagggtgggaatggagcaccaagttatctggtgcttccccactgtgggcgggagggctttggccccaggcctgctctgcttagtcctggaatggatggattgggcaacagcccagagcccaacagccataccgttttgagcgtggtgtgtggtggaggactggccaaggctgaggatcagggactgaggagggagtgtctgcagccctcacaccacctccaccagctcctgctgcctggctctggctgagatctgaagctgttcttatgcccccagcttggttgcagggtggaaccgtaggagacatgcagccttcggtggtacagtgaagcaattgagcacaccccctgagctggccagagaggagaggaaaatcaagggtggggtctggtgtgctgaccccaggccatcttgccccaaggaggtttaagctgtgtcttgtcagctacctttgggagttccccccacaccaatactgtcacctacctctccccacccactgaaggcagcccccaaaaggaccccatggagaatttacagtcccagaaagattgcaggccggggcctgcccaccctgcctgcctgagcctttagccggagcccgcacatccctggctttcagagcctgcctgcctcacagagccagcggccagctcctaggcctgcccagactgactgcccgtctggtgtcactcatctcattctgtcggccaggattcctacgaggcctccccgggctccgagactcagcgtaggcggcggcggcggcacaggcacagccccaccggcccgccaggcttcccccgagacggcgactatcgggaccaggactatcggaccgagcaaggggaggaggaggaggaggaggaggatgaggaggaggaggagaaggccagtaacatcgtcatgctgaggatgctgccacaggcagccactgaggatgacgtacgtgccccccatggccccgggcaggaggccaggctgggtctcctccagggccctcaacttctccccacccctccctcacctgcaacctcagcgcctttcatcccttctccccctccagctcctatcccccagcactgatccgtcctctgtgggcaggtcccatcggccccccggtctggagggaggagtgtcagagaggccggcttggccaagggacattggccatgggtgtctggtagtggtgggtatgggcgggagaagagcagtcctgcacattccactggtcatccagccattttgcatgtgtgcatcatgggccagacgctcaccgggccagtgctggctattgctggtagcagagatgacactggggccctgtaaccattgggggagggatgggattttctgaaatttccttctctttttcccccatccttttttgtcagcagcctggcctggcctcagagccttgggtggctgctaacagcctccacgcctgcctccctttcctcctgtttccttttcatacatacttctcatgacagccacactgaagccccacgaggcctaccagaataacctccaagaatagtgtcctgatcttggtccttcttagtctactccgccgcccctcaccccctacccccatgaattctctgatcagccctcctctgaaatctgctagctgctcattttgtaacagagaaaatcccacttgtgtatttgagggtttctaaggtctggcccacctgccctgttcagggtcagacagtagctggttgctgacatttgttgagaatgtatctcagggtgggccatgtgttaggtatgattcagtccccatggcagcccagcagggaaggtactctttgtattccatccttcggatgaggaaaccaagccctgagtgggaatgtgacttgccccaggtctcatagccagtgagtggcagagcagagctggagtctgaacccgggcagctggaccctagagcccactttttgctgcttcctcagccttccctgagtttggagtcctgataagctcttctgtgtgtttttccttttcaccctgtgtatgggtgtgtgtaaggctaatgtcctgtctgttgtttaacctggtggggaaactgaggcccagagacatgaagactccttcccaagaatggctggcataggctcctggtcctcagtgagagacctcactggcctagagaccctgcctcacctgggccaaatcctgaattgcctctgcagtttccctctggcctactccatctgggaagcaatccccaggactacatctttttgctttttgtctccaccctaagttattgctacagtcatggtctagggcacatggctgggatttgctcagactcctgtcctccccagtttgacatttatgtcatggatctcttttgacgcaagctgcaggtcagcagggcaggggcgggggtgcgggttatccccttgccaagggcaagaattgcatcccaggtttccttacttcgtggctgccagcgagccctttgtcagatcaccctgcccaccgttcttaagtggctggctcacttgctctcttgttctctgtgcccctgagggtcgtcctgctgccatgctttaccttgctctgtgcccatttcttcatttgattcactttctgcaagtctggggctgaaagtcaagactgtgaactggtgtgggcctggggctgttgtcactcagggaaaagctgcgaaagaggcggaggagactgtgtgcacatcaccgatgacccctcgggatccagaggcctccagccagcctcaggtacccagcggccccattgtgctgagcctgccctactctgtatctccccgtatagatccgtggccagctgcagtcgcacggcgtgcaagcacgggaggttcggctgatgcggaacaaatcttcaggtgagcttttgttctagtgccctccccttcaagtggccagcctcagcctccgaatctccctcctgcctctgccttctcccccactccctccaccaccttcctgccacagctgggaatgggcagcgtggggggtgccctctcttctctcccactccccacactctcctcacagctccagccaaaagcctcttcaatggggctgtcggggcaggggtgcagctctgagctgagctgggtgctccctggggtcagggccagggccaggctcccaggcacctcctctctgggactctgagtatctgagatggtaaccccctcccatacactcccttccctctcctttcttctccttcctctgcccctcactttcccccacattttttggtaacagcctctgaccagaaagtagctctgacgtggtggtcccacatgtgtgtcccaagggggaagcaggggatggctcttatccaaggacacatcccaaggaacagccaggacttcctggcctcgcctgttccctccctccctccctcttgcaggctgcttggagctggcctgaggttagcagggtggtggtggggggagttgtctctacaggacctctgcccaggctccccaaggcaggcacagtggggcctcactctgcctgggcttctctctccatctctcagtctctcctccccacacctccatctctctctctctctctctctctctctctctctctctctctctctttctccctctctctctttctctctctctgccccccccaactatattattcattccatcctcctatgcatcctaacggttattcttttgaacattaagcatgcccccccaagcccctctcatccaagccctccccatgtatctgcctctaaaggacatgctatcctgaggcctcaaccctgaatccctttcccaagcctggaatcttggttgcatgtaggtcttgctctgcatcaccccaactacaccacacacggacagcttctgggtctctctctccacaaggaggtgttccaggtgcggccttctcaatggccctgggcgcttctcccaggcacccattgattcttacctctaaggtcctcctggccaatcctggccaccattctccttttgtccaggggaacctggactgtttgtggctgtagtctccaccctgtggccctgaggtggctccctagcgaggcccgcctcccctgcgctgcggtgaggctgagatgaggtcgtgtctttaaccgcccctggtttccaatgggccaagagccttcctagcctcgcagagcagcctggcccagcttctcttttgctcctgtgattcaacacctgttacaggacccctcctgggcacccctggccttgagctgggcccgccctggagttacgtattgtggcttgtgtggagccagcagcctgcccaccatcccctccctccttctttggaggcagatctctcgtattctttccctcccagctgcttctctccgtctctgtcaccccaggctggctgggcaggtctgcccgagccccatctctctcttcccagttggtgtgtgtgtctctccccctaccgacctctggcctctgtttttctccctccaccttccctgccccacctggccatctaccttgccccccacgcccgctagtctttctctctctgattgcctctttctctttcttcctttttcctcttcccctttccctctctgccccccgtcctctcccctcgggtcccgcccccgggaacgccgtgtgtccaaagctgttgactaacccactgcgtctgtatctgaatgctgtctccaggtcagagccggggcttcgccttcgtcgagtttagtcacttgcaggacgctacacgatggatggaagccaatcaggttgctttgccgcacttgaacccccccccaaacaaatactactttgtaatcgagcgctccccatcgcctgattcttatggacacagttccctgccctgtggccctgtgtcccatccccccgccccctctctccccttcctgaccctcactatctcctcttcccatctctcgctaccccactgggcttctcatccagagcccacactcaccactggccccttcctaccaccaggcactagtgctgccccttcacctctcccagctgagcgttcagagaaagagctgccagggtgggttctttcacctagcttcccactcccccggggctggtggggggggcacccctctctggggttagccagagccaggacctcattccaccctcaggaccactggaagtcctgccagtgaggagcttagctattggcacagtcactagcaagactcattttgtcagccccatccctgcatgtgaatttggccctttgattttcatgcaaggggacagcactgctctgttgatctcaagttcccgtcgagtatgatagttttatcgacaccctggcctcacttcgccgcccctacccttcctatcacatctccacactcgcaggaggcaccacctcaggcagctctgtcttctcggcaaggacctgtgcacagtcagccctggggggagcctgtcccccaagcctggcacgggatcccaactcagcagctttgggacctccgagacccaaagatctgcctggtcacccacccctgcccagatccctggtgtagggcactggagagcagtttcaggggaggaaggggcagaggtggtagaatgggggatcccggcagaggcagccctggggccgtctcctcggggttggtaggctagtgccatgggcccaggacccagccatccatgggaagacggcctcatggcagaaacttccatctgttcgaaatggctctttctttttccccttctccagcactagcgcacctgcgctctctttctctttttctcccctctccctccccctccctgtctcccctcaccccccaagtgtagcctgtgtagtcctggccctgggtgtggcctggcagtgtcagggccgagtgggggtttctccccactgtccggcaagcgtcggtcagccgaacactgtgtgcctggtggtgtgtgttcacatgtgtgcgtgcgtgtgcccggcagagcagcaaacagctgcgcccgagagctgtggcgctttccctccctacctcccttcttccctccatccgctctccgacctccctccgttccctgtccctcatccatccagctgaagggctcgctcactctcttctcctatgctgaaacggtgcgtggggcactgctgcctggacctcactgtgctctgctttttcccgcagcactccctcaacatcctgggccagaaggtgtcgatgcactacagtgaccccaagcccaagatcaatgaggactggctgtgcaataaggtacaggggcggtgggcagcagttgtcatggacagagacagcaacagcagtggcggcgatctctcccttcctctcccgctctttctccctccatctctccccctcccccaatctctcctctccctctgtctctctctctctctctctctctctctctcattctctatcccttgctagctcagcttgagtagtcaccattcctagccagccatatacaaatgtgtagtgagcgttcacttggtgcaggctctgtcctcctaaaatgcagtcttgcctggagttccagtagactttaaggaaatatatacgtggatgatgaattagtgacagtgtagacttgaagtggtggtgtggagaatgtgggcttcagagccagactggctgaaatgagactatcccagatcggccttgattttggccaaggtgcttagcctctctttgcctcactttccccatctctaaaatgtgaatattaatgacacctctcccaaaaggtggttgggaggattcagctgtgttaatgagagagtaacactcagaacagtgcctggcccacatttaacacagtcgaattgttaactgtaatcatgaaagaaaagcacagagcgttctgagagcccatagcaggtagctcaagcctgaaggccactctgaccaggccaagtcaaacctgaaactggaggctgtggttttgtagtcacctctgtcttccctgaggggaagctgaggctcagagaggtggaaccatgggtgaacctttagctgtgccctgtgccttgctcctgatcacagggacttggatgccacagtggcttcaggtctgccctggggccagcattgtgattccacagtttgtagaggccccaaccctctccccaggaagtactctgcctagtcagggagagtggtgcatctgttttaaaaaaaaaagtcccatcagaggattggtgcttaacatttctggagagataaagacaaagtgacagtggaactccttcctgtgtttccagatagcctcaaaaccagggaattctcttttttttttttttgagacaggatctggctctgtcgcccaggctggagtgcagcaatctgggctcactgcaacctctgtctccagcgctcaagccatcagcctccagagtagctgggaccacaggcgcatgccaccacacccactaatttttgcctttttatttttattttttttggtagagacagggtttcgtcatgtttgccaggctggtcttgaactcctgagctcaagcagtcctcacgcctcagcctcccaaagtgctgggattacaggcgtgagccaccacgcccagcccaaaaccagggaattctcttgaactccttcccctcccctgcatcctgttggccaccaggtcctgtcacttccatcacagaaacgccaccttccctccctcgccattcccgctgctcatgccaatcgtcacgctctcacccactcactgtggagccctctctggtatgctggcctcttgtcctctttctcccacgccctcacctggaacattcctcaaaaccacctctgactacccacgcctctcctcctctgcttaaccagccccagctcagcttaagcataagatcctccattacctaactggcttccttccccggccttggcttttgcttctccccttactctcccacaccagtttcggaaagtccattgttccctccgataacaatccctccccagcaaggcttaacaaaatgaaacttctgggcatcccaggtcaaacctccctgcttctgtgcagggactgtccctgccgagtaaatggcaccccacccccagcccatttccctccccgagcccctgctggatggtccatgcagaccgacctgcccctcttcatgctgcatctgcccctgtgctattaggccatgagggcagagaccatgttctggccatgtgcagcagggcctggcccaggagtggtgcttagtacctgagtctggaacagagatggagtgtggtagaagctgggtctccagatgctggaacattcaaggaaaatttctcaagcgtagcaggatccaacccagtcctagagctaagaggaggggtgcgggtctggctactgacttctagggctgaaacactgaaaggtttctgaatagaggagcaagtttcagggagaggaacctaataaagggattgaatacctgaggcggggaacagtcctgggagttggtggccttaagaaggcagaggaaggagaggagggagttgttgtaccaaatgggggagttgtttattcctgagctgagtgggttggcacagaggacaaatgagagtctggaaagggaagatgcacagtactgagaacaacatcagaaggttcagaaggcacctgccaccattgcctaggggctttccttcctggggcactgcggggtccctgggagatctcttcatccaagtttggagggtgcagtgggaaatccctgctccctctgacggcctggcctgtgcctcacagtgtggcgtccagaacttcaaacgccgagagaagtgcttcaaatgtggcgtgcccaagtcaggtgaggcccacctacctctcgtgctctccagggcggagcggttggggagaagggaagggtgaggggtctgtgctcagggcttggtatagggaggagggtgaccagtcgtggagccttccccttatcaccagcctgtctcccactgcccctgacagaggcagagcagaagctgcccctcggcacgaggctggatcagcagacactgccactgggtggccgggagctgagccagggcctgcttcccctgccgcagccctaccaggcccagggagtcctggcctcccaagccctgtcacagggctcggagccaagctcagagaacgccaatgacagtgagtcagttgttccttcttcctctgtgccctagggtgtcgggctgggctcaccaagaccagagaaatggcagtgagcaggacctcatcctcatggaatctccacttggtgcggggatagacatttgatgtagggagaacagggggagtggcaacatcccacctgactttgggggtgtgtcgggaaggttctcagcagacaggcagccaggctggcacctggaccgccaagcagagttgatcctggaggaagcagtgagggaagcggcagttgcaaaggcacggagtgagtgggggcagaggaaagggagcagtgggggcattgaagggcagggctggcaagagtgccaggggtgtcctctaacattgggccccttcccacagccatcattttgcgcaacctgaacccacacagcaccatggattccatcctgggggccctggcaccctacgcggtgctgtcctcctccaacgtgcgcgtcataaaggacaagcagacccaactgaaccgcggctttgccttcatccagctctccaccatcgtggtgagggcggcacagttgggggccgggcagccagggtcccggcccccggggtggagacgagggtccttttccccagcctcccaccgcggctgccagcctggaaatcgggcaatggagccgggggcctccccgggcctgacccttctgtccctgcctcccctcctcccacaggaggcagcccagctgctgcagatcctgcaggccctgcacccaccactcactatcgacggcaagaccatcaatgttgagtttgccaagggttctaagaggtcagggccccacctgtgtgccttcccacccttcccctccccaccctcccactcccccctaccgcttggggcctcctatctcactcccagtctctaacatcctcctcagggacatggcctccaatgaaggcagtcgcatcagtgctgcctctgtggccagcactgccattgctgcggcccagtgggccatctcacaggtactcagaccccttgtgcctcccagcgtcctgagacctgggctttctcaaccctcctgcaccctctctgaagcaggaaggctggcttgctatccatggatgcaaaaccctctcccagtagctggcatggctattctaccttgctcctggctctctagaccccctgggacattccccttcatcatcaccgcagctttcttcccaattgcctcccatgcgctcatgtacgacgccattgtgcctggcattctgtgctgtttggtggggtttttattgtcctgaataggtatgatatacacatatccttatatgtaatatatacatatatgatatacacgtatcatatgttcctgaataaaaataacgtataagtggttgagagaaaattgggagaagagaataaagaagtaagaagatggtgtcttccttggcctgacacccaacacacacgccacacacagcagaatcagcagaatcagccctggaacattttggcgttcatctgtttttctgtcttgtgtttgccactggcctatttgttctcttgtggccaggcaaccctcgctttccacttgtcttaaggctgcatgctttgtctgtcaggtagaaatactagccccacgtgtgggacagatgcttctagcaggttccccaccccccacccccacaccttcctgttctaatgaacccctcccacctgcccttcaggcctcccaaggtggggagggtacctgggccacctccgaggagccgccggtcgactacagctactaccaacaggatgagggctatggcaacagccagggcacagagtcttccctctatgcccatggctacctcaagggcaccaagggccctggcatcactggaaccaaaggggatcccactggagcaggtgagccccagcatctctctctgcagctgtggtgggggccagcaggcataaagtccccggccccattattcacaggcattgtccctgccctgtccctccttacaggtcccgaggcctccctagagcctggggccgactctgtgtcgatgcaggctttctctcgcgcccagcctggtgctgctcctggcatctaccaacaatcagccgaggcgagcagtagccagggcactgctgccaacagccaggtgagtgagccctgtgggtatgtatcccggggaggcaggcaggcggcaggggtggcatgggcagacactgagccctgttctcctgtctggccccatgaccagtcgtataccatcatgtcacccgctgtgctcaaatctgagctccagagccctacccatcctagttctgctctcccaccggctaccagccccactgcccaggaatcctacagccagtaccgtgagtagccacagcctgtgggtaggggtggggagttcttaataaagcagggaatagtgtgaccccgttcccctcaccccctagctgttcccgacgtctctacctaccagtacgatgagacctccggctactactatgacccccagaccggcctctactatgaccccaactcccaggtaatagggcagcccagggagggatgggatcgggtcaggtcgcgtcaggaacagctagccctgcaggttcccttcacaaggtcttccctcacatcccctcttccctcctcctccctcagtattactacaatgctcagagccagcagtacctgtactgggatggggagaggcggacctatgttcccgccctggagcagtcggccgacggacataaggagacaggggcaccctcgaaggagggcaaagagaagaaggagaagcacaagaccaagacagctcaacaggtgaacaccagggtccagcagtcactggctggctgtgtggtgtcttccagcaacggcactctgtcagctcttgccctctcctgccaagggagatggcgggcaggtgtggatgtgggcagtgactgcttagcagaccatgctcttgccccagctctgctctttgctgaatggccttgagccagagcagtctcctcagtgtgtggcagggttgcccaactccaggaggtggcttgtgccatccgagtgagccctgtcaggtgtcttctgtcccatggtggggaccctcacattctgctggtgaatatacatgtatgccagagaaattctcacaggccataagggggtgggcaggaaaaaagccctgcaatgttttgtgggagtgggcagatggagggcacctcagtgtctctctgtggagaaagggtgtgacactgtgagcgtagcgtttacaagcaagcactaagtgttaccttagcaacctgatgaattctaaaaatggtgctgtgctggggggaacatggaaatatagaatgtggcattgtgtcatgcatataaagttatacacaaataaacattcctatgcatttttaaatgataaaatggaaatgcacaacaaatgtgacagcgtgggtgtatgtcaggggaagaggagtgtcttcatccatttgctgctccataacaataccacagactgggtaatttataaggaaaagagattgatttggctcacagttctgtaggcagggaagcccagtggtgttggcatctggtgagggccttcttgccgcatcataacatggcaaagggcaagagagcatgcatgagagcaagagaaaattgggccaaactccccctttttatctggaacccactcagtgatggcattaaatggagactcaaaaggtggaggggggccgggagccgtggctcatgcctgtaatcccagcagtttgggaggctggggtgggcagatcacctgaggtcaggagtttgagaccagcctggccaacatggcgaaaccccgtctctactaaaaatacaaaaattagccaggcgtggtggcaggcgcctgtaatcccggctactcaggaagctgaggcaggagaatcacttgaacccaggaggcggaggttgcagtgagctgagatcgtgccattgcactccagcctgggcaacaagaacgagactccttctcaaaatatatatatattatatatatataaaggtggaggagatgggagggggtgaaggatgaaaaattacttaatgggtatgatgtacattatttggctgatggatgctctaagaaccctgacttcagcactatacaatctgtgcatgtaacaaaagcacttgtttattttatttatttatttattatttttttgagatggagtttcgctcttatcatccaggctggagtgcagtggtgcaatctcggatcactgcagcctccacctcctgggttcaagcaattctcctccctcagcctcccgagtagctgggattacaggcatccgccaccatgcccagctaatttttttgtaattttagtagagacgggttttcgccatgttggccaggctggtctcaaactcctgacctcaggtgatgtgtctgtctcggcctcccaaagtgctgggattataggcatgagctaccgcgcctggctacaaaagcacttgttaccccataaacttatacaatttctttaaaaagcagccgcgatctcttgaggagggcagagcctttgtgacctaatcacctctgaaaggccctgcctgtcaacactgttgcatcagggattaaatttatcttttgagatggagtttcactcttgttgcctgggctggagtgcaatggtgcaatctcagcacactgcagcctccgcctcccgggttcaaggaattctcctgcctcagccttccaagtagctgggattacaggcatccaccaccacgcccagctaattttgtatttttttagtagagctggggtttcactgtgttagccaggctggtctcaaactcctgacctcaagtgatccacccgccttggcctcccaaagtgctgggattacaggtgtgagccactgcactcagccgggataaaggctccacctgtgaacactgttgcattagggattacatttctgacacatgaactttgagggacaaaaaacatagcagagaacacagccagagaggggcttggcaagaagcactggtgactggtgacagaaaataggaacttgcactactgtgtccctcaccttctgattgttctgcctcagcttccactcatctgcctcccagatgggcccgccactctgtccacactgcttctgccacctcaccattgcaaaccagtgggggtgggggcacagggtgtgttcagtgatgaggtcaggagtagccaggtgccaagtgccttgcaggctgtggttgcgagtttgggtttattcttggtgtgatgggaggcgaaggaagggttttaaggacattgtatttgggggtgggagtggcttatacttcatgaaagagcgctctgctgggaaaggtggtcaggagccgtagcccagaggccagatgaagccttctgcagtggttcggactagggatagtggctggcccgtgtttgaggatgcagggcagtgggtcagcagatagagttagtagccccagggtcatgagggttctgggaacctcacctccaccctcacccccagattgccaaggacatggaacgctgggcccgcagtctcaacaaacaaaaagaaaacttcaaaaatagcttccagcctatcagctccctgcgagatgacgagaggcgggagtcagccactgcagatgctggctatgccatcctcgagaagaaggtgtgttggggccacccccctgcaccctgccccacaatcttgtccttcctttgggccctctgtggagtccctgaatttctgtgtccctccaccccagggagcactagccgagagacagcacaccagcatggatctcccgaaattggccagtgacgaccgcccagtgagtgcccaaggcagagaggggcgggggctctgatctggccaggcctgaccgcccaccctcaccctctacagagccctccgcgaggactggtggcagcctacagcggggagagtgacagtgaggaggagcaggagcgtgggggccctgagcgggaggagaagctcaccgactggcagaagctggcctgtctgctctgccgacgccagttccccagcaaagaggcgctcatccggcaccagcagctctcagggctccacaaggtaacagcggatggttggcagggcatgctggggcctggcccactgaggctcatcctcttcacttctcatcctgtccctcttgcagcaaaaccttgagattcaccggcgagcccacttgtcagaaaacgagctagaagcactagagaagaatgacatggaggtgaggtgtgacctgaccctgggctccctcccctgtgtcccttccaagtccccatcacctcaggcagctggagttcaatttctcacgtgttaaccccgtgagccttcttccccattttcctatcctggctgcttgtgcctgtgatggcctgaccctcaggacctgagcctcattagccagatggcatgccctgtgggaccccactccccatgcctgtgttgcctgagaaaagagaccagctccccaacattcacatacacatacaaactttcagcaaatgaagtaccgggaccgtgcagctgaacgcagagaaaagtatggcatccccgagccgccagagcccaagaggaggaagtacggcggcatatccacagcctctgtgtgagtggctgggccaggtgagggggtctggagcccggggccggggccggcaggccgaccactcatgctgtgcaccgcccctgcagagacttcgagcagcctactcgggacgggctgggcagtgacaacattggcagtcggatgctgcaggccatgggctggaaagagggcagcggcctgggccgcaagaagcagggcattgtaacgcctatcgaggtgagtctcaggcagtcctgtcccatcccccagcacccctcacagcatcccccaccagcctgacagagcctgcctccctcacacaggcccaaacacgggtgcggggctccggcctgggtgcacggggcagctcctacggggtcacctcaaccgagtcctacaaggagacactgcacaagacaatggtgacccgcttcaacgaggcccagtgagcagcttcaagagcaacttctccacatgttgggtgtccatcctggggcagggaaggacagagtgttggatggctgggacggggccttgctcttgtcggccagcccactccccagccagagagggcttgaccaaatcaaattgaggtggtgacttttgttggaaaattgggctgggatcacgtcctgttttgtaataaaagctgaaaagtctgcatgttggcctctcc

SEQ ID NO: 197 - DNA, 41919 bp, mus musculus; identical to SEQ ID NO: 196

SEQ ID NO: 198 - DNA, 77022 bp, mus musculus
ggttatttaaagaagggggggcctgagcgaaggggttggaagcggagtgattccccacccctgctccatctagctctttccagtgcagccactgccgccgcccaggagccctcgtcccctgccttgtccccctactcgttcccgctcccacggcatggagcaggacactgccgcagtggcagccaccgtggcagccgcggatgcgaccgccactatcgtggtcatagaggacgagcagcccgggccgtccacctctcaggaggagggagcggccgccgcggccaccgaagccaccgcggccacggagaagggcgagaagaagaaggaggtaaataggaagggggtgtgtgtgtggtggacaaatcctgtgcctggcccctctgaggggcccaaaccctgacctttcggcgccgacaggtacccgcggagctttgcggggctaggggcggcgggtgcgggggtcggcggcggaaccgcctggcgttcgctcccctccccctttccttctcgccgcctggaggacgggggcggggctgggcgcgggcgggagcggcgcggggtggaggggtgcccgctctcccggggcctgggggctcgggagcccctcgacagcccccgaccccctccaccttcccggaactcgggtaacggggtgggggatggggctgtgcaggaaaaagcctccgcctctccctctcctctcgctcgctccctctccccccgccttcccgtcggcctctgcctgggaaatctgggcccttcaatcccacactcgcgctaaaggggttttgctggggctttttttgtaatttgaatttcaaggtgctggtggttgctgggtggagggtgacagggaagacatttctttctttcattggcaatgtcggtcttttggatggcaggaaaaaaaccatcccttgttcgtttgaaccccgcctgccgaggtgggggtgtcaccccgaggaaaggagctctctgcgtcgtacccccccgcccccccaaactgaggaaccgtggacgctggcttaggaaaatttccaacatctgcaccctcaccctcttctgccccgcccccgacggtatagggtttcactccagggccaccccaatggtccctcaatccggccccaagctttccaggcttccgcctccctctcctagtgggcgctgctggctcctggacacacacaggttttttttttttttctcctttaatttttaaaaaactcagcgtcgccaagatgagctgcttctaacgtaagggaactgctctgacacatattaaagccaatccagaaaatatgtattatctccataaggcacatttcgtgtggcccgagacatgcaaataaaactataaaacgttgaaaaattgacataaaaataggatggggcataagcatttttgatgtatgataaaattgcataactaatggtttatgtgtggattttttcctatttacgagtagtcatatcgcaattttaaaaaggtgggtaattatgctttagagatctcaagtggctttgtctgaatcattatatgatactatacgaccaaatgaaaagcttttgaggaaaatgaacacctttcgccttaaatgagaagagtaattttaaatttagcagttgcttctgtgacatattttactattacaaggttgactaaacagaaggacaattgtagtgctaaatgaaaaccgtagaaaacatacacattgtaagatctacgcggtacttggattagtaagacaatattgttggttaaaagtgggtgtaataccaagcatcaatataaatcaaatgttgtgaaattcggaaatgtctgtgtgccttttattccctggactgggcaaatgtgagtgccaaactgccttttgtatggcaggagaggttgtcgaatttccagattgtataaatttttgaattttgtataaaattttgtattgtgaaaaaacgggagaccaataaaaaagctatataatataaacactgagttgatgcctacatatttgtcaactcttgcctcattagaaattgccctaccagtacttcatttgtccacccaggacagggaaatgaggtgctgtatgtcaggaacttcctggatatccatttttatttttaatttttccttaaaaaatgaaatacattacatactaccttgacactttaaattgcatactaaaagtgcagattaacctcttcttcatggccatcagttagtgtactttgacagtgacacaaaggcacctgaaatcccgcaggttgttccctctcaattaagtaaccacctaccagactcttgcagtgttgtgttgatttttaaaaataatttttccagccgggcgcggtggctcgcgcctgtaatcctagcactttgggaggccgaggcgggtagatcacttgaggtcaggagttcgaaaccagcctggccaatatggtgaaaccccgtctctactaaaaataccaaaaaaaaaaaattagccaagtgtggtggcaggcacctgtaatcccagctacttgggaggctgaggcaggagaatcgcttgaacccggaaggctcaggttgcagtgagccgagatcccaccactgcactccaacctgagcaacagagtgagactccgtctcaaaataaataaataaataaaaattttctgtcttcttccttaattgccaggctgttagcgatcactttttaaacacctctagtttcaccagaaataatatgttagtttatgataaagattataggtgtaacaaaaccataaactcatttgaaaaccactgtaaaatacaaaagtgtcagtgataaaacagggagagggaaataatgacacgtgcacaccaagaatcagtgatgctactgcagtggaagacattttcgtccttggtttctgccgtgtcttcttgtagagtgccttcatctagtgatctttccatgtcatttactgttgcttgtattctcggtgacatgggaagccagattttcaaacttggtggaattgtctaccaaataaaaagaaaataggtttctgaatgagagcgctttcatgatgaatacagtagatgagaattagtgaattgacctgtgacatttacctactcaaaggtgtttttgcttactttctggttgttgaatttagttggtttaagtgacggttggattacccaacactgtagacatgaaaacgtcaagaaaaaggtcatggtctttaaaacaagccattttgttgaccttgtgctgcattctcatggcacctagactcagataacaaaatccaaaggaattcattagagtctcttagtcacttttcatcttttcttgtatgaaaaaaatgtagttttgagaatacacacacacacacacacacacacacacacacacgagagaaggtttagaaggtaggtattttaaaatttgttgtggaagatagtgccaattaagtaattacccacagcttttaatagccctgctcaagattaggattttaattagcatataattagattttgatggtagtctaccgcaaggtaagcaaaaaagtaatgggtaaaatgtttttctaggattaaagctttaattttctgtaagtgtacttcccacattattatatatatttgtgcgtatgaggcaaagtaattttcattgttttgatactggaaaactgcacttcatataacctttcaaggaatgaatgataaacgtatggatttgatacccaatttttcttgttgctttgaaaataaatatgatttatattatatatggcagtctgaaagtgtgagtttgaggggctctttagcagttttctattctcatccatccaggattacattcaaaacattccatatagatgtgtacgtatcagatgctgtaaatcaagatggttattatttgggttagtgtaactgaatgatatctgatcagtgctacaaagtaagagtctggacaaggtcaaattccataatctcagtttggatttcctcaaaatagaaattttagtaaatattggaagacataatgggggccatatttttcttatgtttaaggtcacattctgttgatttttgacctaagttttcataaataggttgacaaaagccatgatagttttcacgaacaaatttgtgttttctcttatgcaaagtatgtgttaaaactgaaatgctctcatctttggttctggtgggtagatttgtgtttttattattttatttcttggtttcttatagggaaggaggcttattctatatatgtatttatatttgccagtacaggcttgtctttacaaaggatagggtgcatgagataacccccttccccagataatctctatattaagttattgattgatgttagttttcgctaaattacaatttaaaaatatcaaacattaatagttaagtagccttgacaaattgcttctacaagatgtttatgcaatataaatagtttaaagtagttttcttcccagttagagaaaattaacataagccaaaagtttaaaactgtactattatattaagtatatgtgatcacattgcattacataaaaaattaaatattcttataatactatgaaaacaattttaaaaatatcgttttaggaacagaaaccacagtttttttttctgaaagtgtggcgtatttccatgacataaaggagtgtttcttagaattaatatttactttctttgaattatttggtttgtggttgatattagccttttctagattttaaaatctcttatttaatgtttacacattttcttacactataaattaaagaatggatgagaaagctcagtgtcttgccttttgggttttattccaattaatatttctttggcattcacaatttttcagattttttttattggacctcaggtgtacagaactggattaatcataagccttgttttgtgacatgctctcatcattggtccatacatgtcccacattgatttatatatttagttatgtaattactttccgccttcttctaatgagagcattgaccagtttaagaaccttgctttgcaatttggtgacatttattttctttgaaattctagaaaaacgtttcttcatttcaactcaaacttgctgctaaagcgcctaaatctgaaaaggaaatggacccagaatatgaagagaaaatggtaaatgtagtcttggataggatagtgaatgctgtaattaatttttatagttgagatgttaaagatgaaaaaatacatgtatatatataatgcatagagaatcattgattttagaattggaaaataatttaatatacaatctatcacaatattttctgttgaataaattaacctcctcattttcagatgaggaaataaaggatcagggaagctatatgtcatagttaggactagaagtcacatctcattttggttcggtgctctctgtcccataataaagtgctttaagctagaaatatttatttatgaggtgaaaatatcagtggtaataccactgtggctttgtgacctgagagaaatccagtcacaaagccagattgacgtatttttgtttctttctccttctttggacatatgaataaatgctacacattaatgaaatgtgtaatatgtcaatacactttaaagggaagaatatttgtccaatgcatgaagatatcacatatttaagcagcataatcttagttatacttacatattgcttgctataatacatttaattatttaatttttagttactaaaatacatattttagctttaattttaactaaactcttataaccttggatctttcaagaatttaacaggtggttgaaatggatttttttttcctctgaggggttgtttttgcagtaatattataaaaataagtatagatgaaatatattttttggttgttgatagctattttataagacttaatgtttaaggccacatctaatgtaggtaggcaatgttttaacaactctaaaaataacattccagtgaggataatataaaatggaaagtttttggcctccttccagcttgtagtctgaatttatctaactcttatgtttatgttaatgaactcttctgtaagttttctgggttattaattatgcatccttcattagcaatcaagtattctctactctgtggttggaaagtgactttgaataaataaatagtctttattttttcctttatctagaatgatgtatatatcttttgatcttttaagatttttttagtgaaacaaagttttattgcctgtatatggtacacgttccctgaccttttacaatttattgagaaattagaatacatatcaacttttaatagttaataaactatttcacatatatgtgcatatgtttatatatttttcccaaattctgcttactttggggagaaagtttatacgctactagcacaaaatacagttttctagatccctgtgagtgaagagaggagtgtttattacattactataccatgacactgaaaatattttgagacaagatgatactgtattttaagatttaagttatttctggatacaacttggaaattcttaagagttcagtttatggtatatatatcatagttaatttatatttcaatatttgggatatgttatatatttgatgcttaattttgttactattttatttaataaaatgatgttttggaaagaggatttgctttatgattatgactctttaagaagggtatttcttattggggaatttactgtctgtcagataatttttcttcccttcaaactatttgaaaatacattttcaaattctgctgcttattagctgtgcaaggttgggcaaattacttaccctctctgtgcttcagtatcatgtagttacaatggagatgatacttgtaattacgtcataggtttcttaagagaattgaatggattaatgtttcaagtgctaagaatgttgttcaaagtaagtatttgttaaataactttgaaggaatgaaaaggaaagtccttacttttcttttgttttgcaaattagaaagccgaccgagcaaagagatttgaatttttactgaagcagacagaactttttgcacatttcattcagccttcagcacagaaatctccaacatctccactgaacatgaaattgggacgtccccgaataaagaaagatgaaaagcagagcttaatttctgctggagagtatgttggcacctctctctctactttctttcctttctcctaccttttcttcctcctgtcctcccttgatcccttcatgcaccccttcgctcttcattgttcagtataccttcatgtgacaaaaaatattgccattataattatgttttgaagacaactatatttttttctcactagaggctgatcagtaaaaatgtaggctggttctactgatttctaagcaagaccttggacaactcattctttttctataaaagataatagccatgtacactgatttaattgataccttatcatttaggtcgaatatgaagggatttccttttttaatttcagctaccgccataggcgcacagagcaagaagaagatgaagagctactgtctgagagtcggaaaacatctaatgtgtgtattagatttgaggtgtcaccttcatgtaagtacttcatcacattggtgagttctttttcaatttagttttagaaaaattttacttgagtatgttaatgaaagtatgaaatgtccttgcattttttcaccagatgtgaaaggggggccactgagagattatcagattcgaggactgaattggttgatctctttatatgaaaatggagtcaatggcattttggctgatgaaatggtaaggaattggtagctaaaaacacattctcagttatcaatgatttttatgtaaatttgaaaaacctgagcttacctgcccccctgatgcctggaggctttttaaaagttgttatcatgtaaaaggtattttgtagtcttagaattattattatttttttgagagaggatctctttgtgtttccaggcttgagtgcagtggtgcaatctcggctcactgtaccctcgacttcctgggttcaagcgatcctcctgcctcagcctcctgagtagctgcgactccaggcacgtgcccaccacactgggctaatttttatttttatttttagtagagacaggtctcgccacgtcacccacactgattttgaactcctgggctcaagcagtcctcccacctcgacctcccgaagtgttgggattacaggtgtgagccacagcacccagctagaattgtttcgttaagtcaccgctagaacacagactttcacaggccataaaactcttactgagctttcctcaaatggtccaaaaaccttctctgtacttttgtttttgtttgcattttggcttccaggaagcacagagtcaagatggatgcccaaatgatgcctttatgtaactttttttttaaaattttttgagatggagtctcgctctgtcacccagactggagtgcagtggcacgatctcagctcactgccacctccacctcccaggttcaagcaattctctgtctcagtctcctgaatagctggggttacaggcgcctgccaccacgtccggctaatttttttgtatttttagtagagatggggtttcaccgttttggccaggctggtcttgaactcctgaccttgtgatccacctgcttcggcctcccagagtgctgggattacaggtgtgagccacccccaccctggccttatgtaacctttaatggtctgccctgtgtgtccttctgtcttttcctattctttatctacttgtctttcttactttccttgtcgtctctttatttctattttgccattaatttatgttccatgttttcattgtaggctacctgaaatccttttgggaataaggtggggtatacaaaccaaacaatatgtaaatgactgcctgaatatatgcatgtgtgaatgattatcaatattttgacttgtgaacaatcaaaaagtgcataggtggaataaggaacgaataaagagtaatgttgaatcttgatacagtacagtgcatggtggggctttggaaatcagtgaaggagttataaatgtgtaaataaaataactgaacaggaaaaagtaaggcatataagatgctaattcatcagctaaagggggaatacatgaaggcttttttttttttgagacggagtctcgctctgtcgcccaggctggagtgcagtggcatgatctcggctcactgcaatctcctccttctgggttcatgccattctcctgcctcagcctcccgagtagctgggactacaggcgcccgccaccgcgcccagctaattttttgtatttttttagtagagacggggtttcacgatggtctcgatctcctgacctcgtgatcctcccgccttggcctcccaaagtgctgggattacaggcgtgagccactgtgcctggccccatatttgtattttaagaccaaattaataaaatgcgatttaagagagggcagggaaagttctaaatccatataactcaatgatactcatatttatgtgactctgaaaccatacttgtaatcactattatccagaagagccacatgatgatacgtgccctatggcgtctagtatagttggtagtcagtcgcataagtactcatccctggttgagcaactgttaggtgtgtggcagaggatcccttaaagcaagggtctgtagctccttatatttaggtattctagtttgaagactgttgtcagctcagagggggaggagcttggttaattggacaatggaaggaccaggattatttgccccaagcagctcttggcttcagcctgtctaaacatgaaggatctgatctttagtgatgaatttgtgctgatatcagatatatgtattatatatataatatataatatataaatatatataatatatacttactttttttaatatatatatataatttttttttgagatggagttttgctcttgttgtccaggctggagtgcaatggcgtgatcattgcttactgcaacctccacctcccgggttcaagcggttctcctcccccagcctcccaggtagctgggattacaggcgcccaccaccacgcctggctaattttgtatttttagtagagatggggtttcaccatgttggtcaggctgttctcaaactcctgacttcaggtgatccatctgcctcggtctcccaaagtgctgggattacaggtgtgagccactgcacccagccgataccagatatgttttaattactaaaaaatagacacttttaaggagtatagaaaatttggaaaaaaatgaataattaaaattaagttataattctgctacttagaagtaaccacagctaacattttggcatatttcattttagtctttttcttctggatgtacttattttgtatagttgaaatcatattgtatatataatttggcattctgatttatttacattcatacatatgttccatgtaattaagacattttccgaacataattaattattgcataataatccttgggcggtaccataattttattcaacttctctcttattgctgttcatttggattgcccgatgtgtagtgtaaataatgccactataagactcttgtaatttagtttttgtgcacctctcagattatttccgtaggattcctagaagtagaattactgggttaaggagtataaacattttaaggttttgatgtatagtattcataaaagttgtctcattaagtgacatatcagataggatacaataaaaaaatagctttaagcagacatttataaaaagaagtatatatcttgctcagagataaaaccgaaagcagttttaagaggccgaaaaaggacttagttccctttcttatgggttaggtatgggttcatagatattgaatatattattttttaaaaagtcctctggagttggtgatctctctcaggttctttctggctgcaaagttctgttttgtggttcctaaggttcttaagagtgtgagatgcaagtacagagccacaagccccttgagacacatagtctgaatatttaatatctgggctgtaataatgttaggaacaataggaaagaaagaccagtatctaagcaggctggcaaaggaagcgggtctttataaaacaaacacacagaaaattcctaacttcagaacaagaagaaaaattatatagtagattgcttgctcctttaggaggaaaatgttctaaatagaaagttgctttgttgagcaacattctgactgcaagttattggtttctgtttgtgctcacggtaagtacaatactgaattggaatgatttggttatcttctttaaaaaaaggtatttggtatttttacttttcattggtagaaacataattgcctttgcgagatagtggacaaagatcttttgttatgttgttcctaacaaaatgtttccttacagaaaaaatgttcatggatttttttccttgtgatgataatgcagggccttgggaaaactttacaaacaattgctttgcttggttacctgaaacactaccgaaatattcctggacctcacatggttttagttccaaagtctactttacacaactggatgaatgaatttaaacgatgggtcccatctctccgtgtcatttgttttgtcggagacaaggatgccagagtaagtgagaaacaagtgtaaaaaggcagttaagaataatatcatttctggagtttagttacatattattgctgttaaaaacatctgagttgactactactaaataagacttaaggtgtatgtactctaagctagactctgttttaagtgctttgcatctattaatttaattctcacaacactcccatgaggtagatatatcacctattaataatagacaatccattattatgcttcatctacatttgctttagttcattaacctaagcatttttgaattgtactttgagtgacttttcattaaaaacatcttattttattgacagtatatcttaccagtgactctcatttgtgctattttgaagccaacaatatataaatttgcattacttaaaattttatatttaagtttttgacttttgacttggtgtacacacacgcatatgcatgtacacaactggaacctcttctatatgtacagagagcctcgtgttttgtgtttatgcatagacgcagctttcagttttggtgtttgaatagaaaaatacatgtctgtatatattctcaggtaatattagaaactgggcattttaggggggtgtttaaatcagccatttgtcagtctagtaggctacaatcattttaggactgtagaattaatctaaaaataatatattatgtaaaaatactaaaacagataatctgcttagaaagcttattattaaactttgtctttatttgcctccagagaacacagtttagagatgtattcagttttccatatttagataggttatctaaagatatcctcaaaagaatggtagtgcaatgaattacataattttatccttatcattttgcttgaagaaaaattacttaaatttatttaaatttaacttacaaataatttaaatattgaaatactgagctcataagtttacaattacaggccagattcttccctatgcctaatatttccctaaagcaaattagtcacttagaactctttctggtcaccattgttatctaatgtaataccactccatataaactttgcatttctaaagtattgagcttttgctaaaattatttcttaaagattaaaagcaaaagataaatatctaggtttgtgttttcataatgtctcggtatatttaatttatgactgccctatctctacttcctggggaggctgggattctggtggcttgaaaaatttctttgtttctttttccagaggcggggtctcgctctgtcgcccaggctggaatgcagtgatgtgatcatagctcactgcagccttgaactcctgggctcaagcgatcctctcacctcgggttcctgagttgctgggactacaagtgtgcaccactgtgcctggctttgaaaaatttcttaatcttgaaaaccggtcttcaaagttagtgtttttcaaattgtgagttgctacccattagtgggttgtgactttagcttagtacttggtaaaacaattttctgcaacattgagagagaatggaatagcaaattgcagagtgtttcatactataataaggataaatattgctttgagaaacttttaagttgcctctttctgtgtacacacactcaaacatatatgtatatactggattgcaattcaaaaggtaattttactgtgggctatggtcaaaagagtttgaaaaccaataattgccagttacataaataataagtgtaccatgttcagcacttagagattgatgtggatatgtatagaggaagtccagatcattacatatagacagatttgaatcttggtagaacataggatagatatgttgggtctttgtattttcctggtcttctgtaaacattttatgaaggtaatattttagtaataaaaatttgatgtaggttataataggcatttaattgagttgggagattattagagatactcttgatcctgtctgattgataccaatgtgctttgtggccccttccttttccacgccagaggtatcaaagatagtagacatagaaatgggtttgatttcagttgtggctttgctactgattgtgtagggttgagtgagtcttcaagggccttaattttttcacctctaaaatgagagcttttggattatgtgacacctttaatgttttatcgagatgtttaactctaaatgtatccaatagttacaaaaaattcaaagcagagctaatttaaattaaaaatatgcatttgttgcatgaaacttgtaggcgaaaccatgaaactgagagcttcacaaaatcaaataaggataaggtgttagcacgactgaatggggtctggcactctacttctctttattttgtctcctattccctaatgtcttaattaaatttataaatgtgatcacttcccagggtgcaactgagatctctgaaaaggcctttttttttctgtcctcctcttcagtccaggtgattctcttatacatagtagacaatcagtaaatatctgttgaatgagtctgcagtgtgtttagtgcatagttgtgaattatgaaataaagactttgcagggaacagttaattttgtttatgcactgtaactccagatttataaaacttttttttttttttttgagacggactctcactctgtcgcaaaggcttgagtgcagtggtgacatcttagctcactgcagcctccccgcctcctgggttcaagcgattctcctgcctcagcctcccaagtagctgggattacaggtgtgagccaccatgcccagctaatttttgtattttttagtagagatggggtttcaccatgttggccaggctgttcttgaactcctgacctcgtgatccatctgccttggcctcccaaagtgctgacattacaggcgtgagccaccatgcccagctagatttataatactaatcagcctcttcttaatatagattttgctgcttcccattaacttttgtggttttattttgactgataacatctggaattcagctcatacaagttaaaaatgctctcagtcaacttacctaccatgttggccactgcctgtgaagacttaaaaatagttttaaatagtctcattgttttccatagcctcctgtactagacagagcaagtcccctttatgaaatcatatttgtaacctcatggcaagatctggaacttcacaaaaacattagtgggcttccatgaccttttaacaaagtatatgagtcagcccagctagaaaatgaagaagggacatacaagagttctccaaaggttggaatcattcatgcacattgagttctatttgttgaaactgtatcatgttggtaactcttggatcttggcaagaatatgttgttcagaaagagttactttgtctatgttcttttggatgccccatgatatgaagacaagcccagtaactttgtgatttctggtcatacgaacttttctaggtcattgaatatgccatatttctgtaagggaagcctttgtttctcttctgttaatgaatatattagcaggtcatccagataattgaccacacaactatctttgggcctcagttttcccatctctaaaatggatgaaactaaatgatcctcagggtctcttagaattcttaatattttcttgatattttaattctgtgatcatcttataacatattctaatataaatatattctaatatgaagtattttattttgcattaggctgcttttattcgtgatgaaatgatgccaggagagtgggatgtttgcgttacttcttatgagatggtaattaaagaaaaatctgtattcaaaaagtttcactggcgatacctggtcattgatgaagctcacagaataaagaatgaaaaatctaaggtaagttatcaatatctttattaaagtttacatttaattaccaggttggtttgttcacttttctgtattcagaataaaaaatgatggaacagccggtgtggtggctcacgcctgtaatcccagcactttgggaggccgaggagggcggatcacaagatcaagagattgagaccattctgaccaacatggtgaaaccccgtctctactaaaaatacaaaaattatcagggtgtggtggtgcatgcctgtagtcccagctacttgggaggctgaggcaggagaatagcttgaacccgggaggcggaggttgcagtgagccgagatcgcacccctgcacttcagcctggcaaaagagtgagactccgtctcaagaaaaaagatggaacattgtgattttattcatggaatgtgaatgcaaatctaaattattgaatacaagacacattaaaattgagcacagtttttaatgtaaagaaaattaagtgttcctttggtatacctcctgtgcctaactgttatgctgtagtattttaatattgttgagaatatttagtgtgcaaatatcgtttgtattgatttattttttattgaggggctaccttatatatatttatatggatgagagaaaataatttcctggaattatctgacttgtgtgaattagagtgtggtgttaacactgaaaaatatcaatatttcttgccattcaactccatcaacagtaggaaaagcttcaattatgatgaacctctctttggatcactgggctaatttgggagaaacagggacagaactggagcaaaaccaccaggtggattatactaatttcaaattggaactaatatctgataagaggacacatgctagagaataattttttatttaagagcattataaaaatgtgcatttttgttcatatgattaccattcttttgtgctttttgtgtcttaatttttctggtcttatgtttagaaagttaatataagttactgggaaaatcggctcaattctggggcttaaaaattgtgaccaggccaagttagaacgtgtctgggcatgtagatgaatgtggttggtggggagatggagattttattgtgtaaaatggctaacctggattccatggagaagttctgacctttttctgtgagcccaaaatggagaaatgaaaattttgaagttggggggagggtctcaggtataaatatgatctgcattcttcttcctttttttttttttttttttttttttgagacggagtttcactccgttgcccagggtggagtgcagtggtgtgatctcagctcactgcaacttccgcctcctggattgaaatgattctcctgcctcagcctcctgagtagctggaattaaaggcgtgcaccaccacgcccagctaatttttttttgtatttttagtagagatggggtttcaccatgttggcaagtctgtctcaaaccccagacctgaggtgatccacctgccttggccacccaaagtgctgggattacaggcatgagccactgcgcctggcttgcattcttttaagtatagaaatgtttagttttgcctcactgcagcattgtcacctgaactagggtatttttccatagaaaattttcaagttatattgtagtcaaaaatatattggttggataaattacagtataactgaatgttgagcattctaataagtaaaataatcctcatatgagtattattttctagctttcagagattgttcgtgagttcaagtcgactaaccgcttgctcctaactggaacacctttgcagaataacctgcatgaactgtgggccttactcaactttttattgcctgatgtctttaattctgcagatgtaagtttaagccatacgttttaagtataactttcttattttcactgacatgtgttttaaaacattatagattgaaatttatggtactttttaatttgtaattttttatctgcatgttttggttttcttaggaaagagttctttaatagagttttaaaatgaggatctttggagaaatagtatgcttcttgtctttgagatcaacttgcctgttcaattttgtctctatcacattactcctaaaacttatgatgtgaggctgagtccatagtagtgcattcaccattttattttcattaagttgaaggggtttgaaacatatttttatatactagtttggcaggtggaagctataaaatgatctttgattattgtaggcattgacatttggtgagtgctaaagagctcagagtatgtgatttgaaagacagcatattgtgtaaatgtgttatttatatatatatatttttatcattaacacaaatttatgctaggacaccaaactaaatggaaagatttaagaactttggtgcttgatttttcccattattattattattactattttgagagggagtctcactctgtcccccaggctggagtacagtggcacaatctcagctctctgcaacctccgcctcccgggttaaagtgattctccttcctcagcctccccagtagctgggattacaggtgcccgtcaccacacctggctaattttttgtatttttagtagagacagggttttgccatgttggtcaggctggtctcgaactcctgacctcaagtggtctgcccacctcagcctcccaaagtgctgggattacaggtgtgagccaccgtacctggccccattatgactgttaattgataataaaaagtagcaagtttggccataagttgctttgcacactttatcttgcttttgtttgttttattgtttggtaaaattaacattcttattagcattatgtctttgattttatattctacttttcaaactagatataatattgctacagtatggggaagcctaataaatgtcttttaaggaaaaagttgatggaattcttacacagtggggctcaaattttgttaactgctccagtattttacctattttcagaagtaaataatagtagctatcacagctgataatatttttgaaagtactttttaaatgcattatttccgtattggttgtataagaatctacagaatatcgggtatatttaaaaaaactgtgcactcattggagaatttccacccctctacaggactttgattcttggtttgacactaaaaattgtcttggtgatcaaaaactcgtggaaagacttcatgcagtaagtaatagcagacaagaacattcagtaattaaatagtatacacaaactgacccagaaaacaaaatgctatggaatctgtttgaacttgtgtttgcctcttggctcaatgtcactgtttctccctcctaacctttctgacagcctctttgttttttttttttttttttttttttttttttttattcctctatgtcctcagcctctctctagaacagcttttttcctttggctctcccctgtgaataatgtggtcctctccaatagagaggctgttcctgctcccacaccccacagttcctcaggatggtatcggtattctcctagttcacccactgccacttctaagctactgcttctccactgtcatgtataaagctcttcctttgaagcctaagctgtcttgcagttttatcctccacccattctgtttcctgttaatctgttcatcattgggtggctccttaacacattgtatgccaggctggagtgcagtggcatgatcttggcacactgcaaagtccgcctcccgagctcaagcaatcctcctgcctcagcctcccgagtagctgggattacaggcgtgtgccaccacgcccggctaatttttgtatttttagtagagatggggtttcaccatgttggccaggctgatctcgaactcctgacctcaggtaatctgcccgcctgggcctcccaaagtgctgggattacaggcgtgagccactgcatccgacctttcttttcttttctttttttttttttttttgagagagagtctcgctctatagcccaggctgctggagttcagtggcatgatcttggctcactgcaacttctgcctcccgggttcaagcgattctcttgcctcagcctcccaagtagctgggactaaaggcacgtgccaccacgcccggctaatttttgtatttttagtagagacgggttttcaccatgttggccaggctggtctcgaactcctgacctcatgatccacccatcttggcctcccaaagtgctgagattacaggcgagaaccactgtgcctggccccaactttctattctttgatcgcaatttctcatctctttctagtgctttcgttcatgttaatccttctgtacttgtcctgttacctcacagagacctctaatccccagacctctgcattttctccccatctatcagcttatttctgttgtgacttttttctgtatccagcaatgaactcattttctatcacttgaaccatctttggctagtactcctaaactcccttgctcccttctccgtctgccatacctgcctaaaaaccgtaacctggaataatgtaatgtaactgtctctctgtcttctgggcttcaattttgcttctgctgcttactagcagagtggacatctctgtattggggcagcccaacactggtaaagaagatttcacaactgtccaggttggaaccactgtgattccatgttctctaacataagctgagatgtcatgatactggtgatccttcagcatggccttctacagtcttctttcctgtttcctataacaactatttcagaccttccccagtctccccaagatttctatcccaggtatctcctgccctccttctccctcatcaggtaacatcattcctttctcaaaaagaaaaaagaagacattaggtaggaagtccttcaaggatgtccaccttctaaggaggtctgcatctgtgttaccttctgtttgagtggaagaggtgtcttttctctggtcagtggctaattcttccatgtgaatccttgatctcatctcttcctattctttatggactttcccccatgatttatctttttagttgactatattttctacctctttttaattgactatattttctatctttttaactgactgtattttctacctctccatccatattgggtcttttccctaagtgtaaacatgctcaggtgtctcccttattaattccaaatccaaacacgtacccatccaccctcacacatatgcaaaacagtgctccctcaacactgtgtccctctggctgtgattccgttttcttcccttgatagctaagctccttgaaagagtagtttatcctctccatatctactccctagtctcctgtttactcttgaatccattggccactggcttctatccattccatacaactgaaatttgtctcacagtgtcttcaatgactttccagttgctgaattcagggtacgctttttggtcagtatcttggctattgctttgaagctgctaactatctcctcctgctggaaactttgctgcttggtttctaggatactgttctcttttggattttcttttaccctttgtccacccctatcagtccctttcgtgggcttttctttctttgactgtctcttataaagtttaacattttataaggctttgtctttgactttcgtacatgctctccctggggatccactcccatggttttacctaccacctatatactgacgcctcctaaattgacctctctgtatccttctcctaagcactatactttcatatcccattgccttcggagtctttttgcttaagtatctcacaggcagtttaaactcttaaggatatcttttagaaaactttgaggctcacaccagaagccagaagtcttcttttactcttcccctgtccttacctcccatagatctctaataataatagctacagtttattgtctgctatatacttaagttctacacatgtaccaccacaaatttccacagcagacttggaaataggtatcattatccccatttaaaaatgtttggccgggcagggtggctcacacctgtaatcccagcactttgggaggccgaggcgggtggatcatgaggtcaagagattgagaccatcctggccaacatggtgaaaccacatctctactaaaaatacaaaaaattagctgggcgtggtggctcgcgcctatagtcccagctactcgggaggctgaggtaggagaatggcttgaacctgggagacggaggttgcagtgagccgagatctcaccactgcatttcagcctggtgacagagtgagactctgtccccttccaccccacctccccccccaaaaaaagtttggcgggccgggcgcagtggctcacgcctgtaatcctagcactttgggaggtcgaggcgggcagattgcctgagctcaggagttcgagaccagcctgggcaacatggtgaaacctcatctctactaaaataggaaaaattagccgagcgtggtggcgtgcgcctgtagtcccagctacttgggaggctaaggcaggagaattgcttgaacctgggaggcggaggttgcagtgagctgagattgccccactgcattccagcctgggtgacagagcgagactctgtctcaaaaaaaaaaaaaagtttggtatatacacatatcatatatttgtttttggatgaaccgatgaggaaataggcttggaaaaattagagaactttcctaggctcacaacagctagtcaggactgagctgattttagaattagcctgatctgggtttgaattccacatctaccacttgctagcaaagttcctttgatggccttactaaaatagaaatgataacatttctttcagatttatcgtaaggattaaataatacatgtaaagttcatagtatagtatctggcacattgtaggtaggtactctatagattgtagcactattgtcttgtgatataacctgtcttccaggtatacactgactattttatctttttttctctattcatctatattttccttcatattgaatattttctcctcatttatatatttaactacagtcatgcactggcataacagcgttatggtcaacgatggaccgcatagatgatggtggtcccatcagattataatggagcatatatagagacctgatatatggcacttgatactggcattgcagatcaagtaggggaaatgattgatagtgagtaatagtgctgggacacgtggttttctatatgaaaaaacaaataaatacatataccatgtaggtttgtgtaagaacactctatgatcttagcacaatgatgagatcacttaacaacacatttcttagaacatatccccatcattaagtggcacatgatggtactttgaaatgacctgcatttttatttcatttttgaagactccctgatcgatattctgacttcagatttcctctcaggtttaaaaatcttgttgtgggctgggcacagtggctcacgcctgtaatcccagcactttgggaggccaaggtgggtggatcacggggtcaggagttcgagaccagcctggccaacatggtgaaaccctgtctctactaaagatacaaaaatgagccaggcgtggtggtgcatgcctgtaattccagctactcaggaggctgaggcaggagaattgcttgaagccaggaggcggaggttgcagtgagccgagattgtgccattgcactccagcctgggtgacagggtgagactctgtctccaaaaacaaacaaacaaacaaaaaaatcttgtgttacagcagcttcttttttttttttttttaagggttctttggtgcttattcagcaaccaatagtcttgttgtcttaatttttcatgtattttgtgccatgaagtcatgaatgcctactttaggtcccctattctgattttctaatggactcttacttggtggttctttaccaagaaagttcgcaactggtattggtagtatttgtcagactatgcagtgggaagtaaatttcacattaatgttgttaatgaaatacattattaatcatattaaatgtttcataaacttttataaaaatgatcaccttttaggttttaaaaccatttttgttacgccgtataaaaactgatgtagagaagagtctgccacctaaaaaggaaataaagatttacttggggctgagtaagatgcaacgagaatggtgagctatttcatttcctttaaaacttatttgtgtgtaagaatttactaaaaattagctttgtagttgttcagttatgccattagttcaaaaattacattttatatttaaatggcaagttaagtagttcagatattttcagagaaaatttgtaagtattttatttaaccctttgaaaagagtataggttttggagtctatagatctgtgtttgaattccatgcattaccacttaacagctagttatcttgggcaagttacatagcctaaatttccattctgtaaaatggggataataatatttaatttatgaggatggtgttaggattaaagggggtaatgtcagtggcatgcttgttagttaaaaagcattctttaaaagcattctttggccaggtgcagtggcttacatctgtaatcccagcactttgggaggccaaggcaggaggattgtttgagcctaggagttcaagactagcctgggcaacaaagtgagaccccatctctacaaaaaataaaaaataaaattagctgggcattgtggcacacacctgtgtttccagctacatgagaggctgaggcaggaggattactggagcccaggaagtcaaggctgcagtgagccatgtttgtgccactgcactccagggtaggcaacagagtgagaccgtgtctcaaaaaaaaaagcattcttgctttttccttcagtgaaaataattataaccatattactagtgttgatgaaaatgttggtgattgtggatattacaaaaatagaatctggaatggttagataaatgcacttaaagcaggaaattgacaagggaagtcacaaggaatcataagtgggaagtgttaataatgtaatagtgctgctaataggagcaaaatgttacgtatataaatacaattagatcatgtataaaatatatgatttctttactacataagccagtatagggtagagattaagagtatattctttggactcagactaagatcacagcttggttttgtcccttctgtgaccctgagtaagttgtttaacttctcttagctgccttaatttccatctgtaaaatggggatgatactagtaaatactcagaattgttatgaagatttagtggcataattcgtataaagcccttgacatgatacttggcacttgcactcagcaaaagttgataattattataattacatattatcattgatcgggtgtatatatatatgtaagtctctgtgggggtggaattgtagaaaagagaatgaaaaatatttataggatcagaaaaaaatgacctgtgaagacaggtataagaaattgaaattgtttttagttcaaacaagtaaatgttggatgtcaaattcaggcaaatgttgtagttactgataattagcagatagaattctctaaataattgtcaactgatggcagtttcttgtcatggataaagcaggaggaaacaggtttataagcaacacacaagttcacatgttcaaatattcattactttgtaggttttgcccattagatttaatctcaaatcaaatcttgtttatctttaaacaggaatctaatctgatggccaaaggaacatttgtttatgacattaactttctagtaattgatgattaattatagtttaaatttttaggtatacaaaaatcctgatgaaagatattgatgttttaaactcttctggcaagatggacaagatgcgactcttaaacattctgatgcagcttcgaaagtgttgtaatcatccatatctgtttgatggtgctgaacctggtccaccttataccactgatgagcatattgtcagcaacagtggtaaaatggtagttctggataaactattggccaaactcaaagaacagggtgagtaataaatttttaaattagcatggaataaatttatattaatgacttgtatataaataaaattttccatattcattcattcacttattcagcagacattgttgagtacttaccatttgccaggaattgtcctacaggctgggtgtacaaagatgaataagacaacaatctttgccttggataagctcacagtgtagtgaggaggaatagttgcaattcattgtgataagtgctatgatatgttgagaaactgggagttgggaaagtcttcacagagatgacctttgaggtgagcactggacaatgtgtaggagtgaaccatggggaaaaggaggggaagggttttccagggtaatgaaacagaggcgtgaaacaagggaacacagagagcatatggtacttggggtagagtggcagttgatgaatctggaaagatggatggagccaaattatgaacggtattttaaaccatgccttaaggagttaggacttttattttgaaggcagagggagtgtcagagaagacttggctgtgaagagtgacaatcggagtatgtcactcttacatgttaggaagagaaccttgaaagcagtatgggggtctattgaggatgagagactaggaacaggagactagttgggagactattgctgtagtccagtgagagagcctgtggacccatcattcatccttaagaaaaagtaaaggcaatcttttaagtcgttgcaatatgtgtggaggattttgaagaccttaaaaaatgccaaactcaacaaatgcataattctatatatagcatctcttgaaggtgtgtgggggtgtgtgtgtgtgtgtgtgtgtgcacgtgtgtgtgtgcgttagtggagtgttcatgtgctctacatttatgttgcatatgtttattttgtagcttttaagttagtttcacacaagttgtacaactcactttttcttggtgaaatgttttaggttcaagggttctcattttcagccagatgactcgcttgctggatattttggaagattattgcatgtggcgtggttatgagtattgtcgactggatggacaaaccccgcatgaagaaagagaggtgaggaagagaaaataaaataagatttcagaaatcagagttcaattaagcaatgtatatcaacattaggtagttttgaacttttgccttttctttaggtgggtgcattgaatttctcattagcatctctttctctcttcaatcttcagtgtggcttccattccattgattctttacaaatcatctttttcaaggtcttcaaagacatcaccacttatctaaagggcactacaccatcccatccttattttctctaatcatgcctatctctgaccttttaaattactaacagtttctcaccttactctctaacctccaatttcatgtcattttcttttcctaatttgccagctatagcagacctttgccatttgtggagtttaatggttgagattttgccagtttataagcaaccctaaagactcatgaagcatagtaatccataaagggaatgatcttggttcttatagagctcttgtaaaaactaaatgtgacaaaataggtataggtatttatcatgaatttaaacattgggacactaaaaggttggcctgcaggaatgagtcacttagtgagtaagcttatctagtatgcagtatttttctcaaacatggaaattcttacagatctttagattattcctcacaaatgtcatgggtctaatgcgtttaataccctttaaagcacttttgcttggaaggctttgctaatttatcttctgttttctgtgatccttcagagctctgtctttggcttctgttttaagtctgtacagcaagtcctcacttaatgtcgttgcaaaaaaaaaaattagctgggtgtggtggcgcgcgtctataatcccagctactcaggaggctgaggcagcagaattgcttgaacctgggaggcggaggttgcattgagccaagatcatggcattgcaccgctccagcctgggtgacataatgagactctgtctaaaaaaaaaaaaaagataggttcttatagaaactgcgacgtcaatcaaaacaatgtatgatgaaatcaattctatcttaggctaattgatataaacaagatttaagttctggccaggtgtgttggctcatgcctgtaataccaacgtttgggattgggaggctgaggcaggaggattgcttgaggctagtcagtaaagactagcctgagcaacatagcgagacccggtctctacaaaaataaaataaaataaaatttaaaaaagcattagtcaggcatggtggcatgcacctgtagtccttgctcctctggaggccgaggcaggaggatggcttgagcccaggagtttgaggctgcagtgagatgtgattgtgccactgcacttcaaactgtgtgacaggacaagaccccagttcctgtggcatatttctggtcacaaagacatcaccaagcttctaaataaagaccaaaacacttataatattaaacatggaaataaatgtgagccatacatacgtttaagaaagattaataaaaacaagtaagataattatttacctgcttattccagttcaggattacagtggttggagcctcttctggcagctcaggaccccaggcaggaactagccctggacagaatgccattccatcacagggcatgctcgcacacacaccactcacactgggaccatgtagacatgccaatttgctttttgtgcacagctttgggctgtgggagggcacagagaaaactcatacagacatggggagcacatgcaaaacccatatggacagtggccctggccaggaattgattgtttttttgtcatcagttttataatgaaatgatgttacttgaggacctgctgtactcatgctttgggtaaagatcatggttttatggtatagtggaaaatgcactgaacttggtttcagaagacctgaattttagcaccaacttcaccactttgcagcgtgtgcaagccatttaattctctgagcctcagtagctgtaattctaaggatagtaacaactaggcttctttctctgacaatgttgtgaggatataataggtatgagcacagttttaaacggcatattgcagtacgtactgcaggtcatgaaattgcacccaggcctttctcccttacacctttagggccccatctcaggctacaaggactctctcttagcccgcatccctctccttctgtagctgcaatgggcactccgttccttgtgtgcctccttattgaagcctgtttctagcatagcatagtgttcacagcaagcacacagacccttttcatattaaaggtcttactgctacctctatggggaaacagttgcaataacatttatacgtatgaggatatttcaaggcttacactattccgtgtgctatagttttttcactctctctgagatggcaacttgaagcgttactgagcttttgctgacttattcctgaggattggtttccctgaatccatactaaataaggccctatggtaccattcaggatgatccttcttcctaggacaaagagaatatcatggcagagcagtacgtgctttctgacctcaaatagccaatttgcatttctgactgagctgtctactgtttacctatttatgtccaaattgttctggtttttaaaaattccaaacaatgttatcccctcagagactctgaatttcatgtattgactttaaatatagcaaagtcagagctgttcctttcttcttggaaatgccctgctttccctttatgttgtccacaccatcatttcatctattttcccaataagaagaagaccacgtttgattccttactttgattgtgtgccagctgtgaataagtaattctttctcaacagctctcagattttccctttctccattactacagctaaattcagctaacaaagccactggtcatcgtctgactcagttcctgtaacctctgcttaattggcctcctcacttttatagggaaaggaactaacatttgtcaagcaactactataagctaggcaacttaaagttccaattgaattctcccagcagcgcggtaaagtattggtataattttctccatttgaaactgtgtctcagagagattaaatacttgcccagaatcacagatgtaatcagtggtgaagttgtgattcatgcccaagtttttgctatttcctctacgccaaggtgcctctcactacaccacgctgctttctatactgccccctttacctgctctgctgactgtgacggtggtagttaccttctctgcctgaaactttgaccatgccatccatttattttaaaaaagattgcccatactttgtgattatgcaagtaatatatgactgctgaaggaagttttgaaattaaatacaagtatttctggcctatctttttaggtatatgtaatatgtataagtaattggtatcagacttcatatactatatgtaaagtacagtatcctgatactatttacttaatattatattgtactttttaatgtccataaaaaataattgtaaaagtaattttaggataatatttcaccctatggatgtactataagtaattcatccccctattcttgatcgtttaggttgtttcaaaattttcactattataaataatgctatagtgaaagtccttatacataaatctttgtgcacatctctgattatttccttaggataaattcctagaagtggaatttctgggtcaaagggtatgaacatttttaaggctcttgatgcatattgccaaattgctttccagaaaggttgtaccaatttatactcccagcagcaatgtatgagagtgcccgtctcaccgccccctcatcaacattgagtattatcattttttttaaatcttcaaaaatgttattatgttgttttagtttgcatttatttgattactagcgagaatgaacattattattgtgttttctaaccatttgtatttgttctgtgagttgtctgttctttttttctgctcatttttctactggactttgtttttctaattaatttgtatgagatctttatatagtaagaatattcatattaattttaacattctttactaaatatccctggattgtcatcctgattttcttcattacttacctgcttgttccttgttaccatactgatagaaatcttcttactttcccctttatccgttgccctcattcccatttgtaaaccattttctctgttggttgatcttctaaactaatcattcataagctaatggaaatgaagttgagatttctgatattttacctcctagatatatttcagctctcactcaaaacgttttcattattattgtttttaaataatgtaaatgaattattacttgcttagttaaatttgtgtatgtaattgttctaaatttgtatctatcgatgtaagcttttaaagattaggaacttcatttatataatatactttctacagaaattcacacagtacagtatatgtatagatgcttacatatttttgaagatggaagaatattataaagtatatttataaggaatattataaagtgtgtgaagattttctatatgtattttaaatgtttttatttgtttcttaaggaccctgatggtctaattttatttttctctttttcttctatccctttatcaataaaaaataaaggaagcaatagaggcttttaatgctcctaatagtagcaaattcatctttatgctaagtaccagggctggaggtctcggaattaacctggcaagtgctgatgtggttatactatatgattcagactggaacccacaggttgatctacaagctatggttagtaatctttaatggtgtcagaaatttatcatagctctgaatactattgctatttacacacataaaggtcatttatgataaaaaggtaacaatttttgagagattttatagaagttacagtagattatcctggaaaacacagttgctatgctaattgcaaaaacaaaagaaatgaaagcgaacaacaaacacaccccagatccaacttatagcatttatgtgttgattttggtttttttcatgaaatagaaatgtcagttttttcccattcctacagattgaagaggacacataaatttgttttaatgaaaaggattaaaaaacaatctcttgttattattctgttcaacaactaaatatattaaaatccttagtactgaaattaagagaggtaggattttaactttcataaaaaacaatttgggagagaaggcaaaaaggtaagaaaggaatatattccagaaaaacacttgctacttaataatgataccatgcaaaagctattctacacttaaaaacatttttttttagggagcaaagtttctctgacctttcatcatgacactacaggtaacccctttgatattttggtgtcatttattgaactagagctacaacttctctcaatgtgactcacattttcagataaagaaatataatttagaagtaaaaagatgcaaaataacttcttaggttttgaatatatagctatggataagtgtctttttgggagcaatgaaaagtcatatgccaatgaggtataacttagaaggctttccttttataatagagaattgaaagggattgaccactgggacattccaaaatcaatatgctttggcgtaattattattgcattacgatggtattgaactacctgtttgatatgactaactaggagtaagccccagtaagttacagtgttactgaactggaaaatctaatagtgatagcacttcatttccgtagaagtcttagtgtgcatcccatctttcaggatttgctggttcaggtttaatgtaaatatgtgcaggggattgcattctgtttgaaaaatgtgctgtgttgaaactttgttactaggctctagtgtttttatatttagtacaaggcctgttttgaacttacattttttttttctctaccaccctcctccctttacctatttgctctagcagcttctgtgttttaaaaatactctccctagatggttttataccactagaagttcgccacctgtcacctgtaccaactataaaccataggaccagtcctaggctactgaatagtaaggatagtaatatcccattaatttttataactctttactgcatatccctcagtaagcagaaagaagtgcctgatgatgaaataaagcagacttttgccaccatagcaaccctaactacttaataaaattccttgctagtttcgaagatgtttatatttagtggcttaaagttacttagtaactcaatccagaaactttcagctccctcttttattcatcttacaggtgctttgccctttgtcctggaagtttcccattaatggtacaatataatatttgcagatttctttgttcccagtggtctttagatattctcaatattcatcatgctcttttccaaagtgtcagatctagagaaaaataactaattttatttttagaattttatagcatatgatggctctaaattttatccagaatatccaatatcttacattagaactctttctactaggatcgagcacatcgtattggtcagaagaaaccagtacgtgtattccgtctcatcactgacaacactgttgaagagaggattgtagaaagagctgagataaaactgagactcgattcaattgttatacaacaaggtatttatacatagaaacttaattaggtgttttttgtaaaacacatgtagttttcttcaaaggagattacttttaataaaagttgaccaaaatttgaaaacttagaggaaaaattgaaacatcactgtgtatcccatgagtctgtacaattgttatgtatcacctaaaaataaaaggaaaaaatttaaaaatgctaattgaggctgggtgaggtaggtcatgcctgtaatcccagcactttgggaggccgaggcgggtggatcacctgagatcaggagtttgagaccagcctggccaacatggtgaatccctgtctctactaaaaatacaaaaaattagccgggtgtggtggcgtgcaccagtagtcccagctactcaggaggctgaggcaggagaattgcttgaacctgggaggtggaggttgcagtgagccgagatcgcgccactgcactccgccttgggcgacagagcaagacactgtctcaaaaacaaacaaacaaacaaacaaacgaacaaaaaatgctaattgaaatcttctgaattgaaaccctggcatttgatatatggagtagttgaacatcactagcttattcttgaatgtcagtagcatgctttttgaagtacctgagattatttagcagataaaatggctacttttaaatttttgaaaacatattagagggtaccttttcatatagagaagtttgatctgaaaacagagtttgaacatgaaaaaaagtttctgtccttctgggttttaactgagttttacagaagggaatttatatagaaatagaaagtatgctagaagaaaaacttgtagggtttattaaacaaataaccttaatgctcactaattttttgttctttaaagctttatgtgtggttaaatgtgataatgtctgattagaatgattatgccttctttggaatatgattgattgaatatgtacaatttcaatttttatcattaggaagactcattgaccaacagtctaacaagctggcaaaagaggaaatgttacaaatgatacggcatggagccacccatgtttttgcttctaaagagagtgagttgacagatgaagacattacaactattctggaaagaggggaaaagaaggttagttaaaatagcattttattttcatgctggattgttttaatatcaacatacttcagcatacttatattttcattgtacatgtttatctgcattatctacatgtttcaggtagctcatattctctccaacaacttgtagatctatttccaggggtagattaaggctttaaaacttttttttggtgagaaagactaagaaccagagtttaaaattgagtgaccttatatctaatgctttattgaaaatactatatctaaaagccaagtaaattttgtgtttaatcacatgtataaggaatgctttttttttttttttttttttttaaagagacagggttttgctctgtcacccaggctggagtgcagtggtgcaatgataactcactgtagtctccacctcctgggctgaagtgatcctcccacctcagcctcctgagtagctgggaccacaggcatgtaccaacatgcacatctaattaattttcttttttagagacagggccttgctgtgttgcccagactgatcttgaacctctggccccaagtgagcctcccacctctgcctcccaaagcactgagattataggcatgagccaccatgcctgaccaggactgtatttttataatcttttttttttttttttttttgcactggactagaaatcatctactgatacattggttaattgaaaatcttttataaaacatttcatgaaatgctaaatcactatttgttaaagcataataagttgtttcagaatattgtaattttgtgtttagttcaccttcccctctccacaaattatggataattttaaacataagtaaaagtagacagagtagtataatgagccccgaagtacttatcacctgtttctaacaaccatcaaccagtcctgttctgtctatatccccagttatctttcccctccttggattattttgaagcaaatctcagacatacttcagctgtaaatagttcactgtgtatttctaaaatagaaggactctttaaagataatcattataacattgtctcacctgaaaaaccccaataattctttaataacaccaaatatccagttagtattcaaatttacaattgtgtcgtaaatatttatacttaaaaagttttcttttcatttttaaatcagaatgcaaatcaaaatacaaattgccatggttgagatttcatctctatcttttaaaatctataggccccctctcctgccatgtattgtattccttgtaatttatttgatgaaaagactaggttgtttgccttttgagttaatcacagtgtggattttgctgatttcatctccatggtgtattttactatgtttgttgcatatcttgtaaactggttgaatttgcttttcagaagaattttgtagttcaggtaataacctgcattttaaatgatcttgtgttaatatgtttcataccagtatgcaaaatgtgtatttttagtccatctttgcctttctcttagctttagctatttgtcccatttaaattatgcaagagcaattataatgtgggtacaacttcactgacaaaagattttaaagaaagcctaagtgagagtacttgggaagcaccatttaaatatttgaaatacttgggcaagtaaaatttgcacttcaggtttgatgttagcattgcattcataccttgtaaattagcagactggatatttcatgtcaaaacctgactattaaaaaggtagagaatccacagacttttacaagtaattcagtgataattttctcatttcaatgttttcacctttagactgcagagatgaatgaacgcctgcaaaaaatgggagagtcttctctaagaaattttagaatggacattgaacaaagtttatacaaatttgagggagaagattatagagaaaaacagaaggtaactttttactctcaaccattagaccctcaaatgagcatttctccccataacaattataaaataacactggcacttacctattataataccctgctctagagtgaaatttgatataggtctaaatatctcatgcaaggtatatctttcgtttattttattggtttatcgtcgtcgtcgtcatcatcatcatcatcatcatcatcaatttttgctgttgctgctgctgctgctactactactactactgcttagtactacttttgttattgagaagcagtgtaggattgaggttgaattcctgaattctggagctgaaatctcaactcttgtcactaattaagtgactctgggtattctcaattttctcatttatcaaatggaggttataatagttacatcatagagggattctgatgatgaaatgagttaatactcataaagttattagaataatgcctgacacttaatgttaactgtatgaataataatattagtaacatttagttacttaaatgcagaaggactttgttacatgtggtctgttgaagaaatgggggttttatttatcttgttttttaaactgaaattaaggctgagattttaaaactttttatttttaaattactttagacttacaaaatagttgtaaaaatagtacagagctaacctatagccttcactcagcttcccctaatattaacaatttacatgttagtataatgatcacaaccaggaaattaacaccagtttttctcctaatgtcctttcctgtgccaggaaaaggacattggttaattatctaattaactggtgttagattccaggggatctaatctagtatcccacagtgcatttttaaaaaaatagactttattattttttccttctatttttagttgacacatactaattgtacatatttatgggatacagagtgatattttgttacatatatacaatgtgtaatgatcaaatcagggtaactggtatatctactgtcttagcacatttgtgttgctgtaaagggatacctgaggcttggtagtttataaagaaaagaggtttatttggctcatggttctacaggctgtaagagaagcatggtatcaacatctgcttctggtgagggcctcagcctgctttcacttatggcagaaggcaaaggagagctggtgtgtgcagagaccacatggcagagacagagagagagagacagtaccagagagaggagggaaatgctaggctctttgtcaggaactaatagaatgagagaactcactcattacctcgaggactacaccaagcccttcatgagagatctgcccctatgacccaaacacttcctattgggccccacctccaacactggggatcaaatttccatgtgagatttggaggacaaacatatccaaactatagcattctgcccctggcctcccaaatctcatgcccttctcacattgcagattataatcattccatcccaatggtcctcaaaagtcttaatttgttccagcatcagctaaaaagtccaaagtctcatctcagtctcaatgcaagttccttacagctgtgagcctataaaaccaaaaacaagatatttatttctaagatacaatggttatataggcattgggtaaacatttccattctgaaagggataaatcagcctaatgagaggggtaccaagccccatgcaagtccaaaacccagcattaaagctccaaaatgatctcccttgactctgtttcccccatcctgggcacactagtgtgagaaatggggtcccgagcccttgggcagccctgcctccagggctttgctgggtacagcccacgtggctgttctcatgaattagagtatggtgcctgcagcttttccagataggagttgcttgatgctggtggctctgtaattctagggtccctgcaacacccccaattccactaggcagtgcccttgttggggactttgtgtaggagttccaacctcacatttccactcagcattgccttagtagagtcgctccacagggcagcgcccctgtggcaggcttctgcctggtaatccaggctttccaatacattgtctgccatttttccctctgtaattgataaataccttgtggggagatctttctcagacttttactcactgattttagcatgtactggtggagcttgcctgcagtagttattattgtggtgtttgcctaatggtaattttgtattttcttcattccatctatatgtatttattaattgatatttttctgtgtggaagatctaccccttctccccaatttatttgtgtcttcagttatttatttatatcagtatggactcatggatgttttgagttataatccagttctatctttatatattttgttgctcaaattgctctataaagctgttatatttttgaactgacagaaatgaattttcttaaaataaaaaagctcattcttaggtacttattttactgaaaaatgagaggtgagacattttggttttgcactgtagctagtatgctgataatgctttgtttctgttactgcttctgatagcttttagtttcttgatttgtatttgtcaggttgtcctatctctaatcttcacttagacggcttatattttatcctgctgagatggaggtgatggcctatctgcacagggtggaaattgcctttctaatatgcttttgagatctcattatgtgatataagttttattaattttacaattattcctgcagacttatggataataggagtgttttatgaagtggaaaaattttaaacaatgaagtctaaataccagtggagcttcttatccacatttttagagaaaaattagtaaaatacttggctatctgtaactggtttccttgtgcttctaattttagcaaagtaatgatgcgtaaagagaattttaataaccatgatgacttgtatttttataattaaatgtctgacagtaacagtggtgtccagaatcacatttttttctgaatattctgagctgagattatattttatttctgcctctttgtgttttctagataggttcttaaaataggtttaaattatcttttgaggagaagtgaaaacttgaaagaatatcatttttaaatcatggaaactatacattgaggtagattttcatatatggtttgttgaatcagttgcattacttttacaaccatacctggtaaattaaatcatgatggctgtgatcctgaataaattaacccagataagttagcattaatgtactcttatgtaaagtaaactaattcggtatgatttattcttttttttgaaagttgaggaattggccttcaatgtttgtttcaaatttgaatgcctagaccatcaaacaagtataggttaaatagctaaatacatcacttgtagaatgttggtttaaattattattaatttatttttactccaattgagaaagataaaatattggttatttataaaatatctctttcattactgtcgcttcacattaatccatctgaaggaaaagcgaaatttgtttcattgctgtgggaatttctcattttacttaataatctcattataatatcggtatctcaggctcttagagttagaaggtcatttatgttaagtttcttgtaattaagaaatctcatctttagcatccaagacagatatgcagcctctgaacactgtagtgttgggaatcttatccctctcagggtagtttgtttcactgttttatattctctggttctcagaaaactttttatttgagttacaagttccttgatgaaagagattattttattcatgtgtatatcactgacactgacttgcacataatacagtaggtaattaatgaatagttaaattatattgagtagccatctactttctctaactttccacattgattttaatcttatggatcaatgaaggactgtgttcttttctatttgatagactttcatatgcgaatgtcaccgttgtgtctgtctttagtcattacttctctagacactgtgagaatttgtagatctctaaccatactggtcatcttggtttattatccactcttaaaatacgatgccaaggttggaattcagcccttagattagatcaagtagagtgagacaactaatggtggattaatgcccccttttatgtaaagatactaggctaaggacagaaataaagaaaaatatgaattaggaagccatttctcagactccagaacattgtagtgtcagttttgtctgttgactgttaaattatattttctagctgataatagggtaaaattggtaatgctgccaaatcatggttgatgctactttggatgtttaataatatcttgcatttaactcttggcagtttacttaatgctttcacatatatgatcatatgtaatcctcaaggtaagtattattattctcattttgcaggtggaaaaaaataatttccccaaagttatataactagtgaagtagcagaatcctggtctttctgtttccaccacttttccaactctgccatacctgtgtttccagaaggtctcatttgaatatttctcttgatttgaagggatatatgcttatcatgttgacatttattatttacccctttcatctgtttctttcttttttttcttcttttttaaatttttttaaattatactttaagttttagggtacatgtgcacattgtgcaggttagttacatatgtatacatgtgccatgctggtgcgctgcacccactaactcgtcatttagcattaggtatatctcccaatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacatatgtgtgcatgtgtcttcatagcagcaagatttatattcctttgggtatatacctagtaatgggatggctgggtcaaatggtatttctagttctagatccctgaggaatcgccacactgacttccacaagggttgaactagttacagtcccaccaacagtgtaaaagtgttcctatttccccacatcctctccagcacctgttgtttcctgacttttcaatgattgccattctaactggtgtgagatggtatctcattgtggttttgatttgcatttctctgatggccagtgatgatgagcattttttcatgtgttttttggctgcataaatgtcttctaattcatgcacgtattacagttaccacagtcaatgttactcttccgtctatattagctaccttttatttatttaatttgaccaaaaaaaaccagattgtacagattcttctcaatcaccaaggaagaactaactttaaaagctactttcaaataaaaataaagaaaactgtctttgcatctaaacttggtgtaccactatgttttggaactttggaggtaaattgtgatttataaggcaagttttgattcttcctgatggcttttgcttccttatgtttctgcagcctcgatgtacttgattttgataaaactgttgtttggagtcattaaaccccttgttgttgtttgttgtgtatagcttggcatggtggaatggattgaacctcctaaacgagaacgcaaagcaaactacgcagtggatgcctactttagagaggctttgcgtgtcagcgagccaaagattccaaaggtaaaactgtacaaggccagtttttatgtcctaaagtagatttctgttgcaacatgatctatgggtcagatttacttgtatcattgccaaatcatagtctctaaaatataacagtacaaaaaagtatctgatttggcccagccatataaatggattttattgtatttattgttccatatatcacagaaatagtaaaagataagtaagtttacttcatgtactgaaaagaagtatatataatacattttcctccctcataggctccacggcctccaaaacagccaaatgttcaggattttcaatttttcccaccacgcttatttgagctcctggaaaaggaaattctttattatcggaagacaataggctataaggtattttttccattttttaagattaatataatataatctttaaaaataatttaatctgttaatctagactagaaggtgttgcattttaatttgagagaatgtgacagcaaatcacaacagtgatgtttttaaaaccaaagaggaagtttaactagatgtaaaacatctaaccactgaatcaccagtacagtcatcactaaatgagattaatgaagaattatgcaatattttgaaatagtaataacattatttttataatgccagtgtttgaatagttaaagaatatgtagagagaacaataggtatgcggttaaaagcgaatgttaatatatgataggaaatttttgatcatttccttaataggtccaagaaatagtatttctgtctttattgcctatacgttgctgaaagccttgctggtggttagtagattgtagtcacttaggtgttaaagataatgataaacatgatagtgaattatacaattttaaaatgatcttttggtatttggaattcttatttatataggtagatagaatcctagttttcatgagtgaaatttaatatttgtcacactaaatctgtcatattgggagagtaagcataccaggtaatttctgtatgttgaaattgacttcctagtgaatggagagagatgaccaaaggtataataatcactaacattaaaaaattataaaatactggccgggtgcagtggctcatgcctgtaatcccagcactttgggaggccgaggcagaaggatcagttgaggtcaggagtatgagaccagccttgccaacatggcaaaaccccgtctctactaaaaatgcaaaaattagctgggtgcggtggcaagcgcctataatcccagctactcgggaggctgaggcaggagaatcgcttgatcctgggaggtgaaggttgcagtgagctgagatcgcgccactgcactccagcctgggcgacagagggagactctgtcccaaaaataaaataaaataaaataaaataaaataaaataaaataaaataaaataaaataaaatattaacactattttaattttatgaagtgttctgttttatgaattaacagctgtgttttaaattttattttgtaaacctttgtcacaactggaactgtgacccattattttaattagtagctggaatgtgcctagaaaagctccatgtatataagatacttatatcttaactcattatattttggaactagagtagatctctagggtgaacattcatataagacataaaactagtttcaaagaaagtgaaaacagtgatacaccagaagaaacaggtaagttataggttcaaatataaaataaaaataggaaaattaatgataattattaacaataattattaattgtttaataatgaagtagttatcttgtgaggtaaacaaatacatatcatctcattaaggtttataataatttgaggtttagaatattattttctgttacgttcattaactgttgttagtgagacttgaaaggagaattaattgaaatgttagacctcagtaataaatcaaatatttgcatagaacattttataatttacaaagtgctttaacacatactgaggtcgttgattcctaacaacctcatgaagtaggtgttattatcatctccatttaataggtgaggaaactgaagttcagagaggttaaatgaccttgttcaagatcatggaactaacagggttgccatgggtcctggtctcacaaccagtttctcagtattcagatgttctattcgttccgctcagacgttctgggctctttctgcatgcgatgtaaccctgcttctttctgcagtcctaaataaggactgtgtttacaatggtgtggcatgacatttgggagttgggccaagtggtagtcaagtagcaacaattaaaaaaatcatctctgatataactttatgctccttctttggagatactgaaattttgttccccatgataatttacagtgaccaccacattctggccaccggtctggtttgaatataaacagtgcctttcattacaggcagtttgtggttaggggtgaagtcttacagtgactctttgggtggtggccagctggaaggagatggagaagagaggaaacctcagaagatggaggaatgaagggacagctgttaagggtggtagaaaggaaggggaggaggagaggtataagaatagaggaaagggatgaatagggagaggggagatggcatggaattcgtgctattgcaccttattgtttgctcttcctcacttccctgaaagaagcaagaggagagggaaaaagagtaaaaggaggacctttttttaaagtgtaatacctatttattgagcaatcctttgtgccaggtactgggccaagtacttgggataaagcagtgaataagacaaagtctttcatctcatggagcttacattctaatagaggagataggcattagatactacaatgtaatggtggtggcatttgtgtggttctgtgcttacaaggggtgctaatgagggagtataacatgggtatctcatgtggactgggagatcagggaagtgttccctaaggaaatgtcatttaagctgagtttccagagatgtgaatgagctaagtgaagtgtgggagagaaaagctgaggcaggtggcacctcatatgcaaaggtcttgaggtgggaaggaggatgactccttttgggagctttaagaaagccagtgttgttagggactggtgagacacagggtgacttgagatgaggctggtgagtgggtagagtcaaatcatatggagggctttgtaggtcatattaatgaggttgaactttagctttagagtaaaggaaacccactgagatgtttttaaggcagggaggtgggtgggtgggtggtaaagtaatactaatagcagatacttagtccttacatgtgttacttattgttcaagttatttgtaaatgttagctcattatcctcctaacagcctttgaactacatccttattttacagatgaggaaactgaagcatagagaggttgagtcatttgccctgaataatttgctcagggtcatacaacttataaatggtaaattatgatcagatttacaatttttttttgagacagagtctcactttgtcaccaggctggagtgcagtggcgtgatcttggctcactgtaacctctgcctcccgggttcaagggattgattctcctgcctcagcctcccaagtagctgggactacaggtgcatgccactacgcccagctaatttttgtatttttagtagagatggggttttaccatgttggccaggatggtctggatttcttgatctcttgacctacctgccttggcctcccaaagtgctgggattacaggtgtgagccgccacgcccagcccagatttacatttttaaaagatcactttggctgcgatgcagagaatggcaggtttatctagggaaaccagccaggaggctgttgaagtatcaaaatgagagaagatggtggccacttggactgcagtggtggtggtggaaggagaaccaatcccctactactctactcctagccttggactctcttcagccgtatcctagattgcttctgtattgtcttaagacttgccttgatcctccttatgcatgcttagctgaggatttaggtgacaaataagaatacattctggatatttgttctttctggaccttgtctcttccattctttactaggaactatggacctgagctaaggtgggttctttaattgggtggttttttgtttgagttcagagaatagacagatcagcaggcatgttaatcatcttaaaaagctcccttttaaggatgatgtgatatataaccgttagacatatcttctcaaggcatagctagcattgctttatttcccccttgcaccttcagaaaactcatcagggccacaaagtaaatagagcactagtttatcctcaaatgaacaaaacaaaattgctttagtggagttacctggtattctgtgtacacagattctcaaaaagggactctttcccccttttctgcctaaaggattgttagccaaggggagataggtgatgcccatagctgggggcactgtggttcatggttacgttttatctatgttgagtctccaaaggcttattctgttgtgatttggagtggggctagtgaagggcccacaagttttgaagcagttggtagagagtggtttccttgtacttcctggttatttgcatttttattttctgtttttctccccctttccctccctcatattcagcacaaggtcacagcaatattgctgataataagatctggagttaaagagttttgttttatttgaaggtgagagaagtatttgtttcgccctaaccacgtggtggacagcagtacataatgtgcccattcttgctgctatctaagctttgaccttaggcatattcaaaagctgcattgctctttcgacttaaaggagttgttatttaatgcatgcaatcacttggtcactaaaacctttatattggaagaggacgacttaattgaaatttcaattacagcataaaaaatccagaatatctggacgttccattgagtctaaaacctggaatgcaagagttttgccacattcgaagctaaagaaagctatagaacattctaacatttatccccaataaaaaattctttagggacaaatataaacatttgacaaatggaggaagttccataatctttgtgagttttggtaatgtgtcattgtgggccacctactttttcagtggtagaactaaaataatggtgagctgatttcaggttactgcttttattttgtgtggtgtcacatttaattcagtactccatatttcctatgcaatgcttgctaaactcctcctaagaaacaaggccaaaaaaagtttttcactacttcatggaatacatttcttaatcacaaattccttagcatctgagtagaaatccaaataataattgagatttttactttagaaagataacattttatatattgtgttgctggagatcataatgagacatagagtatgaggactttaaatacctcctgggtatctgttcagtactattggtctgtaatttgtctgcttaattctttttttttcttttgagacggagtctcactctcttgctgaggctggagtgcagtggcactgtgtcagctcactgcaacctccatctcctgggttcaagcaattctccttccttagcctcccgagtagctgggattacaggtacccattaccacgcccggctagtttttatatttttaggagagacggggtttcatcatgttggccaggctggtcttgaactcctgacctcaggtgatccacccgccttgacctcccaaagtgctgggattacaagtgtgagccaccgtgcctggcctatctgcttaattcataatgtagtactttgaaatcattccaggaagcttaatgctgatacgaacctcatgaggtaaaaaaaaaaaaatgtatgtcttattaaaatgatgactattaaggtttttttttataggaggtgtattagtctgttttcacactgctgatgaggacatacccgggactgggtaatttataaagaaaagagatttaattgactcacagttccacatgactcgggggcctcacaatcatggtggaaggcaaggaggagcaagtcaggtcctccatgttagaagggaagagagaacttgtgcaggggaattcctctttgtaacaccatcagatctcatgagaattattcactatcacgagaacagcatgggaaagacctgcccccatgattcaattacctctcactgggtccttcccatgacacatgggaattgtgggagctacaatttaagatgaaatttgggtggggacacagccaaaccatatcaggagggagatacaggaatttagaaactttgagccttttctaattctaaacattttagcagctatttgagtaatttctagaattaaaatagcaaacatagctttcatgaagtcattcttgttttgctatgttaattaatatgaccactggatatagaataaattgcagtggattctaaaatctaatggttttataaaatattctgattttgcttttattagaagttgaaaggggaagtttttagtatggggatgtctgcatgggaataaacagttttattttattttatgtgggtatatttattttctgtcatgaattggatgtttataaaatattttcattttgttaaaaatatggtttgttggacatggaaattttgaaaatgtttaagagaaggatatcttaagatcaaagaggtttctttcaattaaaattaaaatttgaaaccaaagtaatttcacataccagcaatttaaggggtctattaacttttaaaactgtatctgtacttttaaaaaaacattatgaaggatttttaaaaatacaaaaatgttgaaataattgtacagtgaacacccatatataccccacatatgtttgacaatttacatcttatggtatttgctttttcaccgatttttccatttctctggccctctatcatacggatatttatcttattattatgcatctcaaagttgcagacataagtacattttacccagaaacacttcaacatgcatgtcattatccagagtcatattttgtttatgattttttaaagtaacatttacatagagtgaaatatataaaccttaagtgtaccattcaatgttttttcacaagtgcatacacttatgtaactcgaactcctcctataaagatatagaccatttctgtcaccccagaaagtgccttttcccagtgaccatatgcactcctcagaggcaaccactgttctgatctttccctccatagattaggtttttaaatttttgttctagaatttcacataaatggaatcatacaatatgtataaggcttgtttcacttagcataatgttttagagattcagccatgttgtcccatgtatctatgtggctccttccttttgattgtggaacacctattccattgtatggataggccacagtttgcttattcattctcttgatggtcatctgggctgttttctggcttttggctatgatgagtaaagctgctgtgaacaatcttgtcaaagtctttgtatagatacattttcctttctttgggtaaatacttaggaatggaattgctggtatgcctgtaattttaacattgggtttagctactgaagagaagttgtttttaatcatgctatgactgggctacatttcattttaaatgtacaccttttccatttccatttgccaccatcctagtccagatgatcatgcgtcatttctagattatgatagtagagcaggttctcttacctgttagtcgctgccccacttcagtccattcagcaaaaggcttccgggtgaaaacactacattttgacactttactcccttgttcaaaagtctgcagcaccttctgtgtagtgtcaagaccctgtaaatctgtctctacccttccttgtttcttatctcttttcaacataaaccccatatgcgccttcctgcacatttctgccttcatgcttttgctcatacccctagcctagaatattctttcttccttctccatctccctagatccttagagttcttaaggtacagctcataattccacaactagtttgtgagctccttgtgggcaaggaccatatctaatataggtagagtttccctcattcaaaaatctgaaatctgacatgttccaaaatccaaaactttttgagctctgacattgcgtccaaaggaaatgctgctcattggagcattttttggatttcggattctcaagttagaaatgctcaacagataagtataatgcaaatattccaaaacccccaaaaatctgaaatctgaaacacttctggtctgaaacatttgggataagggataaaacctatgcttatattccaatcaatacttatcatagttctacaaacataatagacatttagtcaatacctgctaatttgattgcctgatactgatgattacaagtgaatctaatttctcagtatttctttttaatgctcagttaggttttatacctgaagaactattgtacttaatagttaatttttaagttacttttaagttacaatgatatagttccaaactctatgaaatacatataacaatgagaaaaatgcactctaatgtgtattataattacagggtagtaaaaccatgactacctgatgcccctagggaatgagtcatgtgtgcatttcaagcagtggaaggcttactgccagcccttttattttcatgtttaatggaatgctataaagtgtagtacacatgttatgtacttgccctcttaaatcaatgtgcttccttgtagctgcagatgcacatagcgatggtatcaggctttaggctgagagacttcatttgttcctccatacacacagtatagttcagccccatactgctgaaccacattggttatatatgctcactgtgatacactgaggctctgcaggctacagttttgagatacaggtgacaacttgctttcttggagagctgagcttctgtccttatcttttgaactcaagttctcttctcagttttcactgtatttgcagttctgtacccaaaacaccatatatgatttctgttggtcactgctgttgtagtcttttcctccttgaccactggtcctatcatagctatttgtgtgctctactatacccttccctcttatattctctgtttcctcttttttcttcattatcctgttaactttttccaaactttccattttatgtaaaaatgctctctccccttacataccttggcaggcaataaaagcactcctttctttttgcatgttgaactgatcagactgttggatgtaatgttcaggtgcgttgccacttctccattctgctctgtgttgccaggggaatatggattcttttttgttttttaccactaaactttttgtttgttctgtatattacaatagtataagggtagactttgttccagggtataatcatatctgaaatctaatgtggcatttgccagtgagttttaactatggaatatcatgtggcacaagaatggtttttacttcaataggatcatggtagcagaaatgtggagaggaccgtgtgtcattctggctatgattttatattgtttactcttgaaataactctaaagattgatatgtgtatatacagccttagtaattaatttttctcatcagtttactcttagtttatctcttgatttataggttccaaggaatcctgatatcccaaatccagctctggctcaaagagaagagcaaaaaaagattgatggagctgaacctcttacaccagaagagactgaagaaaaggaaaaacttctcacacaagtaaaatattttcaatggctgtaatacttacagtcaatcaatagaaaaaaagaaaatatagatcacactttttattgtatgggcctagtatcctagtgtgacacaccaacaaaactcagggctattttgtaaacatgtttagaccaaatctccttatttttaaaaattgatcttatagaatatgcccttttggaaatagtggatagtatgtatatgcaaaatataagtgtcaagtattagcaatttgacatacattttgccaattataataaggtcagtgaatccacatttgaattctgatagacagtagttattaacatattcttttttgttttttgagacagtctcgctctgtcacccaggccggagtgcagtggtgcgatctgagctcactgtatcctccacctcccaggttcaagtgattctcctgcccaagcctcccgagtagctgggattacaggcacccaccaccgtgcctggctaatttttgtgtttttagtagagatggggttttgccatgttggccaggctggtctcaaactcctgacctcaagtgatccacccacctcggcctcccaaagtgcaactgatactacaggtgtgagtcaccgtgccaagcctgttattaacatattcttgaaaatttaaatttcttttgtttatagatgtgaattgtctcctgaagttatattctactaattttttattaatggaataatttcataattttcaaaattctttttatctttttttataattttcatacaatgatgagagatttctgaagcttttattattattattattatttaaggtgatcattgtataacaattattaaattaggaaggtttccatttgaacaaaatattaatgcttttaagtcattattgctatcatgagttttacgagtgttctacttctaaaataaactatagaagataaaaatttcagcatagaaggcttgcaaaataaacaaaatgtgtaccgtaggacattactttagtatagagggttgccagcaagatttatttattcaacaaattttgaacaatgtgcgatgcatagtagtaggtaattctccacgttaattattgaaagatagtttttatatttgtatattatttattatataggttttttttgctataacgtaattttattgtatggattttcacaaattacattcataagtttttgagccaaatgcctggaagtaataaagtttagtttgaaaatataatggcagatggctgaatattagaacttaccacagaataaaataaaacatttaaatattcatgttctattttcaaaatgtatttcctgaatgtaaaagtaaagttatggctttagaatgctacatgacttggagtatattgtgaatgtacggtataacatgaatatacagtctcaactgagataatattttagtttgtaattagaaatataatcagttttctgcttctcctagtatatgaattcatttttgtccttctctgctgccttaaataattaatctttttcaaaaaaccatggcagtacgtaggaacaaaatgtggggtcatctgaaatctttatcaactaaaagccagggatagagttttgcagtgtctggagtatcacatttatgtgagttggggctcgaggagtggaagacaaattcttggtcttgtgacttcacagacatgctaataatgccaagggaatttaaaacactggctaaagtgttttatgttttagtaaagaaattgagtggctccaataacgttctgcttgtagaagttctatttatgaacataatttagaacagaaattatttattcacactagttcagaatgatgtaaagagctacaatttttttttgcattatcttttggttattcctcagtgttcttttgatttagtgcatccacatttctctcttttaatttatgtaggaacagatctgtgaaaaaaatcattgaagtactagaatatcacgacttcagcatttatattagcatttttattttcatgcatttgtattttaatgtaggcatctataaaatatgaaattaaaaactacagatcttcgaactatgtatcaacattctctttgtaatagaaaagcagttatttctataacaactctcactcaacttttgattccaacataaaatatgtgcaattttataaggagaaacattttaagtcttttaaagtgttttttaatgtatcattgtatagaagtaaatagggcaataaatggatttattaatttaacctctattgataatgcttaactttttgttcacagggtttcacaaactggactaaacgagattttaaccagtttattaaagctaatgagaaatatggaagagatgacattgataacatagctcgagaggtagagggcaaatcccctgaggaggtcatggagtattcaggtttgtatataatttgaaacatggtgttgtattttaacgttattcatttatttagcatcaatttaattgtacctttgttcagagatgttttaaacttttatgaataagacatagatgagagtataaactataattgtatttctatgaaaaggttataagaaaggttataagatttatcctaacaaactgactgctattgtctctatcacctagctaaaagaggcaaataaagctctgataaaacaagggtggctcttggataagcattgacaaaattagtttcccaccttcccacctctggaatttggtcttctggttcagttctgagattcacattcagtggattgaattcgtgcctttctttctaggtcgtccttaaagtagagagttcctgtcaggcccatttagatgctcaaacaccctcagagttccaccctattccagagagttcctgtgggtcccattaacttggggctagcgggcgtagagctgaaaagattgctttaatcaatctgttaactggtcctcaaatcctctccctctcttactcacctgtgttgttgagctcgaccagaatcagtttagctgctgaagcatatggattttttttacacttactggtttattataaagggtattgtaaaggatacagatgaagcgtgtagggcaaagtatgggccaagagggcgcagcgctttggtgccctccctgggcgaaacctcttcgtgtttagctatccagaaatcttattaaaaataggtaaatatgtctagcaagttttctatatgtagtacatgggacttttctaacttccaaataggttcagctcttaaacttatcatttgaaacaagatgtttagaatctagagcattttttgtcattgaaacaatggcaaagtaggtttaagtttacaaagtaggtttaagtttctatgatagcccctgccccaaatctatttaaccctaccactgaaattctgtttttgcaatagtaggaaagaaacattacagtaccaataaatatactaaagattaataatagctaggaacagcttttaatttatctagcatgctagtgcttgaagaaatccagatttaattagagagatttttttttcttctggaaatctaaaagagtcttctgggggacttcagaggtcagttgtattgagtttttattacatataatataacattaagtatatgaacttccttttccttcataccagcatgatattactattactctgaacatttagcacataaatttagggcatttggaggcttaggggaaaaaatagattgaagagagaaattttagcatcaagagttgaatgaaaagaatgtaaaagggtatgtgcagagagatttttaagaagaatttttttcagaagataggcagggagataacatcggtgtatgtgaagttgcaagaaaaaaatgtgatttaaaaagatgatcctgtcagactttctttcaaatttgacaccaagccaggtggcatgactagctcaggactatttaattgctgcctgccaggttgggggccatgtcacagggtgaggagattgcaatgagtttgttgtagttggttacagtaagagaagaaatgtgtacaattgaccacccatgaatatacagtatcctgtacatagcaagtgtttaaatatttgttgaatgaatatgtgagtgaatgagtaaatgaacacaggtgcttataaaaatcagagtgctcacatacctttcttgataggctctaaaaatgaaaagcttgaggatgtggagtatgtcattaaaaggcctttcattgaagtcatgtgacatattaatacagccagattatttggctcatctataaaatttggttgagtgacttggaatgtttttcagtgtgtatgcaattaaaatcccaatgaggtttttttttttttttttatgagaaaagggtattccaagtaagtttaaaaacacactactggtcattggaaataccgtaagatgattagtgagtgattccaaaagcaaatgacaatttcaagagaaatggctgctccatagaaaaaaatttgaacaacctgttcataatagcttgggttttttgtttatttgtttgtttttgagatggagtctcacttaatcgcccaggctggagtgcagtggcgcgatctcggctcactgcaacctccactttccgggttcaagcaattctcccgcctcagcttcccgagtagctgcgattacaggcacgcaccaccatgtgcagctaatttttgtatttttagtagagatgaggtttcaccatgttggccaggctggtctcaaactcccaacctcaggcaatctgcccacctcagcctcccaaagtgctgggattacagtgtgagccactgtgcctggcccataattgttttcgcatgctaggaagctatattcactgtttatatattactctctcctgtgtcactttatgtgtttggtcccttttctatcatgtttgagtaaaaagcctagcttaaatcagtatctgcatcatcttttgaaatcctagtcatttgggatggatcgtaagactccgtactatttcatgaaggaaaattgctaacctaaaaccttgttttgaggtcttatttttaagtgaaaagttagtagtatttaataatttaacatattatatatataagattaatctgaatcttaattttaagaagtacaagctcattgtattctttcctattaattccttattctacaattccttggatttatttgcttaaatgataggattttaaagaaataactctgtttttcagctgtattttgggaacgttgcaatgaattacaggacattgagaaaattatggctcaaattgaacgtggagaagcaagaattcaacgaaggatcagtatcaagaaagccctggatgccaaagtactatgttttatgtcaaattattattagatcgttttaattgaaatagtggtcagctttgacttcttactgcacattcaattaaaagcactattttgtttaaatacacagattgcaagatacaaggctccatttcatcagttgcgcattcagtatggaaccagcaaaggaaagaactatactgaggaagaagatagattcttgatttgtatgttacacaaaatgggctttgatagagaaaatgtatatgaagaattaagacagtgtgtacgaaatgctccccagtttagatttgactggtttatcaagtctaggactgccatggtatgtattcctttcttaccgatttcctccaactttttattttgaaaaatttcagatgccatatatccttcacctagattctccaattaacattttgacacattggcgctctctctttctctctctctgtgtgtatgtgtatacatacgtagcacctatatatacgtgcagaatctatattttgtattaaaaaatacggggacatctatattctatattctgaaatgcgtatctatattttataagtatacttaactatatttatgaaccatttgaaaattacagacaatgtgagtgttcatctctaaatacttaagcatgtatctcctaagaataatgacattttcttacataaccacaatcccacctgaaaacattgattcagtaatgtcatttagtatacagtctatgtataagcttttccagttgcccccaaaatgccccctttatagctgttttttttaaaattgatgatcctgcaagtttcacacattacatttcgttgttgggtctctttaatctcttttaatccacaaccttttggttttcgtgatcatgactttttaaaggtgtccaggctagttgtcttgtagaatgtcccacattgtggatttacctcattactcattgtaagattcaggttcaacgtatttggcaagagtgctgtggaagtgatgttatgtattttttattgcatcccatcagaaggcacattatgtcatgttgtcacactgttggtgatgctaagtttggtcacttgttaatgtgatgatcttcagagctctccgctttagagttatgttttcccctttgtaattaagcaggttatgcttgagactatgcgaatgacttaaagatggacttttaatgaaaaggagttgttgcctaagttgagttttttattaggaaacagaatatttaagttgaagagatattttattttagcttatgtgatttcctccattactttctaatgtgaattgtgttcctattctagtcctacttagcagtggtgttcatgatgattttgaaatacatgcaacacatttttaatgttggcattgttaatcttttgtcagccaaggtaattaagacaaaatagatttatgcagcctaaaaattaaaagcaaccagaaactaacaatgcaaacaatgtttttgtgactagtcataaaataggatacatttttcttagctgctacctatcataaatatctttttgtccaaaagttgactgagtgtgaaacaatgcttaatattttgcttgactcactttatattttcagttcaagttgaataaaaggaaaggaaaaatctgggttactgtagtgaagacattaattttggcagatgctttagaagatcacatatttgttaaaactttaacacaaatttagagtgtgtggagtatgtccatcaaatttatgaatggcgtatgcttggagagctagcaaatattttagaccaagccatgatccagaaggagctagagtagttggaatgatggatcagttgaatccagcaacacaacatttatttattttatttatttttgtatgtatgtaggtatttatttattttgagatggagtttcactctttgtcacccaggctggagtgcagtggtgcagtcttggctcactgcaacctccacctcccgggttcaagcaattctcatgtctcagcctcccgagtagctggtattacaggcacctgcaccacgcccggctaacttttgtatttttagtagagatggggtttcaccatgttggccaggctggtctcgaactcctgatctcatgtgatccacctgcctcagcctcccaaagtgctgggattataggcgtgaaccaccgcgcccagcaaacatgacatttaatagggataaatgtaaagtgctatacttgtacaaaagaatatgaaaagatatatatgttagcaaggtacagtaggaagaattaagaaaagaataaaaaagataaagaggtaatctgtagcttgaaggactgaggttggatatagggaagagttgttttatagagttctttggatcattgaaatagattattgaagaacaatgtagaatagcttttcattagcctttgaaagtggaattctattttgactctctgaagacattggcagtaagttacttggccttttaaggtcccctttagcacagtgaatctatgactatgtttagcagagaactccttttaaaagccatgcaggataaatcttttagccatttggggttttatacatgtaatgatttaatttagagcaccactaacagcttgtagaagacaaatgcctacctgcatttgtcagttaatcatgttttagaatatacatacccttttctgtgatagaacagttattgaattttgagtttttatttcagtgatattttgctaattttttaaaaggttgagagcttaatgctgttttcagtttctggaatcattaaaccagtaggacgaaacacattcaaagtgcaaggaaaatcttaacactatttataatatgaacacgactgtggaactacataaccttattttattttctaagaaaaaaatccagtataatattatcaaccactagatgtctctgaactcccttgtaaaaaatctgtttttcttccatcttctttttacaaaacatttacctctgtactctttctttaccgagaaatgtaaatctcaattatgttttccaaaaagcacatattaactatttaaatgatcataaaatgaaatctttttctgttaaaaatgaagacatttctgtcttcaattaccttctagaaagtggaatttattatttctgaacaatcttcagaaacatgcagtagtttattttatatttaaatattttaattgaaaagttttatttattactttttctatcgtattaaatttttatttcccttctagttaatggataatttttgcttataataatttttgcttataattctggatttagagtataaataatgtattttaaaacacacatacatttggaactttttagaatatttcatgataatttcaacaattaggaaattatagaaatggattgatggttcttgatgatcttctttccccctttcatttttagtaactcttctgtatagtgaatcacattcacaatctaggaagagaaactgccccatttgaaagaggcacttgtgatttctgaaatacaaagaagttgtttcattgaaaaatcccatcttagaactacagagaatgtaatttgattcattatgtgagtgtgtcactgtgttcaaatgaaaatcttactaatgattgaacttagcttactaaagatacctttaaaaacgatctggcttaaagatgactcttttctttctcagagacatgaatagtgtgaaatgcatcttataaaaagtagaaaccttaatagttatatttgattcagagatctcaaagtactgaattcatggctcctgacttaactaacagtcataaaggcacgaacttccgcttctaaatatgcctcactttgaaagccttcagctaaaggttgcagatttctttgaggctctttttcattaaaaaatgctagctatacaaaagagaaaatgagtttcagttcaatttctctgtgctaaaaggattgtgatttctttctctgagaatttgtgtggtctttaagtaagtaatcagtctctattgaactacataaacaagtaggaaggatatgatcaacttagctttttaagctcagagcatatgaattgccctaccattttctttctaagaaaaccatcttagaatgaggtcatagtcttaggatagtcaaaaacttatcagagttaaaaggacccttatcaaataaccataagaggaagtaatactttgtatttatgtagtaccttttatataatgcttgccaatccctttaccaacattagcttaattttcttgccactccttttaggaaatgaatgtcaggagagtatctctgttcattgagtgacgactaaatgtgactgggagattctggaagaatctaagaagtccaaaagatctagcacattagtcagtttactgcaaaggacatgtggaaagagtacccaaaattcaatcagtaattccttgtaccttcttaggtccttctaagtacttaaagtagaaaaagcagaatttaactctctgaaataaggaacatttcttgatagaaccatttattgcattatttgcagggctgctttgactcttaattttagttaaaaaaaaaattcttaccttttaacctctggggagatttttccttttccagccagctcaagagcctgtgtgtgcattgcttgtggccttgtatatattagagttgaatccgagtattagtaattagtcattacaattaccatatcttttgtagtagtttcaatgcatttttctgatagcatctcagaaagagaatcacatactgtggtatacaatgtaatgaaaattgtgttattactgcttgttttcaaatcacagctttattataaatgaaagtgttttctatttaaaaggtaagaaaatgacattctccattagaattgtaggaaaaaaatactttttagaaaatattgctttagctctttattaacttccctgtttttggcttatcaggaggtattaaatgttaattagtattggttcagcacaggatattttataaattatcagtccagtcagaaatggattttctttacagatactttagaaaaatgacagtcaaattaaaaaattgccaacttgttctatagtcacagtaacacttctatttgctgcttatggagtgtagtctaggaaatttcataaggaaagacagctactcatgatttttaatttccatgttagtacttaattgtgtgataacagctaattttttttttcttggctcactgcaacctccgcctcccaggttcaagtgattctcgtgcctcaacctcccgagtagcagggattacagttgcgcatcactacgaccggctaatttttaatatttttggtagagatgggatttcaccatattggccaggctggtcttgaactcctgacctcaagtgatcctcccacctcgcggtctcccaaagtgctgggataacaggcatgagacaccgtgcccggcctaatattgatattttagagcattacattcttagtagaatatgaaaaatatgaattaatacatcattggtaaaattaataaactgtaaaatgtactgatgggttcttcttgactatagaattaaaatatttaaaaccacgtatttatgcacttaggagtttattacctcctcatgcacttaaaagactaaaatgttcttttcttattaaattttttttttgaaacagggtctttttcttgcccagctggagtgcagtggcatgatcatgggtcactgaagcctcaaattcctggactcaagcgaacctcccacctcagcctcctgagtagctaggactacaggtgcgtgccactgcacgcagctggcttttttagtttttgtgaagacggggtctcactgtgttgcccaggctggtcttgaacacctgggctcaagcaatcctcctgcctcggcctcccaaagtatcaggatcacaggcatgagccactgtgcccggccacaattattaatagttgtatttaaagagaccagcatagcacgtgacccagagtaggcgttcagtgaataaatgggcatagaactgttgtatttaagtttgcttctatcccatagactcctacagttggaccagatttggatagaatgcgagcaaattatgccagtgggttggagttcattttacttttcctttaatctacctttttctaaggttagactttatttggctatcatccctgcagcttttatttattcataagcttgaatagccagttataaatgtcatatgttttattatgcagcaatagtgttcgatttggtaccttgaactgttgtaacaatctgacatgaaatacaattaatgcactaacaggagttcatttaaggtatttattcttatgcgttatcttgtgaggaagtgataacaacattttctttttttctttttttgagacggagtcttgctctgttgccaggctggagtgcagtggcataatctcggttcactgcaacctctgcctcctgggatcaagtgattctcctgcctcagcctccccagtaggtgggactacaggcatgtgtcaccacgcccagctgatttttgtattattagtagagatgaggtttcaccatgttggcccggatgatctcgatttcttgacctcatgatctgcccgcctcagcctcctaaagtgctgggattacaggtgtgagccactgtgcccagtgatacagtattttctaaatagcaatgcttaagcagcagcagttacgtaaaagcatcataacatttaatacttgtttgtgaaatgtaggatatgtttatttgaatattaactctcatataactgcctgtgtgcattctagtatagactgccattgcttttcgttagtatgatagagattcaaaagtgactaggaacctgggaaatatactgcagaatgtataggtgaagacatcgattaaaaaagagcaaaggtgaagcaatgtccattttgttttactaagagctgtagaagaaaattctgacctcatagaactttacctacaaattcagaggcacaaatgcggagtggagttttttgtgtgcccttgctcattcagctgcttttgactttcaaccataacaggcgcagacctgtcattcagacttaggtaggcttagtgtctaggattttagtacataggaaatgtaatgtggagtctctttaatctctttcaataagtcacttcaagtctactgatgctttctctgccttttgaattgaagctttgaagctgagtattggagcaaaggatatttgaacttagtgcccaggatgattgatattcaccacacactaaggggcagtgctgctcactgcaaacattacatcatttattaaaggtagagatacatatcctagtattcaaaaattgaaacttgagtgactttgcattgaatagaatcataaaccattaaaaaagtatggagaaccaaggcaacacaattttgtttaaagtgaagctaagtctgtagcttaaaacaggacttggaaactgtggccccccacctgtttttgtgtggcctgaaagcaaagaatgacttttatattttttagtggctaaaaacatcaaaagaagaaggatattttgcaacatgtgaaaatgatacaaaattcacattctagggttcataagtaacattttcttggaaaatggacacacatttgtttatgtattgtctttggctgttttcgtgctacaatggcagagctaaatagttgtgacagagattgtgtggtctgcaaaagtcaaaaatatttgctatcaggctctttattgaaacaatataccaacacctggcttaaaagtatgtgtaagaaaggtggaaagaattataaccaagggttgatataagtgttatgcaattctttaagaaaagggttaagtgaaggatgggtgtataaagggagaggatatttagccttaaagaggggtatttggggacctaggggtgactgtgattgaggcatgggaacttccttgaaacatgtgaaagattgtcatatggaataggaaatcagcttgttctctaatgtctacaaaagttagacctacaaccaatttttggaaaccatgaggtagcaaattgtagctttgcatagaggaacatttttaacttgtctgaagttggaatagccagccttgtgaggtagtgggtactccatcattggaagaattcagacaggctgtacaactaattagcaaggacctagtagtagggattcaagcatcaacctgaatgacttaaaagttcctttctcatcttgcgagtttatgattttatgaactctgtgtcaagaaaagatttctgagtacaaagtacacttttgattacatcactcctcctgctcaaaaattgtttataagatccttttgtcaatggaattaagtaaaatttttaagttctttgttgttagttcccagtttctttacacagtcacacactggacatatttcaggttcagttccagaacactacaataaagcaaatatcacaataaagcaagtcacatgaatttgttggtttctcagtgcatataaaagttttgtctataaggcgagcaatagcattatgtctgaaaaagtacttactttaattaaaaaatactttattgcttaaaaaggttaacagtcatctgagcctttagcaagttgtaatctttttgctggtggatggtcttgcctcagtgtgaattgctgctgactgatcagggtggttgttgctgaaggttggggtggctgtggcaatttcttcagagaagacaacaatgaagtgtgccacattgattgactcctcctttcacaaaagatttatctttggcatgtgatgctgtttgatagcatgttacagtagagcttctttcaaaattggagtcagtcccctcaaatcttgccaaagctttattaactaattttatgtataattctgaatcctttgttgtcatctcaacaatgttcacagcatcttcaccaggagtagatgccttcccaagtaaccactttctttgttcatccataagaagcaactcctcatccactcaagttttatcatgaaattgcagcatttcagtcacatcttcaggctccacttctaattctagttctcttgctatttccaccacatctgcagtgacttcctccactaaagtcttgaatccctcaaagtcatccatgaggactggaatcaccttcttctaaactcttgttaatattggcattttgacttccttccataaatcacgaatgttcttaatggcatctagaacgatgaatcctttccagaaggttttcaattgactttgcccagatccatcagagtaatcactatttatggcagctatagtcttatgaaatgtatttcttaaataatatgacttgaaagtcagaattactctttgatccatgggctgtaaatgaatgttgtgttaacaggcatgaaaaacctcaatatccttatacattatctccatcagaactcttgggtggccaggtgcattgtcaaagagcaataatattttaaaaggaatctttttttgaggagtagggtctcaacatgggcttaaagtataaatacttcatactataaatagtgctgtcaccccagcctttgttgttccagttctagagctaaggtagagtggatttagcataatttttaagagccctaggattttcagaataataaatgagcgttggtttcaatttaaagtcaccagctgctttagcccctaatgaataaacctgtcatttgaagctttgaagctgggcatccgcttttcctctctagttatgaaagtcctagatggcatcttcttctaatattagggtattttgtctccattgaaaattcgttggttagtgtggccaccctcatcaattatcttagctagatttttctggataacttgctgcagcttctccatcagcacttgctgtttcaccttgcacttttatgttatggaaacagcatctttctataaacttcatgaaccaacctccaccaactttaaacttttcttctgcaccttccttacctctctcagccttcatagaattgaagagttaggatcttgctctggatgaggctttggcttaagggaatgttgtggctggtttgatctgtccagaccactaaaactttctccatatcagcaataaggctgtttggctttcttatcacttgtgtgttcagtggagtagcactttttttttttaaattatactttaagttctgggatacatgtgcagaatgtgcaggtttgttacataggtatacacgtgccatggtggtttgctgcacccatcaatccagcatctacattaggtatttctcctaatgctatccctcccctagtcccccacccccccaacaggccccagtgtgtgatgttcccttccttgtgtccatgtgttctcattgttcaactcccacttatgagtgagaacatgcagtgtttggttttctgttcctgtgttagtttgctgagaatgatggtttccagcttcatctatgtccctgcaaaggccatgaactcatcctttttatgactgcgtagtattccatgggggtatatgtgccacattttctttatccagtctatcattgatgggcatttgggttggttccaagtctttgctattgtgaaaagtgctgcaataaacatacatgtgcatgtgtctttagagtagaatgatttataatcctttgggtacatactcagtaatgggattgctgggttcaatggtatttctggttctagatctttgaggaattgccacactgtcttccacaatggttgaactaatttacactcccaccaacagtgtaaaagcgttcctatttctccacatcctctccagcatctgttgtttcctgactttttaatgatcgccaccctaactggtgtgagatggtgtttcattgtggttttgatttgcatttctgtaatgaccagtgatgatgagctctttttcattatgtttgttagccgcataaatgtcttcttttgaaaagtgtctgttcatggggggagggatagcattaggagatatacctaatgtaaatgacgagttaatgggtgcagcacaccaacatggcacatgtatacatatgtaacaaatctgcatgttgtgcacatgtaccctagaacttaaagtataataataataataaaaagtgtctgttcatatccttcgcccactttttaatggggttgtttgggtttttttcttgtaaatttgtttaagttgtagattctggatattagccctttgtcagatggatagattgcaaagattttctcccattctgtaggttgcctgtttactctgatgatagtttcttttgctgtgtagaagctctttagtttaattagatctcatttgtcaattttggcttttgttgccattgcttttggtgttttactcacgaagtctttgcccaagcctgtgtcctgaatggtattgcctaggttttcttgtaaggtttttatggttttaggtcttacgtgtaagtctttaatccatcttgaattaatttttgtataaggtgtaaggaaggggtccagtttcagttttctgcatatggctagccagttttcccagcaccatttattaaatagggaatcctttccccattgcttgtttttgtcaggtttgtcaaagatcagatggttgtagatgtgtggtgttatttctgaggcttctgttctgttccattggtctatatatctgttttggtaccaatatcatgctgttttggttactgtagccttgtagtatagtttgaagtcaggtagcgtgatgcctccagctttgttctttttgtttaggattgtcttggctatacgggctcttttttggttccatatgaaatttaaagtagttttttctaattctgtgaagaaagtcaatggtagcttgatggggatagcatttaatctataaattactttgggcagtatggccattttcacgatatagattcttcctatccatgagcatggaatgtttttctatttgtttgtgtcctctcttattttcttgaggagtggtttgtagttcttcttgaagaggtccttcacatcccttgtaagttgcattcctaggtgttttattctcctggtagcaattgtgagttggagttcactcatgatttggctctctgtctattattggtttataggaatgcttgtgatttttgcacatagattttgtatcctgagactttgctgaagttgcttatcagcttaaggagattttgggctgagacgatggagttttataaatgtacaatcatgtcatctgcaaacagacaatttgacttcctttcttcctatttgaataccgtttatttctttctcttgcctgattgccctggccagaacttccaatactgtgttgaataggagtggggagagagggcatccttgtctctctcttgtgctggttttcatagggaatgcttccagtggagtagcagttttaacttcctccaagagtgtttcctttgcattcacaacttggctagttgtttagctcaagaggcctagcttttggcctgtctcaacttcctcactaagcttaatcatttctagcttttgatttaaagtaagtcgtttccttttatttgaacacctaggggccattttagagttataattagcccaatttctatatcattttgtctcagggaatagaagcgtgagggagggagagagttgggggaatggctggttggtagagtggtcagaatacacacaacatttataaataaagttagccatctaatatggttgtgattcgtggtacctcacaatgattatgatagtaacataaaagctcactgaccacaggtcaccgtaacagatataataataatgatctttgaaatattgtgagaattaccaacatgtgacacagagacatgaagtaaacatatcctcttggaaaaatggcaccaatagacttgttcaatgtaggattgctacagacgtgcaatttgtaaaagcacaatatctatgaagctcagtaaagtgaagtgcagtaaaacgagatacgcctgtactttgatcctaacttagctgtattcatcactcatgctgtgcaacatttcccaagttgatttctaccaaacgttgttccagggtgtgcaaatcgatgatatgcagaacaagagttctgtgttcagatagagttgggacgtgctgattatactgaatcctgccattcacatttccactctgcattagaatgctaaaagctctgagaagtcctatcataaagaaatttgtgtaacattttaaaaaaccaacatttcccatacacatttgaacataggaattttttgccacagctattaacactacagagcagttttccgtttgttattttcctattctcttctgttgtctttattgtttttgcatctcctcttttcctcttgtgtgctgtttttctccaacttcatttttaaatccagtgtggggaaatggtgagagaaagagataactagactatacaattgtggaaacagtttgaggtcctatgaacaattccctgtaatcccccacaaaataggaagataaagatgtacaagaatctaggagaatatatgaaaggagaaattatagaaaaagaatgtgcttttgacatcatgaaatttctcatagtcatttcatagtcacttattcaataaatgagtcattttttattggtaatctagcctttctccttttaacttctagttttagctagtgttctgtttgtgataacttatgttgcgttaggcagtcatgaagcatgagaataaaaaaatggaggctgggcgtggtggctcacgcctgtaatcccagcactttgggaggccaaggtgggtggatcacaagatcaggagatcgagaccatcctggctaacatggtgaaaccctgtctctactaaaaatacaaaaaattagccgggtgtggtggcgggcgcctgtagtcccagctactcgggaggctgaggcaggagaatggtgtgaacccgggagatggagcttgcagtgagccgagatcgtgccactgcactccagcctgggtgacagagtgagactccgtctcaaaaaaaaaaaaaaaaaaaaatggagctggtatctatagagaacatgacatgacctgtgtgataggaaggtaacacccatacttgtccattccttgatgtctttctgtagcgtcttagattatttttctgtctggagtagttattgacaggttaaaaggaatgaaggtatgaactaattacacagtccatttatactcattttgaggtattctacttccctgcttaggaggctgtctcaaaagtattagtttttttttctgaatcacccacatgaaccatgaatatatatctaaagatatctccagtcacaagcaactattacttattgagaataataatagccagaggatatagcttaatgattcacgagtcagctttacataaagactctatttagtctccctagaaaccaacgatcaaatctcatcagggtcaacttagccttttctataataggtaaattgaataacatgctgtttaatttgtatgtgtgttattgaatgaagctatggagaatatttggtctgcatactaaagatatcactattgttttggtaagtaaggaaaatttcagagttattgtttctaaattatttaaccctgggtgattgaagatacacaagaaacttgaacatgccagtgttacattagagtatttttaataggtaaacaataattcattaatgagcaatttttttctggctagactctggttttctgcctccttttgggtttcatttagagcctaaaattcatttgcctggatagttgatcttattttgtatcttacatttcctatgttgtatgccattttttttggattttatttggaaagataaaactgaattttaaacaattttccattcttaaaaagttacagattgcccaacacttaaatgttcattgcagaaaatttggagaattcaggctagtatcaagagaaaaataaaagttatcagtagtcctactcttagggatagccgatgttaaccactagtaacattattgttaatattcttttagctatttctgtgtatatatataataataataatacgtgtctgtgtattctgtttccagattaccaaaattttagttagttcccagtttaacactgctctaaacattgttttgtaaatatttgtatacatcttatttccttacaatacatttctggaaatggaattgctaggtcaaagggtgtgaaaattttaagatccgtcgttgaaatgtcaaatttgctttcaagaaaggtagtgtattagtcagcttgggctgccataacagaatgccacagactgagtggcttaagcaacaggaatttattttctcaccattatggagactgaaagttcaagatcaaggtgccagcagggctggtttctggtgtggcttctcctcctggcttgcagatggccaccttctgcacgtggcattctcatatggcccattgttggagtgcgtgcagagaaagggagagctttgatgtctcttccacttcttacaaggacaccagtcctattggattagggctccatccataggacctcatttaaccttaattacctccttaaagtccccatcttcaaatacagtcacaagtccccatcttcaaatacagtcacattgaaggttagggcttcagatgaattttgcggagacatacctcagtccatagcagatagtagcattgacatttcatcatcagtgaatgaaagttcccgtttcagcatcttattgtcaatgtcagatatgtataccatatatgtgcacatgcacacaagcatgtacatattgctaatttgatgaagatggcattgttttactttgcatttctttggtcattagttgcagtgaaacttgattataatgtttggacttttttttttttggtgagttttctattcctgtactttgaccatttgtgtgtgtgtgtgttggggttgttcttaattgccagtaaacctacattttcacttgagtgtttagctattctggcaggcatttttgcttatacagaaaaggaatcatattttaaaatattatttatcctttgatattaaaccattatttacctttaaaatatagcaaagtatacagggttaataatatatgatattccgtattaatgaatcatgtttaatgttcaccatacattcgtaaaaagtatttatagtttgcatgcattgatttgctgacagtgaaatataggtagtggcaaggttaatgtagaaatcttttcagatattatttgctctgaattaacaaatacagcagtgtttcctgtgatgtggtccccagaactctgatcccacaagatgtccggtgagaagaaagtctgttggttaaatatttttgacaactgctgcatcctgtacgccccacctagtggttcacagtgcacatagggaactgaaaggctctgagaagccatgtaataagtaaatctgtttaacttttgtaaactgggtacttccaaaacttattttgaccatagaacatccccttatttttttttgtttatgtgatttatgttaactttttattttgaaataagaaaattcacaaaaagttgtaaagaaaatgtacagggaggtctcatgcacccttcacccagttttccccaatagtaacattttgcaaaactatagtaaaatatcacaaccaggaaattgacattcgtgtaatctatagagcttgttcagatttcatcagttatacatgcgctcgtgtgtgtgtgtgtgtgtgtgtgtgcagttcaatgcagttttgtcatgtgtagagttgtgtaacctccaccaccataagactccattgtgctatctctttacagtcacacctaccctctctcctctccctagctcccggcaaccattgatctgttctctctttctataattttgtcatttaaggatgttatataaatggaataatatggtatgtaacctttcgaaattagctttttttttttacttagcataattcccttgaggttcattcagattgttaactgtattaatagttctttcctttttattgctgagtaatattatatgatatggatgtatcatggtttgtttaaccagtcatccataaatgacatttacccccactcctaattctggtggaatctattaataccctgtgtgaatattgtcctgaaaaatagcagttttggaaattctataccacagaaatcatacagttaaatagttgtcagcgttttaaagataatgattgggttgcagaaattaaaaatctttattacttcatttaggaattccagagacgctgtaacactctgatttcattgattgagaaagaaaatatggaaattgaggaaagagagagagcagaaaagaagaaacgggcaactaaaactccaatggtaaaattttcagcattttcctaacttttaggtagatcccatttttttacataattaaaatgcctatattatgtttaatgccatagtgatagctattaataaaagctggttttatgaaatgctaatttgttttggacagaagaagaattgcttcacaaccatgtttcttatttgtttgtagaacatatggttaggaactccctagtaactaggctcagtattttaaaaaattcctcatgaatctaaacagaagtataatgcaagtgaaatcttttgaattgagactagagctatcatgggggtagcagaggggtaggggtgggatgggatggggctgaagttgaaactaggagttctgatttgatcaagtaagttttctgatgtttgtggaattatgagtacaaatgggaactctgagcagacaacaaagctttgcttggtaataagtgaactgttgaattgataggataacttgattttaatccagtcaggttgctttgtacagctgtaatttaaaatattctttaatagatcgtattatttgagtgtggttaagtaaactgccatatttcatcgaatctaagatgccttccattgtaagacacagcattattttatgtaccactgagggaaaatgctgccaggtgtaatttgtcatcagttgtaagttgcatcctgatttcagagatgctaaaatgtgaaagaaatgtgtatcatagaagatatgaaatatggtatgttaaaacctatcataagttttttaaaaaatatatactcataaacaaaattttgcccagaaaacattaagtagttctttaagataagagtacatttataataccatgtgtaagtagatacttgatgactatttttgatgggtattttatgtcttttcataaaaagaaacatctttgaaggttattttacattgggttatatagtttgttgggctatatagaacattaactgtgaatataacatttaagtgaatattcatgttaaaatttttttttaatgcatttacatcctagatttaacattgttgggccatttaaaatgtgcatattggagcagaacattaaatctgtttccattttagtcacagaaaagaaaagcagagtcagctactgagagctctggaaagaaggatgtcaagaaggtgaaatcctaaagcctagaaataaagttttaaatgggaaactgctattttcttgttcccatcttcaaatgctaattgccagttccagtgtattcatggtactctaagaaaaatctctttggttttgatttcttgcatattttatatattttacaatgctttctacctgaaatgtgtagctttatattttatggcattctagtatttttgtgtactgtattttgtgcatttcatgtcttcatcaaaatcctctcagtccttgttcttttgaagcttgtgctgaggttttagcttttctatgttttatatgccgctgctttgaaagagaacctagattctatagttgtattattgttgtttcatactttaaatttatatggctgtggaaaaacgaattaaaatgttttgaggagaaagactttttcacttctttgttgctttcttttctattgagtctgggcttgtttgtgttactgcatactgtgattagcataataattgtttctttgaggtcatctaaatatttttttcctaaaggaataaagggtgaggaaagaaaaatattaaaaaagctaatatttgatactgtgcttgctgtcagtatgcattacatttaaattattctctattcaagtgggaaaatataataaagaaatgtctataagaaattt

SEQ ID NO: 199 - DNA, 23596 bp, mus musculus
ctatgacaccggaagccggaagcgtggtagggaagggcgaccgcgaaactgggactttctcggagcgccggggccctaccagcgttcacagtccgccgctcccacccttctcacgtctgacggactctgctgacaggtgtggtccttttccccaaagacagggttccatccgtgggcgttccgccgcctccgaaacttcccccggacgttcaggctcccccctcttttttgggccccagcccgttcctgctccgcgcttctggagcactggccaaggcgggccgattcaggacccaggttacttgggcggcgagctggactgtttctactcctccctcctcctccactgcggggtctgaccctactccttgtgtgaggactcctctagttcagagacatattctgttcaccaaacttgactgcgctctatcgaggtcgttaaattcttcggaaatgcctcacatatagtttggcagctaggtatctgatttcatatgcctgtttgctcgttttgcaagacaacatctgcctatcgtcatactgtttctgtgatctgagaatgaatgggctctcctggcacattagaggaatagcacggaggtcactatagctggagcagagtgagggaggggagcacagttggagaggaagggatggggaacccgatggtacagggccttgtaggccgttgtagggagattggcttttacgcagaaggcaacggggatccatggtagggttctcagtagaggaggaatgtgatcggaattacgtcttacactgatcgttctagcagtggtggggagaacagaccatagtgggcaagggtaaaagaagggtggcgtggtaagaggtaattgcagtaatccagctcagagacagtgctttgagcattttattattggaaatttcaaaaatgtacgaaagtagaaaaatgagtatagtaaatctttttggtttgtttgtttttgagagatggagtctcgctctgtcgcccaggctggagtgcagtggcatgatctcagctcactctaacctcctcctcctgggttcaagcgattctcctgcctcagcttcccaggtagctgggactgcaggcgtgcgccactacgcccagctaatttttgtatttttagtagagacggggtttcactatatgttggccagtctggtcttgaactcctgacctcaggtgatctgcctgcctcagactcccaaagtgctgggattacaggtgtgagccactgcgctcggccagtatagtaaatcttacattcacagctaccaacttcaacaattgaaggtatcaacttctgactaattttgtttatatccctcgcaatcctctcccattattattttatttctttttctttctttctttcttttttttttttttttgagacagaatctcgctctgtcaccaggctggagtgcagtggtgtgatctccacccactgcaacttccgcctcctggattcaagcgattcttctgcctcagccgctgggactacagttgtgcaccaccacgcccagctaatttttgtatttttagtagagatggggtttcatcatgttggccaggatggtcttgatctcttgaccttgtcatccgcccgcctcggcctcccaaagtgctgggattacaggcatgagccaccgcgcccggcctctttttttgagacccagtctcactctgtcgcccagaatggagtgcagtggcacgatcttggctcaccgcaacctccatctcccaggtttgagcgattctcctgcctcagcttcccaaatagctgggattacaggcatgcaccatcactcccagctattttttttttttttgtatttttggtaaatacagggttttgtcatgttggccaggctggtcttgaattcctgacctcaagtgatccacttgccatgacctcccaaagtgctgggattacaggtgtgaaccaccatgcctggccaccactattattttcaataacagcttgagatatcattagcatgtcacacagttcatccatttaaagtgtacaattcaatggtttgttgtatgtatattcacaggacattttcgtcacccctcaaagaaaccccataccctttagctcagcttatcttcccctcagccctaagtggcactccccagcaatctttaatccactttatgtctctgtggatttgcctgttgtagacatcttatataaatagactcatacaatgtttaatcttttgtgacttgtttatttctcagcatattttcaagatttgttcatgttatagcatgtggatgtactagattttgtttattcatagttgatggacatttgggttgtttccactctctggctgctatgagtaatgctgctacaagcattcatgtggacacatgtgttttcatttctctccggtatatacctaggagttttcccattatttggaggtgaattcagacatcatctttaaacatttaagtgtgcctctctctaagacaggactctgaaaaacaaccacaatatcattatgacacctaaaatagttaatgttaattgctcagtgtgatcagatcggttgggggatacattttaacaggatttcttgatggattagatgtgctcttgtgtgtgtgtgtgtgtgtgtgtgtatgtgtgtgtgtgtgtgtgagagagagagagagaatcaaaaaagacttttgacagctggaggatggattcgccatcagctgataacaaagaaggccttgggtagatctgggttttggggactgtcggaggtcttagagaggttcgttttgagaaggctactagataaccaagtagaaatgtcgagtttgataaatgaatgtggagtttagaaaagaggtctaattaagcatcaagattggagttcaaggcatgagactggacagaattcctgtgggagtgaatgaagttacagagaagaagatgtcctaggacagagccctggggcagcccaacatgaaggatgggaacccagtgagagtgcctgggcaggagtagccagcaagatagggaggaaaccaggagaaggggctgttctgaaagccaagggtggagtgcagtggcacaatctcagctcactgcaacgtccgcctcctgggttcaagcgattctcttgcttcggcctcccgagtagctgggactacaggcgcgtgtcaccacactctgctaattttttgtattttttttttttgagatggagtctcgctctgttgcccaggctggagtgcagtggcgcgatcccgggttcacgccattctcctgcctcccgggttcacgccattctcctgcctcagcctcctgggtagctggggctacaggcgcccgctaccatgcctggctaattttttgtatttttagtagagacagggtttcactgtgttagccaggatggtctcaatctcctgacctcatgatccacccgtgtcggcctcccaaagtgctgggattacaggcgtgagccaccgtgaccggcaatttttttttttttttttagtagaggcagggtttcaccgtgttagccaggctggtctcgatctcctgacctcatgattggcccgcctcggcctcccaaagtgctgggattacaggtgtgagccactgcgcccggccagacattttaatctcacagttctggagactagaagtccaaaaccaaagggttagcaagcacacaccctcaaaggctctaagagggcaatcctcccttgcctctcccaagcttctgccccatttattcctgggcttgtggctgcctcactccagtctccgaggcagtcccgacatggcctcctccccttgcgtctccctctggcttctctcttctgtctctcataaagacacgttgttggatttagggcccacccacgtcacccagaatgatctcatcttgagatcctacatctgcaaagacccttttcccgaatcacatatgtttcaggggttagaacatgggcatatcttttcggggggctaccattcagcccactacactggatgaggggccggtaccctccacttctcctgcttggaggtgtgtaggggatcaggattcccagcatactgacatctccctccacaaacagtcttgtcccgactctcccatctctggtgaaattcttctatttccagcctggagctaggccttttcaagtcccacatgggtggtccagcacctccctttggaatgggagtatctgctaccccttagactgaaaacccactttagcatcctgatacactaggtgaattatcagcattctgtttaaaatgtagccccagaactcataggctttttctgctgggtaaggatgtgggtctcctgtgactcccctgctgcctttctctttcagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgaggtgaggaaagagtcaggggatccagccctgctgaggggaaggcgtcttctccccacctgcacctctgcgtttcctgggcctggggtggggatgtgctgccctccctcttggtttcaggaagtagactctgagatgcagattagcggggaggaagtttagcatgctctcaggaccagtactgggaagggaaaggagggacaggggaagaagccagggagggcagagggagaagcacgctgccgggtaggctccaggacagccttgctggatcttacagggagctctggagctggaatgaaccttccaggttggaccaacatgtccaggcctctgtgtccctgcactgagcactcatgaagtgctgtccatcctgggacagggcagagtcggcgctgggaagaggcgtggtctgcccagagagggggtggggcctgtcctggaaatgggcggggcatgccctggtagaggggcgtggtctgtcttgggaaggaaggtgcgtggcccccacaggcaacattcctctggggcaatcccggcgcacacctcagcggaggtgaaggctgacttcccacacccagtggctgggactggggagttctttcctagactgccatccgggcgcccctcaccctcttgctgctcagctccaggtcgtcatgggttcagggctcagctgcacgctcctgcccgcgccctgggcgtgatggcacccccagcccctgccattcttccccctcaccccctctccctgccactgctctgcattgccctgggttagcctggcggggccaggtggcacccgccatatactcttgcctttctgctgcgggggccttctaagcctcgggtcccagagctgcagggaggggcggcatagactccccacatggctcactgggtgtggtggggcctgtagccctttttgtttcatcctttggttcctgctggggactcaggcctaagtgtccaccccatcgtggaggacaacaccccttccttgcaggagtcatccctgagctggcagcttcaattggctctccgtgtcctggctggctggcagctcctgggcgaggtggcatgtgccgtgactactagagatcgctgtcatgggcccactcccccgccttctttgctggactgtggtccgagatgttatgtggggctctgtgctgacaagtcacatagtctgtaggcttcagagagtggctctggctgacaccccgtgggcagagacaagacccatgcctgcgatgtgtctcctcttactgtcaaggcaaatcacctttccttccatggaggaaggggtcagtgcagtcagcttgctgtcagggggctgcttggtctcctcgacggtgaggctgaattggagaggccctgctggagcatggagacccaacatgacctgcctgttccaggacagggtcccccacctcagtgccatcggcacctggggctggagaattctcttgtacgttgtagggtgtggagcagagtccctggcctgtacctgctagatgccagtagcacctgtcctgttgtgacaactaacaatatccccagatatttattgccaaatgacccctgggggatacagttgtccctggtgagacccactgtattgggatcttcagagcactggtgcacagagaggtgacagttagactgggggcttctgctcatccccaggagagtgctctattgagggggacttgagggtgagtgttgcaggccagctgtgcagggaccctggcacagcgtatggcgcccttgcttcccttccaggctgtgtgttcagtgcagcagcttccctcgggctccagggacacaaggaggcctcaaggctgtattgactccccctgctccgcctgacctgagctttgtgggtggcaggtgaaacttggtagctccatgtgtcaggccctgggccaagcccctaagggcccagaagatgtctgtcccccaagatgtacatgcttatgtccatggaggaggctgtacttagaatgttgagggagagattcacgaagaagttgcatgtctctagtgtgtgactccactagtgtgagacatgtccagaagtggccaatctgcagaggcagatgcagatgaggagggtgctgggggagcgactgcttatggggtcccggaactgttctggaattagatagtgcggatggttgcacaacctgatggatacaccgaaaactgctgaattagttaaaatagtgaatttgatgtcatgtgaattttacctcagttcagaacattttttaaaagacaagttgccagccaggtgcagtggctcatgcctgtaatccgagcactttgggaggcccaggcggggggatcacctgaggtcaggagtttgagaccagcttggccaacatggtgaaaccccatctctactacaaaaattagctacagacgtggtggcgggcacctataatcccagctacttgggaggctgaggcagggagaattgcttgaacccaggaggtggaggttgcagtgagctgagatcgcgccactgcactccagcctgggcgacagagcgagagtctgtctcaaaaaaaaagacaagttgcagatgagctgagctttgggcagagcaagcgggattctgatggggggtggatgttgcgctcgtcagcaggcaatagttagttggttgagggttttgatcacggggtagctactgcctgccccattttatccagctctgtagttgctatagagttgctagaaccttggcacatcacttatcagttttgtcacctcagatggcttcttcactacttggggtgtctcctgggtgtggggctctccttcctgtggcctctgctgactgcctggcactggcacacatgctctggtgaggggaggaccagcggtttttcccgtttgttttctgcttcctcgtttaaccctcctcgtcttgtaagatgaatgttcttgtctctgttcactatgcagatgaggactttgaggctcagagacgccactaacttgcctggtccaagccttttgggcctctcaggctgcagccagcaatgctgcagtgaagtttgcctgggaggctgaccctaggagtctgcaggcgtgttaggacccccgatctagaagacagcagagatgtaggccagggaggaccaataccgagcatctgagggcaggcacacctcagactgaccagaatacaaatgaattcgagtcacttacaaacaaagtggcataaggccaggcacagtggcccatgcctataatcccagcactttcggaggccgaggtgggaggattgcttgaggccaacgatgtgagaccagcctgggcaacatagcaagaccttgtctctacaaaaataaaaattcaaaaaagtggcatttaacacatactttttttcttttttttgagacagagttttgctctgtcccccaggctggagtgcaatggtgtgatctcggctcactgcaacctccacctcccaggttcaagtgcttctcctgccttagcctcccaagtagctgggattacaggcgtgtgccaccacaccgggctaatttttgtatttttattagagacggggtttcaccatgttggccaagctggtctggagctcctgacctcaggtgatccacccaccttggcctcccaaagtgctgggattacaggcatgagccacagtgcctggccaacacgtacttttaagtgaagctgatgtgtttggtgttattttcttgcagaaagtgaggggcattagtgtaaaggattttggaagtgtttaaagaaacaaaagggagtgttgagacgccatccacccctgagagaagctgcgtggtattatggcgggtgggggcaccaggatgggtggccccacttctggcctctgacttcctgagcctcaggcccatgtgggcccaggcagggcccggcaggccgggctgcccagctcccctccactgtcccctctgccaccagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcaggtagtcggggcagggccaggttctgaaaacccgcggtgacgccagtgttccacaagggaacccgtggtcggggtcccccaaagcaccctggggctcagtgctgtgccgggagggctcggaactcagaaaagccgtcacactcccagttccggtttattacaaggaaaggacacaggttacggtgagcgaaggctcagggcgcacagggcgggctccaggagagaccaggcgtgagcttcagcggctcctcgcccaggggagttgtgcagacggcacctgtttctttcggcaacagtgtgggacagcgagcacggagtcacaaccgggaagctcaccccagccgtggcggccggggttttcacggggggtgggccgcgtgggcaccgagcgcctgcgtggccaaccctggtcactcggctgtagccaccagaggtccagctgtgtggcccaaggctccccccataaatcgtgtcattagcacagaccgcctggtttcagggtctttgtgtgtgggcttggctgatcgcaggatcctggcgatggtagtcaggaaggggccgtgctccctttgaggggcaaggtggagagaagtgctggagaggagacttgctggcgggtacctggcacttgccacagccaggctccactcccctggggaaaggcgtggatggtgggctgtgcacgccgctccactcagggcttagagcgcctggcttaaggcgttgatttcctgtgtgggaagtggatgagttttctacagctgccgtgaccaagcaccacagactgcggggccgaagccacagaaacgcgtggcctcccgcttctggaggcctggaggctgagctagcggtggtgtcggcagggtgggctccccgccagggccgcgagggagctgccttccaggcctctccacggcgccgggggccgccggctgcacctctccagcctccatctccgtcatcctgtggccttgtccccgcgggcctctgtgcctgtcctcctcttttgacaagaacaccggagatacacaaaggtacacaaaagcgggcctttgttcaagctggcaaaagagatcttcttcagaaacccctgcttgcgggggagagagctgagctccgttcccgccccagcagaggcggcctggccttgcgaagggagaaggagggagtcgggagggggcgagtgcaggctcaggtgaaagatgacggggcagccagcgtccttgccgcgaggccagccgtgtgtgggagctgccggtgcttaccaaggttgggatgcttccgtcccgtggagactgggagactgggccccgcgcctcctgaggtttccgtttccaaggagtggctgcggggccctcgggaaagcccctgggttgtgggtgctacacagatgtctcaaagggacagggtaagccctttgtagtaaatgctgtcagaaagggaggtcaggtgttggccggaacagacagtacatgctctgggcagccctgagcgtttccagacgggaactcactcaaaagggggctggggcgtcccaggggcgcggccttaggctcccagaggccccgcgaggtggtggccgggtgtcttcgggcaggggtttgagtgcagtgtgcctgccgagaggttctgcagttcccagtgtttaacaaaattcagtgtccactcttgatctgcacaaactctcccatcctggcggccccgggtgtggactggggcctgtgtttactttgccctattcgtgtctggcctccttttgtcccaagtctcagagagacggagagagatcccctgctggggctgtagctgcaaggccaccgggttcagccctcgaggcctgcttgccggggcagtgactaagccgttgacaacctcaaggcagctttgtgctccttcgtctctttggggatctctttttgccccatctgtgtgtcaccctgtggcagagggttaaggtgggcagctggggagggttgggtggcccttgggctcatgaggccctagggcacccaggtttgggggtgccgagggcaggaaaaaaggcctcatggcgcgcaggcctcagccgcttgcgggttgccccgggcttgcggatggcaggagtgggccgctggggagaaagcagtgctgacaggaagtggctttttatcctgcagcagatggctgaggacaaggcctctgtgaaagcccaggtgacgtccttgctcggggagctgcaggagagccagagtcgcttggaggctgccactaaggaatgccaggctctggagggtcggtgagtcgggggagccggctccggagaccccttccagggtttccaaaagcaatgaggtgggtttaggggcctccagggtgctccttgatgaggatagaccggggcaggctgcgtaaacacgtcggggcagacgtcgggagaggtctgggccaggcatccgggacctgggtcccagccggctctccgcactctgtgaccctttgatggagtttggattatttccttaggaggcattctgggggccccgagcccacacccacagtgtctagttctctggaaggacttctgggaccggcgcacagtcgccctcgtggctgaggttgatgacagggaaaaaggcacagggcaggagccgccagggcaggagccgtggggggagttggagaagccctgtcccagcctcccgctgccctgcgagcggcacagtgagaagcgcctcccacacgggccgtgttcctgcccagggatgcccgctagagactcagcgccctgggtgtttactgggggcaggtcctgtcagcgccctctgccaggcaggtacctaaatccccgactcccagcagcagagcgggtgctcacgtcaaccacgttcttcctacaaatggcctaggtgcagggaccgacctgaccactagagaaagtgtcactgtggcaagggaacttcaccagccaagggccaaccttgccagccggtggcctcaggcctgctggttactctcttttgcaaaggggtcttggttcttgtgagtgggaccattgggtcaaagggcagggaggtttctgtggttctcattcggtcctgcttctgccctccagacagatggatcagctgccaggggggccccagccatcccagcacagtaagcggtcaaggtgcacttggggcagccagcagggcagaggggaggggagcttgacccaggctctgatgggcagagggaacccgtgcagggtgtgggggcagtatgcaggcaggcgcggaggggagagccaagcagccaggcctgccaggcagagttggggtgactggagaagggccgtgtctgcctgtggccagaggccacccaggacctggacagatgcacccaccattgtccctgcagtgaggctgtggaagggcttggtgtggtgggatgaggccagaccctggaaactggaggttaagggagctgtaggggggcaggtgtgggaactgagcatccgagcaggtcgtctgggactccagcagagctctgggcagcagcagggatggggccgaggcccggtctgcattgagctcagtgcttgcacgcccaggtgggcagtctctcatttttggaacagcagtctctcctgaccccctccactgagactgcttttgctggggcccccagcagtcccccagtggaactccacgggcagttccgagggctcctctcacctggccccagcactgcgggatgcaggcgaccccatccttttctcggaccacccccttcccctgacttccaggtctccttgccatctgtacttggtcacctgctgggcccctgcattgaagcaaacacgtcttaagcaaagctcctcacctgctgctcccacctggccccctgcagttgtcctcgtgtctgttgacggtgcctccaccctgccgcctggcatcagctcgcagtcacagggtgttcagagccgacccccaccccccgcccacgccctgcgcatagcccctgccgtccccccgttcgtcctccctgagtctgctctttccccgtgccagggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagtgagtcagcgggggcggggccgcaccgcagggtctgtggttctacacttgatcttagccgaaaggctgagaagtgtcgggtccatggttctttctgccttctgaggactccttcagattctgcctgtggctgtgggcccattctgtcccttagccttgctaacggtagaggcgaccatgatgacacccggtttgtctttgatacagtcatgccatctgctctccagaccacgtttcactgcgtgtccacacgtggccttttttgtagtttttttttcctagccactaggtcatcaggggacttgtcctttaaaaccccttctaggccaggtgctgtggctcacgcctgtaatcccaacactttgggaggccaaagtgggtagatggcttaagcccgggagttccaagaccagcctgggcaacagaaagacaacaaaaatacccccaaacccccccgtctaccagcatccaatctgggacctcaggttcctgtccttggcgtgccttttcagtctcctttaatctagaacagttcccctgcctttctgagctgtttgtgaagttcacagttttgaacagtgcagggtagttccattgtattattactattattttcaagacagggtcttgctctaccgtccaggctggagtgcagtggcataatctcggcttactgtaccttccgcctcttggtctcaagcgatcctcccaggtagctgggactataggcgcaggccagcacacctggctaatttttgcatttttggtagaggtggcgttttcctatgttgcccgggctggtcttgaactcctgagctcaagcgatcctcctgccttggcttctcaaagtgttgggattatgggcgtgagccaccgcgtctggccgcgattttattataaacattaaaaatactagcttttaggaaaacgatattaactgcctggtgaccagcccaccaaagcctgctttagagttgacggcctcaggagtcctcacacagccttggaagaccccattccaggcctgtgatgcgagggagggaaggaagggggtagagttggaagcaggcagcaccgtggctggactggcatgaggtggtttctccagcaaaagctccctttcctcaggaggaagctggcccagttgcaggtggcctatcaccagctcttccaagaatacgacaaccacatcaagagcagcgtggtgggcagtgagcggaagcgagtgagtgcgaccactggggctctagggctggccttgcctcttcctctccccgtggccctgaaccttgagaatgggtagacctgccttagacttgccttagacctgtgtcaggctgcagctgcgacagctcagggaagctgtggggagatggcaaccccaggatgttgctctcaggagtgtcagcaggccatcttaatggggggctgggccagagccttggggtgctccctctgtggggctggggacgtcttgtctccatggacattccctcttgccagccatcgccatctggcacctggctcagcttcccccaagccaaggtaagcccgacagcatttccaccccagtgttggctgggagccttttcctagtttgtcctcatcagacctaagctggggtgcagtttgctagtgatcacattttagcaggacaccgtcaatcgtaagtgtacccagaggagatttataaggacaaagcctgaagccaggtcacatggggaagagttagctacaaaactggccacttaatctctggaggggggcgttggtggggtgtgtctgtgtgtgtctcagggggctggagatgcctgcgtgggaggagtgcacctctgaccaggtggcagagtggaaggactgagggctctcagctgagctgtgcacatggcgggcacaggaccggctggctgtgagtgggtgtggcctgtggcctgtgaagggtgggaggagggctgtggagctggggattctgggaagggaatgtcggcccagctgggaggttgtaccagatgacctcagcggcctcttcagtcctgaaaaaaacctcagcatctcctctgtcgttttgggccgtgacaggacgcagccatctccctgtgcacgctgagatcctgcaatgggccctcaaatcaggggctggcatcacccagcctggtcagccagggccactctttcatccttctcagttcttctcagccagcctcgccctgggctgacgaggctccgtcagctccccttgcccgtccttagggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggtgagggccctcctctctgacccaccctggcactgggacctggagagtctctttggcgtctttttttttttttttgcttttgctttttgagattgagttttgctcttgttgcccaggctggagtgccactagtggcacgatcttggctcactgcaacctctgcctcccgggttcaaacaattctcttgcctcagcctcctgagtagctgggattacaggcgcctgccgccatgcccgtctaatttttgtatttttagtagagacagggtttcaccatgttggcccagctggtctcgaacttctggcctcaggtgatctgcccaccgcagtctctcaaagttctgggattacaggcgtgagccaccgcacccggcctctttggcatcattttgtagtggcctttcgtaagcttctgagccacttgtgctgctccttagacctctcggtgagcttggcattactcgccgacgtatctgtttcctctgcgccgctgggggctctgggaggacagcagtgggttctgctttgttcctgtggtgcctggcgcagtgcctggtgggtggctggcttgtggcgggcacatccctttctgttggatttgccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggtgggcctctgagagcgtgcccgtgtgagcagtgggtgcgacactggggggtcgccagtggtgaccccgcagtgggtgcgacactggggggttgccagtggtgaccacaggagacggatggctcctggtgttctgggttagggctcactgtggtccctctcctctcacctgagcttccaagagctgctttgacactagtccagccaaggagctttacagaaatgcgtggcttgactggacggtttctgttttcaaaggatcgaggacatgaggaagcggcatgtcgaggtctcccaggcccccttgccccccgcccctggtgagtgagcgagaactgggcctgcgggaggaggtgggtggggagggcaggtgctgcgccgcgggaggtcacagttcgaccttcctgttgctctctggagacttgacggcgggagctcgtgtaggccaccccatcggtagcccacccccttccccgaggctaagggaggcatgccgtggtagcggcggctcctggtcttacatgagtggcctgtgagaccaggcctgccattgacagtcctgccaagtctccgtccccctccatcctccccttccctctgactcttctcttttcccagcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggcagctcttcctcccaccggacaccgacccgcccgctgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaatccttgtgcattagtcgtgcgtatctttggcatagattctgagaagtgacaccactgagcatgggcgatggcgtagatggtacctgagcccccttcctccttggagcttggtttcccatctctccccaccccctatttccctagccttgccaaggaggaggtgggaaagcccgtttgggtttttgtcattcgctaggccatgcagttctctgttaagagtgagcttaaacatctttcctgaggctttaaggaccttttttagttctgcttctgaatgggctgctcatatcatatatatatatgtatatgtatagttgtgtatatgtatgtgtgtgtgtgtgtgtgtgtgtgtatttttttttttttttttgagacagagttttgctcttctcgcccagactggagtgcagtggcgtgatctcagctcactgcaacctctgcctcctgcgttcaacctattctcctgcctcagcctccctagtagctgggactacaggcgcctgccaccacgctcggctaatttttgtatttttagtagagatggggtttcaccatgttggccaggctggtctcgaactcctgacctcacgtgatccacctgccttggcctcccaaagtgctgggattacaggtgtgagccactgtacctggccaatttttgtatttttagtagagatgggggtttcagcactttggccaggctggtctcaaactcctgacctcaggtgatctgcctgcctcggcctcccaaagtgctaggattacaggtgtgagccactgcgccccgctgggctgctcatatcttttatccgtttttctactgggttatcttttgttgctcagcttttagaaactctttgtccatgagcaggattgggtttgtggctgtgatagaaattgcagatatcttttcctgctttgacctcgctactagtgtttctttgttttttgttttgagataaggtctctgtcacccgggtgggagtgtagtggcacaatcagagctcactgcagccttcacctcctgagctccagcagtcctcctgcctcggccttgcgagtagctgggatcacaggcgtgcgccaccacaccctgctaaactactggtgcttctcagcctcgaagtttttttttctttatgtagtcacatttatccattttttcccccttttactgctttgactttggagtcgtcgtgaccaccttgtggtctgtgggagggatgcttcacacatgagcacttttctttttctaacaccgaagcgtgctcttgtcttcaccaagagtgttgttgcccagtgtgactggtgatggctgtttcatcatattccagaagtttgtgatgccatttcccacactggccccaattaggaagaacagacgactctacttgttttgcaagattctggaaatttcccggggtgtcagagccctgggcattaaccctgcaattgtagcaaaggaaacaaagttggaagttgactccccagcacccaggccttccttcctgccctcctccaagctgccctggttgggaacgggatattgtgaatccaccctgaggcttcctcacagggcttcctgctatttgacagtgtgaggctggctagaattgggatatgaggccttctaaaaattaacctggcctgagggctttctcagcatctgggggcggggtgtgggggcggggagtgacctttcccctccttcaagccaggtgcccatcagattctacttgggaaaatgtgaaaggcacagacagcttgtctgctcacgggtgctgcacttaaatcctaatcttgcaatttttctacaagagcactttacattttttttttggagggagggtgtatgagtagacggtggctgctgtaacaaaggactgcacacttggggcttaaaacaacagaaactccttcacagtgttggaagccacagtctgcaatcaagttgtcagcaaggctggtttcttttttctttctctttctttctttctttctctttctttctttctttctttctctttctttctttctctttctttctttttctttctctttctctttctttctttctttcttttttctttcttttctttctccctctctctctccctctctctctcctctctctctttctctctttctttcttgttggatacagtcttgctctgacacccaggctggagtgcagtggtgccatctcagttcactgcaacttacgcctccagggttcaagcaattcttgtgcctcagcctcccgagtatctgggattacaagtgcccgccactatgtccggcaaggctggtttcctctgcaggtgccaagagaatcgtttacaggtctctgtcttagcctctgctggttgcttatagagccatcaccctagtctctgcctctgtcatcacacagtctcttcctcttcgtctgtgtcttcccttttgtctcataaaggacaccagtcattggatgtagggcccacctggataatccagaatgatctcctcatctcggcattcattacatctgcaaagacccttttcccaaagaaggtcacacccataagatatgcacgtatctcttcagggccatcacacaacccagtatggggacatgttccagtgcacacagatgagggcaaatgcagcagcagtgcctgggagctggaaaaacacccctgcttgggccccctggaccaaccgagtcagaatcttggtctagacccaccaggcattggtctagacccaccgccctgcccggaggtggggctgcctcctccctcctccggtagcacagtgtagggttgaccgtacaccagacaccaaggatttaaaaccataccatttgcgcagaagtacggcattccagggttttccttttcggctttacttaggttgagcttccagaacaactggttggattactcttgggagggaaccagcctgcctgccctattggctgcggccccttgatccacaaacgaagcccatccctgccggagcttgtggcgttctctggtgttcatgcgcgctccccctcctgccgaccaatgcacaagaacagtgcgggcgaccagtaagcacagtgagaaagcatttcaccctcatcagtaactaaaacaacagcaagtctgacagcaagcaaaaagtgatctgaaaatggcaaccgatgaagccctaggtgagcgctctgctggcaaggtgcaggacagcggcccttgcaatgctgccctttccgagggggccatttgctgggatggagcaagcccgtaggcagcgtcctcagccctggtgcgtaaccctaagagagagtcgggcactcagcgatgactctggcattgggaaggtgcttcacttcgtcatttgtagctgccaaaggtcggggtgagataagaggctgcgtatgtaacgatgtggtccggcacagctggcattttgaacatctcctcacacgcaacatgccttgtagcatgttggtgtgaacaggccaggtgacaaacttatggataaagcgtgaccccaatagagaagtaaaagctctgagtgcataccctgctaacatttggacggacgtgagtagctgggtggccagtaatgagaagttttccttacatgttagtacctttcctaaatgcctatcatttgcacgcattcctttgatacacagagaatacgtcttcccacacagtcgctcgggtggtaacgcagcttggttttcttctgtgccagtggcagggaagagcccgctgttgacacagcctctcagcaaggcacggggcaggggctgactgtgtctcctggggctgccgtgaccaagcaccacagactgcggggccgaagccacagaaacgcgtggcctcccgcttctggaggcctggaggctgagctagcggtggtgtcggcagggtgggctccccgccagggccgcgagggagctgccttccaggcctctccacggcgccgggggccgccggctgcacctctccagcctccatctccgtcatcctgtggccttgtccccgcgggcctctgtgcctgtcctcctcttttgacaagaacaccggagatacacaaaggtacacaaaagcgggcctttgttcaagctggcaaaagagatcttcttcagaaacccctgcttgcgggggagagagctgagctccgttcccgccccagcagaggcggcctggccttgcgaagggagaaggagggagtcgggagggggcgagtgcaggctcaggtgaaagatgacggggcagccagcgtccttgccgcgaggccagccgtgtgtgggagctgccggtgcttaccaaggttgggatgcttccgtcccgtggagactgggagactgggccccgcgcctcctgaggtttccgtttccaaggagtggctgcggggccctcgggaaagcccctgggttgtgggtgctacacagatgtctcaaagggacagggtaagccctttgtagtaaatgctgtcagaaagggaggtcaggtgttggccggaacagacagtacatgctctgggcagccctgagcgtttccagacgggaactcactcaaaagggggctggggcgtcccaggggcgcggccttaggctcccagaggccccgcgaggtggtggccgggtgtcttcgggcaggggtttgagtgcagtgtgcctgccgagaggttctgcagttccgagcaccatcattttctcctcctcagaccccttggttctccttccacgtcctggcagctgcttcgcaggctccttgctggttcctgtgtctccgagctgactcccgaattctcttcctctccttgctcagacactgcccctttgtgacctcgtccatcttcaaggccttgatgctgatgacagatttctgtcttccagtcccgatctgttccttcacgaaaatgagcccagtagcccgtccaagccagaaatggacttttagcccccaccccctgccaactctgccctttccctcatccccagttgcttaaaccaaaacggattcctcttcctctcatgatccaaactcctgagtcccttcaccttttgcctacactatcacagtgacctccttgctgctttcacactggagagcgtgggctccctgtgatctactctccacatggcagccagtgtcatctggtaaacctttgctgaaaccctgccatgcccttcagttgccctggaaacctgaactcatcctcagcctggctcgcagagccctcatgccgctgggacgtcacgttatgtccctctcctgctggcccgctgcacccagccgcaccacatgccggccgcacctcacacacgctggcctcttggcccttcctcgaacacacggcgcttgtccttgttgtcccctcatctttgcatggccgatttctttttctcattcagctctaagtttaaactttcaacagttctaagcgtatcaccttcttcatcttaaagtcctcatcctaaatcacactgcactgttttaactcccagcttggcagtccaaacggcctcatttattctgctttgttttctctctccttccaccagagggagagcagaggcctcctccagctcagtcaggcaccatcccccggaacagcggtctccaacctttttggcaccagggaccggttttgtggaagacgagttttccacagacggggatggggcgtgggatgacggttcggggatgaaactcttccacttcagatcatcaggcattagtcagatgctcctaaggagcacacaacctagatgatccctcgcacacacagttcacaatagggtttgcgctcctgtgagagtctgaggccgctggctgatctgacaggaggcagagctcaggcggtcatgcgagcaatggggagcagctgtacacacagatgaagcttcgctcgcgtgcccaccactcgccgcctgctctgtggctcagttcttaacaggccacagaccagtatcggtccgtggccggggggttggggacccctgccctagaacgatgctcggcacagctacactcggtgcacatttcttggtggcctgagcttgtcttgagctccatcaggatttctctgtcaatatttttgtagaccataccctgtcaccataaatggtgcttggtagaaatgactgtatgcatgtgatagggataacacagaaaacccatggtag

SEQ ID NO: 200 - DNA, 1535 bp, mus musculus
cgattcgctctgggctcggcagttctttctgatagcaggcagccatcttgcctggagcctgagaaagggaggagagacagaaggaaccggcgacagtggtctcagggccgctccggggggcctcaagaaccggaggcagccccggaggtggtccccgatcccgggctatgctcttggatctgagaagggaaggcggagggcggcggggacaagatgggtggagaatgtcaagcaaggaatgctaggcgggggaggggcgttgctatggcgactggggaggggcggtgtctgttctgaatcgctgtgtgtcacccgggcgctgcccaggaagggcagggctggggtgatgaccatggtaacacccgggggggagttcgtgacatctccggcgcggagggactcgatgtctatggcaatggtcgcctggtggaagggacggaactagatcccttcgctcgggacgctcacattccaggcccttgtcctgcaggctgccgcgggcggacacgccagaggaggaggccggggaatggccgcggtgtggcagcaagtcttagcagtggacgcgaggtgaggcgtggggtcaaagcccatgggagcagaacttactgtggtgcatgcgcaatggcgataagtgaggctgggcggagaacttgccttatgcggctgcgtgggcatgccggaggtgagcatgcgcagtagcgggggcgggcacgcccgcggtgagttggctgcgccggagaggattctaaacagcaagctgggaaaatgtggtcagatgtgggcatgcgcaaagcggctacctgtgagagggaggtggggctcaggcaggtgacatcctatcccctatgggtgtcccctagacttttttttttttacatcatcacttccccattctgaccccatcacctcccaacgctgacccccataatgtcagtctgatttctgtcgccctggtatactgaccctaattattgtctgcgctgacccagtcaccccgtagggaccccagcacggcagcagactgactctgttgtctgcaaactgacctcatgaccatgctcattattactgcagactcactcccaccacaggaccaagaggtccctcatcaccactgctagtcattcttaccacctaggccccagtcactgccacacacctcactctcctgccgtacccccccccccgagctgattgattccctctgtcctgtgcctgctgcctgccctgcatcctgaccctgcaggtacaacgcgtaccgcacaccaacgtttccacagtttcggacgcagtatatccgccggcgcagccagctgctgcgggagaatgccaaggctgggcaccccccagcgctgcgtcggcagtacctgaggcttcgggggcagctgctgggccagcgctacgggcccctctccgagccaggcagtgctcgtgcctatagcaacagcatcgtccgcagtagccgcactactcttgaccgcatggaggtgagcttctggccacattcacccccgggcataccctgcctgcac

SEQ ID NO: 201 - DNA, 7809 bp, mus musculus
tgtctgtctctaggtccagagatctcatgaatttatgtatctactttagggtgtactgccaagagaagcaagaggagaggagggaactgcctcggatcattacaggttggtatgagggtggggccctgtagacaggtgaccagagtaggtccagtagaaatcaaagtctgggacttcttggttgctcccatttatcgtcagacctcctaccatcctttccactgttcatttggtgtatagaaatgtgtatagaagtatcttggaagaaaattattgggcattggggaaggtggagagaagatgaaataagaggaatggagaggctgctaatcatcctctcttccaccaagcacatggttctaccattttctgttcctctgtgtatctatctgtatgatgcaacaaaatcagaagagaaattttagtccatttccttcctccacttctaggtccacctccagaggcagctgtagtggcctttgagtggctgaagaccagcaccctcacaggcctacacccacaactaccactctctttaccccagcccgagtgcgctctaccataccttgttcgtgcttttagcaggggtgattacatgggccgcattcaggaagtgggctgggtgactgcaggactggtgatctgggctggcacctgctactacatttacaaatttaccaagggaagagcccagagtgtgaggactcttgccagaaatggatccacagttaagatggagactgtggttggggtacagagccagaccttggccataaatgaagcagagattaagactaaaccccaagtcgagattggagcagaaactggagcaagaagtgggcctagggctgaagtagagaccaaggccactgctatagccatacacagagccaactctcaggccaaggcaatggttggggcagagccagagactcaatctgagtccaaagtggtggctggaacactggtcatgacagaggcagtgactctgactgaggtcaaggccaaagccagggaagtggccatgaaagaagcagtgacccaaactgatgctgaggctggcaaaatagttaagaaagaagcagtgacacagaccaaggctaaagcttgggcgctggttgccaagacagaggccaagagagaagcaatgacccagaccaaagctgaaactcatatattggctgaaaaagagacagagattaacagagtaatggttacacagagtgagaccttggcagtacccagggaagtggccaagatgggggccacgaacaagactggaattgtggatgaaaccaagacaagagctctggaagagactgtgagtgtggctaagactcagtctgaggccaggcctggtgccacagttgatgctaggggaaatcccaatggcatgtccagggaggtggctggagtggacatgaagtcctgtgcacagtctcaggctgtgaccaagatccagggtgatgacatgcctggtactggggttgaggacatggggaattgtaaaaccatgtctagggcagagtctggggcagacacgagggcttctgctcagcctcaaatttttgccaaaacccagactgaggccattcctggggcaaagattgatgccgggggtaacaccaatgccatgtgtaaggtgggggcaggggcagatgtgagagcttgtatacaacctcagactgtggccaagaaacaggctgaggtgacgtctggtgccagggttgatggtaggggaaataccaatgtcatatctaaggcaataactggagctgacatgagagctgctgctcagcctcaagctgttgccagtactcacgctgaggccatgtctgatgctaaggttaagaacagaggcaatcccaatgccatgactaaagcaggggccaaggcaaacttgagggccaattcccaggttgaggccttgcctgatgccagggataagagcagaggcaatcccaatgttatggctaaggtgggggatgggacagacatgttgtcctgtacacagcctcagcttgtggccagtgttcaggctgataccttgtctgatggcaaaattaaggtcaggggcaatgtcaataccatgcctaaggaaggagctggggtggatatgaaggctcaaggtatggcccagagccagggtgaagccttacctaatactagaggtaaggctaggggcaaagccaaagccaagtgtaagacagggcctgggatggacatgaaaacctgtacacaacctcaggctggggtcaagaccccagctgaggccttgcttgattccagggttgatggtaggggcaatcctaatgccacttctaaagccgggactaaggcagaccagagggtctgtggtcagcccctggttgtggccaatccccagggtgaggccttgcctggtgccaagaataaagtcaagggcaatccccatactgtgcttaaggtgggggctggagaaggtacaacagactctgcccagcctgaggcagtggtcagtttccagggtgaggccttgcttggcaccaagaataaagttaagggtaatcccaatgttgtgcttaaggcagaagttggggaaggtgcaatgggcactgcccagcttcagattatggccagttccaagggtgaggccttgcttgattctaagaataaggtcaagggtaattccaatgctgtgtctaaggcaggggctgggacagatacaacaggctctgtccagccccagattgtggccaattcccagggtgaggtcttgcctggtgccaagaataagatcagaggcaatcccactactgtgcctaattcaggggttgggccatatacaacagactctgcccggctccaggctgtggccaattctcagggtgaggtcttgcctggtgccaaaaataaggtcaaggccaatcttaatgctgtgtctaaggcagaagctgggatgggtgcaacaggctctgtccagccccaggctgtggctaattcccattgtgagaccttgcctggtgccaagaataaggtcaggggaaattggaatgctgtgtctaaggcaggggctgggatggatacaaggggctctgcccagccccaggctgtggccaattcccagggtgaagtcttgcctggtgccaagaataaggtcaagggcaatcccaatgtcgtgtctaaggcaggggccagagaagatacagtgggctctacccagcctcaggttttggccagctcccagcgtgagaccttgcctggtgccaggaataaggtcaagggcaattccaatgttgtgtctaaggcaggggccagagaagatacaatgggctctgcccagcctcaggttgtggccaactcccagcgtgagaccttgcctggtgccaggaataaggtcaagggcaattccaatgctatttctaaggcagaggctggggcaggcataatgggctctgtccaggtccaggttgtggccagttttcagggtgaggtcttgcctggggccaaaaataaggtcaggggcaattccaatgctgtgcctaaggcagaggctggggcagatacagtgggctctgcccagccccaagctgtcgctaattcccagagtgagaccttgcttggtgccaggaataaggtcaagggcaataccattgctgtgcctaaagcagggactggggcaggcacaaggcactctgcccagcctcagattgtggccggttcccagggtgagaccttgcctggggcaagggacaagtctatgtccacttctgaggcagaagccacagcagaagatgaggcctatgcaaagcctgaggctgaggccatgcccacttctgagagtgagggtgggtcaggcactcaagcctgcagaaagactcagcctaacatccatgactactactggaatgggattggtgttgaagactggattgctgctgagcggtggatcaaatttaggtttcagaccatggatggagactgggaaaatagcgtgtcctgggctgatgatgagaatgaagccagtattgggtcctggagtggggctagtgataaggctgggattattcggtcttgggctgtggcttgtgatgagaccagtgttaagtcctgggctggggccagggctgagaatgtggttggtattgggacttgggctagagctggggagcaggccagtggagggctctgggctgggggtcagactagtgaggggacctgggctggggacaaggccagtggaggagcctggactggggctgagaaccaggccagtggggggtcttgggctctcgctgggaatcaggccattggagagctttgggctgcgggtcaggccagtgatgggtcctggcctgggggacaggccagtggggtgtcctgggttggggaagaggccattggagggtcctggactggggctgagaaccaagccagtgaagggtcttgggctggagctggggctgggaatatgagtagtgtttcatactgggctggggttgtggatcaggccggtggagggtcctgggctgggactagtgatcaatctggtggtgggtccaagcctagatttgaggatcaagccagtggagaagggtcctgggctggggctggtggccaggctagtggagggtcaatgttggggcctgaggaccagtccagtggaaggtcttgggctgacactgcagaccaagccagtggagggtctaggctgggccacgtagatcagtccagtggtggggcctgggctgggacacttgatcagtctggtggtgggtccaagcctagatttgaaaatcagaccacagaagaagggtcttgggctggggctggtggccaggctggtggagggtccaaggtggggcctgaagaccagtccagtggaaggtcatgggctaactctggggaccaaatcagtggaggattcttagttgggattgtggaccaggccaatggagggtcctggactggggctgggcatccagctagtgttgggccaaagcctatatttgaggatcaggtcagtggcagagggtcctgggctgatgccagggagcaggttgttggagattctaggctggggcttagggaccagtctagtggagattcctgggctgacactggggaccaggccagtggatggttctgtgtttgccctgggagtcagacgaatggagggtcttggggtggggctagtggccaggatgttggagggtctaggccagggcccacgaaccagtccagtgctgggtcctgggatagccctgggagtcaggtcagtggaagctgctggactggggctggggctgtggatcaggctggtggttgttccaaacctggatttgaggatcaggccattggaggggggttctggcctggtgctggggaccagactggtggaggctccaggccagggtctgaggatcagtccagtggaataggttcctggggtgtggctggtggccaggtccttgggggagctaggccggggcctgcagaccagtccagtggtgggtcctgggctggcactgggaatcagtccagtggaaggtcctggattgggcctggggatcaggctgttgactgttccaagcctgaatttgaggatcaggcttgtggaggaggctcctgggctggtgctgggagccaagccagtggagaatcctgggctggatctaggcctgggaatgaggccattggaggatctaggatgggatctgaggaccaggccactggaggatcctgggctagatctgaggaccaggccagtggaaggttccaggtcagttttgaggtggaggccaatgaaggattctggtttgggcctggagctgaggccgttatagggtcttggtgctggacagaggaaaaagctgatattgtgtccaggcctgatgataaagatgaggccactactgcatccagatcaggggctggggaagaggccatgatttgttctaggattgaggctgagaacaaggctagtagtggctcctggattagatctgaggaggtggcttatatgggctcctgtgtaggggctgaggctggggctggggctgaggctggggctggggctgaggctggggctggggctggggctgaggctggggctgaggctggggctggggctggggctgggcctgggactgagtctggggctgggatttggtcctgggatggagatgcaaccactgtagagtctaggcttggggctggggaagaggctggtgtagagtcctggaccttggctaggaatgtgggagaggatgagctaagtagagagtccagccctgatattgaggagatcagtttaaggtctttgttttgggctgagagtgagaacagtaatacgttcagatctaagagtgggaaagatgccagttttgagtctggagctggggataacaccagcatcaaggataagtttgaggctgctggtggagttgatatagggtcttggttctgtgctggtaatgaaaacacaagtgaggacaaatctgcacctaaggctaaagccaaaaagtcatctgagtcaagaggcatatatccgtacatggtccctggggcaggaatggggtcatgggatggagccatgatctggtcggaaactaagtttgcacaccaaagtgaggccagcttcccagttgaagatgagtccagaaaacaaaccaggactggggaaaaaactcggccctggtcttgccgctgtaaacacgaagctaatatggatccacgagatcttgaaaaactcatttgcatgattgagatgactgaagatccttctgttcatgaaatagccaataatgctttatataacagtgctgattattcttattctcatgaagttgttcgtaatgtaggtggaatttcagttattgaaagcttgctcaataatccctaccccagtgttaggcagaaggctttaaatgcactgaataatatctcagtggctgctgaaaaccataggaaggttaaaacttacttaaaccaagtatgtgaagacactgtcacctatcccttgaattcaaatgtgcagttggctggactaaggttgataaggcatctgactattaccagtgaatatcagcatatggttacaaattatatttcagaatttcttcgtttgttaacggtgggaagtggagaaactaaagaccatgttttgggaatgcttttgaatttctctaaaaatccatctatgacaaaagacttgctcattgccaatgcaccaacatcactgattaacatttttagcaagaaagagacaaaggagaatattcttaatgctctttcactatttgaaaatataaattaccattttaaaagaagagcaaaagcatttacccaggacaaattcagtaaaaattccctttatttcctattccaacgacctaaagcatgtgccaagaaacttcgagccttagcagcagaatgcaatgaccctgaggtgaaagagagagttgagctattaataagtaaactctgattggctgtatgttcccaaacaaatttgagtaatattttggttttgcactctggaagtaatgcacattgtaaattgcattataactttgaaactgatgttacctatgatggtctatagctggaccattttatgaacaccaaatgaattcaagcttgtactaaaaatacatgtgttgatttttatcttgtctggattgagatatttttagtatgcttcatgagcagaaactgaatggattcttcataagtaaggtaatctttggtcctttgtgtggacttatgtttatacatttaagactatttttatgtcatcaataaagttgtgtgttttaagcagcagaa

SEQ ID NO: 202 - DNA, 47664 bp, mus musculus
taactgggtcccagtgccgctgtggctgcggctgcctctgcgaggctcccgcctccccaccccccttcccagggctccttcccgcccgccgccgccgagacccaggctgaagctggggaggacggtggagcccggcccaggccgttctcctgcccccgcggctggagcatcgtctgggactactggctgaaggcgagccccgcagcccaagcgcagcgcacacgcgcgcccccggccaccgccgttctctcttccctcccctcctctcccctcccctctcctccgcccccggcctcggctgcggcgggaggaagaacgcttcccaaccagccaggagagcccagatctattcccattcggggagaaagaagagaccccgcacttggatccgaccgacttctcgccccggggccacggaagtggctcgccgtccaccggagagtccccgccgagcgtagccctccaaccctcgcccaaccgcagccgcatagacagcgctccccagcgggcccccggccccgccgagcccactccccgcgcggggccggggccggggccggcgatgcctggcacggcagcggcggtggccgcggctgctgctgctgctactgccaccgctgccacggctgctggcccgggcccgggctgggggcttgagtctctgcagtggggctgagcccgcagtcccgccccccgatcctgaggccgctgctccgccgggcgccgggcctcctccgcccgcgcctccgccccaggagctggagccaagcggggagctcgggccccgcgcccaggcccggaccatgcatggccaccgagccccggggggcgccgggccttcggagcccgaacacccggccacgaacccgccgggcgccgctccgccggcctgtgccgactcggaccctggagcctcggaacccggactgctggcgcgcaggggctcaggttcggctcttggcggcccactggatccccagtttgtcggaccctcggacaccagcctgggcgctgctccaggccaccgggtcttgccctgcggtcccagtccacagcaccaccgggccctgcgcttctcttaccacctggagggctcgcagcctcggcctggtgagtgagcgactgagagagcatgggagcccgggccacgggcctggtactgggagcgggttcttgttctcgagccctctaagccccacctcggaacaggctcgcttacctcggccctttgggttccctcaaacccctcctcctccccacgtcccttggccttatgtccagtcctttcaacctctgtccccatctcctctctctgtcccttgtgcccctcaacctctccaacccccttctcctctgtctgctgaggctaatgggagagggagcactcgcgagaaaaagagggaggattgcaaggcagcaatccttggatatttggttggggaaaccagggtttcgtttggagaacagaagaaaaaaaggagccttacatttgccaagcgcctacattgtaccaggcactggactgggtgctttacatggattttcatttcagcttcaggaaccctcatgaagtagataccattagtcccattttgtagggaaggaaactgaagctcagagaagttaagcaacttgcccaaggtcacacagctagtatggagccacgattcaaaccagatctgtttgtgtccaaagtctgtggtctttctgcttccccaaactgaggctggagaccatgaaagtaatgccaagccttctgcttatgtgattttctcctgtactattcagcagccctggagtatgagcggaaaaaaaaaaaaaaaaaaaaaaaaagaaagacggtggattgatccaaggttgagattttgccaggtgtgtgtggcgggagaacaagggaaggaaggagtagaaggtgctgagagagaaaggtggaagaggtgggccttgggagtcaggctagaggagaaggctggaggggctgataggtagggagacagcagaaaagccaacagaggcagaagccagttgtagcaggagctggagagctgcaggtccacgaggttggttgtgatgtgaaatcaggatggtttcttggatttgaaaaggtggagcagctttaagtcaggctgaggccacagaccactgcctttgtgctacacagacctgagtgtctgaggagcacagcaggaccttccccatctggggacattctcatacgggcctgagcccaggagccacagaagaagagcagcgcacatctgccctgccttccactgggactgaaggagttgttaagcccttgggggctcccgggttcacacctcaggctccacagatctctgggaccgtggccttgcaccaggtagcagtagtgaagtataaagcatgggtaggatgtgccttttggtgccttcatgaccttgggctagtcatggaacctctgggagatttcagggggctccctcagtgtgggctgaagataaccagctggcaacaggcccttaacaccttggcctgcatgttacttctgctggctttccaaactccccttgacactgtgtaaagccagtgcctttttgcagctgccaaaacaggccacaagcactcccaccccaggacttttgcattggcttttccttctggctggaagctcttcccctagccctccacctggcttgctcctcgtcttgcatgtctcaggtcaaatgtcacctcttccaagagactgtccctaaccactttaggtagggccacttgtgagtctccatcagagactgtgagtgtgcttccatctttgcacttagtacaatctgaaattatcttattgtatgtgtctactcgtttattgcctatcttcctctactagaatgtgagctccatgggggcaaggcgattatatctcttttgctcactgttgtatccccagcaactagcgcagtgcctaacacgcagtaggtgttcaagaaatcctcattaaataaatgcctaaacagatactaaagaagcacatagtaggccctcagtaactattgcctaaaagaaggacaccaaattcctgccctctggatactcttgatctgaaagtcagtagctgggcaatgtctagacccccagtctctggcctctgtaatcaatacaaggtgatgattctgagtatgccttcccaatccaccaattcattcaaattacaaatcataatacccttcctaaaccactctcctcctccccaaaaaggcaacacagagttcccaggatccttttccccaacgaagtccttgcctctgtaattgcatagtgggtgtcttttttttttttttttttgattcaagatggggattaggaataagacaagtgtcagggaaggacctggcctcctattctaactaattcactttgtgaccctgggtgagtgacttttcttctctgaacctcagtttcttcatctagagaatgcaatgaggagtctatgaattaatggttgtaaagcctgcagcatggtataaatcctcagcaaccaggagtttaaaaaaataaaattaagttaaaaaataagagaaaaaccttctgaagaagaggcggaggaattactcaggccctgactaggcgggcgccgggccatgtgattcactgcagcatgggttgtgagaggccacctcccccactgcccagccggcccaggggtaggcacaagtgacttggcttctctctccatgggactcgcctataattggccctaagagggcagggttagtggttgtagggtgtgtgtgtaagagagagacagagagggtttcctgagcttcaattaaagggctgaaacatgctggtccacatgttaagatttctgtgtgcctgctgacttcctccctaacactgctgagacctttattgaatcaccatctttagggctcagtggctcatcctgggggtggggggaggcttttaaaaataataattgtatcttagccatgtgaacagccttgaattgcttcaaagtgctttctcttttagtgatcctgtctgcttcctggtggggaaaggtacagttgttattatgcccattttccaggttgattaaaccgaagtccttgttggatcactgggaaaacccagtgaaatgccagagaggggtttgagagagtcagaaagcggtttgcttgcaggggtttgcagagatggttgctctattcctcagggttgaggcctagaatgtcctttcagatgcagggattgtggggatattggtgtctgaccctagctaagtcaaaggagttgcacctgatgttagagccgttttgtgggtaatgggggaaactgagccagttgaggggggcaaggggaggggctgactctttctcatttggatcctgaggcatcttcagagtctccaagagtaagaattggagctagaaaagactctagatactgcctcgttctgagtttccctaactgagtgagcatcagaatctcttgttgaccttaaaaaaaaatgtgattccacactccacctcagagtgccagaatcttggggttgacaaccaaggaacctattttcaaaagctccttaggtgattgtgatgcacagcctagagtgggaaccactagttaagtccgttttccagatgggacagtgaggaaggctcagagaggtagtgatttttttagccatcatcctacagtgagtcagcatcattagggccaggagaatacatcggcctccccatctaaggccctttccccagggccccatgtgggcttctgtcaactcactcccaaccgcaaatggaggcatgggattaaacacaaagggagagtcaacctcctgccctcatacacacaaacactggctgcctcagtttacccttattctcagctctcgtgaatggctaccatttggcagttcaaattggaaggcagttgccattctgggactctaggcagaggaaaccctggcatcatcagtgcccagtgcaggatctggccctaaggaagggttctagaggggtgtcaataaagggttgtagagctagagaagaacatggaggacaattcaggtaagaggttcagtggaagcaaaggcagcgagacatggggcactggggaatagggctggtattgggaggagtggagtgacaaggctgacaaggaactttcttctgagggtgaagagaaaccatcgaagggtttattaacgagaatgacatgctcagacggggtgtttggaaactctccctagctgcatggggagaatggatggaaggggtgcaagagtggaagcagggagacaggcaggtgagtgttgcagttttcccagagagaggtgatagcttgagttagagcgatgggaggtaaggagggtaagatctgagagatatttagatgctagcatggacaggccttggtagtagcttggatgtagaggctgagacagaaggcaaagtccagattgctccatgttgttttctgaaaccaactacagtgacctggtggatgttggtggggccatctatatacaagagagggaggaggtttgagggaagatagtgaattatgtttgagacaagttgaattcgaaacgcctgggggtacatgcaggtgaagatggccagcaggcatttgtgggtttggttcatttttgttttttactacccaggatgatcacttttaatattttggtctgttttctgctagatctttttctacatattgacgtatattttacataattgaaatcatactatatgttcaactttatatcatgctttttcatttaatatatgtatttttccaatatcattaaaaactcttcatgaacattttattttttttgaacaacattttaatgactgcataataatatgccattgtatggatttaccataatctttttttaaacttttattttaggttcaggggtacatgtgcaagtttgttatatgggtaaactgcatgtcagggggatttggtatacagattatttcaccacccaggtaataagcatagtacccgataggtagtttttcgatccttaccctcctccctccctccaccctcaaataggctccggtgtctgctttttgtttctttgtgtccatatgtactcaatgtttagctcccatttataagtgagaacatgcagtatttggttttctgttcctgccttagtttgctaaggataatggcctctagctccatccatgtttctgcaaaggacgtgatctcattcttttttatggctgcatagtattccatggtgtatacataacacattttctttgtccagtctactattgatgggcatttgggttaattccatgtcttcgatattgtgaatagcactgtgatgaacatacatatgcatgtgtctttatggtagaacgatttatacttctttgagtgtatacccaataatgagattactgagttgaatggtaattctgcttgagttatttgagaaatcaccaaactgctttccacaatggctgaactaatttatattcccaccagtagtgtataagcatttccttttctctgcaacctggcatgttattttttgactttttagtaatagccattccgactggtgtgaaatggtatctcattgtggttttgatttgcatttctctaatgattagtgatgttgagcattttttctttttttttttctctgtcacccaggctggagtgcagtggctctatctcagttcactgcaacctccgcctcccaggttgaagcaattctcccacctcagcctcccaagtagctgagattacaggtgcttggtggcaccacacccagctgatctttgtatttttagtagagacggggttttgccatgttggccaggctggtctcgaactcctgacctgaggtgatccaaccgcctcggcctcccaaaatgctaggattataggcgtgagccaccacgcctggctgatgttgagcatttttttcatatgcttatcggccacatgtatgtcttcttttgaaaagtgtctgttcaagtcctttgcccactttttaatggggttgtttattgcttgttgatttaagttccttacagattctggatattggacctttgtcagattcatagtttgcaaatattttctcccattctgtaggttgtttactctgttgatagtttcttttgctgtgcagaagttctttcatttaattaggtcccatttgtcaatttttgtttttgttgtaattgcttttagtgccttcattatgaaatctttgccaggtcctatgtccaaaatggtatttcctaggttgtcttccagggtttttatagttttgggttttacatttaagtctttaatccatcttgagttgattttagtatatggtgtaaggaaggggtccagtttcagtcttctgcatgtggctagccagttatctcagcaccatttattgactagggagtcctttccctattgcttcttttgtcaactctgtcagaggttagatggttgtaggtgtgcggccttatttctgggctctctattctgttccattggtctgtgtatctgtttttgtccagtaccatgctgttttggttactgtagccctgtaagtatagtttaaagtcggtagtgtgatgcctctggttttgttttttgttgttgttttgttgttgttgttgagatggagtctcgctctgtcacccaggctggagtgcagtggcgtgatcttggctcactgcaagctccgcctcccgggttcaagcaattctcctgcctcagtctcccaagtagctgggactacaggcacccgccatcacgcctggctaattttttgtatttttagtagagacggggtttcaccgtgttagccagggtggtgttgatctcctgacctcgtgatccacccgcctcggcctcccaaagtgctgggattacaggcgtgagccaccgcacctggccttttttttttttttttttttttttttttttttttgagactgagtctcgctctgtagcccaggctgaagtgcagtggcatgatctcggctcactgcaacctcctcctcccgggtcctggttcaagcaattctcctgcctcagcctctcgagtagctgggattacaggcacacgccactgtgcccagctaatttttgtatttttagtagagatggggtttcgccacgttggccaggctggtcttgaactcctgacctcgtgatctgcccgcctcggcctcccaaagtgctaggattacaggcgtgagccaccgtggtttggtttttttgtttgtttgtttgtttggttggttttttcagacggcgtgtcactctgtcgcccaggctggagtgcagtggcatgatctcggctcactgcaacctctgcctcctgggctcaagtgattctcctgtctcagcctcctgagtagctgggattacaggcgcccgccaccatgcttggctaatttttgtatttttagtagagacatggtttctccatgttggccagactggtctcgaactcctgacctcaggtgatccgcctgcctcggcctcccaaagtgctgggattataagcttgagccaccatgcccagctggctttgttctttttacttaggattgccttggctatttggacacttttggttctatattaatttttaaatagttttttaaaattctgtgaagaatgtcattggtagtttgataggaatagcattgaatctgtaaattgctttgggcagtatggccatttgaacaatattgagtcttcctatccatgagcatggaatgttttcccatttgtttgtgtcatctcgcaagcaggcatttggacgtaagattggaaagttcaggaaagaggcctgggccagtgatgtttgggagttttcaccaccaacacataccatgtatagatctgggagccagtcccatccttgaagacagacagtaaggttggcagggtcacactcagatgaattattcagtacctgctgtaactttgccatagaaatgccttttttcaggggaaagcagtttttaaagtatattttcatgaagctgagacccagccgtttttaaggcatatttgagggctgggcacggtggctcacacctgtaatctcagctgctcaggacgctgaggcacgagaatcacttgaccccgggaggcagaggttgcagtgagccaaaattgcaccactgcactccagcctgggtgacagagcaagactgtggttttgttgttgttgttgttttctttgtttttgctttttgacggagtcttgctctgtcgcccaggctggagtgcagtggcaatctcggctcactgcaacctccacctcccaggtccccgttcaagcaattctcctgcctcagtcttcccagtagctgggattacaggcgcacaccaccatgcccagctaatttttgtattttaagtagggaaagagtttcaccatgttggccaggctggtcttgaactcctgaccttgtgatccgcccgccttggcctcccaaagtgctgagattacaagcatgagccaccatgccaggccaagactgtgtcttaaaaaataaaatcgaccgggcacggtggcacacgccagtaatcccagcactttgggaggccaaggcgggtggatcacttgaggccaggagtttgaaaccagcctggctaacatggcgtaatgttgtctctactaaaaatacagaaatcagccaggcgcagtggctcatgcctgtaatcccagcactttgggaggccaaggtgggtggatcacaaggtcaagagatcgagaccatcctggccaacatggtgaaaacctgtctctactaaaaatacaaaattagctgggcgtggtggcgcatgcctgtagtcccagctactcgggaggctgaggcaggagaatcacttgaacccgggaggtggaggttgctgtgagccaagatcgtgccactgcactccagcctggtgacagagcgagactccgtctctaagaaaaaaaaaatcatccaggtatggtggcacatgcccataatcccagctactcaggaggctgaggcaggagaattgcttgaacccaggaggcagaggttgcagtgagtcgagattgtgccactgcgctccagcctgggtgacagagcgagactctgtctcaaaaaaataaaataaataaaataaagcatatttgccgggcacggtggctcacgcctgtaatcccagcactttgggaggccgaggtgggtggatcacaaggtcaagagattgagaccatcctggccaacatggtgaaaccctgtctctactaaaaatacaaaaattagccaggcgtggtggcgcacgcctgtagtcccagctactcgggagactgaggcaggagaattgcttgaacccaggaggtggaagttgcagtgagccgagatcttgccactgcactccagtctggcaacagagcgagactccatctcaaaaaaaaaaaaagcatatttgaagccagtcatggtgcctcacacctgtaatcctagcactttcggaggctgataggggaggattgcttaagggcaggagttcatgaccagcctgggctacatagtgagaccccgtctctacaaaaaatatttttaaattagcagggcatggtggtgtatgcctgtagtcacagctacttgagaggctgaggtggaaggatcacttgtgtccaggagttcgaggctgcagtgaagtatgattgtgccactgcactccagcctgggtgacaaagtgagactctgtctcaaaaaataataaataaataaacatatttgcatgaagctgagacccatttcacgtacacccagggtagctggctattgcaaagtattgagggaggagtacttctgaaaagcaaatcaaacattggtaaagtaaatttgtgtggttcccagtgttctctctgttgagggcatcctgagaggccagtgagggggtttgcttacggaaaggagaagagagggcttgggacaggaggggatcgtggggtctgctggggagttttggagagaagtagtttgagattccaggggagagtctggggaaagaaccaaatttggttcctagtccactagggccttccaaacaaacacaacaaaatgtaaagactctgggtagctgggaaaaggacttccccagacaagactaaaagaatagaagcttctaaattgcagatggctggcagtccgctcttggccctttcaggcccctctgtccctgggggagggcccaggtggggctgcctgcttcctcaagggagagtggagtggcagctaacaatgccccacacaaacccaagccatggctttctgggggccagttagctaaatgccttaggcagatgtggagctggccagacgctggctgggtggggctaggacctgtctggaatgagggcaggaaatgcagtctgccattggctagcaccacagagttcagttccctcatctggagagagcaaacatctttggagcaatgagtccagcctctctgggctctggtgcccagttccttggacctagaaggtgtgacacctccaaacggtgtctgaaaacacacacagctcctgagacaaggctgcagggcatagccgggggagcctcagcactcctagctctgctattggttcactgttcctccaggcctcccttcccctctcagggtcttagtttccctatttgtaataccacaaacctggtcattgtggcatcaataaataatacttggtgagcaaatagggtacaggggaagggagagtgaaagaggggagcaaggggggcatttctttatttaacatgtacctgttgagtgcctactatgtgctaggccctgtgcttaggtgccaggtaggcaacaagacagtcactatccctgtcctcgtggagctgatatctagcaggaaagacacactacaagcaattccaagtgcagatgctgcaagaacacatgagggtggggggagtgggcggacagggcaaaggagatatttgagttgagacctgaaggataaataggagtccagaggtagggagaggcagactagcagttcgggtcacgggaacaacatgtgccaaagccctaggcggaagagagcactttcgaggaacagacaaacggccattgtggctggatcgtggggcggggaaatgttcctgagctaggccttccttgtccctgtgctcaggagtttcacccctgaaggcaaagggagcccttcacaaggctgaagggattgcaggggactgtgttttccaaaagctggcagtggtgtagagaatgcctcgtagaggcccggaagatgggagtgaaatcagttagggggctggagggggaatgaagcatagggattctagagcaactgaccatggtgcatctaaaggacttggggcctggctggacatgtgggttgagggagaggaataaacctaggacttgggcttgggcagctgggcggatggagttgtccttcctgcgatggggaaggcaggaggagaagcagaccggggctggggtaggagtgtcgttcacgatgtgctgaggctgaggagcctgaagacaggacatctaggtgacagcacccagttggcatcagatatgcctatctgggtcccagagtaagggcaggtgggtgaggggcacaggtatgtagctgagactaagagggaagagccctccttggcgcttccccatggcccctgcagggaaagggttaaatcgcggagggaaggcgcctgtggaaagcgggaaaggcgggactggcagggctggcctttgggagctgcagctggcatagaagcccttccgcccgccagggcctgctaggcctgggccgccaccgcccacaccaccgcctttgccttcgcctttgcctttgccttccctgctccccctccagccccttccctgctcccctaggctgggggacccccctacctaatgcattccaggtgtagacgcagcccctcccccaccgcgcgggtgtgggaggggcagggaaggctggggtcactttcaccgcatctcttagggagcatctcccaggcttgctgactgcttctctctctctggagaattccctcagggatctctgtttgggcctccctgactctggcaggggctggcagcagagagagccccccagacccaggtccgccactttctaaagtgtcacgtgaccttgggcaagtcatctcacccctctgagcctcggttttctcatctggaaaatggggctgtcattcccaccttctagggttgttgtaaggattcaatgccacagatccatccccagcccttggcatggcacattgtcaccatgttcaacagatggccctggcctgccctttttgttcctgcccctctgcctgggtctgtatccctcgctgactaccatgccctgtgtggacctttctgtctctgtctcccttctgacttgtcccttccttttgtccatctccctctatgtccatctctgggtctctgtggttttcctgtcctctccctccttgtgtttgtcccagtgtctttctcttatcatctgtcttttcccctcataatccttctgtgtctccaactctcagatttggccaggcctctggtgaatgggaagggagatgggtgggtgttggggtccctggggttgaggcaagggtcagagggaccatccccctagcggctttgcctcacaggaaggggaatctcagccagcgtggcagccccagcatctggtaattactgctcccagtgctcccagctgcagttccactcccttcccttcctgtcctctgaagtccccagctcctcccggggcgggggagggagatgggcgggggtggagctaccgccccctatcctctggcctctagtccagagaagcagggaggaggtggccaggccctcacagtaatcaaggaactggaagagggatgggctgcttgtgctctcatgtggctgcttggtttgtctgtgtgtgtgtgtgtgtgtgtgtgtgtgtgtgcgcgcgtgtgcgcgcgcatgtgcctggccttctttgtccccgtggatctattttgtgtgtgtgtcttaatgttcttgtttctgtatggccatctgtatgtttgcatatagatccatgtgtgtctctgggtctgtatgtgttacgtgctcctctgtgcctggttgtatgtcaccttggccctaagtatgtgggagtttctagatgtttctgcgcatgggtctccttagatcttgtggatgtgtctgtctgtttctatacctgtgtctgttcccgtgcctgcgtctgcctctgcatgccccctataggtctatggttgtggtgtagggaagggggtgtctgcttgcttgtatcttttggcctttcctgatccttcttcctgctgtggagccttcttgcaaacccatgacattacgtacttcaaatatatgcttcactcatacctccccacccaatatccacacttttgcccactcttcttcccttgtctgcagaaccattctcagtccatctatacctaaaaaaaacacaccccatcctggatggtgcaactaaaaaccacctcctttaggaagtcttctctcctcccccctccaaatgtgatttctttcccaactcagcagtcactgaaggtgtgctctgtgactctggacacagacacacctgggatctggtcccagctcaaccacttttagctgtcctcaggcaaattattttgcctctttgtgcatcagtttcctcatctgtaaaatgggtaatagctcaccggatcattaggaggatgccatacgagatagcatcaacacaacacctggcccagagtgggtgttcagcagttgaatcctcatatcttatatcctctactaaaaagtgaacagcttgagttccagagatttctgcatattcttacaatctcctgctctctcttctttaggcatcctgcacagggcagaaggtaaatcgggtcacacagaacaaaaggcagattccaattcagggaacttctgacaagtaatgcatgggccagctccctgagcctgctcagacacagaggaaactgggcccttccagggagtgggagataggacctgcaaggcttctactcaagggcaagagcatgtgagatagggcaaggcataaacagcaggagtagaatgagccttcaggatcatctaactcagatagtgcaacatgatggcccacaagttgaatttgactcacaagtttcatttggcttgcccacagtttttaaaattaagggacttcacatgaaaaacctggatttcccggccgggcacagtggctcatgcctgtaatcccagcattttgggaggccgaggcgggtgaatcacctgaggtcaggagttcaagaccagcctggccaacgtggtgaaacctcgtttctactaaaaatccaaaaattaggcagatgtagtggcgtgtgcctgtaatcccagctactcgggaggctgaggctggagaatcgcttgaactcgggagacagaggtagcactgagctgagattgcgccactgcactccagcctgggcgacagagtaacactctgtctaaaaaaaaaaaaagaagaaaaatctggatttctggattcccttgaaatattggaagacctgacaatacagcgccacattactgcaagatgacacctgggtggaggggagaagctgctgcttctacttcaggttaggcatgtgctttccagtttaacccagtccccaccattccccatggccttagactgtcccactctacagaaagttcctcactttatactagggtctgcactttacagaaacatccttctctttacagaaggggcctcactttacaaaaaggagttctcctttttaacagtcttctgttttgtcatgatccttaagagtcctttggttacaaacaggccatccattttacaaaagggcctttagagaactctcctcactttacagcatgtccctccactttgaagaaggctcctctttttggaaaaacttcttccctttacagaagggccttctgtttatcaaagagatctccatttcacagaaagtgtctccgttttgaaggatggaacactcttcaggaaactcgaaagagttaggaagctcctgacttgccagaatggcccccacttcttgaaagtgtcttcacactatagaaagtgcctccatttttctgcagagtccttatgttgagaagaatagtcgacttcagggaaggaacccctgagctacccacagggttcctgtaaacagctccttctgcacatttcacacttgaccgagctttgtgtttgaactttgagagacaacatctgccaggtcaggcagcctgggtgcagtctggccttgaaggcggagtggggcagctggcctgcagttcacattcaaggggcaggtgggaagaggtggggcagttatggctttttttttttttttttttgtcaagcggagggatgccccttcccctgacagaactggcttcccaaaaggcactttcctttctgctgttcttctccactccctctgctccctttccccaccccacccccaggaattccagctgtcccaggagcctacctctctgcccggaaaggaaaagatttgagggctgtagggagaagtttgcctgggctgtcaggagacctgcgtgctaggggctggcttctgctcaccctaggatctcgctgattgctcacaacaagcagaacacacgttttctccccattttagcatctctgcagagctatccttcatagctgtgggccccaaatggggaaattggggcccagagctttgaagccacttgccccaggacaccagggagttaatggccaagggccagtctggggccctagtagctgtcttgagattaagccaaggctacagctgggagaagtgagaggggctgctactagctgggagggggaaaacttggcagctgagattcccaggaagggttgagggagatgcagggtccagttccagtgggaatgggcaaaaggagcccttgtcctcagacacagctagatgctggactttctctgccagtaaacccagaagcatgtgctcagggcacctgccacgcaggggcatgcagcaaccagaaacaatttttgcaaggattttcctatttcaataataataaattgtcatgggaaaattcaaacctcagctacacttcttgacacttattttacagtttttttctggtttgtattttgaattgaatttgaatggggaggacagggcaccattgtcttcactgccctaccacctcgcataggaatcctgccctgatctgcagagctatcctggtgagtggggctaggttctgtgtctctcactggctgagtttgcttgtgtttctcagtgtatatacagttttacgttgggttgcagcctacagcccgtgggcttatgtatttatgtgtgtagttttgtggctttgtggatgtgtgattctgttggttttcaaatttaacccatatcactctgtgtgtgtggtggggtgggggtgggtcactgtgctctttcccttccttgtcccataggctcccccaaaccaaggaactgctattattgtccttctttccagataaagaaactgaggctcaggtagatggggagacttgcccagggccacacagctagtaaaaggtagtgttgtgatctaaactgaggtctgtgcaagtcctaagccagctgttcctaatacaggtgctgcagcagttcaatccgtgcagttcagtcagtgatcatgatgacaccacccttgttgggaatagtcaagtatcatagttttataaattagtgacttaagaaaaaaaaaaagaccagattcaaggccatccctgaaataatggcactgtcgtgagcattcagatgcccatggcagaaaaaattgggtagagtccctagcctgcttgaggcttaagtggacaagagtctgggggaactctggctaccaggtgctgtcttgaaggcccggctctgccacattcatttggaagctttccctgactagcgttgccagaattagccttcagaaagtatttaatacaattagatttgaatttcagatatacaataagtcattttgtttttagacggggtatcactctgtcgcccaggctggggtgcagtggcatgatttcggcccactgcagcctccgcctcccgggttcaagccattctcctgcctcagcctcccgagtagctgagattacaggcgcctgccaccatgcccagctaatttttgtatttttagtagagacggtgtttcgccatgttggtcaggctggtctcgaactcctgacctcatgatctacccacctcggcctcctaaagtgctgggattacaggcatgagccactgcgcctggcccaacaagtcattttttaagtatagcttaagaaattgttagtataagtattcatgagacatattatactaaaacattccttgtttatctaaaattcaaatttaactgagtggccgggcatggtggcttacgcctgtaatcacagcaccttgggaggctgaggcaggtggatcacctgaggtcgggagatcgagaccagcctggctaacatggtgaaaccccatctctacaaaaatacaaaaattagctgggcttggtggcaggcacctgtaatctcagctattcgggaagctgaggcaggagaattgcttgaacccaggagtcggaggttgcagtgagctgagatcgcaccattgtactccagcctaggtaacaagagcgaaagtccatctcaaaaaaaaaaaaattaactgagtgtcctgtattttatctggccaccctatccattctcctccactgagcttccccagtccccacaggctcgccctcgttgcctttcctgagttagagtctttgtctttgagattgggagctccctgagggtaagggtcaagattgcccttctggcctgctgaatgcctgggggggcaggggtttgagagtggggcaggaagggtgcataccccacccccatccccacagcagagctggcacagtgcactggcactcctggggtgcctagagtatgctttcctaggtgacaagagatgtccgagtggcagtggtggttgtgtgtgtgcagttgtgccgagcacggtgcacacagacatgagtagctctgtggttctctctctgggtctttgagggatgtgcacagttggtgtgtggctgggtacatttccacaaagtgttatcagatttggtggtggctgggtgtggtggtacacacctgtagtcccagctacttgggaggctgagacaggaggattgcttgagcccaggaattcgacaccagcctgggcaaaatagtaaggcctcacctcaaaaataaaaaataagaaagatttggtggtgtgaccaaatgtgtgtgacgggggctttttggtgatctctgctctactgggcattggggaattataaatccgttgatggaaggggcagtgctggtggaggatcttgtcaggtgtggaggtgtgggtgtgggtgtgataatgttgtggattatcaaccacaagaaaaatgggctggaattgggcacactggctcatgcctgtaatctcagcacttttggaggcagaggcaggaggatctcttgaagccaggagtttgacaccagcctgggcaacaaagaaggaccccatctctacaaaaaaaattaaaaatagccagccatggtagtgagtacctgtagtcccagctacttgggaggctgagatgggaggatcacttgagcccaggaatttgaggttacagtgacctgatcacactactgtacttaaccctaagcaacagagcaataccctgtcttaaaaaaaaaaaaaagggctggagaaaatgaatccaggaccttgctgggtagggacgggatggggcagtgggaatggctgtggtttctaggaaggaggaggggggcctaccctgggagctccccaagggcagggatgggattttctcatctccaagcacagggtctactaggttcaaaaatattctggagaccaaactcagccaaggaaagccatagagttcagcatggtcatgaggggccactgagagctagctgagaagtttctttttttggtgtttttgtttgtttgtttgtttgtttgtttttgagacagagtttcgctcttgttgcccaggctggagtgcaatggtgcgatctcagcttaccacaacctccgtctcctgggttcaagcgattctcctgcctcagcctcccggtagctggtattacaggcatgcgccaccacgcccagctaattttgtatttttagtagagatcgggtttctccatgttggtcaggctggtctcgaactcccaacctcaggtgatccacccacctcagcctcccaaagtattggaataaaggcgtgagccaccgcgcccggcctagctgagaagtttctattttcccatggacagtagggagttacagaaggttcttgtgcaggtaagtggcatgatctgagctggactgtacgtaagttcattcagccacctggagggagcaagacttggagccaaggaggccactgagggaaaataggagacagggaaatgtaggcagagagacaagggagagggagttctgaaacgagagggagggatcttgaaccttctcccgctcagtgaaacctagcctggttcttggccaggcctaggctcctaaactggacccctgttcaactccctgtggacagggttgaggggtgtccctctgactagctacactgcagtttgtgactttcggaagccgttgggtccacccgcccctcctggttcccctcttttccagcttgcccttggagagcagggttaataagaaaggaatccagtccatgaccagtctgcccaaaagtgtgccattcattgatttgctctgtgaccttgggcaagtcactgcctctctctctgactccatctcctcactagaaactgggctgacaatctcttttcctctcacctgggactccagggaatctttgcatttcattcagcctcctcttcctgcagggctgcctgcaaggaggcagagagaatggagaggcaggtctgtctgtgggctgtcaggtgagatgggtgaggagggagcaatgggtgggctagggcagggccatggaaagtgggatgtatggtcactccatcccgaggaccagcactggaggagaaggagagcagcattatccagggaccctgctgctttgctacagatagggtagggagggcttgcccagagaggcctgcctgctttgaggtgtggagataggtgggctcctccaggcccaaggaggcagacaaggggcaccagggaccctggcacctatgtgtgtatatctgaggaggggtctctgcatggcagggtgcctggctttactcactgcctctctggccctgtcagctcctctctgtctctctcccttgctctggccatgtgtctctccaaccacatctccgcctgtgccaccctccaggtgattcatcttcctcacccccacgcccagggggagggcagggcaagaccaggccaggatgtgctgagcagggcagggtaagcggcacagctgagtggagaggagcgcctcctccatcctggccaggccctgccagcttaggtggggaaggaagtgaggaacgacacccaaagcaaggtacagagttggggaggggcgctcggcctggggcctggggcaccctgttccctcagtgctgggaaaggaccctgatctgagtcccctggggtggacctggctgggatgtagccaggggtgaggtcaggggcctagggaagctgctggaaccctgtgggttgggctatttcttccctccgggactgggagacctaaaatcccctgtgactctttctgcctgtgtgaccctggaagggaggctgcagaggtctttgtgtgtgtatgttttcacagcagagtttgtatgtgactatttaggaggaggcaagtgtcccacagtgtgtgtattcctgggcctatggctaagacccagggacaccgtggatgtgtttgttagatgagtatgacatagtaaatgacagttgtcccttggtctccatggggaattggttccaggacagcctgaagataccaaagtcgccaacactcaagtcccttatataaaatggcatgttgtttgcatataaactatgtgtatcttcctgtatatatatatatattttttttttgagatggagtctctgtcgcccaggctggagtgcagtggcatgatcttggctcaccgcaacctccacctccctggttctagcgattctcctgcctcagcctcccgagtagctgggattacaggcatccaccaccacacccagctaatttttgtatttttgtagagacagagttttgccatgttggtcaggctggtctcgaactactgacctcaagtgaaccgcccgccttggcctcccaaagtgctgggatcacaggcgtcagccaccgcacctgacccttcctgtatactttaaatcatcgccagattacttataatacctaatacaatgtaaatgctatgtaaatagttgttatactgtactgggttttatttatataatttttattgttgtattgttattttttgtctttttttccaaacatttcgatcaatcagcctccatgcagaggccgaggatgcaaaacccatgaatgtggagggccacctgtatgccacatgtctgtgattgtgagttcgtgtttctgagtgtgtggtatcatgtgactttatgctgttttgccactgtatgtgattgtgtctgacatggtataattgactctgtgcctatagtctttgtgtgtaaccatgtttgcaggtgtgacatggtgtgtatgacactccatggccctgcaattgtgagacatagtgtaaatgacaatgtatatcttttgtgactcagtgaaaccatgtttgaagaatgtctaactgggtatatgattgtctgtggttgggcggttgtatgaagctgtgtgtgagatggcagaattgccattgtgtgactctgtgtctttgtgactgcatgaccatgtttgcaggtgtgtgtgatactgcgaggctgtgtgatcgtgtgtgaggttgtggccgcaggtctttgtgactgtgtgtaactaggctttcaggagggcgattacctgcagttgggtgaaatggtgtaaataacaccaagtgtttctatgactgagtgggcccatttgtgactagtcatttatgagactgtgtgtgatataagctaacagaccctttgtggctgtgagtgggaggccatgtggttgtggcacagcataacttacaccatgtgatggtggtacctccgggagctcttgactactgctcactctcttgtcctcacacctgtttgcctccatctctccctatgcaaggggtttttgtggctcccttctgctacaggatgaatgtcagcctagcatccaaggcctttcccactcctctctggccccacctgacttctctatcatttgaggcactcccacagccccctgcccagccaggaccacatgagccccacattcctttccttggggcatgccatccctggggtgggggtccctcactgcctcccagaccaaatcctctctcctaagcatgaccatcatctcctctagagccaaagatagaggtggctttaggggacatacagtgagggaagagggacagtataaaaaggcctcccctttttctgaactggctgcttgatttaaagttattcctgtgacctgaactctggatgttgcacgtgtgtgtgtggcagaggtggaagatgcatgtgggtctgtgtagatgtggaagttgaggaaggtagtacagattgctgagaagttgggattttctttttcatttttcttcttttttttttttttcttgagacagcgtcttgctcttttgtccaggctggagtgcagtggggtgatctcagctccctgcaacctccacctcccaggctcaagtgatcctcccacctcagcctcccaagtatctgggaatacaggtgcacaccacactgcccagctaacttttatattttttgtagagacagggtctcactttgttgcccaaactcatctcaaattcctgagctcaagcaatcctcccttctcagcttcccaaaatgctgggattacaggcatgagccactgtgcccagccagaagttgggatttcaagaagcaaaacttgctcatgaaacacaatttcatcatttttaagcacacttagctgcacaaaattgtaaacaagaaagtctagatattctcagggccttaacaaaagcgttgaagaatggtttatactcagcatacctatgtggctgtagaaacaagggctgcaaacgcatgtataaactttagggtgctcacagccacccccagcctggttaaactccctagtgatactgcctgctgacatacatggaatcaatgcactagtcacaaagaattcttatctattgatgaaaacagccagccccagccctgggtctggctctccatctgagggctaggataggggcttcccagaaaaacactgtggccaggaaaggggctcagagaaacccaataccccagatagctgctaagacatgccagtcctaactttaaccccagtcccctttgggttaaagtcagttacttcacacccattttctcccttcctgcagggctgcaccagggaaaccggatcctggttaaaagtttgtcccttgaccctggccaaagcctagagcctcatccagaaggtccccagcggcttcgctcagacccaggtcccccgactgaaacccctagccagcgtccttcaccactgaagcgggcaccgggcccgaagccacagggtaagtggtcctggaaaagagcagagaagtggcccaggggagggtacagaggaggggagaagttagccagtggcagagaagagggtttgttagaaggatagggagccaccatgctcccagggcagtgctacctacctagtgcacagagtgctgtggcctgaggctaatgtgtgcatactgtgatctcaccttagcccctttgtgtctacctcaggcaaaggtgcagattggtgtttgtggaaggggttgtggcctggccatgacagccagccacctccaaatccagctttttttttttttttttttgagacagaatctcactctgtcaccaggctggagtgcagtgacatgatcttggctcactgcaacctccgcctcctgagttcaagcaattatcctgcctcagcctcccaagtagctgggactacaggcacgtgccaccatgcccagctaatttttgtatttttagtagagatggggtttcaccatgttagccaggctcaaatccagctcactgatgtctcccttctctcttccccattcgtctctccagtgcccccaaagcccagctacctgcagatgccccggatgccccccccactggagcccatcccccctccaccatcacgcccactgcctgccgacccccgagtggccaagggcctggctcccagggcagaggccagccccagttctgcagcagtatcctcactgattgagaagtttgaaaggtgagtctggtccctagggcaccctctaggggaaagggggagcctgggacaggaagggatagtcaggagaggcctctcagtcaagctcataccctgcttccatgtgtgtccaccacccacctcagagagcctgtgattgtcgcctcggatagaccagtccctggccccagcccaggtcccccagagccagtcatgttgccacagccaacctcgcagccaccagtgccccagctccccgagggtgaggcctcccgctgcctgtttctgctggctcctgggccccgggacggtgagaaggtgcccaaccgggacagcggcattgatagcatcagctcgccatccaacagcgaggagacctgcttcgtcagtgatgacgggccccccagccacagcctctgccctgggccccctgccctggctagtgtgcctgttgccttggccgacccccaccggcctggctcccaagaggttgacagtgacctggaggaggaggacgacgaggaggaggaggaagagaaggacagagaaatcccagtgcccctgatggagagacaggagtctgtggaggtactgacctgtgttcaccgagaggcaggtccatgtggagaacctggaagcgccttttgtgcttgattcttcccctagctcagtatttctcgaaataggaccttgtttccaagctctgtgacactgggcaagtcttttccctttctgcttccctaccataagcctcagtttccttatttgtaatacggaaagtctcttacttacatccatagagacttctcaacagctggaggaggggcgcaagagctagagccctgcaggggcccgaggctgtgcagatgaaggctcttggcagcagagacccctttctgtgcccgggcagcctaacatttcttcagaaggcaccatcgcacttgagttagatctcagccggaatacttgctctgctaggaccaagctcaagtgtaggggccaaagccagggactgccggcatggcaggtagtcaacacatatatctaaggaataggaaactaggccaacaggcaatgagttttatacgttcttatacttttgtgcttttctcacaccccaggtactcagcaagcccttgctgatagtgtactgagtgggtgaataaatgattaattaacatttatataccatttaatctgtagtctgatgtgttttatttatattaaattatctaattgtctccattaccaatggacttcagtcctattattattttgttttggttttgtttttgtttctcaccagcctctacattaaatagattctattattatctgtatttatggatgaggcgtcctaaatacagagctgttaaagaacttacacaagctagtgaatggcagagcttaggatttgaacccaggaagtctgacttaccatcccacatgcttaaccactacactctgctgagtgaatagagagagcgggtgaatgagttgttgagtgagggagtgcacgtcatcagaatggaggggtaggctttatggtagactggggactcagggatgaagctgaaggacttacagatctagagatgggggtcaaggttatcctagggtggtattaggcttagagtggcatgggaactgttttaagaattctgggggcttgggtgagggttacgatagaggatgatggatcaggggttactgtttctcctttccagttgactgtgcagcaaaaggtgtttcacattgccaatgagctcctgcaaactgagaaggcctacgtttccaggctccatctcctggatcaggtgagtggccccttgggggtacgagggccccaggaccttgtaggtgcgtttcaaggaggcagtgatagggcctgagttcaatcccaccattgtggccagaatttagaggcagtaaggctcctctctgaccttgaagtcagcttgtccctgaagccatctctgattatgccccaagcttgatcagtgagggctgataccaaccctcactcctaacgctgggcaggtacaccagccctgactgcgactctgacactagtactgacttggacccagatcctgaatttatccctagctgtgaacttcattctaaccctggccctattccagatcccaaatccactagaatccctgagagtagagatttttatctttgttcactgctctatcttaccctctatgacagtgcctcgcacacagcagacattcaaaaatattcattaaatgaacagatctaattccaactttctctctgaccctgaatctaattctaagcctgaccttgatcctgacttctaattgttccaaagcctaactcttggcagcagggacccctttctgtgcccaagcagcctaacatttcttcagaaggcaccctcgcacttgagttagatctcagccagaatacttgctctgccgggaccaagctcaagtgtgggggccaaagccagggactgctggaataacctgaaatccatctccccaatatataaccctaaccccattccctgtctcctcagtctcaagaccaatgctgatcccaaagctccacaagcctccccacaaatactgccctcacccttcaccagccaagccccaggcccagctgggctgagtgcttctgccctgccccacaggtgttctgtgcccggctgctggaagaagctcggaaccgcagttccttcccggccgacgttgtccacggcatcttctctaacatctgctccatctattgcttccaccagcagttcctgctgcctgagctagagaagcgcatggaggaatggtgaggggccctagacctagactgcccactcccctgtccacctgcctgccgagcccagacccagaggtgtacacaagacttcatttctgcttgctcttcctcttagtgacttttgaaaaaggaatcagagccgggcacggtggctcacacctgtaatcccagcactttgggaagctgaggcaggtgaatcacctgaggtcaggagttcgagaacagcctggccaacatggcgaaaccctgcctctactaaaaacattaaaaattatcctggcgtgatggcacgcgcctgtagtcccagctactcgggaggctgaggcacaagaatcgcttgaacccaggaggcggaggtgtggtgacccgaaattgcaccattgcactccagcccaggtgatagagctagactctgtcttaaaaaaaaaaaaaaagaaaaagaaaaaagaatcaggcccaagctctgccttcgaggacctcccagtctgatgtggaacacagaccagaactcagaaaattgcaacagaatagcatagcctacaggagtatgaggttaggagccaaattggctgagttcaaattccagctgtgccacttgctagctttgagcaagtttcttaagttgctatgcctcagtttcctcatctataaaatggggggaaataataacggcctaccttgtagggttgttttaaggattaaataacttaatacataaaagagcttagaacagtaccaggtataggccaggcatggtggctcacacctgtaatcccagcactctgggaggccgaggcaggcggatcaccaggtcaggagagcgagaccatcctggctaacacggtaaaatcccgtctctactaaaaatacaaaaaattagccgggcatggtggcgggcgcctgtagtcccagctactcgggaggctgaagcaggagaatggtgtgaacctgggaggtggagcttgcagtgagccgagatcgtaccactgcactccagcctgggcaacagagcaagactctctcaaaaaaaaaaaaaacaaacaaacaaaacagtaccagatatatacagtaagtgctcaatggatgtaagcttttgttatttttacagtgctatgatagagcagagaatgggaggctgtgggaatccagacaaatggaccaagcctagcttggagattacagaaggattcagggagaaggtgatgcctaagctgagtcctgaggtagaagggcaaggtttacaggcagcctctcaggccttcttccaatccagcctttagagtccacaccatttgccagaacggtctctctaaacaagtcagaccatgtctctccctgcttaaaatcatgtccacattccccatacctacagattctccacacctacagagtcaagtgtgtccccctcaccagactgtgaccacagaaagccagcatgaagcctggttcctatatctccccacgagtctgtgaaccctgagggctgggaccaggtctggtttgctttgctcctgcaccagactgaccaatgaggagtacaaccaggcctggtctctttgtctcacctaccagatggtgaccctctcagggctcaaatgggtgtgactcatttctgtgtccccagcatcacccagcacacagttgataatcagtatatgaagtggtcctggcagtaaggtctcagggtgagtacttcaaccagtactcgggcagggcagaattgaggcaggtggcatcccaggctgtggtctgaagtcaagccgagcctcttggcctcactggcctgtaatgtaagcagcatttctgaaggagcagactagctgagaagtaggtttctaggactgagatgaaaggtatctgcctggggctggaaacttgtgggggaagtttctgaggggcaaagagcagcaggaccacatcagcccctaattccaccccagggaccgctatccacgcattggagacatcctgcagaaactggcccccttcctcaagatgtatggtgagtatgtgaagaactttgaccgggccgtggagctggtcaacacctggacagagcgctccacccagtttaaagtcatcatccatgaggtgcaggtaagtggtcaagctggaaggagcagacttggggaggagaggtctgcagggatgtggtggggcatctgcagccagatctgagcccctctgcttctgcctgtcacagaaggaggaagcctgtggcaacctgacattgcagcaccacatgctggagcctgtgcagcgcatcccccgctatgagcttcttctcaaggactatctgttaaagctgccccatggctccccggacagcaaggatgcccaaagtgagtgtgtgcacccaggccccttcctacttctccacactaatagctctaggccagacctctgaggcaggaccccaagacttaattcacagggtcggccttccattgccacatgattgaaatcccagaggagaatctccaaactgaaaggcccacattgaggttctgaagtgagaccccaggatgagatcctccttctgaatgttctctttgggtattcaggcagggacctctaagttgagacccctgcctgaatacctgtagagaacattcagaaggagatccccaacctgaacttcccaactggaaccccagagtttgagtggcatgcccattatgatcccctaaaggaactcatccatttcctagatcgagaccccaaggctgacccctagactcacccccaaatgaagttgtaccaaatgagaaaggaaactgagcctgaaacctcagggactgagccaccaagctgagaggccagactgacccctcaggccaagcccacatcacagaatctccacagctgagctccccagaaagagccctggctcatcaattttccatcctccagatttagagctttcctccatgtccgccagccactacccagaatgaacctcccaaaagaacctccaaattgagcaccctagactggaccccaaattttccacctctcaaatttggatctctaggctgagatacctcctccccagactgaatccttacacattgaaccactagaaaagtcttctatcccgattcctccagtatcaacctgaaccccacaccccagatagagctccccccgcctaccccactttctcttccccagattttcattcattcattcattcattagtttaacagctacttactgagcacctccatgtttttgtgcattgttctaggtactggggatatagaggtgaacaaaacagacaaggtccttgatctcagggagcatatattctagtcagcaatgagacacagtaaacaaaaataataaacacacagtagaggccgggcgcagtggctcacgcctgtaatcccagcactttgggaggccaggccgggggatcgcctgaggtcaggagtttgagactagcctggccaacatggtgaaaccccgtctctactaaaaatacaaacattagctgggcgtggtggcgggcacctgtaatcccagctacttgggaggctgaggcaggagaattgcttgaacccaggaggtggaggtttgcagtgagccaagattgcatcactacacttcagcctgggcaacagagcgagactccttctcaaaaaaaaaaaaaaaaaaaaaaagagctgggcgtggtggtgggtgcctgtaattccagctactcgggatgccagggcaggagaatcactcgaactcgggaggcagaggttgcattgagctgtgattgagccactgcactccagcctgggtgacagagcgagactccatctcaagaataaataaataagtaaataaatacacagtagaatattagataggtgctgagtataattcagagaattagaagagggtggcatgacagtggctggagagcctacttgagattgggtggcctgtctgactagaagacagtgagtcaaaacctgaataaaaagaaggtaggcacatgcctgttggggttgagcatgttccaggcagaggccacagcaagtatagggtccaaggcaaggggagatattaggggaggtggggtgctggacaggttgcatatctctggatcaggaagaaggtcagtgtgacctgaacatgacaaataagagtagaatggtagaaatgaggttggagagaggagcaaagactgaaggccaagataaggagatggattttattctgagtatggtgggtagccatgggaaggtttcgatcatgattacttggggagcaagagagagagagctgagagatcagttagaagccttttgcaataatccaagtgagaaaagttggcttggatgaggacagtagcagtagaatcggtgagaaatggttggattcaggatacattcttttcagaagcagcactgagaggactagggtggagtggatgctgggcttgggagcaagagtcaggaatgacttaaaggtttttggctggtggtgatggttcctgagatgatcttaggagtctgactttggacatgttcaaagtgagctgctagtcaggcagttagatgaatctagaatttcagggagagatttggatgtcattggcacatagatagtattccaaagccataaggctggccaagatcaccaaagggagtgagtgtaaaaggaggggaaagggggccaaggacaaagctcagggatgtggaatcaccaaaggagacttagaaggagcagccctaggctgggcgcggtgactcacacctgtaatcccagcacttttggaggctgaggcaggtggatcacaaagtcaggagttcgagaccagcctggccaacatggtgaaaccctgtctgtactgaaaatacaaaaattagccaggtatgatggtgcacgcctgtaattccagctagtcaggaggctgaggcagtagaaccacttgaacccgggaggcagaagttgcagtgagccgaggtggcgccactgcactccagcctgggtgacagagcaagaccccatctcaaaaaaaaaaaaaaaaagaaggagcagccctaaaggtaggaagaaaaccaagaaagtgtggggtcctaaaagccataagaatggggttcgaggccgggcgtggtggctcacgcctataatcctagcaatttgggaggctgaggcgggcagatcacctgaggtctggagtttgagaccagcctggccaagatgatgaaaccccatctctactaaaaatacaaaaattagccaggcgtggtggccgtgcctgtaatcccagctaccctggaggctgaggcaggagaatcgctggaacccgggaggcagaggctgcagtgagccaagatcgtgccactgcactccaacctgagccacggagtgagactccatctcaaaaaaaaaaaaaaaaaaaaagaatgggaagtggacagctgtgtccactgctgtgtccgcttcccaaactgagccttctccaccctgccagatggggcactttgctaccaagcctggacccctagaaagaactaggcctctagaaagtttaatagctaagctctacaagcagacatctgcagcataagtaagtacctcattcctcctgctgaaaaagagccctcactgaggtgccagcctaaacttctagaaagggccttccagactgattgtctgggatgggccctatggactgacatctccaaactgaaccttcatactaagcccattctgaggtcccagttatagatcccaacactggtttctcaaactaagatccccagactgggcctcttcccacctggaatactcttcccacactgagccctgagagtgggttcccagtgagagccttcagcttgaggtccccaaaagagcttcccagtctgatctccttggccaccattctatagacaagtattgccaaactgagcaccctagattaattctcctatttcatatccctcagactgaaactttcagcctgaacttaaaagactgactctccaggtccatcctacagactgaagccccactgagccccaagactggattctctgagttccccagagggaaccctgaaattcagcagcccagactgagctccagacagagattccagattgtgttctccccagcccaagtcccctagactgatgacccctatttttcttttttctttttcttttttttttttttttttttttttttgagacagagtcttgctccgtcacccaggctggagtgcagtggcgcgatctcggctcacggcaacctccgcctccctggttctagcgattctgcagcctcagcctcccaagtagctgggattacaggcacccaccaccgcgcccggctaatttttgtgtttttagtagagatggggtttcaccatcttggccaagctggtctcgaactcctgacctcgtgatccacctgccttggcttccaaaagtgctgggattacaggcatgagccaccgtgcccggccaacgacccctatttttcatttaccagatggagagtcccatgatgagctccaggactaatgccctagattattagactgtcccccaaattaagccacacaggctaagtgcctagtcccatgtccacattgagcttccaggactcagttctgcaattttattttcacactggatccccaacgtaacatccccaggtgaaaattctccaaataagctccctgcactagacccaaagtgagccgccagtgaaagcaacctagagtgggctccagatagagtccattttctcaactgtatatccttgggcaagctgctcagcctctcagcctaagttttctcacatgtagaatggggatgataatgatacctacctcatatggttgttttgagaagtaatgagataatctgggtaaagctcctagcacaatgcctggcacatggtaaaggctcaataaatgttagctgcttttattactaaatgcactggctaatgcccatccctctaaaattggccccaggttgagtttaagaaatttatttattttttatttatttttatttttatttatttattatttttttgagacgtagtctcactctgtcgcccaggctggactgcagtggcgcgatctccgctcactgcaatctctgcctcccaagttcaagcgattctcctgcttcagactcctaagtagctgggattacaggcacccaccaccacgcctagctaaattttgtattttgggtagagacagtgtttcaccgtgttggccaggatggtctcaatctcttgacctcgtgatccacccgcctcgccctcccaaagtgctgggattacaggcgtgcgccaccgcacccagcctatttttatttttattttttttgagactgagtctcgctctttcgccaggctggagtgcagtggcacaatcttggctcactgctgtctctgcctcctgggttcaagtgattcccctgcctcagtctcccaagtagctgggactacaggcacacaccaccatgcctggctaagttttgtattttagtagagatggggtttcaccatgttggccagcatggtctcgatctcctgacctcatgatctgcccaccttggcctctcaaagtgctgggattacaggcatgagccaccgcacccggccttttatttttttttattatttttatttatttatttatttatttttgtattttttttttagtagagacggggtttcaccatgttagccaggatggtctcaatctcctgactttttgatccacccgcctcggcctcccaaagtgctgggattacaggcgtgagccaccgtgcctggcctatttttttttttaagtgaaagtaagtttattaagaaagtaaagaaataaagaatggctactccataggcagagcagcctgagttgaagaaattgagcttcctgttttgtatcaatcccaaccctatctgaggccccaggatgaacctcacagcttgagcttggccaactgagcttccttaatggagcctcccagattgagctccccacatcaagtccaaagatgaaactttgtccccagaaacaacttaccggtctggttttctgagctgttcagaatgagaatctctgaatgagagcccgcctgagatatgcgcactaagatcctcagcccaagatcgtaagctgagctcccaattttttacacctcagactaaattccccaggctgagcctcactgaatcatatgtctggttccccagactgacttgcccactttctactttccagactgcactctggagcctggaccctagaccaatctccccataccaggccatctggaactcctggcctcagttgcctacactgggcccaagactaaactccaaaccaagatcctagactgccaagcccagaccaggccccactaacgcttccaaaccaagcccctacatcaggccccgcagattgcactccctagcctgaacccctaagtgaaattctagactgaaatccccacactgagcccccaggtagggactgtacaccctggatccttggaaatgccagtctgtactccacatgagacatctccagacagagctcgttgtaacaaagcctccagtcagagcccatcagcctacacaggcctgagcttgtgtgcccacaacttgccagagtcttcttcctatccccttccctgggtgccccctacctctaccactcagcctgccccctgccttggggtgggggagatgtaggatgtgtaggagaaaaggcagctgggagatcattcccagctctgatgccaactctgccacccaggtaggcaacctagggtggtcaccttctccctgggtcttggtttcctcattggataaatggggcacaatcatctatgttacagggttgttgtgagggttgaaggagctaatttatccaaagcatctgcctggagagggcagtgggaccttggccctgtcctagggagctcgtagtctactgaggaatatggatgcagatgtataaatacatgatgagcactgtgactagtgggacagaagggagcaaaggagaatgtgagaacccagacagggtcctaacccagcccgagaactctgggcaggctcactggaggaagtgagctggatccagaagacagtgacagttggccagatgaagtaagacgggacatgtttagggaggtgtaggaagctggagtggtcagcagaagccacatcaccaagggctttgagtctttttttttttttttttttttttttgagacgtagtctcgctctgtcacccaggctggagtgcagtggtgcgatctcggctcactgcaacctccacctccagggttcaagtgattctcctgcttcagcctcccgagtagctgggattacaggcacgtgccaccacgcctggcgaatttttataaatttagtagagacggggttttgccatgttggccaggctggtcttgaagtcaggtgatctgcccccctcggcctcctaaagtattgggattacaggcatgaaccaccacgcccagcctcaccaagggctttgaatgtcaggctaaagggctaggtctttaccctgcaggcacaggggagccattgacagatttgagcagaggagtgacagtaaactgtgtgagaaagctccttctggcagctaggatggaataagggttggagattggagcccggcccctgaaaggcatgtggatgcctgagctgggacaggggccatagatctccgtgagcaccaaaacttggtcatgaagagagagcctcttaggaaaacacgacttggttggccagccatatggacctccttcagaagcacctctgctcctctagcacaggctgatctgagtggggagatccagcacatacagaatggggtacacaaagactgtggccaggccttaagcatgggtgggatttattagtgtgtggagatgtacagggactcatttcagctttttctttttttttttttgatgatacctggtcactataggaaatatggaaattacagaaaaagatgaaagaagtaggaaaaaaatcccctgttatctgagcccccagagaataagcacaatgaacattgtgacataaattcttcctggtgttttttagacatgtatacttgtaaaagtaagatcattctatataaacatgtttgtatccttttcttaaaacaccctgagcatttcccagattattaaaagacctacatgaggatcatttgtaaaggttgtttaatgttccattatatgaagacaccataatgtatttaactgaacccctacagttggccattttttttggcagggaagaggtacaggtgaaggtgtgctcccctacagatggacatttttgtttcccacttggaactgttgtaaataccaatatgacaaaaatgtgtttgtgtatagaatgtgtattttcctagaatagatacccagaatcagaatcattgagacaaagaacaggatcatctcattgtttctttatatggctttttctgattataaaagtaatacatgttctttgtcaaaaatacggaaaatacagaaaaacctaaagaagacaataaaaaccacccacggccccaccaaccagagacaacatgggtatgcttccttctggttacatatgtaactattattgttattattaatggtaataataatcttggcaagcttgcatttttttattggctgccaactactccatctattgtgattctggcattgtgacattggacaacttctgattttaaatgatgttgctgtggacatctttgagggtggagctttctgagatgggagggtgtgatcaggccaggaggaggtattcagggaggaaagaagccccgaggccgggtgcggtggctcacgcctgtaatcccagcactttgggaggctgaggtgggtggttcacaaggtcaggagttcgagaccagcctggccaacatagtgaagccccgtctctactaaaaatacaaaaattagccaggcatggtggcacgtgcctgtagtcccagctacttgggaggctgaggcaggagaatcgcttgaacccgggaggcagaggttgtggtgagccgtgatcatgccgctgcactccagcctgggcaacagagtgagactccgtctcaaaaaaaaaaaacaaaaaacaaagccccggaaaggctcctctctgctagtcccccatctgacctcacccctctatgcctgtagagtctctggagctgatcgccacagcagcagagcactcgaatgctgccatccgcaaaatggtgagtggcccttctagcccctgcccttccttggccacccacctgtggtgtctccatcctggagtgggggtgtcgtgacttgtgggcatctgacaggaggctggcaccccaaccgtgccttttgttccctgtcttttgccaggagcgaatgcataagctgctgaaggtatatgagctgttagggggcgaggaggacattgtcagccccaccaaagagctcataaaagaaggccacatccttaagctgtcagcaaagaatgggaccactcaagaccgatacctcatactagtaagtgccaggcatggaattgtgggtgggtcatgcccctcccaacacacacacacatagtgacctggtactcactcaaagactatacctcctttcattcctgaaagaggaaaaaaaagaaaaacagactatacctcctgctagtcattctctcctctagtaacgaattgtattttcactacctagctaggattttttttctccactttacagatgaggcaaataagccttgcagagaagtgacttgcccgaggttccccactaggaagtgtcttccatgcctaggctctttccttgtgacccctgtgcccaatttgggctgtcttttctccatctattgcctacagtccttggcagtaaagcttcagggcaaggagctgggccacatccccactaggccctctgcacatacatcccaaactttttccttcctagttcaacgaccgcctcctttactgcgtgcccaggctgcggctccttggccagaagtttagcgtgcgggcacgcattgatgtagatggcatggaggtaagcatccaagaggtgggaaatgggaacttggagtggggcattggtgttgggaggaacaaagatgctggctttgaccccgagtctgtgtgtgtatgtgtgcagagggctagggccctgtggagttcagtggcctcaccatgcccctttctgcctccattcagctaaaggagagctccaacctcaatctgcctcgaaccttcctggtgtcaggaaagcagcgctccctcgagctccaggccaggtacttatccttgcctatgcctttcctccagcgcctacctcccttttgttcagatatgctgaggcattccaggcccagagattgttccagagaaaggatgggcacctttccccaaagatgcaggcttgctcttcagcggtgggggtgatccctaagggttagacaccatttagattcagggtgagtacttcacgatatggggaaaggtggcactcctgccagggaaaccttttggaaaatgaataagctctccctaattaaaccaagaatttcttctggtggattttgttagaggagagagaagaatgggatgtgaaacccaacatgaataataccaccacaaatagtttattgtagattcacagatctaagagaaataacaatcaaatgcagtacttggtccatgacagaagcctggtttgggaaaaagagccctaaaagacatttgtgggacaataagagaaaatgtggatgtaaagtgaacattagatattgagaaattattgctgtcttaggtgtgataatgttatggtggttatgcaggagaatggccttgttttgcagcagtgcatgctgagggcttagtgtcacaatgtctgttaattactttaaaatggttcagcacccaaaaaatacatatgtaaccatacatacacatttgcacacatatacatacatacacatatacagtcatgcactgtataaaacattttggtcaatgacagaccatatatacacagtggccccataagattaaagtatcatattttactctaccttttctttttttttttttttttttaagacagagtctcactctgtcacccaggagtgcggtggcatgatctcggctcactgcaacctccacctcccaggttcaagcaattctcctgcctcagcctcctgaataagtgggattataggtgcatgccaccacgcccatctaatttttgtatttttagtagagacagggtttcactatgttggccaggctggtttcgaactcctgatctcaagtgatctgcccgccttggcctcccaaagtgctgggattacaggcgtgagtcactacgcctgtctttactataccttttctaggtttagatatgtttacatacccaaataattagtgtgctacaaattaatacaatattcagtacaactgtaacatgctttacaggtttgtagcctaagagccataggctgtaccttatagcctaggtgtgtcgtaggctagaccatctagtgtactagtgtcagtacgctctctgatagtcgcacaacaatgaaatggtctaacgacacctttctcagaacacatccccgtggttaagtgacgcgtgactgtatgtacatatatatgaagtaaatatggcaaaatataaaaaaattttgcatctctatagtaggtatatagatatgtattgtacttgtgctatcctgtttacttttttgtatgcttgaagttttttataataaacattttaaaataatagcatgggatgatggccagccatttaacagaggggcctttcatatccattctctacttcgatgattataatcatagctcatatttcctcaagacttagttttttgccaggtgctgttttaagttaatgttaacttaaaattttaagtctaagttgactagtcaaaagcttacaagagccctagaagtagctactgttaccataaatctactttacaaatggggaaacttaggtgtaggacagttctgcatgcagggcgcagtggctcacgcctgtaatcccagcactttgggaggccaaggtaggaggatcacttgaggccaggagttcgagaccagcctgggcaacataacgagacctcgcctcttaaaaaagaaagaagaaagaaagaaaaagaatatttatgtacttgcccaagatcccagagcaagaaaggagcagagctgagattggagctcaggtcatccggccctggagtccacattcctaaccactgtctatgctgccttctgagggaccaggtgaaagggtatcagggtcatggtgagggccagaggatggatgcatgtcagcagatggcctgcttctgacaggctgtgagaaagtgagaaatgactggctgggactgcaaggaggtgggagagagagatgaatgtgagatagagggtatcctcctgggggatgaagtgagtcttgaagcttggggagattgagagcctcatggaggcctgcagcagggaaagtgagagcaaagcagatgccctgcacatccaggggagtgacaagccacgtgacagggactcatcatctgcagagaggaaaggggctgcagtgggacactgggcccagaaggggcagccaagcaatgtaggatttcctcctagtggcagcaggaaggcatggagggtttgctttgctttgcagtcacttttactgcccttaaaagaaaaaagaaatttaatgcaaattttcaaatatccggaaaagtgtaagtacaacaagcacccagatgcccacaacttagacagctgcttctcaactttggcaacctttggaatcagctggggagcttttaaaaaatacggatgcctgggacccacctgcagagattctgatttaattggcttgggggatagcctgaacatggagagctctaaaagccccccaggtgattttattttactttttaatttttatttatttatttttgagatggagtctcactctgtcgcccaggccagagtgcagtggcgccatctcggctcactgcaacctccacctcccgggttcaagtgattctcctgccttagcctcctgagtagctgggactacatgtgcatgccaccgcgcccggctaatttttgcatttttagtagagacggggtttcgccatattggccaggctggtcttgaactcctgaccttgtgatctgcccggctcggcctcccaaagtgctgggattacaggcatgagccaccacgcctggtccctaggtgattttaatgtgtgtatcagggtgtacaaccacttatttaagagtcaacaactactgacattaaatgtcttttgctgaaccattttaaagtaaattacaaatatcaggacacttcacccctatacacttcagcatgaatagccaaaaaactctactatactgtagttcttttttttttttttttttttttttgagatagggtctctccctgtcatccaggctagagtgcagtggcgttatcatggctcccttcagcctcgaactcctgggttcaagtgatcctcctgcctcagcctcccaagtagctgggaatacaagcatatgccaccatgcccagctaattttcgtattttttgtagagatgaggtctcactatgttgcccaggctggtcttaaactcctggcctcaagcaatcctcccgcttcagcctcccaaagtgctgagatgacaggtatgagccaccactccgtctattgtggctcttaaaaataaaaagcaacacttgttcacttctaagaaattataaattagaaaatatagataaataaaatatttcttttttttgagtcgcagtttctctcttgttgcccaggctggagtggcagcaatggctccatctcggctcactgcaagctccgcctcccaggttcaagcgattctcctgcctcagcctcacaagtagctgggattataggctcccgccaccacgcccggccaatttttgtattttcagtagagacggggtttcaccatgttggctaggctgacctcaggtgatccagccgcctcggcctcccaaagtgctgggattacaggcatgagccgctgcacctggccaataaaataattttttaaaagaatacaatcagaataggccaggcacggtagctcacgcctgtaatcccagcactttgggaggccaaggcgggtggatcacctgaggtcacgagttcaagaccagcctggccaacatggcaaaaccccgtctctactgaaaatacaaaaattagccaggcatggtggcacacacctgtaatcccagctactggggaggctgaggtaggagaatggcttgaatctggaaggcggaggttgcagtaagctgagatcacgccactgcactccagcctgggtgacagggcaagactccgtctcaaaaaaaaaaagaatacagtcagaataaagtgattgcagtgcagtgcagggcagacagaagagtcagggaaggggaacgcacactgattgagcatcgagtgtgccagacattgtgctgagcactgtacacgttacctcggttactgctgagaacccagagagtgataatcattatctccattttacaaatgaaaaaaaaactaccctcttttctcaacttgacacccagcaacagagaattttttttcctttttgagacagagtctcactctgtcacccaggctggagtgcagtgggacgatctccgctcactgcaacctccgcctcctgggctcaagcgattctcatgcctcagccccctgagtagctgggactacaggcatgagccatcacgcccggctaatttttgtacttttagtagagacagaatttcaccatgttggccgggctggtctccaattcctgacctcaagtgatccacccgccttgacctctcaaagtgctgggattacaggtgtgagccacccacacccggccaactgataattattgacacggtttcttttatgttctatattctctcccacacatttcacccttacccctctacctgaggcctagcacctccttgaaaagtcctcacccaaacttcagactggggcatgtcacctcctctgggctccttggccttattttcaccatcaaaacactgatctccctgtattgtccctgtctatttcctctactagaccatgagctccttgagggcagggtcctctctgaagctcaagttcttagcacagggtctggaaagtattagtaatcgttgaataaataaacccaggcagattatgtgacttgcccaaggtcatataagtaataggtgaagaagagggtcaagcccaggtctttctgactccaaaacacctgctcttccactcctattgctttttgtgggcctacctaaccaaacatctttcttttttattccccaccccaaggactgaggaggagaagaaagactgggtccaggtaacatccaaggctctgtggtagggggctagaagagtattaacaggtctcctaggggttgatagattctccctcaaaactcacagctaaccagaatggtcctggacaactgtctttcagcaaactttactatccccattttacagataagcaaactgaggtgcagaggttgagcagaaactcacaaactcttcttttaggaagctggtttctctgagggtgtataaggtgagggtgtcaagctctgtaaaatcttaagcccagaaggtggccaggaaagccacctgaggtttttcagccaccactccccctcccccattttacacttgtaacactgagacctggatttgggaggggatttgttcaaagtcatccacctaccagtgacagaactgggtttgaaacccagcttttctaacttcaggctagggtatacgaaggtgaggcgagggtagaaatgggtagtttgtggggtgatctgacttctcatttcttacacctcctccccaggccatcaactccaccctcctgaagcatgaacagacgctggagactttcaaactgttgaactcaacaaacagggaagatgaagacaccccacccaactctccagtaagagtccccgccctctttcccctgcactgggaccccttccagacttccaaatgcccacctgacctttagatgatcctctccctttcctagacggtaatgaccagagaggcaatgcatgacttcagaagcagtcttccattggtagggccacagagaaatcattggggaaactgaggcccagaaagtataatagaagtgacttgtcttcagtagcacagctaggagcagagccaggacttaaaggcaggtcttctgaatgtggctgctccccctacccccagcccatccccaccccatgataatccaagcgttggagcaggaacaagggctggctggactgggctggggagtagctgtctctgacctgagacctggccctccctacagaacgtggatcttgggaagcgggcacctacgcccatccgggaaaaggaagtcaccatgtgcatgcgctgccaggagcccttcaattctatcaccaaacgcaggcaccactgcaaggcctgcgggcatgtgagtgttgggaggcaggggcagagctagggaggggacagaatggcagcccaaaggcccactgcagagtgggtaccctccaagtggggggaggccacaagtctgctgtgggagttggtatgctgaagggaagacccgctggaatcaggctactcttgcccacttgccaccccaggtggtttgtgggaagtgctccgagttccgggcccgcctcgtctatgacaacaaccgctccaaccgtgtgtgcactgattgctatgtggccttgcacggggtgcctgggagcagtccagcctgcagccagcatacaccccagcgccggaggtccatcctggaggtaagagccagcccctgactaactctcccacagtgggcaaatgggttccaactctacccagtgagactgaggaggcccgagtatttgggaaacagtagtgatcaagggacccaggcttggagtgaataaaatgacggcaagagtgaatgaaagacagtcatctttaagtacttagacatttaatccccacagtaactaatctgcccatgctattgttctctttattttacaaac

SEQ ID NO: 203 - DNA, 47664 bp, mus musculus; identical to SEQ ID NO: 202

SEQ ID NO: 204 - DNA, 47664 bp, mus musculus; identical to SEQ ID NO: 202

SEQ ID NO: 205 - DNA, 214 bp, mus musculus
tagtgttaggaaagctgtgtgggagctgggcaccagccacctcactgtgcagtgacagtgcctacacaccgcagccactcagatacttggtagtctatgatagatggggacaggtagagaagaccactccttgcagcccctttacctgatgcgtgttgcatctgagcccgtgcctggtgggcagcttgtggtggaggaggaggagaaaccaact

SEQ ID NO: 206 - DNA, 301 bp, mus musculus
gcaagtgtgtagaaagatctgtctatttctgttcacctgggacctggtggtgactgaactctttcagcaagggcaatggctcaatgtgattcggtgctggagctcagctgggactcagtaaatctgcacgttctctgctggtcagaacatgtttcctggagagcattgcttttctatctagaagttcgttacctcctgcatgatagtgggatattgagatgtgggttctaagatccacagactcatacttttgtgaactttggaatgtggtagggtacactgaaccaagtcagaaaatagt

SEQ ID NO: 207 - DNA, 39884 bp, mus musculus
aggtggatggtggtcggagcgccgactcccttctcgtcgtcgccattttgagctggtgactgtggccggctgggagtaggcggcagtgagtttccctgggagggcagcgcgcttggcgcttctcccctccccccgatctgcctccagtctcggacttggttgttgcgcgctccggctccggctgagctgggagagttggaggaggtggcggcgggcagaggtgatgtctgggagcccttccttgacagcccgggccgagaaggtgagcgtcgacgctggtcgtgggggcggaggtaaggggcccggggcggggacgtagaggaggcgcgagggcggacttcgggtcgggggagatgcgcggaacggaggggttggtgcaatgtctcaacccgggagggtttttttttttttggttttttttttttttttttttttttttggtgtgagcaaaggcgcgtgcgcgactgggacatgggatgggtgcatgcgggttgggggaagggagggacggatgggagtgggctactgtggatcactgtgtcggctacatcgaagtttatcagtggggaagcggttgtctgcgactttgagtttgtgcataggagaggggatgctgctctgtgttactctggtgtttatcggtccatggggaaatattctgtggttctggtctctattcctgggggatcggaggggggatgtgactctggtctttaccctttgagggggggcggtctgtgactctgatccttatccatggggcggggcttgggggacgactgtcttttgattgaccctaacccacttattgggtgggaaggggcatgcagggaatgtgtgtgtgactcattgccccttcttttggggagtttgtatctgtgacactgacgctcatccatggaaaggggacccactgtgtaattgtggtccttactgtgtgttccttctgtgatgtgggcccgtagttatttggggctcgtgtctgtgactggcccttggctgtggtggatgttactgtgtgactctggcccctttgccagagtctcttgaaggtttttgtgctctcagacgccagtgcctctgtgtgattctaactcttgcccacctgggagcaggtaactcgggttccctgtggcttgaggaggaagagaaaattggagtgtgtttgtctgtgtatgtgtgtgcacgagcatagagcaaaggtgtggcagcaacctagtgttgagcaggtgctattattgcctggctttacctgcttcttattcagagggtggggcctgaagatctgggattcatcctgacctctggctgggtcacagggttctcaggactccctgagttctcaccacagccctgagggttggatgaagtggctgctgctccatcccaatagaagagcacagtggttcagaacagcctccaaaagggccccttttgcctctggaaaccgggcttgagccctggggagggaaccaccttaggaccgggctgcacataagagacagggctcagggctgagccagttgctgtgtgagggccaaggctgtgttggccaggagcccagggaggtggcagctgtctcgtcgccaagttcgccccttcacacacccccccaagagcctttcatggtcttttgctgccttataggggacagccagcagcttgttgggaggatgagatggtcccttggggcctgtggaaggagcctggggcccccattgttgtgaagtcttgtctgatgtgctgaatctcaggcaagactttcagccctgagagtcccctacccccaccctgggatgcagccccaggcttgaatttgtctacctgtcttaggtggcaaagccctgatcacactgtgggtggccccgccaggtctctctgcaagatgccccctgtctgctgaagtccttgctgttttctagggcagtgggctctagccttatgtttgcggggaaagggaggagcaggccaagtaggggctaccttcatactgtgatgcacaggagtgctgggagctggaagacaatgtccctgggctaaggggcagcggagagccttgacaataagagtttctcaaggaggccctctcagtcccaacagttttgacccctttcttccctccactctccccagagtccctgcaggaagcatcacccaggctggcagatcatggtagcagcagcgggggtggctgggaagtgaaacggagccagcggctgaggaggggccccagcagcccccgaaggccctatcaggacatggagtatgaaagacggtgagttatctgttctcagcttcccagacagcctaggcttgcgtctatgtgagaattgatccaagaaggtgctaggatggggcttctgggtagaggaaacagcatagcagatgatgggtttcttttcagcagacaggtgtttggcacctgttgtgagccaggacctgtgctaggctctgatagtgcagtgatgaatgagacatgagattgcatccttctcagtactcagggtgtcacagggacgctatgcagttaacgggtgggaggttgaggttggggctatagcctggggtatgagggatgggtgggaatggcaccatcagagtcaggatttgcccgggaccactaggggacaagccaggtcagatagtggaagactccagggacagtatgggctacagttggcatgatacttgctgggaatggatactctcagacagttatttcttcagctctgctatgaacaaggaatagctggaacactgggtaaaatacagaaatcctgagtaaaattcagtgatccctcgccatccaggtgattccgaggcaggtgacccagccatgacacttgaagattgcctagaaaagcagacctaactctctcagaaagcctctattaagactcaagagtcaatagctttataaaaagagaaaataatttttaaaatgttttacgaagtgtttcttctaccaccactccttttaaaaatgtagaattgtaatattttgttttctgaaaagtgagcccaaatttgagataaggtcatcacctagtgttattcagtcttggctttcattagaaatgttttttgaaagacatttgattttggacggtattcactagaagtgctctgtggccatttctgaatttgagtagctgacatacatactttgttcaaactttattaccaagtaaaaccattgacttttaaaagccctcaagtgcagaggtttgagttcatcatactttccagttcaaggtaggtttctgtcataggtcagcaaaaggcttcctcttgtcatgtttattttttcatttttattcccaattcccacctctgtgggcagctgctctgtcgtgtttgatatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatcatagatttatcatatagatcattttcatataaatgtatcatatagatacatgtatcatataaatacatacataaatgtatcatatagatacattttcatagaaaatgaaaatatgaagtgttgttttgagtgactgtgttttcagttgacacacatggcatggtgccacagtcttcgttttgtttcctgaactttgtattactcagagtgggaggttttttttgttttttgttttttgttttgagacagggtgtctctatgttgcccaggctggtctcaaactcctgggctcaggcaattctcctcccttggcctcccaaagtgctgggattaaaggcatgagccgctgtaactggccaacagtgctgtttttttttgtttgtttgttttgttttgttttgtttctttgttttgagaaagagtttcactcttgttgcccaggctggagtgcaatggcgcagtcttggctgaccacaacctctgcctcccggtttcaagcgattctcctgccttagcctcccacatagctgggatttcaggcatgtgccaccacgcctggctaattttgtatttttagtagagatggggtttctccatgctggtcaggctggtctcgaactctcgacttcaggtgatcctcccatcttggcctcccaaagtgctgggattatgggcatgagccaccacacccggcacagtgctgtatttttaacatctgtctgtattgccatgtatatgttactactttgtttctaattgctggcaagggcatcatggggcatgtctactgagttttacttaatacttcccccaagagtagatgcctgttgttaattttgatgtgctagcatcattttttttttttttttttttgagacggagtttcgctcttgttgcccaggctggagtacaatggcgcgatctcggctcaccacaacctccacctcccaggttcaagcaattctcctgcctcagcctcccaagtagctgggattacaggcatgcgccaccacgcccagctaattttttgtatttttagtagagatggggtttctccatgttggtcaggctggtctcgaactcctgacctcaggtgatccgcctgcctcggcctcccaaagtgttgggattacaggcgtgagccaccgtgcccagcccaacgtcaccttttttgctttatctgttaatgtatagtgttttttgtttgtttgtttgtttgttttgagatgagtctcgctctgtcacccatgctggagtgcagtggcacgatctcggctcactgcaaacttcgcctcccgggttcacaccattctcctgcctcagcctcccgagtagctggtgctacaggcgcccgccaccacacctggctaattttttgtatttttagtagagatggggtttcactgtgttagccaggatggtctcgatctcctgacctggtgatccacccgccttggcctcccaaaatgctaggattacaggtgtgagccactgcgcccagcctaatgtagtttttaccttttgcattcagatctttaatccatctagattccactcttgaatatggcatacggtaggctccggttttattttcttccatatagtaggcagtttttccagtaccacctcctaaatagtccattctttctttattgatctgtggtacctcatctgatttcaggttccctcatgtacatggatccgtcttgagtgatgtgatttgttccattggtctatttgcacattcttgtgccagcaccttactgtttttattattatggctttatagaatgtcttagtagctcctttgcacttatttttcaaagctggtttaatcatttatggggctttattatatatcaaaagttatcaaagtccctcaaaaacaacaagaattttgatcgatgttacactgaacttctctattaatttggggaaaattatctttgtaagtagtcatttcatctaagacctttgtagagaatattttgaaatttatgtaaagagcataaaaagctttcattttcataaatggaaatacaggtcttatgtattctttgttaaagtaatccctaggtacttcagtcactttcattatctttttttttttttctcgagacttggtcttgctctgtcacccaggctggagtgcagtggcgacctccacaggctcaagtgatcttcctacctcagccttccaagtagctaggactacaggcacgcaccaccacgcccagctaattttttgtagagacggagtttcaccatgttgtccaggctgatcttgaactcctgagctccagcaatccacccaccttggcctcccaaagttctgggattacaggccattatcttattttttaaaaaatatttttcatgctggtatttgctggggtagaggaaagctgttgatttctgtaagttacccctgctgtatgcccttattatttctaatacttcattgttgattctgatgttctttctaagtagttggtcatattgtatgcaaatctatcctgtcacttatttatttttcttcatttatagtattgtccaggacttttagtaccatattaaatagtataagtgatactgggtacacaaattaagatttactttggctggttgtggcagaaagtccaaaggataatggcttagacaagatagtttacttttctttcccataaaggcagtctgcagaagagcaattaatctagggctgacaggcagccccttctgtgtagccatcctcagcacatggcagttgagacagtaggaagaagggagaggaataaaagggaatgtgtctaaagtttctccattaagtatggtgcatgcagtaagtttttagaatgtatcctttaataaatcaagaaaattatctaatcttcgtttgctaagattgaccataaataagtattgaacttcaaaatcctgtgctttttttctccctttgtccattaatttcataaattgtggcctggcatggtggatcacagcaccttgggaggccaaggtggttggatcgcttgaggccaggagttcaagaccagcctggccaacatggtgaaacctcatttctactaaaaataaaaaaatcagccaggcgtggtgaagcatgtctgtaatcccagctactggggagactgagacatgagaatcgcttgaacctgggaggtggaggttgcaataagctgagatcgtgccactgcactccatcctgggcaacagagtgagactccatatcaaaaaaataaataaaaattttgtaaattgcattaaatgatatccttggcattcttgagctataccccacttgatcatggtatgtatgtatatgtttatgacttcttactttgaaaatatctcaaatttacagaaaggttgcaagaaaaagtataatgaattcccatatatcctctactcagaattacttgttttaagtattttgccacatttgctctatcactctatatctttttttttttttttttttttttttgagacggaatcactctgtcacccaggctggagtgcaatggcgtgatcttggctcactgcaacctccgcctcctgtgttcaagcaattctcctgcctcagccttccaagtagctgggattacacgcgcctgccagtacgcctggctaatttttgtatttttattagaaacgaggtttcaccatgttggtcaggttggtctcaaactcctgacctcaggtgatccacctgcctcagcttcccaaagtgctggaattacaggcgtgagctaccgcgcctggcccaccctatagctctatatctttacatagacacacacacacacacacacacacacacacacacacacacacgttttttttaatcgtttgagttggtggcagccatgacttttctttttgagtcagagtttcactcttgttgcccaggctggagtgcaatggtgcaatctcggcccactgcaacctcttcctcctgcattcaagcgattctcctgcctcagtctcccaagtagctgggattacaggcatgcgtcaccacacccagctaattttgtatttttagtagagacaggatttttccatgttgatcaggctggtttcaaactcccgacctcaggtgatccgcccatctcggcctcccaaagtgctgggattacaggcatgagccaccacatccagcctgacatgaccttttaagtctggcagcatgtacgtcttaagaacaaaggtgttctcttccataaccacaatatacttatcaatatcaggaaattaaacaattatatagtacttttattctatataaagcccatattcagatgttatcactcttctcaataatgtcctttataatggttttccccaatccaggatccagtccaagatcatgtattgcattgagctccttgtctcctttaatctgaaacagttattctatctttgtcttttatgaccttgtcatttttttttttcctgaacctatggattatattgaaagcatgttttaaagttagttgttttatagaatgtttctcagtttggatttttctgatgcttactcatgagtttttggcagaaatgttatttaagtgatttatgtatatttttaaaaccttgttagattttattagccattgtatcatctaggatatctacacctgtatttatcagtgaggtagtccaatatttttattttcagtatttatctggcattggaatcaaggtagcctcattacatgaattgggcagcctttgttattctctctttattggagaaacttgtataagaattatctgtacctcgaaaaacttggtaggactcacctttaaaagcatctggaggctgggcgcagtgggctgaggcagttggatcacttgaacccaggaattcgagacgatcctgggcaacatggcgaaactctgtctctacaaaaaatacaaaaattagctgggcgtggtggcaggtgcctatagttctaactactcaggaggctgaggcaggaggattacctgagtctgggaggttgagactgtggtaagccatgatcatgccactgcactccagcctcagtgacagagtgacaccctgtctcaaaaaataataaaataaaagcatctggagctggtttttgattaccatttcatctcttctgccaattttagcattttatattttctagaaatatactcattttgtgaagatcctcatatatgatgattcagtccagcatcctagaaatgctttataaaagggatatgcctttggaaggtgtttgttcagagtgctttggtggccaattaaaaatattcctttctatccaaatatgttcccttcctgagtttagatagcaagagttcaatacctgaatttatttggtttggatattggatgtcaagagagttcaggataatttcatctgaaaatttataaatttattcatatctgttcagttcttgattttttttccttttttttttgtttgtttgtttgtttgtttttgtttgtggagatagtctcactctgtcttccaggctggagttcagtggtgcgatcttggctcaccgcaacctctgctttccaggctcaggggattcttgtgcctcagcttcctgagtagcaaggattacaggcccgtgccaccacacccggctaatttttgtattttagtagagacggggtttcaccatgtttgccagactggtctcgaactccgtacctcaggtgatccactcgcttcagcctccgaaagtgctgggattacaggtgtgagccaccatgatggcccagttcttgaattttgatgactacagttcaaattgattgtatcaagaaccttataactactcataccactgacagtgatttcttctctaggcatttacggtagggaaacaatttggggccaggtgtggtggctcacgcctgtaatcccagcactttgggaggccgaggcgggtgaatcacgaggtcaggagtttgggaccagcctggccaacatgatgaaaccccatctctactaaaaatacaaaaaattagctgggtgtggtggcaggcacctgtaatcccagctactcgggaggctgaggaaggacaatcgcttgaacccaggaggtggaagttgcagtgagccaagatcacgccactgcactccagcccggaggacagtgcgagactccctctcaaaaaaaaaaaaaaaaaaaaaagagtttgggttccaagctgagttcgtggggacagggactttattttgttcacagcagtatccccattacctagaacagtacttatcgtatagccaatgttaggttaatatttgttgaatgaatgcatgaacaaataattgtttaaaaaaatggaagtcaaccaaaatgtttgaaaacatgtttaatggatatttgccccatttgttacttatctttatggtgttttccatagtttagtgtgaaatttcaagcatgtagcaaagtttaaagaattttacaatgggcctggtgcggtggctcatgcctgtaatcccagcactttgggaggctgaggtgggcagatcacgaggtcaggagatcaagaccatcctggctaacacagtgaaaccccatctctactaaaaatacaaaaaaattagccggctgtggtggcgggcgcctgtagtcccagctacttgggaggctgaggcaggagaatgtcatgaacccgggtggcggagcttgcagtgagccgagatcgccactgcactccagcctgggcaacagagcgagactccatctcaaaaaaaaaaaaaaaaaaagaattttacaatgaacaccatatatacccatccactagattctttttttttcttctttctttcttttttttttttttgagatggagttttgttcttgttgcctaggctggagtgcaatgacacaatctcagctcaccgcaacctctgcctcctgggttcaagtgattctcctgcctcagcctcccgagtagctaggattacaggcacgcgccaccacacctggctaattttgtatttttagtagagacggcgtttctccatgttgctcaggctggtctcaaactcccgacctcaggtgatctgcctgcctcggcctcccaaagtgctcggattataggtgtgagccaccgtgcccagcccactagattctactattaacgttttaccatacttgctttattacatatttacttctaagtttctcgtattttttacactctatagagatttataatttttacaaagccagatttattcattttccttttatgactgctgggatttgtcttgctgaggaaggccttccccactcttaaggtgatacatttttttcttatgttttctaatatttgttttctttttttaaaagttcaacttttattatagattaaaggatacacatacagtttttttttttaactcagtgaagatgtctgcacagcaggaatcatgtgggatgggatggccctttttcctaacgctggaccacttgatgttctcttccatcttcccccaaccctcatttagatcatgacatcagaaaatcaggttaaagttaagaaaaagaagaatcagatcattggggattcttagtagtagcatcgccattgggagctgctagcccagcgggtattccccatgccacccctctggatcttggctccatgggtactgggaggaggccttgttggccagggaggccacgctgtgctgctagaagctgggcgacatactggtggtgcagcagagtctcgggtgcggcagcttggaggtactacccacataggcattggccttccagggtgcatcctggcccatcatgctgctgcagcagctgtggctggtgctgcatgtctgcttgcctgctaggctgctcgccggcttggccaggagcttgctgtgcctcagtggggccacatcccctgtggctgctgtggctgtgctctggtcttggaaaatggtggcgatgtggttccagaggtctgtgaagaacctgctcacaccctcgtaggctgggaaggcgttgatgtcgatgacggcatgctgccccatctggttgttgatgatgatgtcggtgccgaacagcaatactcccagtgcctgccgcagggcccgggggagttcccggatgacctctttgctcggctgctcttgaacagaccagaccccttgatcttgtccagctccatcaggaccaatgatgactctggctttgacacactgtggctattgaggaagatggattcgtggtcacattgtgtccgcggagaatttcttgagcaagggcctctggaccacggtgtaggacttgctgaccacgaacaccttgtacagaacggtgttgtggttgatgaaattctagaccacacagggtggctgtatgccattcaggccctcctgattgaatacagtagacatctcgtgagagttggtgccgtgagccactctagttttgcacatgaacaggaaagccaggctgttcttctccagcagccacatggtgtcatccccgcacaggcttgtgacctccatgaagggcagcaagcagatcctgccgccttccatgtagatctcaatcttccagatgagtttgcaggacttggagcggtcgagcagggttctgacggcagggaaggagtccaggacgatggtttcagggtgggcatcgatgtagtcctgaaacctgtgcaccagctccagggactggctgtcattctggtcggcttcaaggatgacatcagtcaacttgtgaatgatgacgtccaggggtccctgctcctcgattggccggctgaggttcagctgcatgacttttttttttttttttttgagatcagtctcactcagtcgcccaggctgaagtgcagtggtgtgatctcagctcgttgcaacctctgccccccaggttcaagcgattctcctccctcagcctcccgagtagctaggattacaggcacttgccactacggctagtttttgtatttttagtagagacagagtttcaccatgttggccaggctggtcttgaactctcgacctcaggtgatccacccgcctcggcctcccaaagtgctgggattacaggcgtgagccaccgcgcccggcctcagctgcaccacttctatccctcacttcctgcacacctccgctaaagccgggaaattgagcttcttgattttcttctcatgcagccagtagccaactctcttccctttcataaaggtctatatcttcctcctcgggcaaggagcctgggtcctgaggaaattgcccataggctgagtctgttggccagtgagcgctgggagcgtgcgggcaccccctggtggcaggggtgtggaaagggctcggggtgcggggttagggccgcgtggtgtcacggtctccacaacccccccacccctggccacccagctggagctcacggcccacatacaggttgttctttttttcatacgcagtttcactctgtcgcccaggctggagtacagtggtgcgatcggctcactgtaacctccgcctccctggttcaagcaattctcgtgcctcagcctgcccagtagctgggactgtaggtgtgcaccaccatgcccagctaattttggtattttttagtagagacgaggtttcaccatgttgcccaggctggtctcaaactcctgacctcagtgatctgcccccctcggcctcccaaagtgctaggattacaggcatgggccaccgcatctggcctgtacaggtttttttacatgggtaaattgcgtgacactgaagcttgaggccccgttgatcccatcacccaagcagtaagcttagttcccgacagatggtccttcagcccatgccccccttcccaccttcccggtctagtgatccccaatgtctgatattccaatatttacattcatgtacattcaacatttaactcccatttataagtgagaacatgcagtacttggttttctgttttcgtggcaggtggcttaggataacagcctccagctccatctatatggctgtgaaggacatgattttgtcttttttatggctgcatagtattccatggtgtatatgtaccacatttttctttatcctgtccactattgatgggcattcaggctgattccatgtccttgctattgtgaatagtgctgcagtggccaggcgccatggcccatgccagtaatcccatcactttgagaggccgaggtgggcagatcacctgaggtagggagttcgagaccagcctgaccaacatggagaaacgccatctctactaaaaataaaaaattagccaggcgtggtggcacgtgcctgtaatcacagctactcgggaggctgaggcaggagaatctcttgaaccaggaggtggaggttgcggtgagccgagattgcaccattgcactccagcctgggcaacaagagcgaaactccgtctcaaaaaaaaaaaaaaaaaaaagtgccgctttgaacatgggtgcatgtgatagaataaattattttcctttgggtatatacccggtagcaggattactgggtcgaatagccaaagcaatcctaagcaaaaagaacaaagccagaggcatcacattgtccaacttcaaactatactgtaaggctacagtaatcaaaatagcatggtcctggtgcaaaaacagacacataaaccagtggaacagagtagagaacacagaaataaacccgcacacatagaaccatctgatctttgacaaaatcaacaaaagtaagcaagggggaaaggactccctgttcaataagtgctgggataggtggctagccatattcagaagaatgaaaccggacccttacctctcaccatatacaaaaattaagatgtaagacctcagactataaaaatcctagaaggccaggcgcggtggctcatgcctgtaatcccagcactttgggaggccgaggcaggcggatcacctgaggtcgagagttcgagacgagcctgaccaacatggagaaaccccatctctactaaaaatacagaattagccaggcgtggtggcgcatgcctataatcccagctacttgggaggctgaggcaggagaatcacttgaacctgagaggcggaggttgcagtgagccaagattgtgccattgcactccagcctgggcgacaagagtgaaactctgcctcaaaaaaaaagaaaaaaaatcctagaagaaaacctaggaaatgccctcctcgatacagggtttggcaaagaatttatggctaagtccccaaaagcaattgcaacaaaaccaaaaattgacaatttggacctaattaaacagcttctgcacagcaaaagaaactaccaacagagtaaatggacagcctacagaataggagaaaatcataagctacacatctgacaaaggtctaatatccagaatctacaaggaagttaaatcaataggcaaaaagcaaaatttccaattaaaaaatgggcaaaggacatgaacagatacttctcaaaagataacatacaagtggccaacaaacatgaaaaaatgctcatcatcactaatcatcagagaaatgcaaatcaaaaccacaaggagacaccgtctcatgccagtcagatggcaattattaaaaagtaaaaaaaaaaaaacatgttagtgaggctgcaaagaaaagaatgcttatatactgttggtgggaatgcaaactagtttggtcatgggagaaagcagtttcgagatttttttttggagagagagatttctttaatatttttatggtttctatttgggaatttaagttttcacccatccataatttatttggcgtaagaagtgaggtaaactttgttttcttagtgggcaacacttttctgtgaaggatcagatagtaaatatttttggcattgcattgcaggactgtctctgttgcaactaaactgaaagcagtcacggacaatttatgaatgaatgaatatagctgtgttccagtaaaactttatttaattaattttttttttgaaacaaggtcttgctgtgttgccctggctggctggagtgcagtggcgcgatcagagctcactgcagcctctgtctccctggctcaagggatcctcccacctcagcctcacacacagctaatttctttctttctttctttctttttttctttttccagtagagacgaggtctgactactgtgttacccaggctgggtctggaactcaagggttactcctgccttggccttccaaagtgttgggattacagatgtgagccactacatctggcctccactaaaactttatttaaggagactggatttggtccactggctatagtttgctgattcctaggccagatagttattgtaactattatttattgactaatttgttttccccttgttagtttgaaatataacctttggcttatactgaatttccaagtgtgtttttgtatgctgtagattctattctatttcactgatctgtctattcatgttttaattaatttacctttataatgttttaatatttgctagagttcctctcaactcattagttttttttttttttttttttagtgagagagagagagagagagagagagggtctggctttgtcgcccaggtgcagtggcgcgatcatggctcactgcatccttgacctcctggcctcaagtgattctcctgcctcagcctcccaagtagctggggatacaaacacgcaccaccacgcctaactactttttgtatttctttgtagagatgaggttttgccatgtcacccaggctggtcttgaactcccgggctcgagcgatccgcccacctcatcctcccaaagtgctgggattaggggcatgagccactgctcctggcttatcctttgttttttgtttttgtttgttttgagacagagtctcactctgttgccaggctgtagtgcagtggcgcaatctcggctcactgcaatctttgctccctgggttcatgagattctcctgcctcagcctcctgagtagctgggattacaggcacgcgttaccacacccagctaatttttgtatttttagtagagacggggtttcaccatgttggccaggctggtctccatctcctgatctcgtgatccgcctgccttggcctcccacagtgctgggattacaggcgtgagccactgcgcccagcctgtcctttgttttttaaaacaatgctacagtaacttttttgtacatgtgcaagtatgtgtatactttaaattcccagaagtagaactgtgggtcaaagggtatatagatttttagttttgtcagctattgccgaattctcctctataaggattattccatttttaactcctaccagcaatatgaaagtacctgttttccatacagtcttgctgtttgttttcaaacattggactgttgtaaatctgttagattaaaaatgttctatcaaatcttccttactagtgattattgtatagtacaatactatattatttaatagttatcataaataataattttaatataactccaaataatgtagatactccctcctctaggaggtagagcttaattaccctccttttgactgtgggctggtcttagagactcacctctaaagaatagagtatggaggccgggtgtggtggctcacgcctgtaatcccagcactttgggagggcgaggggggcggatcgtgaagtcaggagatcgagaccagcctggccaacatgatgaaaccccgtctctactaaaaatgcaaaaattagctgggggtggtggcaggtgcctgtaatcccagctacttgggaggctgaggcaggagaatcgcttgaacccgggtggaggttgcaatgagctgagatggcgccaccgcactccagcctggcaacaaagcgagactccatctcaaaaaaaaaaaatagagtatggagagagaaatagagaaattttacagggaagaaacctggcagacagcaccttaactaggtgatcatggttaacatcaccagagataagtcatgttgttatcatgtactcttctgtgatatgatcagaagggcatttcactatctcacttctgttgtatgcttctccaaaaaaaaaaaaaaatccataatcttaggtctaatcatgagaacacatcaaacaaaaccagttaaagggcattctacaaaatacctggccagtgctcttcaaaactgttaaggtcattaaaaacaaacaaggacagactgataaaccttcacaggccagaggagactgagggaacatgacaactacatgtaatgtaatatttaggattaaatcttggatcagaaaaaggatattaacgagaaaattggtggaatcctaatataatctgtagtttagttaattccttagttttgacaaatgtgccttagttttgttaatattaggggaagctgggtgaagggtatacagggattctttgaacttttctgcaaatgtaaaattatttcaaaataagaagtttgacttcatcaaaattagaaacttttgtttatttttgttggttttatagcgatgagttttcggtatgttgcccaggctggtctcaaactcttgggttcatgtgatccgcccgtcttggcctcccaaagtgctggaattacaggtgtgagcccaccacgcctggccacaattagaaacttttggaagtctctctgaacctattctggttcagggactgctggtaacaacaacaaaagattagaaacttttttttttgagacgtagtctcactctgctgcccaggctggagtgcagtggcgcgatctcggctcactgcaagctccgcctcccaggttcacgccattgtcctgcctcagcctcccaaatagctgggactacaggcgcctgccaccacgcctggctaatttttttttttttttttttttttttttgagacggagtctcactctgtcgcccaggctggagtgcagtggcgcgatctctgctcactgcaagctccacctcccggattcacgccattctcctgcctcagcctcctgagtagctgggactgcaggcgcccgccaccacgcccggctaattttttgtattttttagtagagacggggtttcaccgtgttagccaggattgtctcgatctcctgaccttgcgatctgcccacattggcctcccaaagtgctgggattacaggcgtgagtcactgtgcctggccgattagaaacttttatacttccaaagacactatcaagaaagtgaaaagacaacccacaatgggaaaacatatttgtaaataatatatctggtaagggattaacatccagaatatatgaactcttacaacaacaaaattatccaatttaaaaatgggcaaaggattcatgaccagcttgacttaacatggtgaaacccctgtctctactaaaaatacaaaacatcagccaggtgtggtggcaggcgcctgtaatcactgctactcgggaggctgaacctgggaggcagaggttgcagtgagctgagatcatgccactgccctccagcctgggtgacagagttgtactccatctcaaaaaaaaaaaaaaaaattggcaaaaggacttgaatagacatttctccaagaaagatatacaagtggccagtaagcacatgaaaagatgcaaaataacaagtgttggtgaggatgcggggaaattggaacccttgtgcaacactggtaggaatgtaaaatggtacagctgctgtggaaaacagtttggcggttccagaaaaagttaaacacaggattaccatatgatccagcaattccactcctagatatatacccaaaagaattgaaagcaataattcaaacagatacttggacaccaatattcatagcagcgttattcacaatgtccaaaataaccaaggggtggaaacaacccaagtgtgcacgaacagatgaatgaacaaaatatgcatactacaatagaagagtattattccaccataaaaaggaaggaaattctaacatactgccttgtggatgaaccttgaaaacatgccaggtgaaataagctagacacatagggacaaatatatgattccactactatgaagtacctagaataggcaaattcattgagacagaaagtagaatagaggctgtggggtggggtgagaattgtttaatgggtacaaaggttttgtttgggatgatgaaaaattcctggaaaaggtgatggttgcataacattgtcagtatacttaatgccactgaattagataattaagaatggttggctgggcgcggtggctcatacctgtaatcccagcactttgggaggccgagacgggcggatcacctgaggtagggagttcgagagcagcctgaccaacttggagaaaccctgtctctactaaaagtacaaaattagccgggagtggtggtgcatgtctgtaatcccagctactcgggaggctgaggcaggagaatcgcttgaacccgggaggcagaggttacagtgagccaagattgcgccattggactccagcctgggcaacaagagtgaaacttgtctcaaaagaaaaaaaaaaaaaaagaggctgggcgcggtggctcacacctgtaatcccagcactttgggaggctgaggcaggcggatcacctgaagtcagaagttcgagactggcctggccaacatggtgaaactccatctctactaaaaatacaaaaattagccaggcatggtggcacacacctgtagtcccagctactcgggaggttgaggcacaagaattgcttgaggcccggcccagtggctcacgcctgtaatcccagcattttgggagaccaaggtgggcagatcacgaggtcaggagttcgagaccagcctggccagcatagtgaaaccccgtctctactaaaaatacaaaaattatccgggcgtggctgcgtgcatctatagtcctaactactcgggagactgaggcaggagaatcgcttgaacccaggaggcggaggctgcagtgagccgagattgtgccactgcactccagcctgggtgacagagcgagactccatctcaaaatttaaaaaaaaaaggatggttaaatggtaaatgtatattttaccacaatacaaaatgatctagaaaaaatatacaaaaattaaaattttaagtttattttaggccatgtgcagtggctcccgtctgtaatctcagcactttgggaggctgaggcgacaggctcactttagtccaaaagttcaggatcaggctgggcaacatagtgaggtcctgtatctacaaaaaatttgaaaattagctggatgtggtggtgcattcctgtagtcccagctggttggggctgagatgggaagattgcttaagcccaggaggtggaggctacagtaagctatgattgcaccactgcactcagcctgggcaacagaccgagaccttgtctcaagtaaaataaaatttattttgaaacagtctatccaatgtagttttaattctcatctttctctctctcttttttttttttcttgagatggagtctcgctctgtcactcaggctggagcgcagtggtacaatcatagctcactgtaacctagaactcctaggctcaagcagtcctttcgcctcagcctcctgagtagctgggactatagatgtacaccaccatgcccaactaatatgttgtggtggtgatggtggttttgtaaagacgggatcttgctatgttgtccaggctggtcttggcctcgagcaatcctcccactttcaccccgcaaagtgctgggattacaggatgagccatctcacctagcaaaattttcttttttttttttttttgactgagtctcgctctgtcgcccaagctggagtgcagtggtgcgatctcggctcattgcaacctccgccttctgggttcaagcgattctcctgtctcgccctcccgagtagctgggactacaggtgcgtgtcaccacacccagctgattttttttatttttagtagagacggggtttcaccatgttagccaggatggtctctatctctggaccttgtgatccgcctacctcaccctcccaaagtgctgggattacaggtgtgagccaccgcgcccggcaaaattttcatctttcattatgagtgagatagagcatcttttcagatacacatcattgatatttttatctgtgaattctgtttacttcctttccccatattttttcctagtttattgtcttttgacttggttaatgatgttttttatttttctgtttttttctccaagcaaaagtattttatttttatgtagttgaatttagtaatcttttctgtggcttctggatttggattataggtttccccatttcaagattataaagaaattattcagttattctatattttcttttatgatttcatttcttttttttttttttttttaagacagagtcttactctgtcacccagactggcagtggctcaccgcagcctccgcctcccgggttcaagcgattctcctgcctcagcctcccaagtagctgagattacaggcgtatgccaccacacccagctaatttttgtatttttggtagagatggggtttcaccatgttggccaggctggtctcgaattcctgacctcaagtgatctgcccacctcggcctcccagggtgccacccacgcctggcctatggtttcatttcttatgtttaaatctttgatctatttcaaatatatcctggtatatatgtgaagtatagtcataatatcttgcacatgtctaggtatttaacctttttgatgaattgtacttgggacctttctattttctaaacagtggttacattaatttgtacccagcatccttactgatttattatttataacaagtttttcagttgattctcttaggctttgcaggtatactctcatatcatttacaaataatggtaattttaccttctcctttccagcttttaacctcttttcttccttccctgtttaattgctttagctagtgtctttagaataatgttaagaatgctgttgataacggacattctaatgttgttcccgaccagaattggaatcctgttagtatagtagcattcttctgtggcatctagttttttctattttaaataaacatatattggttgctcttagaatgcttttttagtcattatttgttcaaaataattgttgagcgcctactgagtgctagggaatatggcagtgagctaagggtcccctcatttcctggagcccatattctagtaattttttaactcaccaaagaaacacagattaggccatgcacagtggtggacgcctgtaatcccagcactttggaaggctgaggtgggtggatcacttaagcccaggaatttgagaccagcctggcaatgtggtgaaaccccatctctacaaaaaatacaaaaatgagctgggcgtggtggtgcgtgcctgtggtcccaactactcaggaggctgaggtgggaggatggcttgagcttgggaggttgaggctgcagtgagccctgataatgccactgccctccagcctgggcaacagtgccagatccattctcaaaaaaaaaagaaaagaaatgcagatgaaatcagctttgagatcattattttacagttattgcggtaggagaaattttaatgaaagagctgctagtgtcggcaaggtgacagtgaagcaggggcaggggacgtggtgcaagacagggaggaggagcctcacccccggggatcctgcaagccgaatgagaccttggtgagcattttggtatttgatcctgagactgagggggagccactaaagggagtgagatgggtttgagtggctttgccttagaaagcactcacatttgggatttgggatgtagagactgaactggggaggtccaggtagaagtgaggagaacagccaggccacaaccaaggtgccccatgagggaagccagtggcatggaccagagagtgacatagggatggagagaggcaggttgcacttcagagatgtggagcagggatttaggaatccctgtatgggggcgggcctgagggcttccaaagaatagagtagggggagggaaaaatagaaagtttacagggtgagaaacctggcagacactgccttaaccagatgaccatggttaacatcaccagagctaagtcatggtggtatcatgtacttctttctctgataggatcagaagggcacctcacttctgttgtatgctcctccaaaaaaaccaaaaccctacgagaacacatcacctgggcctcttgcaccttttagaaagggcaaccttctgatccctccccatccttcttcctccactagtggtggtcgtggtgacaggactggccgctatggagccactgaccgctcgcaggatgatggtggggagaaccgcagccgagaccacgactaccgggacatggactaccgttcatatcctcgcgagtatggcagccaggagggcaagcatgactatgacgactcatctgaggagcagagtgcggaggtgaggagggggcgcgctgcgccaggcctggctgggatgggctcccaagggccctctgtgtctggctgcagcaccgtgtgcaggcagctctccactcccgtgccttcagactgtgctcggtggctttgcctcacctggagggcctgttcccactcccctctctgagggctcctctcccaacctgggtctccctggcttccacatgcttggctctgtacttctgagggcccctggccaccactctttccctttctccctgttgttcagttcgggcccatggctcactgtgaaccctgtactgcccgctcccagccaacttgggcacttgaagagcctcttccatgggacccggcgtctggggttgggaggacaacaaggggactgcagaccaccaagctgaggagctctgggaggccagccatgggcattcccagtggtgatagagcccctagacagaagggaaggacccttctggagaagccagtgccatgttgggtagttcaccctagcctgcgggatgaggcgcgatgtttacaccatcagggagcccccacccgaggggaagaaacaggcttgccttaggggaatcccagttggaggggcagtcagggacctggtccatgcgagcaggcagctctcctgtccagcaggctgggaagggagttcttgcaagcccagccctggggggcagtctgtgagctgcccactgccctctggagggtccagggcaaaaacccctttggtggactgccaggcttctccagtggcagctgtcaagctgtgcccagacgtctccaggagcactgggccctggccagggtgggaatggagcaccaagttatctggtgcttccccactgtgggcgggagggctttggccccaggcctgctctgcttagtcctggaatggatggattgggcaacagcccagagcccaacagccataccgttttgagcgtggtgtgtggtggaggactggccaaggctgaggatcagggactgaggagggagtgtctgcagccctcacaccacctccaccagctcctgctgcctggctctggctgagatctgaagctgttcttatgcccccagcttggttgcagggtggaaccgtaggagacatgcagccttcggtggtacagtgaagcaattgagcacaccccctgagctggccagagaggagaggaaaatcaagggtggggtctggtgtgctgaccccaggccatcttgccccaaggaggtttaagctgtgtcttgtcagctacctttgggagttccccccacaccaatactgtcacctacctctccccacccactgaaggcagcccccaaaaggaccccatggagaatttacagtcccagaaagattgcaggccggggcctgcccaccctgcctgcctgagcctttagccggagcccgcacatccctggctttcagagcctgcctgcctcacagagccagcggccagctcctaggcctgcccagactgactgcccgtctggtgtcactcatctcattctgtcggccaggattcctacgaggcctccccgggctccgagactcagcgtaggcggcggcggcggcacaggcacagccccaccggcccgccaggcttcccccgagacggcgactatcgggaccaggactatcggaccgagcaaggggaggaggaggaggaggaggaggatgaggaggaggaggagaaggccagtaacatcgtcatgctgaggatgctgccacaggcagccactgaggatgacgtacgtgccccccatggccccgggcaggaggccaggctgggtctcctccagggccctcaacttctccccacccctccctcacctgcaacctcagcgcctttcatcccttctccccctccagctcctatcccccagcactgatccgtcctctgtgggcaggtcccatcggccccccggtctggagggaggagtgtcagagaggccggcttggccaagggacattggccatgggtgtctggtagtggtgggtatgggcgggagaagagcagtcctgcacattccactggtcatccagccattttgcatgtgtgcatcatgggccagacgctcaccgggccagtgctggctattgctggtagcagagatgacactggggccctgtaaccattgggggagggatgggattttctgaaatttccttctctttttcccccatccttttttgtcagcagcctggcctggcctcagagccttgggtggctgctaacagcctccacgcctgcctccctttcctcctgtttccttttcatacatacttctcatgacagccacactgaagccccacgaggcctaccagaataacctccaagaatagtgtcctgatcttggtccttcttagtctactccgccgcccctcaccccctacccccatgaattctctgatcagccctcctctgaaatctgctagctgctcattttgtaacagagaaaatcccacttgtgtatttgagggtttctaaggtctggcccacctgccctgttcagggtcagacagtagctggttgctgacatttgttgagaatgtatctcagggtgggccatgtgttaggtatgattcagtccccatggcagcccagcagggaaggtactctttgtattccatccttcggatgaggaaaccaagccctgagtgggaatgtgacttgccccaggtctcatagccagtgagtggcagagcagagctggagtctgaacccgggcagctggaccctagagcccactttttgctgcttcctcagccttccctgagtttggagtcctgataagctcttctgtgtgtttttccttttcaccctgtgtatgggtgtgtgtaaggctaatgtcctgtctgttgtttaacctggtggggaaactgaggcccagagacatgaagactccttcccaagaatggctggcataggctcctggtcctcagtgagagacctcactggcctagagaccctgcctcacctgggccaaatcctgaattgcctctgcagtttccctctggcctactccatctgggaagcaatccccaggactacatctttttgctttttgtctccaccctaagttattgctacagtcatggtctagggcacatggctgggatttgctcagactcctgtcctccccagtttgacatttatgtcatggatctcttttgacgcaagctgcaggtcagcagggcaggggcgggggtgcgggttatccccttgccaagggcaagaattgcatcccaggtttccttacttcgtggctgccagcgagccctttgtcagatcaccctgcccaccgttcttaagtggctggctcacttgctctcttgttctctgtgcccctgagggtcgtcctgctgccatgctttaccttgctctgtgcccatttcttcatttgattcactttctgcaagtctggggctgaaagtcaagactgtgaactggtgtgggcctggggctgttgtcactcagggaaaagctgcgaaagaggcggaggagactgtgtgcacatcaccgatgacccctcgggatccagaggcctccagccagcctcaggtacccagcggccccattgtgctgagcctgccctactctgtatctccccgtatagatccgtggccagctgcagtcgcacggcgtgcaagcacgggaggttcggctgatgcggaacaaatcttcaggtgagcttttgttctagtgccctccccttcaagtggccagcctcagcctccgaatctccctcctgcctctgccttctcccccactccctccaccaccttcctgccacagctgggaatgggcagcgtggggggtgccctctcttctctcccactccccacactctcctcacagctccagccaaaagcctcttcaatggggctgtcggggcaggggtgcagctctgagctgagctgggtgctccctggggtcagggccagggccaggctcccaggcacctcctctctgggactctgagtatctgagatggtaaccccctcccatacactcccttccctctcctttcttctccttcctctgcccctcactttcccccacattttttggtaacagcctctgaccagaaagtagctctgacgtggtggtcccacatgtgtgtcccaagggggaagcaggggatggctcttatccaaggacacatcccaaggaacagccaggacttcctggcctcgcctgttccctccctccctccctcttgcaggctgcttggagctggcctgaggttagcagggtggtggtggggggagttgtctctacaggacctctgcccaggctccccaaggcaggcacagtggggcctcactctgcctgggcttctctctccatctctcagtctctcctccccacacctccatctctctctctctctctctctctctctctctctctctctctctctttctccctctctctctttctctctctctgccccccccaactatattattcattccatcctcctatgcatcctaacggttattcttttgaacattaagcatgcccccccaagcccctctcatccaagccctccccatgtatctgcctctaaaggacatgctatcctgaggcctcaaccctgaatccctttcccaagcctggaatcttggttgcatgtaggtcttgctctgcatcaccccaactacaccacacacggacagcttctgggtctctctctccacaaggaggtgttccaggtgcggccttctcaatggccctgggcgcttctcccaggcacccattgattcttacctctaaggtcctcctggccaatcctggccaccattctccttttgtccaggggaacctggactgtttgtggctgtagtctccaccctgtggccctgaggtggctccctagcgaggcccgcctcccctgcgctgcggtgaggctgagatgaggtcgtgtctttaaccgcccctggtttccaatgggccaagagccttcctagcctcgcagagcagcctggcccagcttctcttttgctcctgtgattcaacacctgttacaggacccctcctgggcacccctggccttgagctgggcccgccctggagttacgtattgtggcttgtgtggagccagcagcctgcccaccatcccctccctccttctttggaggcagatctctcgtattctttccctcccagctgcttctctccgtctctgtcaccccaggctggctgggcaggtctgcccgagccccatctctctcttcccagttggtgtgtgtgtctctccccctaccgacctctggcctctgtttttctccctccaccttccctgccccacctggccatctaccttgccccccacgcccgctagtctttctctctctgattgcctctttctctttcttcctttttcctcttcccctttccctctctgccccccgtcctctcccctcgggtcccgcccccgggaacgccgtgtgtccaaagctgttgactaacccactgcgtctgtatctgaatgctgtctccaggtcagagccggggcttcgccttcgtcgagtttagtcacttgcaggacgctacacgatggatggaagccaatcaggttgctttgccgcacttgaacccccccccaaacaaatactactttgtaatcgagcgctccccatcgcctgattcttatggacacagttccctgccctgtggccctgtgtcccatccccccgccccctctctccccttcctgaccctcactatctcctcttcccatctctcgctaccccactgggcttctcatccagagcccacactcaccactggccccttcctaccaccaggcactagtgctgccccttcacctctcccagctgagcgttcagagaaagagctgccagggtgggttctttcacctagcttcccactcccccggggctggtggggggggcacccctctctggggttagccagagccaggacctcattccaccctcaggaccactggaagtcctgccagtgaggagcttagctattggcacagtcactagcaagactcattttgtcagccccatccctgcatgtgaatttggccctttgattttcatgcaaggggacagcactgctctgttgatctcaagttcccgtcgagtatgatagttttatcgacaccctggcctcacttcgccgcccctacccttcctatcacatctccacactcgcaggaggcaccacctcaggcagctctgtcttctcggcaaggacctgtgcacagtcagccctggggggagcctgtcccccaagcctggcacgggatcccaactcagcagctttgggacctccgagacccaaagatctgcctggtcacccacccctgcccagatccctggtgtagggcactggagagcagtttcaggggaggaaggggcagaggtggtagaatgggggatcccggcagaggcagccctggggccgtctcctcggggttggtaggctagtgccatgggcccaggacccagccatccatgggaagacggcctcatggcagaaacttccatctgttcgaaatggctctttctttttccccttctccagcactagcgcacctgcgctctctttctctttttctcccctctccctccccctccctgtctcccctcaccccccaagtgtagcctgtgtagtcctggccctgggtgtggcctggcagtgtcagggccgagtgggggtttctccccactgtccggcaagcgtcggtcagccgaacactgtgtgcctggtggtgtgtgttcacatgtgtgcgtgcgtgtgcccggcagagcagcaaacagctgcgcccgagagctgtggcgctttccctccctacctcccttcttccctccatccgctctccgacctccctccgttccctgtccctcatccatccagctgaagggctcgctcactctcttctcctatgctgaaacggtgcgtggggcactgctgcctggacctcactgtgctctgctttttcccgcagcactccctcaacatcctgggccagaaggtgtcgatgcactacagtgaccccaagcccaagatcaatgaggactggctgtgcaataaggtacaggggcggtgggcagcagttgtcatggacagagacagcaacagcagtggcggcgatctctcccttcctctcccgctctttctccctccatctctccccctcccccaatctctcctctccctctgtctctctctctctctctctctctctctctcattctctatcccttgctagctcagcttgagtagtcaccattcctagccagccatatacaaatgtgtagtgagcgttcacttggtgcaggctctgtcctcctaaaatgcagtcttgcctggagttccagtagactttaaggaaatatatacgtggatgatgaattagtgacagtgtagacttgaagtggtggtgtggagaatgtgggcttcagagccagactggctgaaatgagactatcccagatcggccttgattttggccaaggtgcttagcctctctttgcctcactttccccatctctaaaatgtgaatattaatgacacctctcccaaaaggtggttgggaggattcagctgtgttaatgagagagtaacactcagaacagtgcctggcccacatttaacacagtcgaattgttaactgtaatcatgaaagaaaagcacagagcgttctgagagcccatagcaggtagctcaagcctgaaggccactctgaccaggccaagtcaaacctgaaactggaggctgtggttttgtagtcacctctgtcttccctgaggggaagctgaggctcagagaggtggaaccatgggtgaacctttagctgtgccctgtgccttgctcctgatcacagggacttggatgccacagtggcttcaggtctgccctggggccagcattgtgattccacagtttgtagaggccccaaccctctccccaggaagtactctgcctagtcagggagagtggtgcatctgttttaaaaaaaaaagtcccatcagaggattggtgcttaacatttctggagagataaagacaaagtgacagtggaactccttcctgtgtttccagatagcctcaaaaccagggaattctcttttttttttttttgagacaggatctggctctgtcgcccaggctggagtgcagcaatctgggctcactgcaacctctgtctccagcgctcaagccatcagcctccagagtagctgggaccacaggcgcatgccaccacacccactaatttttgcctttttatttttattttttttggtagagacagggtttcgtcatgtttgccaggctggtcttgaactcctgagctcaagcagtcctcacgcctcagcctcccaaagtgctgggattacaggcgtgagccaccacgcccagcccaaaaccagggaattctcttgaactccttcccctcccctgcatcctgttggccaccaggtcctgtcacttccatcacagaaacgccaccttccctccctcgccattcccgctgctcatgccaatcgtcacgctctcacccactcactgtggagccctctctggtatgctggcctcttgtcctctttctcccacgccctcacctggaacattcctcaaaaccacctctgactacccacgcctctcctcctctgcttaaccagccccagctcagcttaagcataagatcctccattacctaactggcttccttccccggccttggcttttgcttctccccttactctcccacaccagtttcggaaagtccattgttccctccgataacaatccctccccagcaaggcttaacaaaatgaaacttctgggcatcccaggtcaaacctccctgcttctgtgcagggactgtccctgccgagtaaatggcaccccacccccagcccatttccctccccgagcccctgctggatggtccatgcagaccgacctgcccctcttcatgctgcatctgcccctgtgctattaggccatgagggcagagaccatgttctggccatgtgcagcagggcctggcccaggagtggtgcttagtacctgagtctggaacagagatggagtgtggtagaagctgggtctccagatgctggaacattcaaggaaaatttctcaagcgtagcaggatccaacccagtcctagagctaagaggaggggtgcgggtctggctactgacttctagggctgaaacactgaaaggtttctgaatagaggagcaagtttcagggagaggaacctaataaagggattgaatacctgaggcggggaacagtcctgggagttggtggccttaagaaggcagaggaaggagaggagggagttgttgtaccaaatgggggagttgtttattcctgagctgagtgggttggcacagaggacaaatgagagtctggaaagggaagatgcacagtactgagaacaacatcagaaggttcagaaggcacctgccaccattgcctaggggctttccttcctggggcactgcggggtccctgggagatctcttcatccaagtttggagggtgcagtgggaaatccctgctccctctgacggcctggcctgtgcctcacagtgtggcgtccagaacttcaaacgccgagagaagtgcttcaaatgtggcgtgcccaagtcaggtgaggcccacctacctctcgtgctctccagggcggagcggttggggagaagggaagggtgaggggtctgtgctcagggcttggtatagggaggagggtgaccagtcgtggagccttccccttatcaccagcctgtctcccactgcccctgacagaggcagagcagaagctgcccctcggcacgaggctggatcagcagacactgccactgggtggccgggagctgagccagggcctgcttcccctgccgcagccctaccaggcccagggagtcctggcctcccaagccctgtcacagggctcggagccaagctcagagaacgccaatgacagtgagtcagttgttccttcttcctctgtgccctagggtgtcgggctgggctcaccaagaccagagaaatggcagtgagcaggacctcatcctcatggaatctccacttggtgcggggatagacatttgatgtagggagaacagggggagtggcaacatcccacctgactttgggggtgtgtcgggaaggttctcagcagacaggcagccaggctggcacctggaccgccaagcagagttgatcctggaggaagcagtgagggaagcggcagttgcaaaggcacggagtgagtgggggcagaggaaagggagcagtgggggcattgaagggcagggctggcaagagtgccaggggtgtcctctaacattgggccccttcccacagccatcattttgcgcaacctgaacccacacagcaccatggattccatcctgggggccctggcaccctacgcggtgctgtcctcctccaacgtgcgcgtcataaaggacaagcagacccaactgaaccgcggctttgccttcatccagctctccaccatcgtggtgagggcggcacagttgggggccgggcagccagggtcccggcccccggggtggagacgagggtccttttccccagcctcccaccgcggctgccagcctggaaatcgggcaatggagccgggggcctccccgggcctgacccttctgtccctgcctcccctcctcccacaggaggcagcccagctgctgcagatcctgcaggccctgcacccaccactcactatcgacggcaagaccatcaatgttgagtttgccaagggttctaagaggtcagggccccacctgtgtgccttcccacccttcccctccccaccctcccactcccccctaccgcttggggcctcctatctcactcccagtctctaacatcctcctcagggacatggcctccaatgaaggcagtcgcatcagtgctgcctctgtggccagcactgccattgctgcggcccagtgggccatctcacaggtactcagaccccttgtgcctcccagcgtcctgagacctgggctttctcaaccctcctgcaccctctctgaagcaggaaggctggcttgctatccatggatgcaaaaccctctcccagtagctggcatggctattctaccttgctcctggctctctagaccccctgggacattccccttcatcatcaccgcagctttcttcccaattgcctcccatgcgctcatgtacgacgccattgtgcctggcattctgtgctgtttggtggggtttttattgtcctgaataggtatgatatacacatatccttatatgtaatatatacatatatgatatacacgtatcatatgttcctgaataaaaataacgtataagtggttgagagaaaattgggagaagagaataaagaagtaagaagatggtgtcttccttggcctgacacccaacacacacgccacacacagcagaatcagcagaatcagccctggaacattttggcgttcatctgtttttctgtcttgtgtttgccactggcctatttgttctcttgtggccaggcaaccctcgctttccacttgtcttaaggctgcatgctttgtctgtcaggtagaaatactagccccacgtgtgggacagatgcttctagcaggttccccaccccccacccccacaccttcctgttctaatgaacccctcccacctgcccttcaggcctcccaaggtggggagggtacctgggccacctccgaggagccgccggtcgactacagctactaccaacaggatgagggctatggcaacagccagggcacagagtcttccctctatgcccatggctacctcaagggcaccaagggccctggcatcactggaaccaaaggggatcccactggagcaggtgagccccagcatctctctctgcagctgtggtgggggccagcaggcataaagtccccggccccattattcacaggcattgtccctgccctgtccctccttacaggtcccgaggcctccctagagcctggggccgactctgtgtcgatgcaggctttctctcgcgcccagcctggtgctgctcctggcatctaccaacaatcagccgaggcgagcagtagccagggcactgctgccaacagccaggtgagtgagccctgtgggtatgtatcccggggaggcaggcaggcggcaggggtggcatgggcagacactgagccctgttctcctgtctggccccatgaccagtcgtataccatcatgtcacccgctgtgctcaaatctgagctccagagccctacccatcctagttctgctctcccaccggctaccagccccactgcccaggaatcctacagccagtaccgtgagtagccacagcctgtgggtaggggtggggagttcttaataaagcagggaatagtgtgaccccgttcccctcaccccctagctgttcccgacgtctctacctaccagtacgatgagacctccggctactactatgacccccagaccggcctctactatgaccccaactcccaggtaatagggcagcccagggagggatgggatcgggtcaggtcgcgtcaggaacagctagccctgcaggttcccttcacaaggtcttccctcacatcccctcttccctcctcctccctcagtattactacaatgctcagagccagcagtacctgtactgggatggggagaggcggacctatgttcccgccctggagcagtcggccgacggacataaggagacaggggcaccctcgaaggagggcaaagagaagaaggagaagcacaagaccaagacagctcaacaggtgaacaccagggtccagcagtcactggctggctgtgtggtgtcttccagcaacggcactctgtcagctcttgccctctcctgccaagggagatggcgggcaggtgtggatgtgggcagtgactgcttagcagaccatgctcttgccccagctctgctctttgctgaatggccttgagccagagcagtctcctcagtgtgtggcagggttgcccaactccaggaggtggcttgtgccatccgagtgagccctgtcaggtgtcttctgtcccatggtggggaccctcacattctgctggtgaatatacatgtatgccagagaaattctcacaggccataagggggtgggcaggaaaaaagccctgcaatgttttgtgggagtgggcagatggagggcacctcagtgtctctctgtggagaaagggtgtgacactgtgagcgtagcgtttacaagcaagcactaagtgttaccttagcaacctgatgaattctaaaaatggtgctgtgctggggggaacatggaaatatagaatgtggcattgtgtcatgcatataaagttatacacaaataaacattcctatgcatttttaaatgataaaatggaaatgcacaacaaatgtgacagcgtgggtgtatgtcaggggaagaggagtgtcttcatccatttgctgctccataacaataccacagactgggtaatttataaggaaaagagattgatttggctcacagttctgtaggcagggaagcccagtggtgttggcatctggtgagggccttcttgccgcatcataacatggcaaagggcaagagagcatgcatgagagcaagagaaaattgggccaaactccccctttttatctggaacccactcagtgatggcattaaatggagactcaaaaggtggaggggggccgggagccgtggctcatgcctgtaatcccagcagtttgggaggctggggtgggcagatcacctgaggtcaggagtttgagaccagcctggccaacatggcgaaaccccgtctctactaaaaatacaaaaattagccaggcgtggtggcaggcgcctgtaatcccggctactcaggaagctgaggcaggagaatcacttgaacccaggaggcggaggttgcagtgagctgagatcgtgccattgcactccagcctgggcaacaagaacgagactccttctcaaaatatatatatattatatatatataaaggtggaggagatgggagggggtgaaggatgaaaaattacttaatgggtatgatgtacattatttggctgatggatgctctaagaaccctgacttcagcactatacaatctgtgcatgtaacaaaagcacttgtttattttatttatttatttattatttttttgagatggagtttcgctcttatcatccaggctggagtgcagtggtgcaatctcggatcactgcagcctccacctcctgggttcaagcaattctcctccctcagcctcccgagtagctgggattacaggcatccgccaccatgcccagctaatttttttgtaattttagtagagacgggttttcgccatgttggccaggctggtctcaaactcctgacctcaggtgatgtgtctgtctcggcctcccaaagtgctgggattataggcatgagctaccgcgcctggctacaaaagcacttgttaccccataaacttatacaatttctttaaaaagcagccgcgatctcttgaggagggcagagcctttgtgacctaatcacctctgaaaggccctgcctgtcaacactgttgcatcagggattaaatttatcttttgagatggagtttcactcttgttgcctgggctggagtgcaatggtgcaatctcagcacactgcagcctccgcctcccgggttcaaggaattctcctgcctcagccttccaagtagctgggattacaggcatccaccaccacgcccagctaattttgtatttttttagtagagctggggtttcactgtgttagccaggctggtctcaaactcctgacctcaagtgatccacccgccttggcctcccaaagtgctgggattacaggtgtgagccactgcactcagccgggataaaggctccacctgtgaacactgttgcattagggattacatttctgacacatgaactttgagggacaaaaaacatagcagagaacacagccagagaggggcttggcaagaagcactggtgactggtgacagaaaataggaacttgcactactgtgtccctcaccttctgattgttctgcctcagcttccactcatctgcctcccagatgggcccgccactctgtccacactgcttctgccacctcaccattgcaaaccagtgggggtgggggcacagggtgtgttcagtgatgaggtcaggagtagccaggtgccaagtgccttgcaggctgtggttgcgagtttgggtttattcttggtgtgatgggaggcgaaggaagggttttaaggacattgtatttgggggtgggagtggcttatacttcatgaaagagcgctctgctgggaaaggtggtcaggagccgtagcccagaggccagatgaagccttctgcagtggttcggactagggatagtggctggcccgtgtttgaggatgcagggcagtgggtcagcagatagagttagtagccccagggtcatgagggttctgggaacctcacctccaccctcacccccagattgccaaggacatggaacgctgggcccgcagtctcaacaaacaaaaagaaaa

SEQ ID NO: 208 - DNA, 39884 bp, mus musculus; identical to SEQ ID NO: 207

SEQ ID NO: 209 - DNA, 39884 bp, mus musculus; identical to SEQ ID NO: 207

SEQ ID NO: 210 - DNA, 39884 bp, mus musculus; identical to SEQ ID NO: 207

SEQ ID NO: 211 - DNA, 18497 bp, mus musculus
tgccttgtccccctactcgttcccgctcccacggcatggagcaggacactgccgcagtggcagccaccgtggcagccgcggatgcgaccgccactatcgtggtcatagaggacgagcagcccgggccgtccacctctcaggaggagggagcggccgccgcggccaccgaagccaccgcggccacggagaagggcgagaagaagaaggaggtaaataggaagggggtgtgtgtgtggtggacaaatcctgtgcctggcccctctgaggggcccaaaccctgacctttcggcgccgacaggtacccgcggagctttgcggggctaggggcggcgggtgcgggggtcggcggcggaaccgcctggcgttcgctcccctccccctttccttctcgccgcctggaggacgggggcggggctgggcgcgggcgggagcggcgcggggtggaggggtgcccgctctcccggggcctgggggctcgggagcccctcgacagcccccgaccccctccaccttcccggaactcgggtaacggggtgggggatggggctgtgcaggaaaaagcctccgcctctccctctcctctcgctcgctccctctccccccgccttcccgtcggcctctgcctgggaaatctgggcccttcaatcccacactcgcgctaaaggggttttgctggggctttttttgtaatttgaatttcaaggtgctggtggttgctgggtggagggtgacagggaagacatttctttctttcattggcaatgtcggtcttttggatggcaggaaaaaaaccatcccttgttcgtttgaaccccgcctgccgaggtgggggtgtcaccccgaggaaaggagctctctgcgtcgtacccccccgcccccccaaactgaggaaccgtggacgctggcttaggaaaatttccaacatctgcaccctcaccctcttctgccccgcccccgacggtatagggtttcactccagggccaccccaatggtccctcaatccggccccaagctttccaggcttccgcctccctctcctagtgggcgctgctggctcctggacacacacaggttttttttttttttctcctttaatttttaaaaaactcagcgtcgccaagatgagctgcttctaacgtaagggaactgctctgacacatattaaagccaatccagaaaatatgtattatctccataaggcacatttcgtgtggcccgagacatgcaaataaaactataaaacgttgaaaaattgacataaaaataggatggggcataagcatttttgatgtatgataaaattgcataactaatggtttatgtgtggattttttcctatttacgagtagtcatatcgcaattttaaaaaggtgggtaattatgctttagagatctcaagtggctttgtctgaatcattatatgatactatacgaccaaatgaaaagcttttgaggaaaatgaacacctttcgccttaaatgagaagagtaattttaaatttagcagttgcttctgtgacatattttactattacaaggttgactaaacagaaggacaattgtagtgctaaatgaaaaccgtagaaaacatacacattgtaagatctacgcggtacttggattagtaagacaatattgttggttaaaagtgggtgtaataccaagcatcaatataaatcaaatgttgtgaaattcggaaatgtctgtgtgccttttattccctggactgggcaaatgtgagtgccaaactgccttttgtatggcaggagaggttgtcgaatttccagattgtataaatttttgaattttgtataaaattttgtattgtgaaaaaacgggagaccaataaaaaagctatataatataaacactgagttgatgcctacatatttgtcaactcttgcctcattagaaattgccctaccagtacttcatttgtccacccaggacagggaaatgaggtgctgtatgtcaggaacttcctggatatccatttttatttttaatttttccttaaaaaatgaaatacattacatactaccttgacactttaaattgcatactaaaagtgcagattaacctcttcttcatggccatcagttagtgtactttgacagtgacacaaaggcacctgaaatcccgcaggttgttccctctcaattaagtaaccacctaccagactcttgcagtgttgtgttgatttttaaaaataatttttccagccgggcgcggtggctcgcgcctgtaatcctagcactttgggaggccgaggcgggtagatcacttgaggtcaggagttcgaaaccagcctggccaatatggtgaaaccccgtctctactaaaaataccaaaaaaaaaaaattagccaagtgtggtggcaggcacctgtaatcccagctacttgggaggctgaggcaggagaatcgcttgaacccggaaggctcaggttgcagtgagccgagatcccaccactgcactccaacctgagcaacagagtgagactccgtctcaaaataaataaataaataaaaattttctgtcttcttccttaattgccaggctgttagcgatcactttttaaacacctctagtttcaccagaaataatatgttagtttatgataaagattataggtgtaacaaaaccataaactcatttgaaaaccactgtaaaatacaaaagtgtcagtgataaaacagggagagggaaataatgacacgtgcacaccaagaatcagtgatgctactgcagtggaagacattttcgtccttggtttctgccgtgtcttcttgtagagtgccttcatctagtgatctttccatgtcatttactgttgcttgtattctcggtgacatgggaagccagattttcaaacttggtggaattgtctaccaaataaaaagaaaataggtttctgaatgagagcgctttcatgatgaatacagtagatgagaattagtgaattgacctgtgacatttacctactcaaaggtgtttttgcttactttctggttgttgaatttagttggtttaagtgacggttggattacccaacactgtagacatgaaaacgtcaagaaaaaggtcatggtctttaaaacaagccattttgttgaccttgtgctgcattctcatggcacctagactcagataacaaaatccaaaggaattcattagagtctcttagtcacttttcatcttttcttgtatgaaaaaaatgtagttttgagaatacacacacacacacacacacacacacacacacacgagagaaggtttagaaggtaggtattttaaaatttgttgtggaagatagtgccaattaagtaattacccacagcttttaatagccctgctcaagattaggattttaattagcatataattagattttgatggtagtctaccgcaaggtaagcaaaaaagtaatgggtaaaatgtttttctaggattaaagctttaattttctgtaagtgtacttcccacattattatatatatttgtgcgtatgaggcaaagtaattttcattgttttgatactggaaaactgcacttcatataacctttcaaggaatgaatgataaacgtatggatttgatacccaatttttcttgttgctttgaaaataaatatgatttatattatatatggcagtctgaaagtgtgagtttgaggggctctttagcagttttctattctcatccatccaggattacattcaaaacattccatatagatgtgtacgtatcagatgctgtaaatcaagatggttattatttgggttagtgtaactgaatgatatctgatcagtgctacaaagtaagagtctggacaaggtcaaattccataatctcagtttggatttcctcaaaatagaaattttagtaaatattggaagacataatgggggccatatttttcttatgtttaaggtcacattctgttgatttttgacctaagttttcataaataggttgacaaaagccatgatagttttcacgaacaaatttgtgttttctcttatgcaaagtatgtgttaaaactgaaatgctctcatctttggttctggtgggtagatttgtgtttttattattttatttcttggtttcttatagggaaggaggcttattctatatatgtatttatatttgccagtacaggcttgtctttacaaaggatagggtgcatgagataacccccttccccagataatctctatattaagttattgattgatgttagttttcgctaaattacaatttaaaaatatcaaacattaatagttaagtagccttgacaaattgcttctacaagatgtttatgcaatataaatagtttaaagtagttttcttcccagttagagaaaattaacataagccaaaagtttaaaactgtactattatattaagtatatgtgatcacattgcattacataaaaaattaaatattcttataatactatgaaaacaattttaaaaatatcgttttaggaacagaaaccacagtttttttttctgaaagtgtggcgtatttccatgacataaaggagtgtttcttagaattaatatttactttctttgaattatttggtttgtggttgatattagccttttctagattttaaaatctcttatttaatgtttacacattttcttacactataaattaaagaatggatgagaaagctcagtgtcttgccttttgggttttattccaattaatatttctttggcattcacaatttttcagattttttttattggacctcaggtgtacagaactggattaatcataagccttgttttgtgacatgctctcatcattggtccatacatgtcccacattgatttatatatttagttatgtaattactttccgccttcttctaatgagagcattgaccagtttaagaaccttgctttgcaatttggtgacatttattttctttgaaattctagaaaaacgtttcttcatttcaactcaaacttgctgctaaagcgcctaaatctgaaaaggaaatggacccagaatatgaagagaaaatggtaaatgtagtcttggataggatagtgaatgctgtaattaatttttatagttgagatgttaaagatgaaaaaatacatgtatatatataatgcatagagaatcattgattttagaattggaaaataatttaatatacaatctatcacaatattttctgttgaataaattaacctcctcattttcagatgaggaaataaaggatcagggaagctatatgtcatagttaggactagaagtcacatctcattttggttcggtgctctctgtcccataataaagtgctttaagctagaaatatttatttatgaggtgaaaatatcagtggtaataccactgtggctttgtgacctgagagaaatccagtcacaaagccagattgacgtatttttgtttctttctccttctttggacatatgaataaatgctacacattaatgaaatgtgtaatatgtcaatacactttaaagggaagaatatttgtccaatgcatgaagatatcacatatttaagcagcataatcttagttatacttacatattgcttgctataatacatttaattatttaatttttagttactaaaatacatattttagctttaattttaactaaactcttataaccttggatctttcaagaatttaacaggtggttgaaatggatttttttttcctctgaggggttgtttttgcagtaatattataaaaataagtatagatgaaatatattttttggttgttgatagctattttataagacttaatgtttaaggccacatctaatgtaggtaggcaatgttttaacaactctaaaaataacattccagtgaggataatataaaatggaaagtttttggcctccttccagcttgtagtctgaatttatctaactcttatgtttatgttaatgaactcttctgtaagttttctgggttattaattatgcatccttcattagcaatcaagtattctctactctgtggttggaaagtgactttgaataaataaatagtctttattttttcctttatctagaatgatgtatatatcttttgatcttttaagatttttttagtgaaacaaagttttattgcctgtatatggtacacgttccctgaccttttacaatttattgagaaattagaatacatatcaacttttaatagttaataaactatttcacatatatgtgcatatgtttatatatttttcccaaattctgcttactttggggagaaagtttatacgctactagcacaaaatacagttttctagatccctgtgagtgaagagaggagtgtttattacattactataccatgacactgaaaatattttgagacaagatgatactgtattttaagatttaagttatttctggatacaacttggaaattcttaagagttcagtttatggtatatatatcatagttaatttatatttcaatatttgggatatgttatatatttgatgcttaattttgttactattttatttaataaaatgatgttttggaaagaggatttgctttatgattatgactctttaagaagggtatttcttattggggaatttactgtctgtcagataatttttcttcccttcaaactatttgaaaatacattttcaaattctgctgcttattagctgtgcaaggttgggcaaattacttaccctctctgtgcttcagtatcatgtagttacaatggagatgatacttgtaattacgtcataggtttcttaagagaattgaatggattaatgtttcaagtgctaagaatgttgttcaaagtaagtatttgttaaataactttgaaggaatgaaaaggaaagtccttacttttcttttgttttgcaaattagaaagccgaccgagcaaagagatttgaatttttactgaagcagacagaactttttgcacatttcattcagccttcagcacagaaatctccaacatctccactgaacatgaaattgggacgtccccgaataaagaaagatgaaaagcagagcttaatttctgctggagagtatgttggcacctctctctctactttctttcctttctcctaccttttcttcctcctgtcctcccttgatcccttcatgcaccccttcgctcttcattgttcagtataccttcatgtgacaaaaaatattgccattataattatgttttgaagacaactatatttttttctcactagaggctgatcagtaaaaatgtaggctggttctactgatttctaagcaagaccttggacaactcattctttttctataaaagataatagccatgtacactgatttaattgataccttatcatttaggtcgaatatgaagggatttccttttttaatttcagctaccgccataggcgcacagagcaagaagaagatgaagagctactgtctgagagtcggaaaacatctaatgtgtgtattagatttgaggtgtcaccttcatgtaagtacttcatcacattggtgagttctttttcaatttagttttagaaaaattttacttgagtatgttaatgaaagtatgaaatgtccttgcattttttcaccagatgtgaaaggggggccactgagagattatcagattcgaggactgaattggttgatctctttatatgaaaatggagtcaatggcattttggctgatgaaatggtaaggaattggtagctaaaaacacattctcagttatcaatgatttttatgtaaatttgaaaaacctgagcttacctgcccccctgatgcctggaggctttttaaaagttgttatcatgtaaaaggtattttgtagtcttagaattattattatttttttgagagaggatctctttgtgtttccaggcttgagtgcagtggtgcaatctcggctcactgtaccctcgacttcctgggttcaagcgatcctcctgcctcagcctcctgagtagctgcgactccaggcacgtgcccaccacactgggctaatttttatttttatttttagtagagacaggtctcgccacgtcacccacactgattttgaactcctgggctcaagcagtcctcccacctcgacctcccgaagtgttgggattacaggtgtgagccacagcacccagctagaattgtttcgttaagtcaccgctagaacacagactttcacaggccataaaactcttactgagctttcctcaaatggtccaaaaaccttctctgtacttttgtttttgtttgcattttggcttccaggaagcacagagtcaagatggatgcccaaatgatgcctttatgtaactttttttttaaaattttttgagatggagtctcgctctgtcacccagactggagtgcagtggcacgatctcagctcactgccacctccacctcccaggttcaagcaattctctgtctcagtctcctgaatagctggggttacaggcgcctgccaccacgtccggctaatttttttgtatttttagtagagatggggtttcaccgttttggccaggctggtcttgaactcctgaccttgtgatccacctgcttcggcctcccagagtgctgggattacaggtgtgagccacccccaccctggccttatgtaacctttaatggtctgccctgtgtgtccttctgtcttttcctattctttatctacttgtctttcttactttccttgtcgtctctttatttctattttgccattaatttatgttccatgttttcattgtaggctacctgaaatccttttgggaataaggtggggtatacaaaccaaacaatatgtaaatgactgcctgaatatatgcatgtgtgaatgattatcaatattttgacttgtgaacaatcaaaaagtgcataggtggaataaggaacgaataaagagtaatgttgaatcttgatacagtacagtgcatggtggggctttggaaatcagtgaaggagttataaatgtgtaaataaaataactgaacaggaaaaagtaaggcatataagatgctaattcatcagctaaagggggaatacatgaaggcttttttttttttgagacggagtctcgctctgtcgcccaggctggagtgcagtggcatgatctcggctcactgcaatctcctccttctgggttcatgccattctcctgcctcagcctcccgagtagctgggactacaggcgcccgccaccgcgcccagctaattttttgtatttttttagtagagacggggtttcacgatggtctcgatctcctgacctcgtgatcctcccgccttggcctcccaaagtgctgggattacaggcgtgagccactgtgcctggccccatatttgtattttaagaccaaattaataaaatgcgatttaagagagggcagggaaagttctaaatccatataactcaatgatactcatatttatgtgactctgaaaccatacttgtaatcactattatccagaagagccacatgatgatacgtgccctatggcgtctagtatagttggtagtcagtcgcataagtactcatccctggttgagcaactgttaggtgtgtggcagaggatcccttaaagcaagggtctgtagctccttatatttaggtattctagtttgaagactgttgtcagctcagagggggaggagcttggttaattggacaatggaaggaccaggattatttgccccaagcagctcttggcttcagcctgtctaaacatgaaggatctgatctttagtgatgaatttgtgctgatatcagatatatgtattatatatataatatataatatataaatatatataatatatacttactttttttaatatatatatataatttttttttgagatggagttttgctcttgttgtccaggctggagtgcaatggcgtgatcattgcttactgcaacctccacctcccgggttcaagcggttctcctcccccagcctcccaggtagctgggattacaggcgcccaccaccacgcctggctaattttgtatttttagtagagatggggtttcaccatgttggtcaggctgttctcaaactcctgacttcaggtgatccatctgcctcggtctcccaaagtgctgggattacaggtgtgagccactgcacccagccgataccagatatgttttaattactaaaaaatagacacttttaaggagtatagaaaatttggaaaaaaatgaataattaaaattaagttataattctgctacttagaagtaaccacagctaacattttggcatatttcattttagtctttttcttctggatgtacttattttgtatagttgaaatcatattgtatatataatttggcattctgatttatttacattcatacatatgttccatgtaattaagacattttccgaacataattaattattgcataataatccttgggcggtaccataattttattcaacttctctcttattgctgttcatttggattgcccgatgtgtagtgtaaataatgccactataagactcttgtaatttagtttttgtgcacctctcagattatttccgtaggattcctagaagtagaattactgggttaaggagtataaacattttaaggttttgatgtatagtattcataaaagttgtctcattaagtgacatatcagataggatacaataaaaaaatagctttaagcagacatttataaaaagaagtatatatcttgctcagagataaaaccgaaagcagttttaagaggccgaaaaaggacttagttccctttcttatgggttaggtatgggttcatagatattgaatatattattttttaaaaagtcctctggagttggtgatctctctcaggttctttctggctgcaaagttctgttttgtggttcctaaggttcttaagagtgtgagatgcaagtacagagccacaagccccttgagacacatagtctgaatatttaatatctgggctgtaataatgttaggaacaataggaaagaaagaccagtatctaagcaggctggcaaaggaagcgggtctttataaaacaaacacacagaaaattcctaacttcagaacaagaagaaaaattatatagtagattgcttgctcctttaggaggaaaatgttctaaatagaaagttgctttgttgagcaacattctgactgcaagttattggtttctgtttgtgctcacggtaagtacaatactgaattggaatgatttggttatcttctttaaaaaaaggtatttggtatttttacttttcattggtagaaacataattgcctttgcgagatagtggacaaagatcttttgttatgttgttcctaacaaaatgtttccttacagaaaaaatgttcatggatttttttccttgtgatgataatgcagggccttgggaaaactttacaaacaattgctttgcttggttacctgaaacactaccgaaatattcctggacctcacatggttttagttccaaagtctactttacacaactggatgaatgaatttaaacgatgggtcccatctctccgtgtcatttgttttgtcggagacaaggatgccagagtaagtgagaaacaagtgtaaaaaggcagttaagaataatatcatttctggagtttagttacatattattgctgttaaaaacatctgagttgactactactaaataagacttaaggtgtatgtactctaagctagactctgttttaagtgctttgcatctattaatttaattctcacaacactcccatgaggtagatatatcacctattaataatagacaatccattattatgcttcatctacatttgctttagttcattaacctaagcatttttgaattgtactttgagtgacttttcattaaaaacatcttattttattgacagtatatcttaccagtgactctcatttgtgctattttgaagccaacaatatataaatttgcattacttaaaattttatatttaagtttttgacttttgacttggtgtacacacacgcatatgcatgtacacaactggaacctcttctatatgtacagagagcctcgtgttttgtgtttatgcatagacgcagctttcagttttggtgtttgaatagaaaaatacatgtctgtatatattctcaggtaatattagaaactgggcattttaggggggtgtttaaatcagccatttgtcagtctagtaggctacaatcattttaggactgtagaattaatctaaaaataatatattatgtaaaaatactaaaacagataatctgcttagaaagcttattattaaactttgtctttatttgcctccagagaacacagtttagagatgtattcagttttccatatttagataggttatctaaagatatcctcaaaagaatggtagtgcaatgaattacataattttatccttatcattttgcttgaagaaaaattacttaaatttatttaaatttaacttacaaataatttaaatattgaaatactgagctcataagtttacaattacaggccagattcttccctatgcctaatatttccctaaagcaaattagtcacttagaactctttctggtcaccattgttatctaatgtaataccactccatataaactttgcatttctaaagtattgagcttttgctaaaattatttcttaaagattaaaagcaaaagataaatatctaggtttgtgttttcataatgtctcggtatatttaatttatgactgccctatctctacttcctggggaggctgggattctggtggcttgaaaaatttctttgtttctttttccagaggcggggtctcgctctgtcgcccaggctggaatgcagtgatgtgatcatagctcactgcagccttgaactcctgggctcaagcgatcctctcacctcgggttcctgagttgctgggactacaagtgtgcaccactgtgcctggctttgaaaaatttcttaatcttgaaaaccggtcttcaaagttagtgtttttcaaattgtgagttgctacccattagtgggttgtgactttagcttagtacttggtaaaacaattttctgcaacattgagagagaatggaatagcaaattgcagagtgtttcatactataataaggataaatattgctttgagaaacttttaagttgcctctttctgtgtacacacactcaaacatatatgtatatactggattgcaattcaaaaggtaattttactgtgggctatggtcaaaagagtttgaaaaccaataattgccagttacataaataataagtgtaccatgttcagcacttagagattgatgtggatatgtatagaggaagtccagatcattacatatagacagatttgaatcttggtagaacataggatagatatgttgggtctttgtattttcctggtcttctgtaaacattttatgaaggtaatattttagtaataaaaatttgatgtaggttataataggcatttaattgagttgggagattattagagatactcttgatcctgtctgattgataccaatgtgctttgtggccccttccttttccacgccagaggtatcaaagatagtagacatagaaatgggtttgatttcagttgtggctttgctactgattgtgtagggttgagtgagtcttcaagggccttaattttttcacctctaaaatgagagcttttggattatgtgacacctttaatgttttatcgagatgtttaactctaaatgtatccaatagttacaaaaaattcaaagcagagctaatttaaattaaaaatatgcatttgttgcatgaaacttgtaggcgaaaccatgaaactgagagcttcacaaaatcaaataaggataaggtgttagcacgactgaatggggtctggcactctacttctctttattttgtctcctattccctaatgtcttaattaaatttataaatgtgatcacttcccagggtgcaactgagatctctgaaaaggcctttttttttctgtcctcctcttcagtccaggtgattctcttatacatagtagacaatcagtaaatatctgttgaatgagtctgcagtgtgtttagtgcatagttgtgaattatgaaataaagactttgcagggaacagttaattttgtttatgcactgtaactccagatttataaaacttttttttttttttttgagacggactctcactctgtcgcaaaggcttgagtgcagtggtgacatcttagctcactgcagcctccccgcctcctgggttcaagcgattctcctgcctcagcctcccaagtagctgggattacaggtgtgagccaccatgcccagctaatttttgtattttttagtagagatggggtttcaccatgttggccaggctgttcttgaactcctgacctcgtgatccatctgccttggcctcccaaagtgctgacattacaggcgtgagccaccatgcccagctagatttataatactaatcagcctcttcttaatatagattttgctgcttcccattaacttttgtggttttattttgactgataacatctggaattcagctcatacaagttaaaaatgctctcagtcaacttacctaccatgttggccactgcctgtgaagacttaaaaatagttttaaatagtctcattgttttccatagcctcctgtactagacagagcaagtcccctttatgaaatcatatttgtaacctcatggcaagatctggaacttcacaaaaacattagtgggcttccatgaccttttaacaaagtatatgagtcagcccagctagaaaatgaagaagggacatacaagagttctccaaaggttggaatcattcatgcacattgagttctatttgttgaaactgtatcatgttggtaactcttggatcttggcaagaatatgttgttcagaaagagttactttgtctatgttcttttggatgccccatgatatgaagacaagcccagtaactttgtgatttctggtcatacgaacttttctaggtcattgaatatgccatatttctgtaagggaagcctttgtttctcttctgttaatgaatatattagcaggtcatccagataattgaccacacaactatctttgggcctcagttttcccatctctaaaatggatgaaactaaatgatcctcagggtctcttagaattcttaatattttcttgatattttaattctgtgatcatcttataacatattctaatataaatatattctaatatgaagtattttattttgcattaggctgcttttattcgtgatgaaatgatgccaggagagtgggatgtttgcgttacttcttatgagatggtaattaaagaaaaatctgtattcaaaaagtttcactggcgatacctggtcattgatgaagctcacagaataaagaatgaaaaatctaaggtaagttatcaatatctttattaaagtttacatttaattaccaggttggtttgttcacttttctgtattcagaataaaaaatgatggaacagccggtgtggtggctcacgcctgtaatcccagcactttgggaggccgaggagggcggatcacaagatcaagagattgagaccattctgaccaacatggtgaaaccccgtctctactaaaaatacaaaaattatcagggtgtggtggtgcatgcctgtagtcccagctacttgggaggctgaggcaggagaatagcttgaacccgggaggcggaggttgcagtgagccgagatcgcacccctgcacttcagcctggcaaaagagtgagactccgtctcaagaaaaaagatggaacattgtgattttattcatggaatgtgaatgcaaatctaaattattgaatacaagacacattaaaattgagcacagtttttaatgtaaagaaaattaagtgttcctttggtatacctcctgtgcctaactgttatgctgtagtattttaatattgttgagaatatttagtgtgcaaatatcgtttgtattgatttattttttattgaggggctaccttatatatatttatatggatgagagaaaataatttcctggaattatctgacttgtgtgaattagagtgtggtgttaacactgaaaaatatcaatatttcttgccattcaactccatcaacagtaggaaaagcttcaattatgatgaacctctctttggatcactgggctaatttgggagaaacagggacagaactggagcaaaaccaccaggtggattatactaatttcaaattggaactaatatctgataagaggacacatgctagagaataattttttatttaagagcattataaaaatgtgcatttttgttcatatgattaccattcttttgtgctttttgtgtcttaatttttctggtcttatgtttagaaagttaatataagttactgggaaaatcggctcaattctggggcttaaaaattgtgaccaggccaagttagaacgtgtctgggcatgtagatgaatgtggttggtggggagatggagattttattgtgtaaaatggctaacctggattccatggagaagttctgacctttttctgtgagcccaaaatggagaaatgaaaattttgaagttggggggagggtctcaggtataaatatgatctgcattcttcttcctttttttttttttttttttttttttgagacggagtttcactccgttgcccagggtggagtgcagtggtgtgatctcagctcactgcaacttccgcctcctggattgaaatgattctcctgcctcagcctcctgagtagctggaattaaaggcgtgcaccaccacgcccagctaatttttttttgtatttttagtagagatggggtttcaccatgttggcaagtctgtctcaaaccccagacctgaggtgatccacctgccttggccacccaaagtgctgggattacaggcatgagccactgcgcctggcttgcattcttttaagtatagaaatgtttagttttgcctcactgcagcattgtcacctgaactagggtatttttccatagaaaattttcaagttatattgtagtcaaaaatatattggttggataaattacagtataactgaatgttgagcattctaataagtaaaataatcctcatatgagtattattttctagctttcagagattgttcgtgagttcaagtcgactaaccgcttgctcctaactggaacacctttgcagaataacctgcatgaactgtgggccttactcaactttttattgcctgatgtctttaattctgcagatgtaagtttaagccatacgttttaagtataactttcttattttcactgacatgtgttttaaaacattatagattgaaatttatggtactttttaatttgtaattttttatctgcatgttttggttttcttaggaaagagttctttaatagagttttaaaatgaggatctttggagaaatagtatgcttcttgtctttgagatcaacttgcctgttcaattttgtctctatcacattactcctaaaacttatgatgtgaggctgagtccatagtagtgcattcaccattttattttcattaagttgaaggggtttgaaacatatttttatatactagtttggcaggtggaagctataaaatgatctttgattattgtaggcattgacatttggtgagtgctaaagagctcagagtatgtgatttgaaagacagcatattgtgtaaatgtgttatttatatatatatatttttatcattaacacaaatttatgctaggacaccaaactaaatggaaagatttaagaactttggtgcttgatttttcccattattattattattactattttgagagggagtctcactctgtcccccaggctggagtacagtggcacaatctcagctctctgcaacctccgcctcccgggttaaagtgattctccttcctcagcctccccagtagctgggattacaggtgcccgtcaccacacctggctaattttttgtatttttagtagagacagggttttgccatgttggtcaggctggtctcgaactcctgacctcaagtggtctgcccacctcagcctcccaaagtgctgggattacaggtgtgagccaccgtacctggccccattatgactgttaattgataataaaaagtagcaagtttggccataagttgctttgcacactttatcttgcttttgtttgttttattgtttggtaaaattaacattcttattagcattatgtctttgattttatattctacttttcaaactagatataatattgctacagtatggggaagcctaataaatgtcttttaaggaaaaagttgatggaattcttacacagtggggctcaaattttgttaactgctccagtattttacctattttcagaagtaaataatagtagctatcacagctgataatatttttgaaagt

SEQ ID NO: 212 - DNA, 525 bp, mus musculus
tcttcgcccttccttccctcccttttcttcttggtgtcggcgggaggcaggcccggggccctcttcccgagcaccgcgcctgggtgccagggcacgctcggcgggatgttgttgggagggaaggactggacttggggcctgttggaagcccctctccgactccgagaggccctagcgcctatcgaaatgagagaccagcgaggagagggttctctttcggcgccgagccccgccggggtgagctggggatgggcgagggccggcggcaggtactagagccgggcgggaagggccgaaatcggcgctaagtgacggcgatggcttattccccctttcctaaacatcatctcccagcgggatccgggcctgtcgtgtgggtagttgtggaggagcggggggcgcttcagccgggccgcctcctgcagcgccaagagggcttcaggtctcctttggcttctcttttccggtctagcattgggacttcggagagctccactgttctgggcgagggctgtgaagaaagag

SEQ ID NO: 213 - DNA, 546 bp, mus musculus
tgagagaccagcgaggagagggttctctttcggcgccgagccccgccggggtgagctggggatgggcgagggccggcggcaggtactagagccgggcgggaagggccgaaatcggcgctaagtgacggcgatggcttattccccctttcctaaacatcatctcccagcgggatccgggcctgtcgtgtgggtagttgtggaggagcggggggcgcttcagccgggccgcctcctgcagcgccaagagggcttcaggtctcctttggcttctcttttccggtctagcattgggacttcggagagctccactgttctgggcgagggctgtgaagaaagagtagtaagaagcggtagtcggcaccaaatcacaatggcaactgatttttagtggcttctctttgtggatttcggaggagattttagatccaaaagtttcaggaagaccctaacatggcccagcagtgcattgaagaagttgatcatcgtgaatattcgcgtccccctttttgttaaacggggtaaattcaggaatgcacatgcttcagc

SEQ ID NO: 214 - DNA, 4996 bp, mus musculus
ctgagatgcctgcccctgctctcccctcagctggagtgggccatgaagctctggtggccacacagtgaagccatgattgccttcctcatgggttacagtgacagtggggaccctgtgctgctgcgcctcttctaccaagtggctgagtacaccttccgccaggtgagagctgcctccttgtcccctctagaggctgaatgggggaatggggggagtctggcccggctgcgctcttgccccctcgctgagcacagtcgctcagctggtctgagagtttccggagccccagtgctgttcgttcagtcaacgaagaagcctctgccctcctagagctcgaattttggtggtgggggcgggaggagcagagtgtaagcaagcagacctaggtggtggtgagagtgacagctgtgggaataataccactggagagggttgtgggggggctctttcctatggggtggcagcagggaagcactgagcaggggccgagtcaatcaggggtgtgtctgagggactgggagtctgggcagggtggggcatgtggcacagcaggggggcctggcagcccgggaggataaaggcagagtgggcaagggacggactccagctgcctggtctgattccattgttacctgggtcctggggcttggaggggagggtgttatgggggaagtctgtagggaacagggcagaagctgggacagcagaggaagctgtagctgtcatcccagccagtgagggctggcccaggtgggagctggtggggacagagggttcacagtctggtggagcagcagtgggattcctgagtctccagttcagacggagagatctggactcaccatgaatgttttcagtatcacaagaatgtagatgctgcctggcacagtggctcatgtctataatcctagcactttggcaggctgagacgggaggatcgcttgaaccgaggacttcaaaaccagtctgggcaacataacgagacctggtctctacaaaaaattttaaaaaattagctgggtgtcatgcacacctgtagtcctagctactcaggaggctgaggcaggaggactgcttaagcccagtttgaggctgcaatgagttatgatcacaccactgcactccagcctgggctgggcaacagagcgagactatgtctcaaaaaaaaaaggccgggcacggtggctcacgcctgtaatcccagcactttgggagactgaggcaggtggatcacctgaggtcaggagttcaagaccagcctggccaacatggtgaaaccccatctctactaaaaatacaaaaattagccaagcgtggtggtgggtgcctgtaatcccagctacttgggaggcagaggcaggagaatcgcttgaacccaggaggcagaggttgcagtgagccgagatcgcaccattgcactccagcctgggggacaagagcaagacttggtctcaaaaaaaaaaaaaacaaaaaaaaaaaaacagtacagatgctgctgagatctatgaggcaaaaagggaaatgggggcccagcaaaggagacaagaatcagtggtgacgcaggaagaaaaccaagccaggggctccctgaagcccaagtgctaggagcagagtgataagctgtcttgactgctgcccaggaggcaactcgagctgctgaacacaggaaagggcatggcacccagtggaaagggcatggcacccagtggaaagggcatggcacccagtggtggcaaggcctgggtggtgaatgaatgaagattcatcatgcgtttctaaagccacgactccgactccactggtgaaccctggtactgcgaggactatagcaggggatcttattctggggtctgtgagcttcgaaaccgggggcggagaatcacatctttatttgtactaacctctaactgaaactagcatttgctgccattatgagtggaggcaatgaaccacattggtaatagaagtgcctggctttgtcaccgatagaaatccagatgtgtttacattgcattgcagttagagagacatctgcaagtatcacatatattcgtcactacttccaaagcagcagggttgttagacctgcagctatatcttaatatttaatgcattcatagagtgtgtgttaggggccaccagttctaactcaaaaatgaaattgaaggaatacattttaataagatatagatgacattaaacaattacaaaagttataatcaacaggtaaatcggctgggcatggtggctcatgcctgtaatctcagcactttgggagactgaggcgggtggatcacctgaggtcaggagttctggaccagcctggtcaacatggcgaaaccccgtctctactaaaaatacaaaaattgggctggtcgcggtggctcacgcctgccattccagcactttgaaaggccgaggcaggtggatcacttgaggtcaggagttcgagaacagcctggctgacatggtgaaacccccatctctattaaaaatacaaaaaattagccgggtgtggtggcgggtgcctgtaatcccaactactggggagactgaggcaggagaatcacttgaacccgggaagcactccagcctgggcaacaggagcaaaactccattaaaaaaaataaaaaataaaaaaaataaataaataaattagccgggcttggtggcgggtgcctgtaatcccagctactcaggaggctgaagcaggagaatcactggaacctgggaggtgaaggttgcagtgagctgggatcacgccactgcactccatccagtctgggtgacaagagcgaaactccgtcttaaaaaaacaaaaaccaaaaaactaaccaacaaacaaaaaaacaggtaagtcattatgcatcaaccaacataacagaatacagaaggcaaaaatccagacattgaaggaaattcttctttaccttcctgtgtcatgtcaagcagtcaaaaaataagtaaggacttgaacaatgtaactcaaaagacagaatgaatacacacagaactagtttttatttatttatttatttatttatttatttatttatttatttatttttgagacagggtctctatcgcccaggctgagtgcagtggcacaatcatggctcagtgcagcctcaacctcctgggctcaagcgatccttccacctcagccacccaggtagctgggactacagctgtgtgccatcacgcccagctaattctttaattttttttttgtatagatggggtctcactatgtttcccagcctggtcttaaactcctggcctcaagtgatcctcccgcctcggcctctcaaagtgctgggattataggcgtgagccactgtgcccagcccaggactagttttacttcctacaaagaagaatacaccaactcttatgggccaccatttaaagagacattttcatagtggacttcaatgtaattgagtccatgatccttttgagaaggggctgaactgacaagcctccctgagacaggtgccccatggaatgctagtggagagagaaggaaagagagtggaatgggcactgggcaggggcagagggaggaggagatgagtttgggaccaatggtgagccaggacaggagtcagatgagattgtgcatctactggaagacaggcctgtgaagccgggaatgggagctccaagggagtcacttcttaagagtttcatgacaggtcgtcgcctccatcagggttctttgtttcttttcttttcctttttttttttttttttttgagacggagtctggctctgttgcccaggctggagtgcagtggcgcgatcttggctcactgcaagctccgcctcccgggttcacgccattctcctgcctcagcctcccgagtagctgggactacaggtgcccgccaccactcccggctaattttttgtattttagtagagacgggatttcactgtgttagccaggatggtctcgatctcctgaccttgtgatccgcccgcctcggcctcccaaagtgctgggattacaggtgtgagcctttgcacccggccgggttctttgtttctttgaatcaacgtaaccacgactacaatcacaatagagaacttttttgtttgtttgtttgttcgtttgtttgtttgtttgagatggagtctcgctctgtcacccaggctggagcgcaatggcgtgatctcagctcactgcaacctccgcctcctgtgttcaagctattctcccgcctcagcctcccgagtatactgctgggattacaagtgcgtgccaccacgtccggctaattttgtatttttagtagagatgaggtttcaccatgttgtccaggctgatcttgaactcctgacctcaggtgatccgcccgcctcggcctccgaaagtgctgggattacaggcgcaagccacagctcccggcccgatagacaacgtttctacaccccagggcagagttctttcattccatctagcagtgtctcatccccttgcccagtcggttatatagttgtagcctgcctgctgcgcccacccctgctttcatctttgtggaggacgcagtgtcgcggttaagatcgctggttctggagccacgtcacctggggtcaacccaggctctgacccctggtagcgatgcagtggcatctgggcgggtcctgcaggcgctagctgtcactgtctctgttattccagtttcgcgatcccgagtacggggaatggtttggctacctgagccgagagggcaaggtggccctctccatcaagggaggtcctttcaaaggtgagtgggggagagggcggggccgcaggggttgcgcctctcggctgcccccggccctcactacctgcccgcctctacccgcaggctgcttccacgtgccgcggtgcctagccatgtgcgaggagatgctgggcgccctgctgagccgccccgcccccgccccctcccccgcccccacccccgcctgccgaggcgcggaataaaggctgagtccgctccac

SEQ ID NO: 215 - DNA, 892 bp, mus musculus
tccagggggttaccccacccgctcttctgcctccctgcaaaacccaaagcccgttagttgggaaggggaggaacctctctcttcaggtatggctgatgcaccacggccttcgtgggggccgtttgttgttgcctctgcctagtagccttgcttagtctctagggcagaaagcctgctgctgtccacgacagctttgtggcatcctttttcttggtggctacttggcccgttttgtgcccctagcacaagggtcagttcccaagttgcctactgactgcccgttggcccacaggaccctggccttgcccagaaggcagggtcagggtgagttcggtcccaggcaagagctggaagagtctgggtgagggaaaagccccctgcaggcggctgggggagggccttgggatgccctagtcctgagtggcaggcacggctcccagcactaaccccttgctccgcggccgttctctcctgggggctctagcgatcccctggcctcggtggtggccctgcagacaaaccctcgctgagtgggctttgtgtcctgagcggtgagaggctgctgttctttggctgagctccagtgcctcgatgctctgggggtgggaagctggagctgcctggagggagaaagttggtttagggagttgggaaggctggagctgggctcttgggtgccgcttccttccccaccccccaaggcagaaagtgctggtttctccacatctcggagattatcgccacctaccacgttgactttgaaaggctggtgggttgtctgtgaccgtttttcgttccaggtctctcagcacctgttgcctccagggagcagggcctttctcagcagcccccgggcgggggcgcttggtggttggtggtgccccgcgccagc

SEQ ID NO: 216 - DNA, 196 bp, mus musculus
tgcgaaccgctacgcgcccccgcccgctgcgccccggctggccggcgcccaggctgaactcacatcctccgcaggccgcgcctccgcggctgtgctcgcggtgggagtgggcctggggggtcgggcactgggcaggctcctggccctgcgccccgtccccgaggaggaggaggcccgggctctccccccacagctg

SEQ ID NO: 217 - DNA, 151 bp, mus musculus
actcccgaggcctccggctgctctgctccacgcgggcctgcagaacaaaggcgcgcgggctggctggctggccggccgggcgtgcgaaccgctacgcgcccccgcccgctgcgccccggctggccggcgcccaggctgaactcacatcctc

SEQ ID NO: 218 - DNA, 885 bp, mus musculus
cgcagcgcgcgcagcctgcggagccagcggccgtgacgcgacaacgattcggctgtgacgcgacaacgattcggctgtgacgcgagcgcggccgctcccgatgcgctcgtgccgcccccgccgtgctcctcggcagccgttgctcggccggttttggtaggcccgggccgccgccaggcctccgcctgagcccgcacccgccatggacaactacgcagatctttcggataccgagctgaccaccttgctgcgccggtacaacatcccgcacgggcctgtagtaggtacgcggcggcgggcgggaccccttccgggccccctcctcgtgctccgcctcgcgacctccccgctgccctccccgcgcgccttccccggcccgcggccctgaccgccccgtgtccggccaggatcaactcgtaggctttacgagaagaagatcttcgagtacgagacccagaggcggcggctctcgccccccagctcgtccgccgcctcctcttatagcttctctggtgagagcctcgcctgtggggacagcctgggacgcggggaggatggggtcgcgagggtgtggcaggggggccggtcgagagcggcactggagaaaggggagggaagtctgggggggcaaacagttctgtctcctcctttcaatccagacttgaattcgactagaggggatgcagatatgtatgatcttcccaagaaagaggacgctttactctaccagagcaagggtaaggcaggggttgggtgggcacgctggcaccttcacccgacttcgtcagggaccccgctcacagggaggacctgagacctcagtcccaaccactccagcagccttaggagggagaaactgttacaggtcccgaaatgggattcaga

SEQ ID NO: 219 - DNA, 8013 bp, mus musculus
gttgcaccgggccggggtgccagcgcccgccttcccgtttcctcccgttccgcagcgcgcccacggcctgtgaccccggcgaccgctccccagtgacgagagagcggggccgggcgctgctccggcctgacctgcgaagggacctcggtccagtcccctgttgcgccgcgccccctgtccgtccgtgcgcgggccagtcaggggccagtgtctcgagcggtcgaggtcgcagacctagaggcgccccacaggccggcccggggcgctgggagcgccggccgcgggccgggtggggatgcctctgcacgtgaagtggccgttccccgcggtgccgccgctcacctggaccctggccagcagcgtcgtcatgggcttggtgggcacctacagctgcttctggaccagtgagtgggcccaggccgaggcaggcccgcccgggtacccatgcccggccggaggtgggacttagggtgggggacgccgcggccccgacctagcgggcgagcccggagcgcctgacctctccttccccgccagagtacatgaaccacctgaccgtgcacaacagggaggtgctgtacgagctcatcgagaagcgaggcccggccacgcccctcatcaccgtgtccaatcaccagtcctgcatggacgaccctcatctctggggtacccgggccagtgtgctgggcagggggaggaaaggcgaggattcgggacgggcccagcctcgtcagaacaaaccccttctcgctgccttttcatggagccctggcactccggtttccgggcgttctgccccagggctgagacttggatttgtggctcctgcagcatccctgagggagcatgatttggagagggccttgggcatggagcaggaccaaggaacggccacagggcatatcttacagctcctttaacgtcaggcctccagaaccctctgttctctaaaccatccagggccccacagtcttgggaaaaatttgggggttggacataggatatcctgtgaggaagttctgggccagggactggaagcccagtgtcctggcttcaggtttgcccctggctgggcgtgtaccgttcagccctatttgggagcctggttgccacacctagaggttcctgctctgctgacttcacaggaagttgcttggctctggtaaccagatggccgggtggaggggtgcctggggcttccactcctgaacagagagcttaactgtcctagagttcatggggagccacctagccacactggagcccttcagagctcaccctggctgctgggtggagaaaggcctatagatgtcacaggtggatcctgggaggccaggaaggaggacttggagccatccactagcctagactgggctggttgcagtgacagtacagggagaagtatagaagaatgggcattgtccaagtatgttggggaggtaggcagtccaggtgcagtgattagtaagatgtggagggtgggggagagggaggagccagggagaactgaatgatctggcctaagggtctgaaagatgccactttgggctgtagggaaatggtagtgctgctgtccctcattccctgagatggggtgaaggaagggcactccctggggatatgggaagttggggcatgaagcctttcctgtcctctagggatcctgaaactccgccacatctggaacctgaagttgatgcgttggtgaggaggaatgggcccctcgaagtgggccgggccggccccacctgcctctgcccagatttgccctcctcctgctctgcccaggaggtggcgtccagcagtccaggcagggcatggggtggggccccgcaggccctcccctgtgcctcccttctgcatgctgatgctgggggcagggtggtggagcggggtgcagggggcaggactaattgcatctgtccctgcttaggacccctgcagctgcagacatctgcttcaccaaggagctacactcccacttcttcagcttgggcaagtgtgtgcctgtgtgccgaggtgagctgctcctccagcgagtgcagggaggcacttctggggcaggaaagctggtggccagtgtctctgttttggagggacctatgggggtaggcatcccgggagccaacatgaggcccagctccatcacatgccagcagaggggacagaggctgtgggaggagggatgggtccttggaaagtcctcaactctctgcaactgcccagggatcctgtggacctggagccttggcattagaattcaaggaggcattatccataaccccttctctcagggatgtcactaagagactcattgagaacagtgcgttgtcattggtccatggtggcagtagcatgtacctgcaggccagagggttttgcttctaggagaacaaacaggcttgtggggtgagaaccccaggggataggggccattttgatccctattctccagacagggaggatcacagagattaagctgctggcccaaggtcatggggtaggaggtggcaaagccaggatttgaatccagattgctccttcctctgcaggagcagaatttttccaagcagagaatgaggggaaaggtgttctagacacaggcaggcacatgccaggtgctggaaaaagaagagagaaaggtaagccaggcatagcggttcacacttgtcatcccagcactttgtgaggtcgaggtgagaggatcactcaagcccaggagtttgagaccagcctgggcaacatagtaagaccctgtctctttaaaaataaaaatattttaaacaaaagaaaggtagaaaatatgagttgtatgtagaatatgaaggttctagaataatcctattaagaattttggattctggctgggcgcggtggctcacgcctgtaatcccagcactttgggaggctgaggccagcggatcacgaggtcaggagatcgagaccatcctggctaacacggtgaaaccccgtctctactaaaaatacaaaaaattagctgggcatggtagtgggcgcctgtagtcccagctactcgggaggctgaggcaggagaatggcgtgaacccggaaggtggagcttgcagtgagccaagatcacgccactgcactccagcctgggtgacagagtgagactccgtctcaaaaaaaaaaaaaaaaagtgccggccatggtggctcatgcctgtaatcccagcactctgggaggccgaggcgggcggatcacgaggtcaggaattcgagaccagcctaaccaacatggtgaaaccccgtctctactaaaaatacaaaaattagccgggcgtggtggtgtgtgcctgtaatctcagctacttgggagactgagacgggagcattgcttgaacccgggaggtggaggttgtggtgagctgagatcctgccattgcactccagcctgggcaataagagcgaaactccgtctgaaaaaaaaaaaaaaaaaaaagaattttgaattagctggctgcattggtgcatgcctacagtcccagctcctcaggaggctgaggtgggaggatcacttgagccctcgattttctttttccttgagacaatgtctgtttctgttgtccaggctggagtgccgtggcgtgatgatggctcactgcagcttctgtttcctgggttcaagggatcctgtcacctcagcctcctgagcagctgggactaaggagtgtgcccagctaattcttttttttttttggtagagttggggtcttactacattgccagggctggtcttgaactcctagactcaagcgatcctcccgcctcagcctctcaagtgctgggatcacaggcatgagccattgtgcccaacccagcccaggaatttgaggccagcctgagcaatatagtgagaccccaggtatagatagataggtagatagataggtaggtaggtaggtagatagatagatacgtaggtgggtaggtaggtgggtagataggtaggtaggtacgtaggtagatagatagatagatacatacatacatagatagataagatagatagattgattagatagattagatagccaggtggggtggctcacgcctgtaatcccagtgctttgggaggctgaggtgggtggatcacctgaggtcaggagtttgagaccagcctggctaatgtggcgaaaccctgtctactaaaaatacaaaaattagctggatgtggtggcgcacgcctgtaatctcagctactcgggaggctggggtgggagaatcgcttgaacccaggaggtggaggttgcagtgagctgagatcatgccactgcactccagcctgggccacagagggagacctggtctcaaaaaaaaaaaaaaaaaaaaaaaaaagatttttgtatttgactgtgctctctcatccaggtggtgacatgcttgtatctgtggttaagaggtagtatctgccgggcgcggtggctcatgcctgtaatcccagtactttgcgaggccgaggcgggtggttcacctgaggtcaggagtttgagaccagcctgaccaacatggcgaaaccccgtctctactaaaaatataaaaattagccgaggctgggcgcggtggctcacgcctgtaatcccagcactttgggaggccgaggcgggtggatcacgaggtcaggagatcgagaccatcctggctaacaggatgaaaccccgtctctactaaaaacacaaaattagctgggcatggtggcaggtgcctgtagtcccagctactcgggaggctgaggcaggagaatggcacaaacccgggaggcggagcttgaggcaggagaatggcgtgaacccgggaggcagagcttgctatgagcagagatcgcgccactgcactccagcctgggtgacagagcgagactccgtctcaaaaaaaaaaaaaagagagagataccattccagttgcaatgtggctgcagcagggctaggtggacatgaggagcccagttcagggctgtcacagtagctccagcagcagatgattgtggctgggcctcccaagtgtcacgttggagaaccggagaaggggacttctttgggatgtactctggacttgttgatagattaagtgtaggtggggtgaggaagagaactcaaagatgacaccaggtgttggagctgagccacggggagaagggtgcaaagggaaagcagtgcgggggctgggaggggagagggtcagtcctgttttgcttgtgctgcatctgaggagcccctcacctgtggaaggagagcagtcccagaggcagtggggtgtgcagttctggaacttagaagaatgatcagggggctgggtgcagtggctcacgcctgtaatcccagcactttgggaggccgaggcgggcggatcaagaggtcaggagattgagaccatcctggctaacatggtgaaaccccatctctactaaaaatataaaaaattagcagcgcatggtggcaggcacctgtagtcccagctattcaggaggctgaggcaggagagtggcgtgaacccgggagacggagcttgcagtgagctgagattgcgccactgcactccagcctgggcgacagagcgagactccgtctcaaaaaaaaaaaaaacaaaaaattatcaggaataaagatactgggaattcaaccacaaaaaccacaaagtcacgaatgcagagtgagagtcttcagagagagggcagaggcccaggatggcacagagggagagagaagccaccaagatggcagggagccatggccagagagaaaagcaaaccaggcgcctgtggcaccatggaagcagcaggtgatgctggagaagcgtttccatgcagtgacagctgccagagccagattattatggcctgagggctggtggtgctgcagttgggggggaatggagaccgcagcgggggaatggagaccgcaggggcggcaactcctcccagaggttcagtttggaggaaaaagagacagaaggaagggtaaccaaaggatattagaggtcaaggaggggtttattatttctagctggtcaaagtagaatgtggtaaaacccaataaagtaacagcaaataacaaagaggggcttttaatggaaagctgcagtgcctgcccctcacctccctagccccactcctcagaagcagccccctggagcggtttctctttctgctgcttttggaggctacttctgtctctgtaaaggaacttctgtctctgtaaaggaacaagcagaggccacagtgtcttggcaaatgaccgtggcattgtttatcccaacctgctctgagagatggggactctgctgattcacccctcgtccctgcctctttagttccttcagcaaagaactaataatatgtcattaaggcaaaggcagtatttggcacacttggcttctgtgttccaaaaaattccctttttctccaagcgtagattttaatatggtatttaagtatcaaagtgatttgacacaagtgacacaagtgagcagtagtagcatttgcaaaagctacaaatgatgaagtcttgctccaaaagcatattattattattttttaaattccagtttcaagctcaatggataggttgcgtcagtgggttttagtagagaaggggccagtacctatgaagactcccctgtactattacacatgctgcgtcccaagtagggaaactccagtgggtcatcaccccctccctctagcccaagtgggctgctgggtcagggcactgtttgggttgggttgagattcctggatccctaactagcaccttccaaagaatcggccttgcagagaacaaagttcattgccaaaggtattcccaatgtctgtctctcgctctgtgatagggcttctttactccccactttataagatgaggatatctgctataccccattccttcaacctctccacctctttcctcttttgtctgccatgtgattacttttccatcaccaaggttgatgagatccttactgtgtacttactgtctccaagcatccccaggcttccagccagcacgcagcagccaacattggcttcagaaggaaggaggtttgcatttccttctcttgggtccagtgccatggtctcagggttatctccaatgtggaaagttgctagaccaggagcagtttgactccactgtttttcagtctagcaagtttgagtttttcccaagctcttgatgtgtgttcaaatgaatgttctccctttcccaagagacctccctataagggagggtctagtttcccggggtgccctgagaagaaggggtcagcaggggggaggaatggtggaggctgaggcctcaggcaggtgccctgtgaggagtggctgtgacaagcggctgagatcccagcaaagggttgttgcccagaatctggggcctaagcgaggttggaaatcacaaatgcacttggtttctctagcagctggcacatagtaggatcagcccaggagtggcaccttcaaagagaaaggaacgcatgaggctccgagagcggtcggctggcagccagggcctggctggggagggagggcaggtggtgcgctgacctggggatctttgagagtgtgcaggagtatgtggctgaagcggcccagctggtgagccactgaagatgggggtcataggtagatggaggaattgccaggtcagaatctcggtaggagatgacttgagctgatgctgcctggcacataggggtttagaagatattaggaaggaagccccacagcgtgcccaagtgccatgcaggccctggagacggtcattggagggcgtctgtggatggcgcagtgggggatgggaagtccctaatctgctggggctttcccagcaagcagggactgagggggatagtccccaacacatgggccccagggagaagggcctgtttcattgaggtttggagagtgttgagggtaagctaacctgtcaccccacgcccccgagaatggttactgatagggagaggccttttccttgcaggagatggcgtctaccag

SEQ ID NO: 220 - DNA, 10179 bp, mus musculus
gttgcaccgggccggggtgccagcgcccgccttcccgtttcctcccgttccgcagcgcgcccacggcctgtgaccccggcgaccgctccccagtgacgagagagcggggccgggcgctgctccggcctgacctgcgaagggacctcggtccagtcccctgttgcgccgcgccccctgtccgtccgtgcgcgggccagtcaggggccagtgtctcgagcggtcgaggtcgcagacctagaggcgccccacaggccggcccggggcgctgggagcgccggccgcgggccgggtggggatgcctctgcacgtgaagtggccgttccccgcggtgccgccgctcacctggaccctggccagcagcgtcgtcatgggcttggtgggcacctacagctgcttctggaccagtgagtgggcccaggccgaggcaggcccgcccgggtacccatgcccggccggaggtgggacttagggtgggggacgccgcggccccgacctagcgggcgagcccggagcgcctgacctctccttccccgccagagtacatgaaccacctgaccgtgcacaacagggaggtgctgtacgagctcatcgagaagcgaggcccggccacgcccctcatcaccgtgtccaatcaccagtcctgcatggacgaccctcatctctggggtacccgggccagtgtgctgggcagggggaggaaaggcgaggattcgggacgggcccagcctcgtcagaacaaaccccttctcgctgccttttcatggagccctggcactccggtttccgggcgttctgccccagggctgagacttggatttgtggctcctgcagcatccctgagggagcatgatttggagagggccttgggcatggagcaggaccaaggaacggccacagggcatatcttacagctcctttaacgtcaggcctccagaaccctctgttctctaaaccatccagggccccacagtcttgggaaaaatttgggggttggacataggatatcctgtgaggaagttctgggccagggactggaagcccagtgtcctggcttcaggtttgcccctggctgggcgtgtaccgttcagccctatttgggagcctggttgccacacctagaggttcctgctctgctgacttcacaggaagttgcttggctctggtaaccagatggccgggtggaggggtgcctggggcttccactcctgaacagagagcttaactgtcctagagttcatggggagccacctagccacactggagcccttcagagctcaccctggctgctgggtggagaaaggcctatagatgtcacaggtggatcctgggaggccaggaaggaggacttggagccatccactagcctagactgggctggttgcagtgacagtacagggagaagtatagaagaatgggcattgtccaagtatgttggggaggtaggcagtccaggtgcagtgattagtaagatgtggagggtgggggagagggaggagccagggagaactgaatgatctggcctaagggtctgaaagatgccactttgggctgtagggaaatggtagtgctgctgtccctcattccctgagatggggtgaaggaagggcactccctggggatatgggaagttggggcatgaagcctttcctgtcctctagggatcctgaaactccgccacatctggaacctgaagttgatgcgttggtgaggaggaatgggcccctcgaagtgggccgggccggccccacctgcctctgcccagatttgccctcctcctgctctgcccaggaggtggcgtccagcagtccaggcagggcatggggtggggccccgcaggccctcccctgtgcctcccttctgcatgctgatgctgggggcagggtggtggagcggggtgcagggggcaggactaattgcatctgtccctgcttaggacccctgcagctgcagacatctgcttcaccaaggagctacactcccacttcttcagcttgggcaagtgtgtgcctgtgtgccgaggtgagctgctcctccagcgagtgcagggaggcacttctggggcaggaaagctggtggccagtgtctctgttttggagggacctatgggggtaggcatcccgggagccaacatgaggcccagctccatcacatgccagcagaggggacagaggctgtgggaggagggatgggtccttggaaagtcctcaactctctgcaactgcccagggatcctgtggacctggagccttggcattagaattcaaggaggcattatccataaccccttctctcagggatgtcactaagagactcattgagaacagtgcgttgtcattggtccatggtggcagtagcatgtacctgcaggccagagggttttgcttctaggagaacaaacaggcttgtggggtgagaaccccaggggataggggccattttgatccctattctccagacagggaggatcacagagattaagctgctggcccaaggtcatggggtaggaggtggcaaagccaggatttgaatccagattgctccttcctctgcaggagcagaatttttccaagcagagaatgaggggaaaggtgttctagacacaggcaggcacatgccaggtgctggaaaaagaagagagaaaggtaagccaggcatagcggttcacacttgtcatcccagcactttgtgaggtcgaggtgagaggatcactcaagcccaggagtttgagaccagcctgggcaacatagtaagaccctgtctctttaaaaataaaaatattttaaacaaaagaaaggtagaaaatatgagttgtatgtagaatatgaaggttctagaataatcctattaagaattttggattctggctgggcgcggtggctcacgcctgtaatcccagcactttgggaggctgaggccagcggatcacgaggtcaggagatcgagaccatcctggctaacacggtgaaaccccgtctctactaaaaatacaaaaaattagctgggcatggtagtgggcgcctgtagtcccagctactcgggaggctgaggcaggagaatggcgtgaacccggaaggtggagcttgcagtgagccaagatcacgccactgcactccagcctgggtgacagagtgagactccgtctcaaaaaaaaaaaaaaaaagtgccggccatggtggctcatgcctgtaatcccagcactctgggaggccgaggcgggcggatcacgaggtcaggaattcgagaccagcctaaccaacatggtgaaaccccgtctctactaaaaatacaaaaattagccgggcgtggtggtgtgtgcctgtaatctcagctacttgggagactgagacgggagcattgcttgaacccgggaggtggaggttgtggtgagctgagatcctgccattgcactccagcctgggcaataagagcgaaactccgtctgaaaaaaaaaaaaaaaaaaaagaattttgaattagctggctgcattggtgcatgcctacagtcccagctcctcaggaggctgaggtgggaggatcacttgagccctcgattttctttttccttgagacaatgtctgtttctgttgtccaggctggagtgccgtggcgtgatgatggctcactgcagcttctgtttcctgggttcaagggatcctgtcacctcagcctcctgagcagctgggactaaggagtgtgcccagctaattcttttttttttttggtagagttggggtcttactacattgccagggctggtcttgaactcctagactcaagcgatcctcccgcctcagcctctcaagtgctgggatcacaggcatgagccattgtgcccaacccagcccaggaatttgaggccagcctgagcaatatagtgagaccccaggtatagatagataggtagatagataggtaggtaggtaggtagatagatagatacgtaggtgggtaggtaggtgggtagataggtaggtaggtacgtaggtagatagatagatagatacatacatacatagatagataagatagatagattgattagatagattagatagccaggtggggtggctcacgcctgtaatcccagtgctttgggaggctgaggtgggtggatcacctgaggtcaggagtttgagaccagcctggctaatgtggcgaaaccctgtctactaaaaatacaaaaattagctggatgtggtggcgcacgcctgtaatctcagctactcgggaggctggggtgggagaatcgcttgaacccaggaggtggaggttgcagtgagctgagatcatgccactgcactccagcctgggccacagagggagacctggtctcaaaaaaaaaaaaaaaaaaaaaaaaaagatttttgtatttgactgtgctctctcatccaggtggtgacatgcttgtatctgtggttaagaggtagtatctgccgggcgcggtggctcatgcctgtaatcccagtactttgcgaggccgaggcgggtggttcacctgaggtcaggagtttgagaccagcctgaccaacatggcgaaaccccgtctctactaaaaatataaaaattagccgaggctgggcgcggtggctcacgcctgtaatcccagcactttgggaggccgaggcgggtggatcacgaggtcaggagatcgagaccatcctggctaacaggatgaaaccccgtctctactaaaaacacaaaattagctgggcatggtggcaggtgcctgtagtcccagctactcgggaggctgaggcaggagaatggcacaaacccgggaggcggagcttgaggcaggagaatggcgtgaacccgggaggcagagcttgctatgagcagagatcgcgccactgcactccagcctgggtgacagagcgagactccgtctcaaaaaaaaaaaaaagagagagataccattccagttgcaatgtggctgcagcagggctaggtggacatgaggagcccagttcagggctgtcacagtagctccagcagcagatgattgtggctgggcctcccaagtgtcacgttggagaaccggagaaggggacttctttgggatgtactctggacttgttgatagattaagtgtaggtggggtgaggaagagaactcaaagatgacaccaggtgttggagctgagccacggggagaagggtgcaaagggaaagcagtgcgggggctgggaggggagagggtcagtcctgttttgcttgtgctgcatctgaggagcccctcacctgtggaaggagagcagtcccagaggcagtggggtgtgcagttctggaacttagaagaatgatcagggggctgggtgcagtggctcacgcctgtaatcccagcactttgggaggccgaggcgggcggatcaagaggtcaggagattgagaccatcctggctaacatggtgaaaccccatctctactaaaaatataaaaaattagcagcgcatggtggcaggcacctgtagtcccagctattcaggaggctgaggcaggagagtggcgtgaacccgggagacggagcttgcagtgagctgagattgcgccactgcactccagcctgggcgacagagcgagactccgtctcaaaaaaaaaaaaaacaaaaaattatcaggaataaagatactgggaattcaaccacaaaaaccacaaagtcacgaatgcagagtgagagtcttcagagagagggcagaggcccaggatggcacagagggagagagaagccaccaagatggcagggagccatggccagagagaaaagcaaaccaggcgcctgtggcaccatggaagcagcaggtgatgctggagaagcgtttccatgcagtgacagctgccagagccagattattatggcctgagggctggtggtgctgcagttgggggggaatggagaccgcagcgggggaatggagaccgcaggggcggcaactcctcccagaggttcagtttggaggaaaaagagacagaaggaagggtaaccaaaggatattagaggtcaaggaggggtttattatttctagctggtcaaagtagaatgtggtaaaacccaataaagtaacagcaaataacaaagaggggcttttaatggaaagctgcagtgcctgcccctcacctccctagccccactcctcagaagcagccccctggagcggtttctctttctgctgcttttggaggctacttctgtctctgtaaaggaacttctgtctctgtaaaggaacaagcagaggccacagtgtcttggcaaatgaccgtggcattgtttatcccaacctgctctgagagatggggactctgctgattcacccctcgtccctgcctctttagttccttcagcaaagaactaataatatgtcattaaggcaaaggcagtatttggcacacttggcttctgtgttccaaaaaattccctttttctccaagcgtagattttaatatggtatttaagtatcaaagtgatttgacacaagtgacacaagtgagcagtagtagcatttgcaaaagctacaaatgatgaagtcttgctccaaaagcatattattattattttttaaattccagtttcaagctcaatggataggttgcgtcagtgggttttagtagagaaggggccagtacctatgaagactcccctgtactattacacatgctgcgtcccaagtagggaaactccagtgggtcatcaccccctccctctagcccaagtgggctgctgggtcagggcactgtttgggttgggttgagattcctggatccctaactagcaccttccaaagaatcggccttgcagagaacaaagttcattgccaaaggtattcccaatgtctgtctctcgctctgtgatagggcttctttactccccactttataagatgaggatatctgctataccccattccttcaacctctccacctctttcctcttttgtctgccatgtgattacttttccatcaccaaggttgatgagatccttactgtgtacttactgtctccaagcatccccaggcttccagccagcacgcagcagccaacattggcttcagaaggaaggaggtttgcatttccttctcttgggtccagtgccatggtctcagggttatctccaatgtggaaagttgctagaccaggagcagtttgactccactgtttttcagtctagcaagtttgagtttttcccaagctcttgatgtgtgttcaaatgaatgttctccctttcccaagagacctccctataagggagggtctagtttcccggggtgccctgagaagaaggggtcagcaggggggaggaatggtggaggctgaggcctcaggcaggtgccctgtgaggagtggctgtgacaagcggctgagatcccagcaaagggttgttgcccagaatctggggcctaagcgaggttggaaatcacaaatgcacttggtttctctagcagctggcacatagtaggatcagcccaggagtggcaccttcaaagagaaaggaacgcatgaggctccgagagcggtcggctggcagccagggcctggctggggagggagggcaggtggtgcgctgacctggggatctttgagagtgtgcaggagtatgtggctgaagcggcccagctggtgagccactgaagatgggggtcataggtagatggaggaattgccaggtcagaatctcggtaggagatgacttgagctgatgctgcctggcacataggggtttagaagatattaggaaggaagccccacagcgtgcccaagtgccatgcaggccctggagacggtcattggagggcgtctgtggatggcgcagtgggggatgggaagtccctaatctgctggggctttcccagcaagcagggactgagggggatagtccccaacacatgggccccagggagaagggcctgtttcattgaggtttggagagtgttgagggtaagctaacctgtcaccccacgcccccgagaatggttactgatagggagaggccttttccttgcaggagatggcgtctaccagaaggggatggacttcattttggagaagctcaaccatggggactgggtgcatatcttcccagaaggtcagcagggctgactgggtcgagcccccccagtatgagcgggatgggctcccaagcctcgcctctgtgctctctcaccagggaaagtgaacatgagttccgaattcctgcgtttcaagtggggtaagggctgctggtctctggccacagccatcctcccggcccagagatggccctgtgggcccctggctcccgccccctcgggctggcttgtatgggggtagatgggcgtgtttgtagcgccaggaaggggacaggtgctgagactaggcctgcctctcgcaggggcttgcccaagggagctgaattgaactggaggatgtcgggggtggcagtggccagaggctggcacagaagcttggctcagggcccagcttatgctaacatttctacctcccccctgggcaggaatcgggcgcctgattgctgagtgtcatctcaaccccatcatcctgcccctgtggcatgtcggtgagcctggggacggggacagagagatggcatctggggtggggggcctgggactccctctggtcccaggctgccctgctccaccccacgtctggccttctgtccactgtgctgcaggaatgaatgacgtccttcctaacagtccgccctacttcccccgctttggacaggtgggtggggactgctgaccttcggctgtctgcctgtctgctgtctgctccgtgtctcccactcagcactatggaggccagctgcaggaggagctgagcatgaggctacagcaggggacagagtggaacatagacagggacttcctggcaccgagacattaaaatgagagcagaggaagtcaggctggggcagaggtgggctgtggggtcaggacaggacaggtcatctacagcacaggacccaggaccaggaccttgttttagaggaagagtggcccctggggagtgtgtggcacagcagggccggggcttagcttctggctcccgggttgcttgggctggggctgtgggcactcctactgctcctcatcactcttggcggccaccccacagaaaatcactgtgctgatcgggaagcccttcagtgccctgcctgtactcgagcggctccgggcggagaacaagtcggctgtgagtttcctcctgggtcccccgtagctgtccccggaccccctgctgctggcttccagcagggtgcctccaccctctccatcccgtcaccctcccagggcaccctcccagggcaccttggccaagcttcccgaggggtgcaggccatccctggtcctttccctcaggtggagatgcggaaagccctgacggacttcattcaagaggaattccagcatctgaagactcaggcagagcagctccacaaccacctccagcctgggagataggccttgcttgctgccttctggattcttggcccgcacagagctggggctgagggatggactgatgcttttagctcaaacgtggcttttagacagatttgttcatagaccctctcaagtgccctctccgagctggtaggcattccagctcctccgtgcttcctcagttacacaaaggacctcagctgcttctcccacttggccaagcagggaggaagaagcttaggcagggctctctttccttcttgccttcagatgttctctcccaggggctggcttcaggagggagcatagaaggcaggtgagcaaccagttggctaggggagcagggggcccaccagagctgtggagaggggaccctaagactcctcggcctggctcctacccaccgcccttgccgaaccaggagctgctcactacctcctcagggatggccgttggccacgtcttccttctgcctgagcttccccccgaccacaggccctttcctcaggcaaggtctggcctcaggtgggccgcaggcgggaaaagcagcccttggccagaagtcaagcccagccacgtggagcctagagtgagggcctgaggtctggctgcttgcccccatgctggcgccaacaacttctccatcctttctgcctctcaacatcacttgaatcctagggcctgggttttcatgtttttgaaacagaaccataaagcatatgtgttggcttgttgtaaa

SEQ ID NO: 221 - DNA, 10179 bp, mus musculus
ttgcaccgggccggggtgccagcgcccgccttcccgtttcctcccgttccgcagcgcgcccacggcctgtgaccccggcgaccgctccccagtgacgagagagcggggccgggcgctgctccggcctgacctgcgaagggacctcggtccagtcccctgttgcgccgcgccccctgtccgtccgtgcgcgggccagtcaggggccagtgtctcgagcggtcgaggtcgcagacctagaggcgccccacaggccggcccggggcgctgggagcgccggccgcgggccgggtggggatgcctctgcacgtgaagtggccgttccccgcggtgccgccgctcacctggaccctggccagcagcgtcgtcatgggcttggtgggcacctacagctgcttctggaccagtgagtgggcccaggccgaggcaggcccgcccgggtacccatgcccggccggaggtgggacttagggtgggggacgccgcggccccgacctagcgggcgagcccggagcgcctgacctctccttccccgccagagtacatgaaccacctgaccgtgcacaacagggaggtgctgtacgagctcatcgagaagcgaggcccggccacgcccctcatcaccgtgtccaatcaccagtcctgcatggacgaccctcatctctggggtacccgggccagtgtgctgggcagggggaggaaaggcgaggattcgggacgggcccagcctcgtcagaacaaaccccttctcgctgccttttcatggagccctggcactccggtttccgggcgttctgccccagggctgagacttggatttgtggctcctgcagcatccctgagggagcatgatttggagagggccttgggcatggagcaggaccaaggaacggccacagggcatatcttacagctcctttaacgtcaggcctccagaaccctctgttctctaaaccatccagggccccacagtcttgggaaaaatttgggggttggacataggatatcctgtgaggaagttctgggccagggactggaagcccagtgtcctggcttcaggtttgcccctggctgggcgtgtaccgttcagccctatttgggagcctggttgccacacctagaggttcctgctctgctgacttcacaggaagttgcttggctctggtaaccagatggccgggtggaggggtgcctggggcttccactcctgaacagagagcttaactgtcctagagttcatggggagccacctagccacactggagcccttcagagctcaccctggctgctgggtggagaaaggcctatagatgtcacaggtggatcctgggaggccaggaaggaggacttggagccatccactagcctagactgggctggttgcagtgacagtacagggagaagtatagaagaatgggcattgtccaagtatgttggggaggtaggcagtccaggtgcagtgattagtaagatgtggagggtgggggagagggaggagccagggagaactgaatgatctggcctaagggtctgaaagatgccactttgggctgtagggaaatggtagtgctgctgtccctcattccctgagatggggtgaaggaagggcactccctggggatatgggaagttggggcatgaagcctttcctgtcctctagggatcctgaaactccgccacatctggaacctgaagttgatgcgttggtgaggaggaatgggcccctcgaagtgggccgggccggccccacctgcctctgcccagatttgccctcctcctgctctgcccaggaggtggcgtccagcagtccaggcagggcatggggtggggccccgcaggccctcccctgtgcctcccttctgcatgctgatgctgggggcagggtggtggagcggggtgcagggggcaggactaattgcatctgtccctgcttaggacccctgcagctgcagacatctgcttcaccaaggagctacactcccacttcttcagcttgggcaagtgtgtgcctgtgtgccgaggtgagctgctcctccagcgagtgcagggaggcacttctggggcaggaaagctggtggccagtgtctctgttttggagggacctatgggggtaggcatcccgggagccaacatgaggcccagctccatcacatgccagcagaggggacagaggctgtgggaggagggatgggtccttggaaagtcctcaactctctgcaactgcccagggatcctgtggacctggagccttggcattagaattcaaggaggcattatccataaccccttctctcagggatgtcactaagagactcattgagaacagtgcgttgtcattggtccatggtggcagtagcatgtacctgcaggccagagggttttgcttctaggagaacaaacaggcttgtggggtgagaaccccaggggataggggccattttgatccctattctccagacagggaggatcacagagattaagctgctggcccaaggtcatggggtaggaggtggcaaagccaggatttgaatccagattgctccttcctctgcaggagcagaatttttccaagcagagaatgaggggaaaggtgttctagacacaggcaggcacatgccaggtgctggaaaaagaagagagaaaggtaagccaggcatagcggttcacacttgtcatcccagcactttgtgaggtcgaggtgagaggatcactcaagcccaggagtttgagaccagcctgggcaacatagtaagaccctgtctctttaaaaataaaaatattttaaacaaaagaaaggtagaaaatatgagttgtatgtagaatatgaaggttctagaataatcctattaagaattttggattctggctgggcgcggtggctcacgcctgtaatcccagcactttgggaggctgaggccagcggatcacgaggtcaggagatcgagaccatcctggctaacacggtgaaaccccgtctctactaaaaatacaaaaaattagctgggcatggtagtgggcgcctgtagtcccagctactcgggaggctgaggcaggagaatggcgtgaacccggaaggtggagcttgcagtgagccaagatcacgccactgcactccagcctgggtgacagagtgagactccgtctcaaaaaaaaaaaaaaaaagtgccggccatggtggctcatgcctgtaatcccagcactctgggaggccgaggcgggcggatcacgaggtcaggaattcgagaccagcctaaccaacatggtgaaaccccgtctctactaaaaatacaaaaattagccgggcgtggtggtgtgtgcctgtaatctcagctacttgggagactgagacgggagcattgcttgaacccgggaggtggaggttgtggtgagctgagatcctgccattgcactccagcctgggcaataagagcgaaactccgtctgaaaaaaaaaaaaaaaaaaaagaattttgaattagctggctgcattggtgcatgcctacagtcccagctcctcaggaggctgaggtgggaggatcacttgagccctcgattttctttttccttgagacaatgtctgtttctgttgtccaggctggagtgccgtggcgtgatgatggctcactgcagcttctgtttcctgggttcaagggatcctgtcacctcagcctcctgagcagctgggactaaggagtgtgcccagctaattcttttttttttttggtagagttggggtcttactacattgccagggctggtcttgaactcctagactcaagcgatcctcccgcctcagcctctcaagtgctgggatcacaggcatgagccattgtgcccaacccagcccaggaatttgaggccagcctgagcaatatagtgagaccccaggtatagatagataggtagatagataggtaggtaggtaggtagatagatagatacgtaggtgggtaggtaggtgggtagataggtaggtaggtacgtaggtagatagatagatagatacatacatacatagatagataagatagatagattgattagatagattagatagccaggtggggtggctcacgcctgtaatcccagtgctttgggaggctgaggtgggtggatcacctgaggtcaggagtttgagaccagcctggctaatgtggcgaaaccctgtctactaaaaatacaaaaattagctggatgtggtggcgcacgcctgtaatctcagctactcgggaggctggggtgggagaatcgcttgaacccaggaggtggaggttgcagtgagctgagatcatgccactgcactccagcctgggccacagagggagacctggtctcaaaaaaaaaaaaaaaaaaaaaaaaaagatttttgtatttgactgtgctctctcatccaggtggtgacatgcttgtatctgtggttaagaggtagtatctgccgggcgcggtggctcatgcctgtaatcccagtactttgcgaggccgaggcgggtggttcacctgaggtcaggagtttgagaccagcctgaccaacatggcgaaaccccgtctctactaaaaatataaaaattagccgaggctgggcgcggtggctcacgcctgtaatcccagcactttgggaggccgaggcgggtggatcacgaggtcaggagatcgagaccatcctggctaacaggatgaaaccccgtctctactaaaaacacaaaattagctgggcatggtggcaggtgcctgtagtcccagctactcgggaggctgaggcaggagaatggcacaaacccgggaggcggagcttgaggcaggagaatggcgtgaacccgggaggcagagcttgctatgagcagagatcgcgccactgcactccagcctgggtgacagagcgagactccgtctcaaaaaaaaaaaaaagagagagataccattccagttgcaatgtggctgcagcagggctaggtggacatgaggagcccagttcagggctgtcacagtagctccagcagcagatgattgtggctgggcctcccaagtgtcacgttggagaaccggagaaggggacttctttgggatgtactctggacttgttgatagattaagtgtaggtggggtgaggaagagaactcaaagatgacaccaggtgttggagctgagccacggggagaagggtgcaaagggaaagcagtgcgggggctgggaggggagagggtcagtcctgttttgcttgtgctgcatctgaggagcccctcacctgtggaaggagagcagtcccagaggcagtggggtgtgcagttctggaacttagaagaatgatcagggggctgggtgcagtggctcacgcctgtaatcccagcactttgggaggccgaggcgggcggatcaagaggtcaggagattgagaccatcctggctaacatggtgaaaccccatctctactaaaaatataaaaaattagcagcgcatggtggcaggcacctgtagtcccagctattcaggaggctgaggcaggagagtggcgtgaacccgggagacggagcttgcagtgagctgagattgcgccactgcactccagcctgggcgacagagcgagactccgtctcaaaaaaaaaaaaaacaaaaaattatcaggaataaagatactgggaattcaaccacaaaaaccacaaagtcacgaatgcagagtgagagtcttcagagagagggcagaggcccaggatggcacagagggagagagaagccaccaagatggcagggagccatggccagagagaaaagcaaaccaggcgcctgtggcaccatggaagcagcaggtgatgctggagaagcgtttccatgcagtgacagctgccagagccagattattatggcctgagggctggtggtgctgcagttgggggggaatggagaccgcagcgggggaatggagaccgcaggggcggcaactcctcccagaggttcagtttggaggaaaaagagacagaaggaagggtaaccaaaggatattagaggtcaaggaggggtttattatttctagctggtcaaagtagaatgtggtaaaacccaataaagtaacagcaaataacaaagaggggcttttaatggaaagctgcagtgcctgcccctcacctccctagccccactcctcagaagcagccccctggagcggtttctctttctgctgcttttggaggctacttctgtctctgtaaaggaacttctgtctctgtaaaggaacaagcagaggccacagtgtcttggcaaatgaccgtggcattgtttatcccaacctgctctgagagatggggactctgctgattcacccctcgtccctgcctctttagttccttcagcaaagaactaataatatgtcattaaggcaaaggcagtatttggcacacttggcttctgtgttccaaaaaattccctttttctccaagcgtagattttaatatggtatttaagtatcaaagtgatttgacacaagtgacacaagtgagcagtagtagcatttgcaaaagctacaaatgatgaagtcttgctccaaaagcatattattattattttttaaattccagtttcaagctcaatggataggttgcgtcagtgggttttagtagagaaggggccagtacctatgaagactcccctgtactattacacatgctgcgtcccaagtagggaaactccagtgggtcatcaccccctccctctagcccaagtgggctgctgggtcagggcactgtttgggttgggttgagattcctggatccctaactagcaccttccaaagaatcggccttgcagagaacaaagttcattgccaaaggtattcccaatgtctgtctctcgctctgtgatagggcttctttactccccactttataagatgaggatatctgctataccccattccttcaacctctccacctctttcctcttttgtctgccatgtgattacttttccatcaccaaggttgatgagatccttactgtgtacttactgtctccaagcatccccaggcttccagccagcacgcagcagccaacattggcttcagaaggaaggaggtttgcatttccttctcttgggtccagtgccatggtctcagggttatctccaatgtggaaagttgctagaccaggagcagtttgactccactgtttttcagtctagcaagtttgagtttttcccaagctcttgatgtgtgttcaaatgaatgttctccctttcccaagagacctccctataagggagggtctagtttcccggggtgccctgagaagaaggggtcagcaggggggaggaatggtggaggctgaggcctcaggcaggtgccctgtgaggagtggctgtgacaagcggctgagatcccagcaaagggttgttgcccagaatctggggcctaagcgaggttggaaatcacaaatgcacttggtttctctagcagctggcacatagtaggatcagcccaggagtggcaccttcaaagagaaaggaacgcatgaggctccgagagcggtcggctggcagccagggcctggctggggagggagggcaggtggtgcgctgacctggggatctttgagagtgtgcaggagtatgtggctgaagcggcccagctggtgagccactgaagatgggggtcataggtagatggaggaattgccaggtcagaatctcggtaggagatgacttgagctgatgctgcctggcacataggggtttagaagatattaggaaggaagccccacagcgtgcccaagtgccatgcaggccctggagacggtcattggagggcgtctgtggatggcgcagtgggggatgggaagtccctaatctgctggggctttcccagcaagcagggactgagggggatagtccccaacacatgggccccagggagaagggcctgtttcattgaggtttggagagtgttgagggtaagctaacctgtcaccccacgcccccgagaatggttactgatagggagaggccttttccttgcaggagatggcgtctaccagaaggggatggacttcattttggagaagctcaaccatggggactgggtgcatatcttcccagaaggtcagcagggctgactgggtcgagcccccccagtatgagcgggatgggctcccaagcctcgcctctgtgctctctcaccagggaaagtgaacatgagttccgaattcctgcgtttcaagtggggtaagggctgctggtctctggccacagccatcctcccggcccagagatggccctgtgggcccctggctcccgccccctcgggctggcttgtatgggggtagatgggcgtgtttgtagcgccaggaaggggacaggtgctgagactaggcctgcctctcgcaggggcttgcccaagggagctgaattgaactggaggatgtcgggggtggcagtggccagaggctggcacagaagcttggctcagggcccagcttatgctaacatttctacctcccccctgggcaggaatcgggcgcctgattgctgagtgtcatctcaaccccatcatcctgcccctgtggcatgtcggtgagcctggggacggggacagagagatggcatctggggtggggggcctgggactccctctggtcccaggctgccctgctccaccccacgtctggccttctgtccactgtgctgcaggaatgaatgacgtccttcctaacagtccgccctacttcccccgctttggacaggtgggtggggactgctgaccttcggctgtctgcctgtctgctgtctgctccgtgtctcccactcagcactatggaggccagctgcaggaggagctgagcatgaggctacagcaggggacagagtggaacatagacagggacttcctggcaccgagacattaaaatgagagcagaggaagtcaggctggggcagaggtgggctgtggggtcaggacaggacaggtcatctacagcacaggacccaggaccaggaccttgttttagaggaagagtggcccctggggagtgtgtggcacagcagggccggggcttagcttctggctcccgggttgcttgggctggggctgtgggcactcctactgctcctcatcactcttggcggccaccccacagaaaatcactgtgctgatcgggaagcccttcagtgccctgcctgtactcgagcggctccgggcggagaacaagtcggctgtgagtttcctcctgggtcccccgtagctgtccccggaccccctgctgctggcttccagcagggtgcctccaccctctccatcccgtcaccctcccagggcaccctcccagggcaccttggccaagcttcccgaggggtgcaggccatccctggtcctttccctcaggtggagatgcggaaagccctgacggacttcattcaagaggaattccagcatctgaagactcaggcagagcagctccacaaccacctccagcctgggagataggccttgcttgctgccttctggattcttggcccgcacagagctggggctgagggatggactgatgcttttagctcaaacgtggcttttagacagatttgttcatagaccctctcaagtgccctctccgagctggtaggcattccagctcctccgtgcttcctcagttacacaaaggacctcagctgcttctcccacttggccaagcagggaggaagaagcttaggcagggctctctttccttcttgccttcagatgttctctcccaggggctggcttcaggagggagcatagaaggcaggtgagcaaccagttggctaggggagcagggggcccaccagagctgtggagaggggaccctaagactcctcggcctggctcctacccaccgcccttgccgaaccaggagctgctcactacctcctcagggatggccgttggccacgtcttccttctgcctgagcttccccccgaccacaggccctttcctcaggcaaggtctggcctcaggtgggccgcaggcgggaaaagcagcccttggccagaagtcaagcccagccacgtggagcctagagtgagggcctgaggtctggctgcttgcccccatgctggcgccaacaacttctccatcctttctgcctctcaacatcacttgaatcctagggcctgggttttcatgtttttgaaacagaaccataaagcatatgtgttggcttgttgtaaaa

SEQ ID NO: 222 - DNA, 37095 bp, mus musculus; identical to SEQ ID NO: 175

SEQ ID NO: 223 - DNA, 2044 bp, mus musculus
gggtgatgaccatggtaacacccgggggggagttcgtgacatctccggcgcggagggactcgatgtctatggcaatggtcgcctggtggaagggacggaactagatcccttcgctcgggacgctcacattccaggcccttgtcctgcaggctgccgcgggcggacacgccagaggaggaggccggggaatggccgcggtgtggcagcaagtcttagcagtggacgcgaggtgaggcgtggggtcaaagcccatgggagcagaacttactgtggtgcatgcgcaatggcgataagtgaggctgggcggagaacttgccttatgcggctgcgtgggcatgccggaggtgagcatgcgcagtagcgggggcgggcacgcccgcggtgagttggctgcgccggagaggattctaaacagcaagctgggaaaatgtggtcagatgtgggcatgcgcaaagcggctacctgtgagagggaggtggggctcaggcaggtgacatcctatcccctatgggtgtcccctagacttttttttttttacatcatcacttccccattctgaccccatcacctcccaacgctgacccccataatgtcagtctgatttctgtcgccctggtatactgaccctaattattgtctgcgctgacccagtcaccccgtagggaccccagcacggcagcagactgactctgttgtctgcaaactgacctcatgaccatgctcattattactgcagactcactcccaccacaggaccaagaggtccctcatcaccactgctagtcattcttaccacctaggccccagtcactgccacacacctcactctcctgccgtacccccccccccgagctgattgattccctctgtcctgtgcctgctgcctgccctgcatcctgaccctgcaggtacaacgcgtaccgcacaccaacgtttccacagtttcggacgcagtatatccgccggcgcagccagctgctgcgggagaatgccaaggctgggcaccccccagcgctgcgtcggcagtacctgaggcttcgggggcagctgctgggccagcgctacgggcccctctccgagccaggcagtgctcgtgcctatagcaacagcatcgtccgcagtagccgcactactcttgaccgcatggaggtgagcttctggccacattcacccccgggcataccctgcctgcacacattcactccactgactttcatcaagcacctgctctttgctgggcactgttctgcatcagcagaggacaaaaagataatatgccaagtaaaccagtaaacacacaaactttgtaaacaggtcagtaaacatatagcaagccctgtctttagtatctgctgagcagggggagggcaggaacagcagaactcgtgaggaagccactgcagtagtacaagtgggcagcggtggtggtggcaggggacacagtgagaagtgatctgactctaggtagattttcagggctccacacctcaaaggttctcgggctttttgcaagatgcacccaccctgaccctctccatttgcaggactttgaggatgatcctcgggccctgggggcccgtgggcaccgtcgttctgtcagcagaggctcctaccagctgcaggcgcagatgaaccgtgccgtctatgaggacaggtatgcaccagaggcagccaaggcggggggcgggttgcgaggaggagaggggccctggggcaatggcagactgaacactctcgcatctacctcctgtcacccctcacttcctattggggcccaggccccctggcagcgtggtgcccacgtcagcagcagaggcaagtcgggccatggccggggacacgtcactgagcgagaactatgcctttgcgggcatgtatcatgtttttgaccagcacgtggatgaggcaggtgagccagtgggtagcgggttccatcaccaagcgtttgcccaaactgtgacaaccaaccaaggcatccttttctgaatccaaggcccctggcacactccaaaggaggaatgaccatccataaagccttttgtag

SEQ ID NO: 224 - DNA, 21541 bp, mus musculus
gtcgcgcggcgccctctgcgcctgcgccccggcacgaggtggggcggcgggcgtcagtacagtagagtgtgcgccggggtggggggcaacggtcagccgtcaccctgagacgggcggcggcgggatggcaacagcctccggggcctcggacttgtctggctccggagcgcccccgcccggtgtgggagctcaggcggcggcggccgctgaggaggaggagcgagaggtggtgcgggtccgagtcaaggtgaggctggcggtgagtcggcccagccgccgaggcatcccaggggagggggaggcggtggctgtcataggatggagggcgggacctgagatttcggacataacctgagcggcgaagcttgagggccaagtgatgatggcgaggggtagggagggcctgagagcctgagagcgttagcgacgtaccttggggcgtgggactgaaaatagagggacgaggcgggggtctatgggatgaatgggtggagcttatagacaaaggggaggggctatggggctggaggaggggccgcagtagttgagggtggggctctgaggaatgagaaggtgctggctctggagtcagtcaacccatgtgttgagagtgcacttatgtgcaagttcccactttgatgagctgacaggctcgtgggtggagacaactaaagaaatgagatgcttcggacactaaaataatgaaaaaggttatgaaatagggagtcacgttagccaaggttgtacagggaaatccccagaggaggtattgaaggagcagagacccgaataaaaggagtcagccatgtgcatattagaagggaagagtattctaggcagaaggaatagcaagggcaaagactagaggatgggaatgagcctggcatgttcccgtaggttcctgattgctggagtggagagaatgaggggaagagtggtaggaggtgaatcagagcgctaagacagagacagatcgccaagggcctttggtgtgtatgctgaggaagaacgctgttgccatagttccagtaaacaatgatggtggctccgaccaaccagtggcactggcagtgataagagggtccacacatcacttcagtgtaatagagctctaaggtagaagtttgacattcagaaaaaagatgatgcctgagctgggcgtgaaccacgtgaagaaagtgggagggatgttccagacaggggatcagcacaatcaatggcctggagtcaggatggtttcaaggtaacttctaacagtttggtactactagagtgtaaagttcaaaaaacctggtgagaggctggctggggccccataggcccgcttgctgggactctagggttgccattgaagagattgaagcaggggagtgttgtaggtagatgtgttagattggttacagcaccatagaggactgatttaacaggagccagactggacacggtgattctggcaaccatagttgaagggatatagaagaaggattgggggcctgaactcttgcagtagcctcctcctcactggaccctgtggtccagaacacctgccttgatctggcccctggcacctctctgactttgccttctaccactctgcacctcactcttcagcatggtgatggggcccctggtggcctaccccatgtcttctctccccagaaatgtgagagcttcttgccgccagagttccgctcttttgctgtagatccccagatcacctcgctcgacgtgttgcagcacatcctcatccgagcctttgatttgagtgggtgagtgggaagatgctggggactggccagtgggccaccgacctctacagtggctatctggcctttgtttggtagggtttttgtttattttactactacaaataatcccacagtgaacagccacgtatgcatgtcttggagcacagtagtctacttttgtctgtggttttgctttctgcagtttcagttacccatggtcaacctcagtctgcaaatattacatacaataagatattttgagagagagagagagaccacattcatattacttttattacagtttacagacagtccccaacttacaataactggacttaggatttttcaactttacaatggtgcaaaagcgatacgcatttggtagaaactgtactgcaagtgcccagcgattctgcttttcactttcagtacagtgttcaataaattacatgaaatattcaacactgttgtaaaacagactctgtgttagatgattttcccaactgtaggctaatgtgagcgttctgagcacgtttaaggtaggctaggctaacctgtgatgtttggtaggataaatgtgttaaatgcattttcctttttatttctttttttttttttttttgagatggagtctaactgtcacccaggctgcagtgcagtgacatctcccaggttcaagtgattctcctgtcacagcctcccaagtagctgggactacaggcatgcaccactatgcccggataattttttttttttttttttttgagacggagttttgctcttgtcccccgggctgcagtgcagtggcgcagtctcagctcactgcaacctccgcttcccgggttcaagtgattctcctgcctcagcctcccaagtagctgggattacaggcacgcaccaccacgcctgctaatttttgtatttttattagagacaaggtttcaccatgttggtcaggctagtctcgaacacctgacctcaagttacctgtccacctcggcctcccaaagtgctaggattacaggtgtaagcccccgcacccagtcccagatagttttttgatcttctcttttttttttttttggagacagagtctcactctgtcacttaggttggagtgcagtggtccgatgttggctcattgcagcctttgcctcccgggttcaagtgattctcatgcctcagcctccagagtagctgggattacaggtgtgcaccaccacactcagctaattttcatgaggttggtcaggctggtctcaaactcctgatctcaagtgatccgcccacctcggcctcccaaagtgttaggattacaggcacgtgagcctccgcacccggccaattttttgtatctttagtagagacagggtttcgccatgttgcccagggcagtctcaaactcctgagctcaagcaatccgcccgcctcagcctctcaaagtgctgggattacaggtgagccactgcgcccagccaaatgcattgtcaacttacagtatttccaacttacgatgagtttattggtacataaccctgtcataagtcaagaagcatctgtattgtcataattgttctattattgttaatctcttactgtgcctaatttatcaattaaaccttatcataggtatgtatgtatatgaaaaaaaacatagtatatatagggcttggtactatctgcagtttcaggcatccactcgggggggtcttggaatgtatcccctgtagataaagagggactactgtatttggaaacatctagtcataggataaattcctagcagtggtattgccaggtaaaagggtatttgctttaaaaaaaattttttttttgagacagtctcattctgtcgtccaggctggagtgcagtggtgtgatctcgtctcattgcaacctccacctcctgagttcaagcaattctcctgcctcggcctcctgagtagctggtactacaggcgtgcgccaccatgcccggctaatttttgtatttttagtagagatggggtttcaccgtgttggccaggatcgtctcgatctcctgacctcgtgatccacccgcctcagcctcccaaagtgctgggattacaggcatgagccaccgcacctggcctgctttttgaactattaatgggtgtttccaaaatgctctccagacaggttttatcaatttatgatctcagccgggcgctgtggctcatgcctgtaatcccagcactttgggaggctgaggcaggtggatcacgaggtcaggagatcaagaccatcctggctaacacggtgaaactccgtctctactaaaaatacaaaaaattctccaggcgtggtggtgggcgcctgtagtcccagctacttgggaggctgaggcaggagaatggcatgggcccgggaggcggagcttgcagcgagccgagatcgcaccattgcactccagactgggcgacagagtgagactccgtctcaaaaaaaaaaaaaaacgaatttatgatctcatcagcagcacataaatgcctgtttccctcacaccctcgcaaacattggttactgtaaaactgcaaaatttgccaatctgatagctgaaaagtggtgtctcttgggggcagatgtgatagtcattttgttgtgattttggaggaatacatacacatggtaagaaattcaaacagtacacaattgttgggtatttaggatgtttccatggttatgatgagcatcacgcaacaaacttctttacatagttgcacaagtatagctgaaaaattcttagttgttattagactttcttacataaacatttttgttgtgaaaaataacaaacacagattgctttttttttatgtagtaagaaggctgctttcttcccacttctgtcccacatctaccccagaggggaccaacttttttttttttttttgagatggagtcttgctctgtcacccaggttggagtgcaatgccacaatcttggctcactgcaacctccacctcccaggttcaagcgattctcctgcctcagcctcctgagtagctgggattacaggcacctgccaccacacccagctaattttttttgtatttttagtacagaaggggtttcaccatgttgaccaggctagtctcaaactcctgacctcaggtgatccacccacctcggcctcccaaagtgcggagattataggcgtgagccactgcacccggccaacattttaccagtttccaatgtgacctccagatacaagcaggtgtgtacctgcttgtatgtgtttgtgtaacaaagtgggtataaatgacctgatctcaggctgcccataatccttggcacagtaccttgcacatagtaggaagttgttttcaacgccttctatattaccctccttgttttggaaactgtccctgaggcctccagggcaccaggggccctgagagctccctcgtatcccctgtccaggaagaagaactttggcatcagctacctgggccgggaccggctaggacaggaagtttacctctcacttctatctgactgggacctcagcacagcctttgccactgcctccaaaccttacctgcaattgcgtgtagatattcggccctcggaggacagtgagtactcagtgcccccaggagcactgctctggaacccctttaccccatagggtgatgctacccctcacagtacactccctcatggtgggatgggtagcaaggtatcctagctatagatcctggctcagccactaggccacaatttcttcacttgtaaagagataattgtatcttagaaccattgtgaggccttgtatcttagaaccattgtgaggggaaattcatataaaatgcctggaacagtgcatgactgcataatgaaggctcagaaagtgttatctctaataatgataattatattgtattatactattataacatataaccgagtaatgtatgtaataattagatataatgcagatttataatatagtataacggtatagctttagcattatgtatttcagttataatacctaaatataacaatgcgtattataataatgctagttgtgtttattcattcagtcattctgcacccatattcatttgtttgtattcttgctcactcattcatttgttcccttgacctctcagccactttttctcttctcatctttgttcttccactcttgcctattctggtccctgcgagcacacagataaattaggacgtggtctcaaaatttgattacagaccatacattagataattgtatcagtattaaatttcctgggtgtgtgtcttagtcgttttgtgctactataacagaataccacagactgaggaatttgtaaagaagagaaatttatttctcacagttttggagactgggaagtccaagatcaaggtgctggcaggttgtgtgtctagtgagggctttcttgctgcatcctcacatgacagaagagcagaagagagtgaacccacaccctcaacctctttataagagcccaaatccgctgggcacggtggctcatgcctgtagtcccagcactttgggaggctgaggcaggcggatcacctgaagtcaggagttcgagaccatcctggccaacatggtgaaaccctgtctctactaaaaaaaatacaaaaattagccgggtgtagtggcacatgcctataatcccagctactcgggaggctgaggcatgagaatcgcttgaacccgaaaagcagaggttgcagtgagccaagatcttgccactgcactccagcctgggtgacagagcgagacttcatctcaaaaaaaaaaaaaaaaagaggctgagcacggtggctcacgcctgtaatcccagcagtttaggaggccgaggcgggcagatcacaaggtcaggagatcgagaccaccctggctaacacggtgaaaccctgtctttactaaaaatacaaaaaaatagccgggcgtggtggcgggtgcctgtagtcccagctactcgggaggctgaggcaggagaatggcatgaacccgggaggcggagcttgcagtgagccaagatcgcaccactgcactccagcctgggcaacagagcaagactccatctcaaaaaataaataaaataaaaaataaaaaaagagccctaatcccatctgtgagagctctaccctcaggacttaatcacctcttaaaggcccccacctcttaatatgatcacattggtaattaaattgcaacacatgaatttggaaggacacattcaaaccatagcagtgtggtagtggtatcatatctattgaaggaaaatatccttgttcttgggaaagacacagttaagtatgaaggggtaaaatgtcatgatgtctgcaaataagttggcaaaaataatgtgtttatatacagagagagtgagataaagcaaatgtggcccaaaaaaatgttaatagaggatctagatgaagtatgtatgggtgttcagtgtattcttttaactttattgtaggttcaaaattgttttaaatagttgtggagtggaagatgtggttcccagcctcaggaaactcatgtgcccatttgggatgagtcgagcactttattgatgtcataataacatataactagctaatgtgtagtgaacacttagggccattctgtgcacataatattttttcactgaattgtcaaaataatcctatagagtagggacaatcattttccccatattatagatgaggaaactgaggctcagagaggtgacaggactcgtcccagttatacagacagtaagttgaagagcaagatttgaactcaggcagtggctgaactggctccagagtccttgttcttaaccatttaactctacaacattttggacttgttaaaattggcagctttgcaaaagagagacagaggagagagagaaacaagagtcagagggaaagatagtgacagagatgggcaggaagccaaataggaaaagccaggtagccagacacacaggaacctctgccactgagtagccatatgtgcttatgtcagtcacttaattccctgggccttgttttcctcacctgttaaagagacacagtagcactatttcaggaaaaaaatcaaatctgcatggctacgaaacatgtggagaaaaccccaagtgcatgagaactgggacgaatgccagtaaagcagagagacagacagaaagacacccagtagtctggcaggaatacatctttaaaaggttatctttttaggccaggcgccgtggctcacgcctgtaatcccagcactttgggaggccgaggcgggtggatcacctgaggtcaggagttcgagaccagcctggccaaacatggcgaaaccctgtctctactaaaaatacagaaattagccgggcgtggtggtaggcgcctgtaatcccagctactcgggagactgaggcaggagaattgcttgagcctgggaggcggaggttgcaatgatccgagctcgtgccaccgcactccagcctgagtgacagaactagactccatctcaaaaaaaaaaaaaaaaaagccctctgtcttatttaccaaattcctgcacaacatcggtctgtttctgaattcctgattctcttacgttgatctatttattaaattataagccaattctatgttgttttaatcattgtagtagtttgttttctgtttgtttgtttggttttgagggttttttttttgttttttttttgagacagggtctcactctgtcatccttgctggagtgcagtggcccaatctcagctcactgcagcctccacctcccaggctcaagcaattgtcccacgtcagcctcctgagtagctgggcctataggcacatgcccccatgcccagctaatttttgtattttttgtagagacagggtttcgccgtgttgcccaggctggtcttgaactcctggactcaagcagtctgcccgcctcagcctcccaaagtgctgggattacaagcaagagccaccgcacccagccttaatcattatagttttatgatatgttttcatgttttcctttttaaaaaattttcttgaatattcttgttcacttactgttctttttatttaataaatcagcttattattccattaaaatcctgacgggaatttgattggagtcatatttttaagagaaactaatctttcattacccagtaaatacattcttattaaaaataaaagcattttaaataatgctgaagtctcctgggaacgctatgcctaatctcaatcccctaccctaccctttttgccccgagggaatcggtttgatgtgtaactttgcatgtcctttacttatttacactccctacacacacatttatccacatatgtgagtatattcatatttgcgtgtctgtacacataaacggtatgtgtttaacataaggtattctacacattaatatgtaagtgtccaatatatggagctatcattagacatattaatggcattctcatgatcattttcatggctgtgaaagcaacagacatgttgggactgtttggatggcccagtccctctttctgggaaaaagccagtttctgtcacctctacagttgggagattacaaagcctagacctttgaccaatttgtacttttccgatatgaatcttttttctttttgagactctctttgtcaccaaggctggaatgcagtgacgcaaatatggcccactgcagccttgacctcaagctctcctcctgcctcaggctttcaagtagctgggactacaggtgtgcaccaccatgcccagctaatttttgtattttttgtagagacatggttttgccatgttggccaggctggtctcgaacttctgacctcaagtgatccacccacctcggcctctcaaagtgtttggattacaggcgggagccaccgtgcccagcccccaacctcctttctatcataggtactgcaaatatttttcccagttgatcttttgttttttggctttgcttacgggatggatctgttttgtcctatcaaaattaaacatttgattgcacgcctacacagatatctatctttttctttatgatttctgagtttctcctttttattgcaggtggagggacagagtttcactctcattgcccaggctggagtgcgatggcgcgatctcggctcactgcaacctccgcctcctgggttcaagtgattctcctgcctcagcctcccaagtagctgggattacaggcatgtgccactacacctggctacttttgtatttttagtagagatggagtttcaccatgttggtcaggctggtatcgaattcctgatctcaagtgatccacctgcctgggcctcccaaagtggtgggattacaggcatgagccactgtgcctggctgagtttctcctattactttggaacatgttccccatccataagcttatacaaatattctatattttcttctactatgcttattgttttcttttttacatataaatcttttctctgtcagcattgtgataagcagacctagctttaaaaaaatcaagatagtcaattatgccagcatcattttttttaatttaatttttttttttgagacgaagttttactcttatcgcccaggcaggagtgcagttgcacaatctcagctcactgcagccgccgtctcctgggttcaagcaattctcctgactcagcctcccaaatagctgggattacaggtgcccgccaccatgcctagctaatttttgtatttttagtagagatgaggttttgccatgttggccaggttggtgtcgaacttatgacctcaggtgatccacccacttcagcctcccaaagtgctgagattacaggcatgagccactgcgcccggcctgccagcatcatttattaaataatcaccttttctgcagtgattcgaaatgccacgtttgtcacatattcagtttccatatatacaagcttggatttatttctgggctttctattgcattctaccaatgggctctatttgtctactgctgtgctaacaccatgttatttttatgacagtggttttgtggtcaaatttttttttttttttgagatggagtctcgctctgtcgcccaggctggagtgcagtggcgcaatctcaactcactgcaagctccgcctcccgggttcacgccattctcctgcctcagcctccctagtagctgggactacaggcgataagcttttgccatcctcccactgttctttgtcttaactttttttttttttttggagatggagtcttgctctgtcgcccaggctggagtgcagtggcacaatcttggctcactgcaagctccacctcctgggttcacgccattctcctgcctcagtctcccaagtagctgggaccacaggcgctcgccaccacgcccggctaatgttttgtatttttagtagaggcagggtttcaccgtgttagctaggatgatctcgatctcctgacctcgtgatccacccacctcggcctcccaaagtgctgagattacaggcatgagccaccgcgcccagcctgtcttagctattcttaaatgtgaattcttctatagaaaccttaagataattttatccggttccaggaaaaacccccattcaatttctgactggcattgcactgagtttatatattaatttagggtttgggaagtttgacaattttatgataaggaaatgcgcgtatcatgaatattatgtaataccacaagcagggtctgggccagcagccaagcagcccacaatgaaacacttggatgtttcttcagggaaatgtgtgcatattcacactacgtgggttatataaagactatatatagtctcctgtcagttcagatcaggttttgctactaggtgagtttgtgtttgtagacattctttgcctgttttttgtttgtttgtttgtttgtttttttgagacactctgttgccaggctggagtgcagtggcacaattccggctcactgcaacctctgcctcccaggttcaagcgattctcctgcctcagcctcttgagtagctgagattacaggcacgcgccaccacgcccagctaatttttgtatttttagtagagacggggtttcaccatgttggccaggacggtctcgatctcttgaccttgtgatccgcccgccttgcttctcaaagtgctgggattacaggtgtgagccactgcgcccggccttttttttcctttttttgagagggagtctcacattgttgcccaggctggagtgcagtggcgcgatctcagctcactgtaacccctgcctcccaggttcaagcgattctccttacctcagcctcccaagcagctgggattacaggcacctgccaccacacctggctaatttttttttgtattttttagtagagatggggtttcaccatgttggccaggctggtctcaaccttgtgatccgcccacctcagcctcccaaagtgctgggattacagacgtgagccaccgcgcctggcctctgcctgttttattagtgggattgagggggtggtttttttaatcagtataaaatgtctctttgtgttaaatgcttttggccttgagtgatgctttttctgacattctcatggctactatttttttctgtttgtgtttaccagatatacctttaggattctttaatttttaacctttttgtgtcacctagttttaggtatgtctctcatacctctcgtaaaaacgtcatagcagaatttatgctttttaaggcaactgacagtgaaatcttttttttttctttttgacacgtagtctcgctctgtcgcccagactggagtgcagtggcacgatctcagctcgctgcaacctctgcatcctgggttcaagcaattctcctccctcagcctcccgagtagctgggattacaggcacacaccatcatgcccggctaatttttttttttttttttttgagatggagtttcgctctgtcgcccagactggagtgcagtggcacaatcttggctcgctgcaacctctgcatcctgggttcaagcaattctccctcagcctcccgagtagctgggattacaggcgctcaccatcacacctggctaattttttgtatttttagtagagacggggtttcaccgtgttagccaggatggtctcgatctcctgacctcatgatctgcctgcctcggcctcccaaagtgctgggattatagtcgtgagtcactgcaccccgccccaacagtgaaatctttaggccactttttctcctttaatctctcccactttttctggcctttaaaatggagctttggaacacttgtaattcttattcgttttctggtccctaacccttaacttctagcttttgcttagacaacttttttttttttttgagatggagtcttgctctgttgcccaggctggagtgctatggcacaatctcagcttaccgcaacctcctcttcccaggttcaagcaattctcctgcctcagcctcttgagtagctggggtaacagaagcgcaccaccacacccggctagtttttttatatttggtagagatggggtttcaccatgttggccaggctggtcttgaactcctgacctcaagtgatttgcctgcctcggcttcccaaagtgctgggattacaggcatgagccaccacacccagccaattttttttctttttaaattccgggttatcattctgttttcttactaacacactaagtcacttatgtttcaggaatcctaatgtaacatataatattacaaacccccaatcatgttatcgttgtcattttaactataaatattaaatatgtaatatatataatataatatataatatataaatattaccatttaccttcccctttgtctctccctatcttaagcccttctagtcatgcaggagtcatttgctcagagaacttctttgttctcctccaaaagtgcatgggttagatgtactctaatggccaaaaatgtttttatttggctgaatagatctgtactgtcttggctgggtgtggggcccttggatctcaggtctttcttcttagtgctccataggtgctgtgagctactgtcttattgcctccagggttgtgaagcagaagtctgttgcttgtctgaccttctttccattgtaagcagccgttttttgtctctggaagctgcaagagtttttctttttcttttttttttttttttttttttgaggcaggatctctatttcccaggcgggagtgcagtgacgtgatctcagctcactgcaacctctgcttcccaggttcaagcgatcctcccacccacctcagcctcccgagtggcagggactacaggtgtgcgccaccatgcccagctaatttttatatttttgggtagagacagggttttatcatgttcagcccaggctggttttgaactctcgggctcaagcaatccgcccgccttggcctcccaaagtgctgggattaggctgggcatggtggctcatgcctgtaatcccagcactttgggagaccgaggtaggcggatcacttgaactcaggagttcgagaccagcctggccaacatggtgaaaccccgtctctactaaaaatacaaaaatttgccaggtgttgtggcgcacacctgtagtcctagctacttgggaggctgagacaggagaatcgcttgaacccgggaggcggaggttgcagtgagccaagatcacgccactgcgctccagcctgggcaacagagcaagactctgcctcaaaaaaaaaaaattgctgggattacaggcatgagccattgcgcccagtctaagagtttttctttattcttagaatttgggcatttcgggctgggcgcagtggctcacgcctgtaatcccagcactttgggaagctgaggcaggcggatcacttgaactcaggagttcaagaccagcctggccaatgtggcaaaaccctgtctttactaaaaatacaaaaattagcaaaaattagccgggcgtggtggtatgcccctggaatcccagctacttgggaggctgaggcaggagaatggcttgaacccaggaggcggaggttgcagtgagccgagatcataccattgtgctccagtctgggtgacagagcaagactccatctcaaaaaaaaaaaaaaaaaaaggatagggttggtggggggcctgttgtgtgttgttagttaattaatcctatctaagacttggtgagccattccttcatctcagggaaattttctttcatacttgtttaattctgacatctccacctgatcccttttctccccctgcatttcctattatttccatatttggtctcctggacttggcatccaggtctctctactttttcactcaaatcattgaaccttagctccatgccttgcagtggttcttctgttcagactttcagaccattactgatttttcataatgtgaccttcttcattttacctgttaagtgttttaatgctctgattaatgttttagaaagaccattctggcagctgttgggagagattggagaggaatacagaggaagtgaggactggttaggaggcagtttcaggtgagagatatggtggctcagacagggtgagaagatggagatgagagaacaggtaggatggaggaatgctttacatgcagtagccgtaggacttggcggtggtttggacctgggagttaagagagtgggagggggacaaggatgtctctcaggtttctggtctattaaacaactgaacagatagagatgctgtttgttgagatgaggagtagaggaggaggccatgtctagagtggatcttgggctcctctctttggaccccttaggtttgcagtaccccatgagacatccagggaaaagcagtgacatgcaaacatggcctagggtttgttccccccctcagctctatgggaaaattgggctccatgggaatgctgtttagggatggcatttgcttgcaaatgacagtggcttaaacagatagaagttgattggtttcacacaaaagagtttgaaagttagccacttgggccggatgcagtggctcacgcctgtaatcccagcactttgggaggccaaggtgaagggggcctgcccctccacacttgtgggtatttctcgttaggtggagacgagagattgagaaaagaaataagacacagagacaaagtatagagaaagaacagtgggcccagggtaccggcacactcagcatgcgaggacctgcaccagcgccggtctctgagttccctcagtatttattgatcactatttttactatcttggcaaggggagtgtggcagggcaacagagtgttggtggggagaaggtcagtagggaaacatgtgagcaaaggaatctgtatcatgaataagttcaaggaaaggtactgtgcctggatgtgcatgtaggctagatttatgtttcactttacacaaatatctcagtgtagcaaagagtaacagagcagtattgctgccagcatatctcgcctccagccacggggcaattttctcctatctcagaatagaacgaatggtcggctttacaccgagacattccattcccagggacaagcaggagacagaagccttcctcttatctcaactgcaaagaggactccctctttcactactcctcctcagcatagaccctttatgcgtgtcgggctgggggatgtaaggtctttcctttcccacgaggccatatatcaggctgtctcagtgaggggaaactttggacaatacccaggctttcttgggcagagttccctgtggctttccacagtgcattttgtccctggttaatagagaatggagaatggcgatgacttttaccaagcatactgcctgcaaacatattgttaacaaggcacatcctgcatagccctaaatccattaaaccttgattcaatacagcacgtttctgtgagcacatggttggggctaaagttacatacagattaacagcatctcaaaccagaacaatttttcttagtacagatcaaaatggagtttcttacatcttccttttctgcatagacacagtaacaatctgatctctctttcttttccccacataaggcgggtggatcacctgaggtcaggagttggagaccagcctggcaaaccccatctctactaaaaatacaaaaaattagccaggcgtggtggcaggcacctgtaatcccagctactcgggaggctgtggcaggagaattggttgaacctgggaggcagaggttgcagtgagcgaggatcacaccattgcacgccagtgtgggtgacagaacaagactccgtctcaaaaaaaaaaaaaaaaaaaaaagccagccactggacattgccattgttggcttagtagccctctcgtatcagggctgtaggagaggatctctgaagatcctctcgaacctactctcagatggccactgctgcttcaaccaccacatcttatgtgaggtgggaagaaagaatgcggggcaaaatgaaaaagaaagagaaacggtcaggtgcagtggctcacacctgtaatcccaacactttgggaggccaaggcaggaggatctcttgagcccaggagttcaagaccataggcaatatagtaagatcccatctctaccaaaaaaaaaaaaaatcatccacgcatggtggcacacgcctgtaagccccagctactcaggaggttgaggcaagaggatcgtttgagcccaggagtttgaggctgcagtgagctatgatcgcaccactgcactccagccttgggggacagagcaagactgtctcaaaaaaagaaaaaaaagatgcctgtaatcctagcactttgggaggccaaggcgggctgatcacctgaggtcaggagttcgagaccggcctgggcaacatagcgaaacctcatctctactaaaaatacaaaaattaggccaggtgtggtggctcatgcctgtaatcccagtaccttgggaggccgaggcaggtggatcacctgaggtcgggagttcgagaccagcctgaccaacatggagacaccccgtctctactaaaaatataaaattcaccaggcatggtggtacatgcttgtactcccagctactcgggaggctgaggcaggagaatcacttgaacccaggaggtggatgttgcagtgagccgagatcccgtcattgtactccagcctgggcaacaagagtgaaactccgcctcaaaaaaaaaaaaaaaattagctggacctggtggcaggcacctgtaatcccagctacttgggaggcttaggcaggagaactgcttgaacccaaaaggtggagtttgtagtgagccaagattgcaccactgcactccagcctgggcgacagagtgagactccatctcaaaaaaaaaagaaaaaagaggctgggtgcagtggctcacgcctataatcccagcactttgggtaggccaaggcgagtggatcacgtgaggtcaggagttcaagaccagcctgaccaacatggtgaaactccgtctctactaaaaatacaaaaattagctgggcatggtggcaggcacctgtaatcccagctactcgggaggctgaggcaggagaatcacttgaaaccaggaggcagagtttgcagtgagctacgttcacaccactgcattccaccctcggttacagagtgagactccgtctccaaaaaaaaaaaaaaaaaagcatatacggcatacctgttccacttttgcacaaatattttatttctaaagtatgtctgggctctggactagggtgaatgaagttcagatcccagccctactatttcctggctgtagaatcttggtcacttactatttgttccaaacctttttgtcatcgtctgtaaaatgagaatggtaatattagcgtgcactgtttgtgggaggaggactggcaaaaatatgagagtaggagtttgggctcttgagcttgggcctggccttcaaatttccactctttcactcactagctaaggggccttgggcaagtaccttatcatgactgtgcctgtttcctcaaagagagtcatggtagtagtagtactcaaccgataggactgaagtgactattgcatgagtcagtattggcaaagaattcagaatagttcctggcatacagcactgtggaagcattagctagtattattatttcttatattgctgttgagcgcttgtcctagtgcttggcacatagtaactgctcaataaatattactttatatcattaaaatattagaggctgcccagccagttcctgagacatctactacaaaagaattgttcatggtttgattttgttttttacatgatttggatgatacaggaagagggactgggagttgtttgttcccctgcaggtagcccggcttcagtagaaggagaggaagccggccctgaggtctgggttatcatccccattcttatagcactttgttctgtttgcccaggcccattgctagaagactgggacataatcagccccaaagatgtcattggctccgacgtgttgctggctgagaaacggtcatcactgacgactgccgccctgccctttacacagtccatcctcactcaggtgttttcagggaccctagggacccagctgtggttggagggcagagccttcctggcaccctggttctgagcatgctggttggcatctgcccctagtccacacagctgatggtggcctccctccctcctcataggtgggccgtaccttgtctaaggtccaacaagtgctgagctggtcgtatggggaagatgtcaagcccttcaagccacccctgagcgatgctgagtttcacacgtacctgaaccacgagggccagctctcccgacccgaggagttgcgcctgcggatctatcatggcggtgtggagccctcgctgcgaaaggtgagcatcctcagtcatctgttgggtccatcactgctgcactcattaacagctcctgagacacatgcagtcagccacactgctgtgggcaagggtggagatgttacagggcacgaagttctctttaaggaggggcgagcagtcggaggcctagcagacttagaaggaagacagaggcccaaggggggtgggtgggtggcaactgatagacattggggtatggtttatctggagaactccagcctcatccctttcacccctgggcaggtggtgtggcggtacctgctgaacgtgtatccagatggactgacaggccgagagcggatggactacatgaaacgcaagagccgcgagtatgagcagctcaagagcgagtgggcccagcgagcgaaccctgaggacctggaattcatccgcagcacggtcctcaaggatgtactgcgcactgaccgggcccacccctactatgcggggcctgaggatggcccacatctacgggcgctgcacgacctgctcaccacctatgccgttacccacccacaggtgtcctactgccagggcatgagtgaccttgcctcacccatcctcgctgtcatggaccatgagggccatgcctttgtttgcttttgtggcatcatgaaacgcctggccgccaacttccaccctgacggccgcgccatggccaccaagtttgcacacttgaagctgttgctgcgacacgctgaccctgacttttatcaatacctgcaagaggcaggcgctgatgacctcttcttctgttaccgctggctgctgctggaactcaagcgtgagttcgccttcgacgatgccctccgcatgcttgaggtcacttggagttcgctgccccctgatcctcctgaacatgaggtagagctggttggaccccccagccaagtggcagacgctggttttggtggccacagggggtggcccgtgcgacagaggcacatgctgaggcctgctggtggaggaggtagtacctttgaagatgctgttgaccacctggccacagccagtcaggggcctggtggtggggggcgtctcctgagacaggccagcttggatggcctccagcaactcagggataacatgggctccaggagggaccctctggtccagctgccccacccagctgcccttatcagctccaagtccctctctgagcctttattgaactccccagacccactgctctcctccttttcccaccctgattccccatcttcctcatctccaccatccacccaggaggcctctcccactggtgatatggctgtaggatcccccttgatgcaagaggtaggctccccgaaagaccctggaaagtccctgccacctgtaccaccaatgggcctgcccccaccccaggagtttggccgggggaacccattcatgctgttcctctgcctggccatcctgctggagcaccgcgaccacatcatgcgcaatgggctggattataatgagctggccatgcactttgaccgccttgtgcgaaaacaccacctggggcgcgtcctgcgccgggctagggctctctttgctgattacctgcagtcagaggtgtgggactcagaggagggggctgaggccacagccgcatcttgatcaggctttctcaagccctccatcggccccaccagatctccattctttgccatgagggccaacacatgagaccccacctccctccctgcctgccagccctagacttgttggagcatagagcccttcctccccaggcctaagtatgtggagctctgctttggcactgccccgcagaggccacgcctatttattctgtttctgttgttttgtttttaacaactatactttgcacacatgaa

SEQ ID NO: 225 - DNA, 21541 bp, mus musculus; identical to SEQ ID NO: 224

SEQ ID NO: 226 - DNA, 21465 bp, mus musculus
gtgcgccggggtggggggcaacggtcagccgtcaccctgagacgggcggcggcgggatggcaacagcctccggggcctcggacttgtctggctccggagcgcccccgcccggtgtgggagctcaggcggcggcggccgctgaggaggaggagcgagaggtggtgcgggtccgagtcaaggtgaggctggcggtgagtcggcccagccgccgaggcatcccaggggagggggaggcggtggctgtcataggatggagggcgggacctgagatttcggacataacctgagcggcgaagcttgagggccaagtgatgatggcgaggggtagggagggcctgagagcctgagagcgttagcgacgtaccttggggcgtgggactgaaaatagagggacgaggcgggggtctatgggatgaatgggtggagcttatagacaaaggggaggggctatggggctggaggaggggccgcagtagttgagggtggggctctgaggaatgagaaggtgctggctctggagtcagtcaacccatgtgttgagagtgcacttatgtgcaagttcccactttgatgagctgacaggctcgtgggtggagacaactaaagaaatgagatgcttcggacactaaaataatgaaaaaggttatgaaatagggagtcacgttagccaaggttgtacagggaaatccccagaggaggtattgaaggagcagagacccgaataaaaggagtcagccatgtgcatattagaagggaagagtattctaggcagaaggaatagcaagggcaaagactagaggatgggaatgagcctggcatgttcccgtaggttcctgattgctggagtggagagaatgaggggaagagtggtaggaggtgaatcagagcgctaagacagagacagatcgccaagggcctttggtgtgtatgctgaggaagaacgctgttgccatagttccagtaaacaatgatggtggctccgaccaaccagtggcactggcagtgataagagggtccacacatcacttcagtgtaatagagctctaaggtagaagtttgacattcagaaaaaagatgatgcctgagctgggcgtgaaccacgtgaagaaagtgggagggatgttccagacaggggatcagcacaatcaatggcctggagtcaggatggtttcaaggtaacttctaacagtttggtactactagagtgtaaagttcaaaaaacctggtgagaggctggctggggccccataggcccgcttgctgggactctagggttgccattgaagagattgaagcaggggagtgttgtaggtagatgtgttagattggttacagcaccatagaggactgatttaacaggagccagactggacacggtgattctggcaaccatagttgaagggatatagaagaaggattgggggcctgaactcttgcagtagcctcctcctcactggaccctgtggtccagaacacctgccttgatctggcccctggcacctctctgactttgccttctaccactctgcacctcactcttcagcatggtgatggggcccctggtggcctaccccatgtcttctctccccagaaatgtgagagcttcttgccgccagagttccgctcttttgctgtagatccccagatcacctcgctcgacgtgttgcagcacatcctcatccgagcctttgatttgagtgggtgagtgggaagatgctggggactggccagtgggccaccgacctctacagtggctatctggcctttgtttggtagggtttttgtttattttactactacaaataatcccacagtgaacagccacgtatgcatgtcttggagcacagtagtctacttttgtctgtggttttgctttctgcagtttcagttacccatggtcaacctcagtctgcaaatattacatacaataagatattttgagagagagagagagaccacattcatattacttttattacagtttacagacagtccccaacttacaataactggacttaggatttttcaactttacaatggtgcaaaagcgatacgcatttggtagaaactgtactgcaagtgcccagcgattctgcttttcactttcagtacagtgttcaataaattacatgaaatattcaacactgttgtaaaacagactctgtgttagatgattttcccaactgtaggctaatgtgagcgttctgagcacgtttaaggtaggctaggctaacctgtgatgtttggtaggataaatgtgttaaatgcattttcctttttatttctttttttttttttttttgagatggagtctaactgtcacccaggctgcagtgcagtgacatctcccaggttcaagtgattctcctgtcacagcctcccaagtagctgggactacaggcatgcaccactatgcccggataattttttttttttttttttttgagacggagttttgctcttgtcccccgggctgcagtgcagtggcgcagtctcagctcactgcaacctccgcttcccgggttcaagtgattctcctgcctcagcctcccaagtagctgggattacaggcacgcaccaccacgcctgctaatttttgtatttttattagagacaaggtttcaccatgttggtcaggctagtctcgaacacctgacctcaagttacctgtccacctcggcctcccaaagtgctaggattacaggtgtaagcccccgcacccagtcccagatagttttttgatcttctcttttttttttttttggagacagagtctcactctgtcacttaggttggagtgcagtggtccgatgttggctcattgcagcctttgcctcccgggttcaagtgattctcatgcctcagcctccagagtagctgggattacaggtgtgcaccaccacactcagctaattttcatgaggttggtcaggctggtctcaaactcctgatctcaagtgatccgcccacctcggcctcccaaagtgttaggattacaggcacgtgagcctccgcacccggccaattttttgtatctttagtagagacagggtttcgccatgttgcccagggcagtctcaaactcctgagctcaagcaatccgcccgcctcagcctctcaaagtgctgggattacaggtgagccactgcgcccagccaaatgcattgtcaacttacagtatttccaacttacgatgagtttattggtacataaccctgtcataagtcaagaagcatctgtattgtcataattgttctattattgttaatctcttactgtgcctaatttatcaattaaaccttatcataggtatgtatgtatatgaaaaaaaacatagtatatatagggcttggtactatctgcagtttcaggcatccactcgggggggtcttggaatgtatcccctgtagataaagagggactactgtatttggaaacatctagtcataggataaattcctagcagtggtattgccaggtaaaagggtatttgctttaaaaaaaattttttttttgagacagtctcattctgtcgtccaggctggagtgcagtggtgtgatctcgtctcattgcaacctccacctcctgagttcaagcaattctcctgcctcggcctcctgagtagctggtactacaggcgtgcgccaccatgcccggctaatttttgtatttttagtagagatggggtttcaccgtgttggccaggatcgtctcgatctcctgacctcgtgatccacccgcctcagcctcccaaagtgctgggattacaggcatgagccaccgcacctggcctgctttttgaactattaatgggtgtttccaaaatgctctccagacaggttttatcaatttatgatctcagccgggcgctgtggctcatgcctgtaatcccagcactttgggaggctgaggcaggtggatcacgaggtcaggagatcaagaccatcctggctaacacggtgaaactccgtctctactaaaaatacaaaaaattctccaggcgtggtggtgggcgcctgtagtcccagctacttgggaggctgaggcaggagaatggcatgggcccgggaggcggagcttgcagcgagccgagatcgcaccattgcactccagactgggcgacagagtgagactccgtctcaaaaaaaaaaaaaaacgaatttatgatctcatcagcagcacataaatgcctgtttccctcacaccctcgcaaacattggttactgtaaaactgcaaaatttgccaatctgatagctgaaaagtggtgtctcttgggggcagatgtgatagtcattttgttgtgattttggaggaatacatacacatggtaagaaattcaaacagtacacaattgttgggtatttaggatgtttccatggttatgatgagcatcacgcaacaaacttctttacatagttgcacaagtatagctgaaaaattcttagttgttattagactttcttacataaacatttttgttgtgaaaaataacaaacacagattgctttttttttatgtagtaagaaggctgctttcttcccacttctgtcccacatctaccccagaggggaccaacttttttttttttttttgagatggagtcttgctctgtcacccaggttggagtgcaatgccacaatcttggctcactgcaacctccacctcccaggttcaagcgattctcctgcctcagcctcctgagtagctgggattacaggcacctgccaccacacccagctaattttttttgtatttttagtacagaaggggtttcaccatgttgaccaggctagtctcaaactcctgacctcaggtgatccacccacctcggcctcccaaagtgcggagattataggcgtgagccactgcacccggccaacattttaccagtttccaatgtgacctccagatacaagcaggtgtgtacctgcttgtatgtgtttgtgtaacaaagtgggtataaatgacctgatctcaggctgcccataatccttggcacagtaccttgcacatagtaggaagttgttttcaacgccttctatattaccctccttgttttggaaactgtccctgaggcctccagggcaccaggggccctgagagctccctcgtatcccctgtccaggaagaagaactttggcatcagctacctgggccgggaccggctaggacaggaagtttacctctcacttctatctgactgggacctcagcacagcctttgccactgcctccaaaccttacctgcaattgcgtgtagatattcggccctcggaggacagtgagtactcagtgcccccaggagcactgctctggaacccctttaccccatagggtgatgctacccctcacagtacactccctcatggtgggatgggtagcaaggtatcctagctatagatcctggctcagccactaggccacaatttcttcacttgtaaagagataattgtatcttagaaccattgtgaggccttgtatcttagaaccattgtgaggggaaattcatataaaatgcctggaacagtgcatgactgcataatgaaggctcagaaagtgttatctctaataatgataattatattgtattatactattataacatataaccgagtaatgtatgtaataattagatataatgcagatttataatatagtataacggtatagctttagcattatgtatttcagttataatacctaaatataacaatgcgtattataataatgctagttgtgtttattcattcagtcattctgcacccatattcatttgtttgtattcttgctcactcattcatttgttcccttgacctctcagccactttttctcttctcatctttgttcttccactcttgcctattctggtccctgcgagcacacagataaattaggacgtggtctcaaaatttgattacagaccatacattagataattgtatcagtattaaatttcctgggtgtgtgtcttagtcgttttgtgctactataacagaataccacagactgaggaatttgtaaagaagagaaatttatttctcacagttttggagactgggaagtccaagatcaaggtgctggcaggttgtgtgtctagtgagggctttcttgctgcatcctcacatgacagaagagcagaagagagtgaacccacaccctcaacctctttataagagcccaaatccgctgggcacggtggctcatgcctgtagtcccagcactttgggaggctgaggcaggcggatcacctgaagtcaggagttcgagaccatcctggccaacatggtgaaaccctgtctctactaaaaaaaatacaaaaattagccgggtgtagtggcacatgcctataatcccagctactcgggaggctgaggcatgagaatcgcttgaacccgaaaagcagaggttgcagtgagccaagatcttgccactgcactccagcctgggtgacagagcgagacttcatctcaaaaaaaaaaaaaaaaagaggctgagcacggtggctcacgcctgtaatcccagcagtttaggaggccgaggcgggcagatcacaaggtcaggagatcgagaccaccctggctaacacggtgaaaccctgtctttactaaaaatacaaaaaaatagccgggcgtggtggcgggtgcctgtagtcccagctactcgggaggctgaggcaggagaatggcatgaacccgggaggcggagcttgcagtgagccaagatcgcaccactgcactccagcctgggcaacagagcaagactccatctcaaaaaataaataaaataaaaaataaaaaaagagccctaatcccatctgtgagagctctaccctcaggacttaatcacctcttaaaggcccccacctcttaatatgatcacattggtaattaaattgcaacacatgaatttggaaggacacattcaaaccatagcagtgtggtagtggtatcatatctattgaaggaaaatatccttgttcttgggaaagacacagttaagtatgaaggggtaaaatgtcatgatgtctgcaaataagttggcaaaaataatgtgtttatatacagagagagtgagataaagcaaatgtggcccaaaaaaatgttaatagaggatctagatgaagtatgtatgggtgttcagtgtattcttttaactttattgtaggttcaaaattgttttaaatagttgtggagtggaagatgtggttcccagcctcaggaaactcatgtgcccatttgggatgagtcgagcactttattgatgtcataataacatataactagctaatgtgtagtgaacacttagggccattctgtgcacataatattttttcactgaattgtcaaaataatcctatagagtagggacaatcattttccccatattatagatgaggaaactgaggctcagagaggtgacaggactcgtcccagttatacagacagtaagttgaagagcaagatttgaactcaggcagtggctgaactggctccagagtccttgttcttaaccatttaactctacaacattttggacttgttaaaattggcagctttgcaaaagagagacagaggagagagagaaacaagagtcagagggaaagatagtgacagagatgggcaggaagccaaataggaaaagccaggtagccagacacacaggaacctctgccactgagtagccatatgtgcttatgtcagtcacttaattccctgggccttgttttcctcacctgttaaagagacacagtagcactatttcaggaaaaaaatcaaatctgcatggctacgaaacatgtggagaaaaccccaagtgcatgagaactgggacgaatgccagtaaagcagagagacagacagaaagacacccagtagtctggcaggaatacatctttaaaaggttatctttttaggccaggcgccgtggctcacgcctgtaatcccagcactttgggaggccgaggcgggtggatcacctgaggtcaggagttcgagaccagcctggccaaacatggcgaaaccctgtctctactaaaaatacagaaattagccgggcgtggtggtaggcgcctgtaatcccagctactcgggagactgaggcaggagaattgcttgagcctgggaggcggaggttgcaatgatccgagctcgtgccaccgcactccagcctgagtgacagaactagactccatctcaaaaaaaaaaaaaaaaaagccctctgtcttatttaccaaattcctgcacaacatcggtctgtttctgaattcctgattctcttacgttgatctatttattaaattataagccaattctatgttgttttaatcattgtagtagtttgttttctgtttgtttgtttggttttgagggttttttttttgttttttttttgagacagggtctcactctgtcatccttgctggagtgcagtggcccaatctcagctcactgcagcctccacctcccaggctcaagcaattgtcccacgtcagcctcctgagtagctgggcctataggcacatgcccccatgcccagctaatttttgtattttttgtagagacagggtttcgccgtgttgcccaggctggtcttgaactcctggactcaagcagtctgcccgcctcagcctcccaaagtgctgggattacaagcaagagccaccgcacccagccttaatcattatagttttatgatatgttttcatgttttcctttttaaaaaattttcttgaatattcttgttcacttactgttctttttatttaataaatcagcttattattccattaaaatcctgacgggaatttgattggagtcatatttttaagagaaactaatctttcattacccagtaaatacattcttattaaaaataaaagcattttaaataatgctgaagtctcctgggaacgctatgcctaatctcaatcccctaccctaccctttttgccccgagggaatcggtttgatgtgtaactttgcatgtcctttacttatttacactccctacacacacatttatccacatatgtgagtatattcatatttgcgtgtctgtacacataaacggtatgtgtttaacataaggtattctacacattaatatgtaagtgtccaatatatggagctatcattagacatattaatggcattctcatgatcattttcatggctgtgaaagcaacagacatgttgggactgtttggatggcccagtccctctttctgggaaaaagccagtttctgtcacctctacagttgggagattacaaagcctagacctttgaccaatttgtacttttccgatatgaatcttttttctttttgagactctctttgtcaccaaggctggaatgcagtgacgcaaatatggcccactgcagccttgacctcaagctctcctcctgcctcaggctttcaagtagctgggactacaggtgtgcaccaccatgcccagctaatttttgtattttttgtagagacatggttttgccatgttggccaggctggtctcgaacttctgacctcaagtgatccacccacctcggcctctcaaagtgtttggattacaggcgggagccaccgtgcccagcccccaacctcctttctatcataggtactgcaaatatttttcccagttgatcttttgttttttggctttgcttacgggatggatctgttttgtcctatcaaaattaaacatttgattgcacgcctacacagatatctatctttttctttatgatttctgagtttctcctttttattgcaggtggagggacagagtttcactctcattgcccaggctggagtgcgatggcgcgatctcggctcactgcaacctccgcctcctgggttcaagtgattctcctgcctcagcctcccaagtagctgggattacaggcatgtgccactacacctggctacttttgtatttttagtagagatggagtttcaccatgttggtcaggctggtatcgaattcctgatctcaagtgatccacctgcctgggcctcccaaagtggtgggattacaggcatgagccactgtgcctggctgagtttctcctattactttggaacatgttccccatccataagcttatacaaatattctatattttcttctactatgcttattgttttcttttttacatataaatcttttctctgtcagcattgtgataagcagacctagctttaaaaaaatcaagatagtcaattatgccagcatcattttttttaatttaatttttttttttgagacgaagttttactcttatcgcccaggcaggagtgcagttgcacaatctcagctcactgcagccgccgtctcctgggttcaagcaattctcctgactcagcctcccaaatagctgggattacaggtgcccgccaccatgcctagctaatttttgtatttttagtagagatgaggttttgccatgttggccaggttggtgtcgaacttatgacctcaggtgatccacccacttcagcctcccaaagtgctgagattacaggcatgagccactgcgcccggcctgccagcatcatttattaaataatcaccttttctgcagtgattcgaaatgccacgtttgtcacatattcagtttccatatatacaagcttggatttatttctgggctttctattgcattctaccaatgggctctatttgtctactgctgtgctaacaccatgttatttttatgacagtggttttgtggtcaaatttttttttttttttgagatggagtctcgctctgtcgcccaggctggagtgcagtggcgcaatctcaactcactgcaagctccgcctcccgggttcacgccattctcctgcctcagcctccctagtagctgggactacaggcgataagcttttgccatcctcccactgttctttgtcttaactttttttttttttttggagatggagtcttgctctgtcgcccaggctggagtgcagtggcacaatcttggctcactgcaagctccacctcctgggttcacgccattctcctgcctcagtctcccaagtagctgggaccacaggcgctcgccaccacgcccggctaatgttttgtatttttagtagaggcagggtttcaccgtgttagctaggatgatctcgatctcctgacctcgtgatccacccacctcggcctcccaaagtgctgagattacaggcatgagccaccgcgcccagcctgtcttagctattcttaaatgtgaattcttctatagaaaccttaagataattttatccggttccaggaaaaacccccattcaatttctgactggcattgcactgagtttatatattaatttagggtttgggaagtttgacaattttatgataaggaaatgcgcgtatcatgaatattatgtaataccacaagcagggtctgggccagcagccaagcagcccacaatgaaacacttggatgtttcttcagggaaatgtgtgcatattcacactacgtgggttatataaagactatatatagtctcctgtcagttcagatcaggttttgctactaggtgagtttgtgtttgtagacattctttgcctgttttttgtttgtttgtttgtttgtttttttgagacactctgttgccaggctggagtgcagtggcacaattccggctcactgcaacctctgcctcccaggttcaagcgattctcctgcctcagcctcttgagtagctgagattacaggcacgcgccaccacgcccagctaatttttgtatttttagtagagacggggtttcaccatgttggccaggacggtctcgatctcttgaccttgtgatccgcccgccttgcttctcaaagtgctgggattacaggtgtgagccactgcgcccggccttttttttcctttttttgagagggagtctcacattgttgcccaggctggagtgcagtggcgcgatctcagctcactgtaacccctgcctcccaggttcaagcgattctccttacctcagcctcccaagcagctgggattacaggcacctgccaccacacctggctaatttttttttgtattttttagtagagatggggtttcaccatgttggccaggctggtctcaaccttgtgatccgcccacctcagcctcccaaagtgctgggattacagacgtgagccaccgcgcctggcctctgcctgttttattagtgggattgagggggtggtttttttaatcagtataaaatgtctctttgtgttaaatgcttttggccttgagtgatgctttttctgacattctcatggctactatttttttctgtttgtgtttaccagatatacctttaggattctttaatttttaacctttttgtgtcacctagttttaggtatgtctctcatacctctcgtaaaaacgtcatagcagaatttatgctttttaaggcaactgacagtgaaatcttttttttttctttttgacacgtagtctcgctctgtcgcccagactggagtgcagtggcacgatctcagctcgctgcaacctctgcatcctgggttcaagcaattctcctccctcagcctcccgagtagctgggattacaggcacacaccatcatgcccggctaatttttttttttttttttttgagatggagtttcgctctgtcgcccagactggagtgcagtggcacaatcttggctcgctgcaacctctgcatcctgggttcaagcaattctccctcagcctcccgagtagctgggattacaggcgctcaccatcacacctggctaattttttgtatttttagtagagacggggtttcaccgtgttagccaggatggtctcgatctcctgacctcatgatctgcctgcctcggcctcccaaagtgctgggattatagtcgtgagtcactgcaccccgccccaacagtgaaatctttaggccactttttctcctttaatctctcccactttttctggcctttaaaatggagctttggaacacttgtaattcttattcgttttctggtccctaacccttaacttctagcttttgcttagacaacttttttttttttttgagatggagtcttgctctgttgcccaggctggagtgctatggcacaatctcagcttaccgcaacctcctcttcccaggttcaagcaattctcctgcctcagcctcttgagtagctggggtaacagaagcgcaccaccacacccggctagtttttttatatttggtagagatggggtttcaccatgttggccaggctggtcttgaactcctgacctcaagtgatttgcctgcctcggcttcccaaagtgctgggattacaggcatgagccaccacacccagccaattttttttctttttaaattccgggttatcattctgttttcttactaacacactaagtcacttatgtttcaggaatcctaatgtaacatataatattacaaacccccaatcatgttatcgttgtcattttaactataaatattaaatatgtaatatatataatataatatataatatataaatattaccatttaccttcccctttgtctctccctatcttaagcccttctagtcatgcaggagtcatttgctcagagaacttctttgttctcctccaaaagtgcatgggttagatgtactctaatggccaaaaatgtttttatttggctgaatagatctgtactgtcttggctgggtgtggggcccttggatctcaggtctttcttcttagtgctccataggtgctgtgagctactgtcttattgcctccagggttgtgaagcagaagtctgttgcttgtctgaccttctttccattgtaagcagccgttttttgtctctggaagctgcaagagtttttctttttcttttttttttttttttttttttgaggcaggatctctatttcccaggcgggagtgcagtgacgtgatctcagctcactgcaacctctgcttcccaggttcaagcgatcctcccacccacctcagcctcccgagtggcagggactacaggtgtgcgccaccatgcccagctaatttttatatttttgggtagagacagggttttatcatgttcagcccaggctggttttgaactctcgggctcaagcaatccgcccgccttggcctcccaaagtgctgggattaggctgggcatggtggctcatgcctgtaatcccagcactttgggagaccgaggtaggcggatcacttgaactcaggagttcgagaccagcctggccaacatggtgaaaccccgtctctactaaaaatacaaaaatttgccaggtgttgtggcgcacacctgtagtcctagctacttgggaggctgagacaggagaatcgcttgaacccgggaggcggaggttgcagtgagccaagatcacgccactgcgctccagcctgggcaacagagcaagactctgcctcaaaaaaaaaaaattgctgggattacaggcatgagccattgcgcccagtctaagagtttttctttattcttagaatttgggcatttcgggctgggcgcagtggctcacgcctgtaatcccagcactttgggaagctgaggcaggcggatcacttgaactcaggagttcaagaccagcctggccaatgtggcaaaaccctgtctttactaaaaatacaaaaattagcaaaaattagccgggcgtggtggtatgcccctggaatcccagctacttgggaggctgaggcaggagaatggcttgaacccaggaggcggaggttgcagtgagccgagatcataccattgtgctccagtctgggtgacagagcaagactccatctcaaaaaaaaaaaaaaaaaaaggatagggttggtggggggcctgttgtgtgttgttagttaattaatcctatctaagacttggtgagccattccttcatctcagggaaattttctttcatacttgtttaattctgacatctccacctgatcccttttctccccctgcatttcctattatttccatatttggtctcctggacttggcatccaggtctctctactttttcactcaaatcattgaaccttagctccatgccttgcagtggttcttctgttcagactttcagaccattactgatttttcataatgtgaccttcttcattttacctgttaagtgttttaatgctctgattaatgttttagaaagaccattctggcagctgttgggagagattggagaggaatacagaggaagtgaggactggttaggaggcagtttcaggtgagagatatggtggctcagacagggtgagaagatggagatgagagaacaggtaggatggaggaatgctttacatgcagtagccgtaggacttggcggtggtttggacctgggagttaagagagtgggagggggacaaggatgtctctcaggtttctggtctattaaacaactgaacagatagagatgctgtttgttgagatgaggagtagaggaggaggccatgtctagagtggatcttgggctcctctctttggaccccttaggtttgcagtaccccatgagacatccagggaaaagcagtgacatgcaaacatggcctagggtttgttccccccctcagctctatgggaaaattgggctccatgggaatgctgtttagggatggcatttgcttgcaaatgacagtggcttaaacagatagaagttgattggtttcacacaaaagagtttgaaagttagccacttgggccggatgcagtggctcacgcctgtaatcccagcactttgggaggccaaggtgaagggggcctgcccctccacacttgtgggtatttctcgttaggtggagacgagagattgagaaaagaaataagacacagagacaaagtatagagaaagaacagtgggcccagggtaccggcacactcagcatgcgaggacctgcaccagcgccggtctctgagttccctcagtatttattgatcactatttttactatcttggcaaggggagtgtggcagggcaacagagtgttggtggggagaaggtcagtagggaaacatgtgagcaaaggaatctgtatcatgaataagttcaaggaaaggtactgtgcctggatgtgcatgtaggctagatttatgtttcactttacacaaatatctcagtgtagcaaagagtaacagagcagtattgctgccagcatatctcgcctccagccacggggcaattttctcctatctcagaatagaacgaatggtcggctttacaccgagacattccattcccagggacaagcaggagacagaagccttcctcttatctcaactgcaaagaggactccctctttcactactcctcctcagcatagaccctttatgcgtgtcgggctgggggatgtaaggtctttcctttcccacgaggccatatatcaggctgtctcagtgaggggaaactttggacaatacccaggctttcttgggcagagttccctgtggctttccacagtgcattttgtccctggttaatagagaatggagaatggcgatgacttttaccaagcatactgcctgcaaacatattgttaacaaggcacatcctgcatagccctaaatccattaaaccttgattcaatacagcacgtttctgtgagcacatggttggggctaaagttacatacagattaacagcatctcaaaccagaacaatttttcttagtacagatcaaaatggagtttcttacatcttccttttctgcatagacacagtaacaatctgatctctctttcttttccccacataaggcgggtggatcacctgaggtcaggagttggagaccagcctggcaaaccccatctctactaaaaatacaaaaaattagccaggcgtggtggcaggcacctgtaatcccagctactcgggaggctgtggcaggagaattggttgaacctgggaggcagaggttgcagtgagcgaggatcacaccattgcacgccagtgtgggtgacagaacaagactccgtctcaaaaaaaaaaaaaaaaaaaaaagccagccactggacattgccattgttggcttagtagccctctcgtatcagggctgtaggagaggatctctgaagatcctctcgaacctactctcagatggccactgctgcttcaaccaccacatcttatgtgaggtgggaagaaagaatgcggggcaaaatgaaaaagaaagagaaacggtcaggtgcagtggctcacacctgtaatcccaacactttgggaggccaaggcaggaggatctcttgagcccaggagttcaagaccataggcaatatagtaagatcccatctctaccaaaaaaaaaaaaaatcatccacgcatggtggcacacgcctgtaagccccagctactcaggaggttgaggcaagaggatcgtttgagcccaggagtttgaggctgcagtgagctatgatcgcaccactgcactccagccttgggggacagagcaagactgtctcaaaaaaagaaaaaaaagatgcctgtaatcctagcactttgggaggccaaggcgggctgatcacctgaggtcaggagttcgagaccggcctgggcaacatagcgaaacctcatctctactaaaaatacaaaaattaggccaggtgtggtggctcatgcctgtaatcccagtaccttgggaggccgaggcaggtggatcacctgaggtcgggagttcgagaccagcctgaccaacatggagacaccccgtctctactaaaaatataaaattcaccaggcatggtggtacatgcttgtactcccagctactcgggaggctgaggcaggagaatcacttgaacccaggaggtggatgttgcagtgagccgagatcccgtcattgtactccagcctgggcaacaagagtgaaactccgcctcaaaaaaaaaaaaaaaattagctggacctggtggcaggcacctgtaatcccagctacttgggaggcttaggcaggagaactgcttgaacccaaaaggtggagtttgtagtgagccaagattgcaccactgcactccagcctgggcgacagagtgagactccatctcaaaaaaaaaagaaaaaagaggctgggtgcagtggctcacgcctataatcccagcactttgggtaggccaaggcgagtggatcacgtgaggtcaggagttcaagaccagcctgaccaacatggtgaaactccgtctctactaaaaatacaaaaattagctgggcatggtggcaggcacctgtaatcccagctactcgggaggctgaggcaggagaatcacttgaaaccaggaggcagagtttgcagtgagctacgttcacaccactgcattccaccctcggttacagagtgagactccgtctccaaaaaaaaaaaaaaaaaagcatatacggcatacctgttccacttttgcacaaatattttatttctaaagtatgtctgggctctggactagggtgaatgaagttcagatcccagccctactatttcctggctgtagaatcttggtcacttactatttgttccaaacctttttgtcatcgtctgtaaaatgagaatggtaatattagcgtgcactgtttgtgggaggaggactggcaaaaatatgagagtaggagtttgggctcttgagcttgggcctggccttcaaatttccactctttcactcactagctaaggggccttgggcaagtaccttatcatgactgtgcctgtttcctcaaagagagtcatggtagtagtagtactcaaccgataggactgaagtgactattgcatgagtcagtattggcaaagaattcagaatagttcctggcatacagcactgtggaagcattagctagtattattatttcttatattgctgttgagcgcttgtcctagtgcttggcacatagtaactgctcaataaatattactttatatcattaaaatattagaggctgcccagccagttcctgagacatctactacaaaagaattgttcatggtttgattttgttttttacatgatttggatgatacaggaagagggactgggagttgtttgttcccctgcaggtagcccggcttcagtagaaggagaggaagccggccctgaggtctgggttatcatccccattcttatagcactttgttctgtttgcccaggcccattgctagaagactgggacataatcagccccaaagatgtcattggctccgacgtgttgctggctgagaaacggtcatcactgacgactgccgccctgccctttacacagtccatcctcactcaggtgttttcagggaccctagggacccagctgtggttggagggcagagccttcctggcaccctggttctgagcatgctggttggcatctgcccctagtccacacagctgatggtggcctccctccctcctcataggtgggccgtaccttgtctaaggtccaacaagtgctgagctggtcgtatggggaagatgtcaagcccttcaagccacccctgagcgatgctgagtttcacacgtacctgaaccacgagggccagctctcccgacccgaggagttgcgcctgcggatctatcatggcggtgtggagccctcgctgcgaaaggtgagcatcctcagtcatctgttgggtccatcactgctgcactcattaacagctcctgagacacatgcagtcagccacactgctgtgggcaagggtggagatgttacagggcacgaagttctctttaaggaggggcgagcagtcggaggcctagcagacttagaaggaagacagaggcccaaggggggtgggtgggtggcaactgatagacattggggtatggtttatctggagaactccagcctcatccctttcacccctgggcaggtggtgtggcggtacctgctgaacgtgtatccagatggactgacaggccgagagcggatggactacatgaaacgcaagagccgcgagtatgagcagctcaagagcgagtgggcccagcgagcgaaccctgaggacctggaattcatccgcagcacggtcctcaaggatgtactgcgcactgaccgggcccacccctactatgcggggcctgaggatggcccacatctacgggcgctgcacgacctgctcaccacctatgccgttacccacccacaggtgtcctactgccagggcatgagtgaccttgcctcacccatcctcgctgtcatggaccatgagggccatgcctttgtttgcttttgtggcatcatgaaacgcctggccgccaacttccaccctgacggccgcgccatggccaccaagtttgcacacttgaagctgttgctgcgacacgctgaccctgacttttatcaatacctgcaagaggcaggcgctgatgacctcttcttctgttaccgctggctgctgctggaactcaagcgtgagttcgccttcgacgatgccctccgcatgcttgaggtcacttggagttcgctgccccctgatcctcctgaacatgaggtagagctggttggaccccccagccaagtggcagacgctggttttggtggccacagggggtggcccgtgcgacagaggcacatgctgaggcctgctggtggaggaggtagtacctttgaagatgctgttgaccacctggccacagccagtcaggggcctggtggtggggggcgtctcctgagacaggccagcttggatggcctccagcaactcagggataacatgggctccaggagggaccctctggtccagctgccccacccagctgcccttatcagctccaagtccctctctgagcctttattgaactccccagacccactgctctcctccttttcccaccctgattccccatcttcctcatctccaccatccacccaggaggcctctcccactggtgatatggctgtaggatcccccttgatgcaagaggtaggctccccgaaagaccctggaaagtccctgccacctgtaccaccaatgggcctgcccccaccccaggagtttggccgggggaacccattcatgctgttcctctgcctggccatcctgctggagcaccgcgaccacatcatgcgcaatgggctggattataatgagctggccatgcactttgaccgccttgtgcgaaaacaccacctggggcgcgtcctgcgccgggctagggctctctttgctgattacctgcagtcagaggtgtgggactcagaggagggggctgaggccacagccgcatcttgatcaggctttctcaagccctccatcggccccaccagatctccattctttgccatgagggccaacacatgagaccccacctccctccctgcctgccagccctagacttgttggagcatagagcccttcctccccaggcctaagtatgtggagctctgctttggcactgccccgcagaggccacgcctatttattctgtttctgttgttttgtttttaacaactatactttgca

SEQ ID NO: 227 - DNA, 5375 bp, mus musculus
cccccgccccctcgcgtaggacgcggcggcggggcggccccggcccgtctcccggcgcgtcctcaggatgctcgggagctgagcgccgggggcggcggagggtcgcggtctgtccgggccctcgcctcggagcgcagggccaagggagggagtcacgatgtcaggtagccgccaggccggctcgggttccgctgggacgagccccggctcctcggccgcctcctcggtgacttccgcctcctcgtccttatcctcgtctccgtcgccgccgtccgtggcggcctcggcggcgactctggtgtccggcggcgtggctccggccgcgggctccggcggcctcggcggcccggggcggcctgtgctggtggcggccgcggtgtctggcagcgcgagcgccggcggggcggtgtccgcgggccagtcccggctcagctgcgcggccaggcccagcgccggcgttggagggagcagctccagcctcggcagtagcagtaggaagcgacctctgctcgtcccgctttgtaacgggctcctcaactcctacgaggacaaaagcaacgacttcgtctgtcccatctgctttgatatgattgaggaggcatacatgacaaaatgtggccacagcttttgctacaagtgtattcatcagagtttggaggacaataatagatgtcccaagtgtaattatgttgtggacaatattgaccatctctatcctaatttcttggtgaatgaactcattctcaaacagaagcaaagatttgaggaaaagaggttcaaattggaccactcagtgagtagcaccaatgggcataggtggcaaatatttcaagatctactgggaactgatcaagataaccttgatttggccaatgtcaacctcatgttggaattattagtgcagaagaagaaacaactggaagcagaatcacatgcagctcagctacagatccttatggaattcctcaaggttgcaaggagaaataagagagaggacatccggtacagtgatgaatagaagtggtgatagctgggcatcctagtcttgatgctgatctcaaagtgaaatcattcgacgtgtcaccattagcaattggagcagatccagaaggaactaagtgttttggaagaggatattaaaagagtggaagaaatgagtggcctctactctcctgtcagtgaagatagcacagtgcctcaatttgaagctccttctccatcacacagtagcattattgattctacagaatatagccaacctccaggtttcagtgggacctctcagacaaagaaacagccttggtataacagcacattagcatcaagacgaaagcgactcactgctcattttgaagacttagagcagtgttatttttctacaaggatgtctcgtatctcagatgacagtagaactgcaagccagttagatgaatttcaagaatgcttgtccaagtttactcgatacaactcagtaagaccgttggccacattgtcttatgctagtgatctctataatggttccagcatagtttctagtattgagtttgaccgggattgtgactattttgcaattgctggagttacaaagaagattaaagtctatgagtatggcacagtcatccaggatgcagtggatattcattaccctgagaatgaaatgacctgcaattccaaaatcagctgtatcagttggagtagttaccataagaacctgctagccagcagtgattatgaaggcactgttatactatgggatggattcacaggacagaggtcaaaggtctatcaggagcatgaaaaaaggtgttggagtgttgactttaatctgatggatcctaaacttctggcttcaggttctgatgatgcaaaagtgaagctgtggtctaccaatttagacaattctgtggcgagcattgaggcaaaggctaacgtgtgctgtgtgaagttcagcccctcctccaggtaccatctggctttcggctgtgcagatcactgtgtccactactacgaccttcgtaacactaaacagccaataatggtattcaagggacaccgaaaagcagtgtcttatgccaagtttgtgagtggtgaagaaattgtctcagcctcaacagacagccaactaaagctgtggaatgtgggaaaaccatactgtctacgttccttcaagggtcatattaatgaaaaaaactttgtaggccttgcttccaatggagattatatagcgtgtggaagtgagaacaactccctctacctgtattataaaggactttctaaaactttgctaacttttaagtttgataccgttaagagtgtattagacaaagatcggaaagaagatgacacaaatgaatttgtcagtgctgtgtgttggcgggcactatcagacggggagtccaatgtgctgattgctgctaacagccagggtacaattaaggtgctagaattggtataaagagtttcctgaagtcaaactgagtttgatcctcccaaaagccatctgcagctgatgatgagaagaaaaagaaatggcatgtaatgtctctcccaacatcatttggatttgttttaagtaccttttccctcctttatgcctttgggacactgggaatatccagagaattcgccaccatcagtgtaactatgaactttgctgttggcagtgtggctaatttttgtgatagggaaacaaattcttttaaataaaaataataaacaacaacaacaaaaaaaaaacaatacaggttatcgcaggtcatgaatatgggatgtctccatttttattccactgaatttccttcagtcttgttctggaattaatggtgtatatgttttctgctttgttagttaagataattctcaaatattttattttttctaatgttattatgaattgaactgtggaatttttttaatttactttttttgaatctttattgttagtgcatggaaatgcaatgatttgattgtatattgaaactttattgaattctgtaatattttgtgtaacatttagaagttttcatatatattatgccatttatacatttactttttcctttccaatattgaagtcttgaatttcagtttttttgctgattatttttctcatttttaaaattttactttttattactttcccccttttattaaaaatagattcttccctcaaacaatatatcctgattacagtttccctccatctacgcctcccagttcctccccacattcccttccatctggatccacttcccttttgtctctcattagaaaaggacaagcatctaagaggtaacaacaaaacaaacaaaataaaatataagttaaaataaaacctatccctttgaagattgacaaggcaacccaacagaaggaaaagagcccaagtgaagacacaagaatcagtgacccacttattcacactaaggaatagcttatagataaaaatactaaactggaagccataatatatacacagaggacctggtgcagacacatgcaggccctgtgcatgctgcctcagtctctgtgagttcatatgagctttgcttggttgctttagatgaacttgtttccttggtgtcctccatcccatctggcttttacattctttctgcctccttttctgtgggattccctgagccctgagggaagggatttgatggagacattccatttagggctgaagaatatcctcttctgtcactcctcacctattcttttgaggctggatccctcccacacccacggctcacattttctcagctagtctagaagtgagcaagtgcctcaatacttgttctgcttcaatgccaaggttataggtatgcattggatgcccatcttgctgcatgtgggctgagatccaagcttcagtcttcatgtttgctcagtaaaggttcctaacatgactcatctagtccatgaataatattttaatagtcacagaattcaatttgatgaggattttaatgccaacacttttaagggatactgatctaccattttcttttcttgtaatttgtgtttgttgttttgatatctgcttcacactgtctttataaaacaaagaaatgagtttaccgtcctttttggatactgtcccttacgttgtagtccagagtagctttgaatacatgcttttccagcctcaagcctccagagtgcaagatatgtaccaccagatctgggacttcttcattttctaggagttttcctcttaaatgtttggtagcatgcatatgaagacatctgtactggctagtttttattaacttgacacaaaccggagtcacttgggaagagagaatctcagctgaggaattacctctatgatattggtctgttggtatgtctgtggggccattttcttaacaaatgattgatgtaggaagtcattgaagtaggattgatgcgttgttagttgtggcatccctgagcagatgggcctgcactgtattagaaaggtagttgaggccccaacctagtatgcctacccctgatggtgctacttccaacttctaggctccaggcaatatgtacatcacctgcccacaacctacagggtccttttatgctacacacaacctctgcccagtcagaatcttcacatcttgaactaaggtctatccaattgagcctgcctgatctgcctgagagtgccttccactctctccatacttagcctgggtcccatgtccagtgttggcacctaatctggccactgatactttgtgctactccccaacttccaggctttagacatgactcacactttcaaatcacaatcaacaagccacttgcaagtcacattcaacttttctgtccaggcaggtcctgtaaatcatgtgccatggcctaacgtggagaatatgcttaatcttcccactataaaacctctccaaatcccaagatctagcctggatctcacgcttaataccccagcttcatatggccacccctacttgcattgtctgcaacttacagggttttggccactacttatgctgtcttactgtagtctaaagaccccttgcatgcccatccaaccactcagccaagctaggtcctgtacaccttgtgccaggatctaggcaggtgattccacccgattcttgtggggctgtgggtgtaggggaagaggggagagggagagagcccacgtccagccagagttcttgtgctctgggcaggcagacatgggaggactgtcggacgttttccacgtggccctgggtgagcatctggctgtgtgaagccactgaacccacatggcgggggttggaggaggggcagtccccagtaccaggttctcagtctctggcatcgtatgctggatacagcagaggagctgagaacagaataggggccccagg

SEQ ID NO: 228 - DNA, 2534 bp, mus musculus
ggccaagggagggagtcacgatgtcaggtagccgccaggccggctcgggttccgctgggacgagccccggctcctcggccgcctcctcggtgacttccgcctcctcgtccttatcctcgtctccgtcgccgccgtccgtggcggcctcggcggcgactctggtgtccggcggcgtggctccggccgcgggctccggcggcctcggcggcccggggcggcctgtgctggtggcggccgcggtgtctggcagcgcgagcgccggcggggcggtgtccgcgggccagtcccggctcagctgcgcggccaggcccagcgccggcgttggagggagcagctccagcctcggcagtagcagtaggaagcgacctctgctcgtcccgctttgtaacgggctcctcaactcctacgaggacaaaagcaacgacttcgtctgtcccatctgctttgatatgattgaggaggcatacatgacaaaatgtggccacagcttttgctacaagtgtattcatcagagtttggaggacaataatagatgtcccaagtgtaattatgttgtggacaatattgaccatctctatcctaatttcttggtgaatgaactcattctcaaacagaagcaaagatttgaggaaaagaggttcaaattggaccactcagtgagtagcaccaatgggcataggtggcaaatatttcaagatctactgggaactgatcaagataaccttgatttggccaatgtcaacctcatgttggaattattagtgcagaagaagaaacaactggaagcagaatcacatgcagctcagctacagatccttatggaattcctcaaggttgcaaggagaaataagagagaggacatccggtacagtgatgaatagaagtggtgatagctgggcatcctagtcttgatgctgatctcaaagtgaaatcattcgacgtgtcaccattagcaattggagcagatccagaaggaactaagtgttttggaagaggatattaaaagagtggaagaaatgagtggcctctactctcctgtcagtgaagatagcacagtgcctcaatttgaagctccttctccatcacacagtagcattattgattctacagaatatagccaacctccaggtttcagtgggacctctcagacaaagaaacagccttggtataacagcacattagcatcaagacgaaagcgactcactgctcattttgaagacttagagcagtgttatttttctacaaggatgtctcgtatctcagatgacagtagaactgcaagccagttagatgaatttcaagaatgcttgtccaagtttactcgatacaactcagtaagaccgttggccacattgtcttatgctagtgatctctataatggttccagcatagtttctagtattgagtttgaccgggattgtgactattttgcaattgctggagttacaaagaagattaaagtctatgagtatggcacagtcatccaggatgcagtggatattcattaccctgagaatgaaatgacctgcaattccaaaatcagctgtatcagttggagtagttaccataagaacctgctagccagcagtgattatgaaggcactgttatactatgggatggattcacaggacagaggtcaaaggtctatcaggagcatgaaaaaaggtgttggagtgttgactttaatctgatggatcctaaacttctggcttcaggttctgatgatgcaaaagtgaagctgtggtctaccaatttagacaattctgtggcgagcattgaggcaaaggctaacgtgtgctgtgtgaagttcagcccctcctccaggtaccatctggctttcggctgtgcagatcactgtgtccactactacgaccttcgtaacactaaacagccaataatggtattcaagggacaccgaaaagcagtgtcttatgccaagtttgtgagtggtgaagaaattgtctcagcctcaacagacagccaactaaagctgtggaatgtgggaaaaccatactgtctacgttccttcaagggtcatattaatgaaaaaaactttgtaggccttgcttccaatggagattatatagcgtgtggaagtgagaacaactccctctacctgtattataaaggactttctaaaactttgctaacttttaagtttgataccgttaagagtgtattagacaaagatcggaaagaagatgacacaaatgaatttgtcagtgctgtgtgttggcgggcactatcagacggggagtccaatgtgctgattgctgctaacagccagggtacaattaaggtgctagaattggtataaagagtttcctgaagtcaaactgagtttgatcctcccaaaagccatctgcagctgatgatgagaagaaaaagaaatggcatgtaatgtctctcccaacatcatttggatttgttttaagtaccttttccctcctttatgcctttgggacactgggaatatccagagaattcgccaccatcagtgtaactatgaactttgctgttggcagtgtggcta

SEQ ID NO: 229 - DNA, 2534 bp, mus musculus; identical to SEQ ID NO: 228

SEQ ID NO: 230 - DNA, 2298 bp, mus musculus
atgtcaggtagccgccaggccggctcgggttccgctgggacgagccccggctcctcggccgcctcctcggtgacttccgcctcctcgtccttatcctcgtctccgtcgccgccgtccgtggcggcctcggcggcgactctggtgtccggcggcgtggctccggccgcgggctccggcggcctcggcggcccggggcggcctgtgctggtggcggccgcggtgtctggcagcgcgagcgccggcggggcggtgtccgcgggccagtcccggctcagctgcgcggccaggcccagcgccggcgttggagggagcagctccagcctcggcagtagcagtaggaagcgacctctgctcgtcccgctttgtaacgggctcctcaactcctacgaggacaaaagcaacgacttcgtctgtcccatctgctttgatatgattgaggaggcatacatgacaaaatgtggccacagcttttgctacaagtgtattcatcagagtttggaggacaataatagatgtcccaagtgtaattatgttgtggacaatattgaccatctctatcctaatttcttggtgaatgaactcattctcaaacagaagcaaagatttgaggaaaagaggttcaaattggaccactcagtgagtagcaccaatgggcataggtggcaaatatttcaagatctactgggaactgatcaagataaccttgatttggccaatgtcaacctcatgttggaattattagtgcagaagaagaaacaactggaagcagaatcacatgcagctcagctacagatccttatggaattcctcaaggttgcaaggagaaataagagagaggacatccggtacagtgatgaatagaagtggtgatagctgggcatcctagtcttgatgctgatctcaaagtgaaatcattcgacgtgtcaccattagcaattggagcagatccagaaggaactaagtgttttggaagaggatattaaaagagtggaagaaatgagtggcctctactctcctgtcagtgaagatagcacagtgcctcaatttgaagctccttctccatcacacagtagcattattgattctacagaatatagccaacctccaggtttcagtgggacctctcagacaaagaaacagccttggtataacagcacattagcatcaagacgaaagcgactcactgctcattttgaagacttagagcagtgttatttttctacaaggatgtctcgtatctcagatgacagtagaactgcaagccagttagatgaatttcaagaatgcttgtccaagtttactcgatacaactcagtaagaccgttggccacattgtcttatgctagtgatctctataatggttccagcatagtttctagtattgagtttgaccgggattgtgactattttgcaattgctggagttacaaagaagattaaagtctatgagtatggcacagtcatccaggatgcagtggatattcattaccctgagaatgaaatgacctgcaattccaaaatcagctgtatcagttggagtagttaccataagaacctgctagccagcagtgattatgaaggcactgttatactatgggatggattcacaggacagaggtcaaaggtctatcaggagcatgaaaaaaggtgttggagtgttgactttaatctgatggatcctaaacttctggcttcaggttctgatgatgcaaaagtgaagctgtggtctaccaatttagacaattctgtggcgagcattgaggcaaaggctaacgtgtgctgtgtgaagttcagcccctcctccaggtaccatctggctttcggctgtgcagatcactgtgtccactactacgaccttcgtaacactaaacagccaataatggtattcaagggacaccgaaaagcagtgtcttatgccaagtttgtgagtggtgaagaaattgtctcagcctcaacagacagccaactaaagctgtggaatgtgggaaaaccatactgtctacgttccttcaagggtcatattaatgaaaaaaactttgtaggccttgcttccaatggagattatatagcgtgtggaagtgagaacaactccctctacctgtattataaaggactttctaaaactttgctaacttttaagtttgataccgttaagagtgtattagacaaagatcggaaagaagatgacacaaatgaatttgtcagtgctgtgtgttggcgggcactatcagacggggagtccaatgtgctgattgctgctaacagccagggtacaattaaggtgctagaattggtataa

SEQ ID NO: 231 - DNA, 111379 bp, mus musculus
tgcgcccgcccgccgcccgccgccactgccgccgccggagctgagtagtatggcatcgaggagaatggagaccaaacctgtgataacctgtctcaaaaccctcctcatcatctactccttcgtcttctgggtgagtgcccacttctggctactggccgggccgcggtctatcagaccgtgtggtgatgctcttagaaagaaaggtggaaggaaaacccaaaccccaaacccgatcttagccggtggacaaggagacagccgcaggctgctgggtcggggctgtgagatggtagggtgcaggtctgggctgctccaaccctcgagtttgtccgacgaaggctgaagtgggctgtgtggtggcggtggttgcagatttttccactcttccaaaaaaaaaaaattttttttaatgcattgatttcttaaactctcaggacaggatcagcccctggggaaagttgttgtgatttgtctgtttgctcttttggacttctctccttaccttaccaagccagttttgggtgcctgttggagctaatggagctaacctgtggcgggctgggagcgggcgcaggacggcggggttagatctaagatcccgacttagtcctaaccctgcagggctgtgggagagagtcgccaggaatcttctgcctgactggacaagggcgatcagtctcccaagcgcactaatgcgggacaggcgccgccaccgcgtggaggcgcacggagagggtcttacataagccaggggtatctttgagcttcctcagcgactggctcttacgacccctttcagatttctttccaccccttactgtttccactcggttattgtgtttttctgtgtgaacccaatctgcaatgcccaagaggaggaccccctaccacctggtggctgcggcagcgcccctgttccccacctaactggtactgctactagtccttgagctcaatgcagaaaggtgacgtcagcccttcagcccaggcccgcgaagggctgcgtggtgcacctcgctgagggatgcgcccttctgtgcgcaggaggagggaaaaggggaggagggggctctgggcttatgccttacctcatcctgtttggcaattcatggaatcagtgcagggttgacactgcagtgatttcatttgcagaggtgggtggtacctaaagaccatttccagttctttctctcttcacatagatgcccaccctagttccctcttcccacctcaagtcacagccaccctgcaaaggaatgaatacctgccaccaccaccctggccccccgcaacaccatgatctgggtcattccagctcccaaagcagtcattttgaaacctgaatccctgtttaaaaagatagacagacagacagacagacagacagacagatagagaaagaaagaaaaaagaaccaggcttgcctttggttggttttttttttcttgcccttcctaccccaatattaaccctgtttttgcttcagaagtggagcacagtattgaatgatgtacctatatcaggattgatggtaaactggattgtttgcagtagccaaggcaggagctgagatttattacagatttaaaacaaaatccctaatgtttctaggcttttccttgccactgacattggtgatccttcgggtctggaaaaccatggagtgtggcaacagaacagaccaggggctctgcagtgagatagagtagcaagaccaaaacagcccatcacataagccaaacatagaagctgagtctttctggaatggaaatgacacaggttgaatcatctcaggaatggaactgtgtgctagctatacattcaaggatcttagcttatgtttgcctggaaaaagcagcaatacttggtggtgatggtccaacttcaaagaagccattgctgggcactggttttgctctttatatatccctttaagtctgcttttgttttgccctttgttatatacttcctatttgttaactggagtaaatctatgggtggttatcttaggctcctgaaaaagaaggtttatggtgcaggagaaagaaggaatgctggttttggagcatttctgaagcctggtaaaggaggaggcatttcaggcttcggcttttcatatggattatttaactctttttgtctcaccccatccccatccaatgactcagtgcctcctaaaacatctgaaatggtcaatgtgttgtctgcccctgcaagttgctcatgatggcgttttcatttatttttttaaactttcaagattttcatattcttaaatatttacccagagtattttcacctgttaaaataggattcaaggatcatttcagattttacaatcaaaagaataagatctctccagaaaataggacacttcaaagatgtttttcttaataagccgtagtccaaatgctgtttttttaactgtaccttaagtgctattttgtacaacgcagctttactgaggcgtacttcatatgatatatgtcacccatttaaagcatggtatatgcatacatgcttaacatatagataatttgcattttaggtatttgttatcttttttgtgtattcacaaatacagccatttactacagaccattttcaattgtttcatcatctctgaaaagaaaccctgtcctgtccctttccttcccattttccctcccacttgtttctctcctggagccagtcctaggcaatcatgaatctactttcagttgctatagattttactgttgtgaacatctcatacacttgaggtcatgtatttgccccttttgactggttggtttcagttagcatgacacattcacgattcatgcatgttgttagtctgtgtgagtacttcgttcagttgtatggccaaatagaatacctttttgtgaagatactgtgttttatttctcctttttccattggtggatatttgggttgatgggggctcttgactgttatggatggtgaggttctgatttatgtgccatttgtgtgtgtgcctatattttcattgtttttggctatgtatttggggatctgtatggaatcatatagctctatgattaattgtttgaagaatggccatactagtctttcagggcaagtgttccattttatagtcctttcaacagcgaggattccagtttctccatgtgcttgccagaatttgtcactatctggctatttaatgtagccatcctggttcctgtgcatttagatatcttactgtgtgattctgctttgaatttccttaatgaatgctaatgttgaatattttatagtgcttaatggttgttggtcatctcttgaaaagatatatattcatattctttgaccatcttatttatctattattacattattaatttcttttatattccaggtataaaatcctatcaatatgaagtttttgcaaacagttttttttccattttttgggttcccttccccttagctgttttttgaactgtgaaaattacatatatatgtgtgtgtgtgtatatgagtatacacatatatgtacaaatgtatatgtattatatatgtatatgaagtgcaaatggattggctttttgtttgttgcattgttcatgcttttgatatcacatgaaggaatcctttgccaaagatcacaagaataacctgttaaaaactgtttataagtgttattcctgaattgggtaaatataattgatatatgactatttcttgaatacctagcactatgtctgacacatggtaagtactccacttgttttttacatttctggacttatgccatgtaatagaagaaaaggatgagcttgcactcttttaaaagtaatgcagagacatgattagtcagagtaatttccattgtgttttctgtgagttgttttaattttacttctttcacttcagtttaggccgaggagtagaaggtgcttcatgttaaaatgatggtaggttagtaacatcaagaagtattggcctgtaccaaagcaaacagattgttgtttttatctgtattcttaggtttacagtcatcccctttgactgctatatttcgataaagctatgattctcaacaggggacaattcttccatgtttggccatgcctaaagccctttttggttccatctagagtgggttccactggcatttagtaggtagagaccacaggtgttgctaagcagccacctgatgactccttgcagtggttgagctctgcccagtatctggctcaaaagattaatagtactggtgacctttatcctatcgagattgagcagtaatgaatgctatgaaggaaagaagagtgtgatgggaaatttactgtttcaccatatcacagacagcatgttcaacacaaccacttttaagaagaaaaaaaaatatcctcaatggtgtgccatgctggtttatttgaagattaaaggtaagcgactctttacagattgtgtttctaatggataggatggttttcctttcacttcagtgatatcaaccggaatgctggagaacatgttcttattttccatgatttgtatgttttattttcaggttttatttcaggttttcagagggaaaaagccacctaggagcaagttattctgtgctttaaagaccagaaagagtattgcatggtagtttccttgggaaatatttacattctaaataaatgaatgaaaaatgaaatgtatcaactactactggcttagttattaaacccaccacagctgggggaagctttcaaacgtgtactattttgagtctgtttatgctggattaaatgtgttctttctatttacatgtcgatagatgactaggggacttagggacttgcttacataataaagactgttaaatccttatacttttgtgatctcttttgttggatatttcggttaactgtaattgaacttaagtttgtataaaaatatcaatcttaccctatataaaactaaggttcttattttcgtgagaaatataattcagaggcaaacaagaaaaccttgtaaatctaactgttacttaccagagaattgttttgatttataagcttttatggactttcaatactcatctgagttctaaggtaagatttaaattgactagactacatctgaacagtatcgtgaagagaaatatcctttgcttcattttatgcttcattttagtgaatattgggtttgattattttattgtttaagaatgtaattagcttactaatagcattattaaatcattccagtgaaataccagtgatttttcttttccttcataaacaatcattttggggtaattttaaaataatattattttgttctctttttatggagcaactttcagtgattaaattgaataaagaggggaaaatcctaaagagaggccctaacatttacagagtgtttgcgacgcacacttactcctgacaaaattgtttctgttcagttcagcaaacgttggttggaatgtctgtcatatatcagatatgaaatagtctaaaagatgtcatctgttcactgtatacacacttggcattttcgttacatttatttgtaatacactcaattccaaattgtttgtttctaggtgttatctgttgttgtcacactatagaagatgaagatttagttcctttgtccccttccttttctctcatgagcccatttcccagggatgtcatttatcagtgtatcatttggtttaaagcagtatactcttttcatagtggagccatgtggcatggatatttccctgaagttagcaaacacctccctttttccctttgcatctagtatagtattcacttccatagttttttcaataattctatctttgctcagtgtattcaagcagttcatgggagctttctgtggcctaatgttatagacatttgtcttggattgggttggctttcaatttgaactaattttctctgggcctccactctgttaaatcctcaaagttcctaaatatttgtttgttctacttcttgatttttccccccttcattttggtagagcaaattttcatgtagttttctttctaggaaaggaaacatgggaagtcatatacttaagtctttacaaattcaaaactcttatttgatgcttcatttatcttgatagtttaggggaagatacaattgttgtttcgaaagcatttacatcaaaagctttactgtctactctatacattaaacaaagtaataaagtctttttgttattaatgttgaaaatttgatattattataattcttcttcaatcttgctttcccccctttgaagtttttttattacttgcatattcacaatgctctgaaatttctctctgaaaataataggaatttttattttaataaagttttaattttttcattgtttcttccaaaccattttgttttagggtatgttataatcacagatttcgggttttttttctgctaattattttatatatgtttaaaagggggttatcaccaaccaaagagtacacatggtgggactcatggctccagctgcatatgtagcagaggatggccttgccagtcagcaatggaaggggaggccctatgaaggcttgatgtcccagtgtaggtgaatgtgagagtggggaggcaggagtgggtgggtgggcaggggcacactctcatagaagcaggaggaaggtgaatgggataaggagtttccaagggggatatcaggacatgtaaataaataaaatatccaatttttaaaaaaagagggggttatctaaaaacatttggaagctattatcatgattctgttcacatgtttgctgcttttaagttgtgtgactttgttggtctgggtgagttttatgatcaagatcaatactttccccacccccacccctagattttgtctgttggtctaatcagatgacttacagatgaatcttttcattactttctgaacaagaaggtagcaatataacagaccccacatatggtatacaaatgtccactgtgttcttgggtcagggactttctgctttgctcttctagggttacatccctgaacctatggcagagtaagacaaaaaccagaaacaggaagttggagatttcctaattgctccttaaaacgttttgctagctctttcttctttcagcctccttccttccctaacttcagccctctgggtcttctggaggtgttttggaataaatacctttattctgggatttttcaaagtgactaaaatatttttggttagctctaaggatatcaatatggttgtctcttctcccctctttgctactgtagggttttaaaaagatgttttcagtgtcacatcaggggaattttaggagttagccaagataaatgaatgtatacaatccatcatctttaactagaagtcctttctatctacatctctactttgcatgctattaattaaataagcaattgattctgagtgtttgaatagagcatgtaaatggaaatagttggactatcataagtactggtacaaacacacatacacatacatatacacacatatacacatatagttagactgacttaggtatgtcagggaagcacactatcctattagtatatttataaaaacctgttttgatgacaaggaaaatattctatgttggaataggcttactaaagcagtctctaaaatgaaatctggttatcggggactggacaaatagggatgatgccctgaaggttactggaaatttttctttccttctaatttcttcctgctaggaaaagactcaatatggtgttttctgacttaattcagactggactagaccaacttaatatggctgcctaagagtttagcgtgtgatgttcgtatggtgggagagtcgatgtgaaactactctttttatgctattacagttatagggcatccatatgataatctagagaatattctctttttcagtcatctttatttcttatatacactacgaggttaggagatgcatattatcttctataccatctggggaacattaagccatttctatctaggagttgcttagaacctagctgaaattttgtcaaaatcaaatgaaattcacttcactttaatcccagcgagagttcttgatttgctcttactgtggactacattgtgatgaggcattagctcagcatcacatcctgtttgaagtatgtatctcagaaggtgctgagaactggaagtcatttgtgactgcttctttgtttaagcacattaaacccttgagactgatgactaatgccatgtcaaaccaacactttacaataccttcttaagtttttctactttggtccaattccagtagcttctgatacgagctatcatcatcacttcatggtagcaagcaggtcattgaattgacgaggaaacttctgttggctgttagccctcttgctgggacaggatgctttccatacttggcaaagcattttattctcttaataccgatcaagaaaagaatgaaagagagagaaaatagaagagaggttttttcccccttttttgtttttgttttccattttggtttctgatcagttgaatgtgtaagcattttaaacaatctaatgataaaatcaaggatcctgcttctgtctagaaatattctctttagtgccttcttgaaggtgagtatttcccatcataatctattttaggagaagtttgtaagtatttatgttaagggataatcagttgggtctagaacagatactaattgagcagcttaaatcagtgatttttaacccattttttctcaacaagaattgccttaagttgccctaaaataaatgtctaagctatgttctaagatgctgtgattcagttggtccagatggggttccaacataatagtttggaaataagtaatttcaaagatttccactgttcaaattggattcagttataaacccccaactctaaaaacacatagcagctaaaagcaggccatttcatattgagtctcttggatttggaggtagctaggaagtgttcagaatgggcttactaactgactcatctttgtctgaggcaagatctataatgctttcctcaaaactaaagtagctttgtcaccctgaagagactgcacttatcattgctaaataaaacaatgcttatctaatcagcaagggtcttccttttggcatttatttattgagggtagaggtacgtcacagtttgtaaacaagtaaaaggacaacttgcacaagtggcttcttctaccatgtaggttcttgggatcaaatttagttcaggcttggtggcaagtgcttttatctgccaagtcattttgctggcccactaaaggtcttcttaaagaacaaattagcagtcataattttgaaacctaaattaaaatttgttatgcttagttgctatgaagaggggcctgggtatgtacattaggaagagaaccccacaaagtggttctgatgttcgcttgcgatatagctattaattatacataattatacataactctcattatgaagttttcatatgtggatataatgtatacaattttgtttttttatacccacagaactggtatttggtaaacatttacagatgaattattggagattagatatctttctgttcctagaaatgtacacagagagagagagagagccatcatctaatatataaagcaaaatgatgaatttactacttatcaaaggaagaaagagctgtgttagtcaattgtagtttataactaaagcatatcttttgagctggcttcaaatttgcatctacaaaatagtgggcttagagaaccaagtcaccatgctaaactaccactgttatttatgattcggtttatctttcaaatgcataaatacaaaacattaagatagaaaaagataaaaccatcttctgtggctaaagttgttatttacctcaaattccagagtctagttaaaaaaaaaaaaaacactaagagaatttgatatacaggctggatataaggtaagcataaaacattagctgcctttcattggttcatcacacaagccttagaaggaaaaagtactttctttgcagcaccaacaaaaatcatgactattgcagaaaatagttaataagaaatgtaaggaagactctgatacagtggaatggaagagaaacgtcactgaaaataagccctgaacagattgaaagaaacctacgtactcttgagttgggagatgcaatatcataaaatgaccagttttctaaaaagttatttgatgtatattttttttcatatagaattctggtagaatttggggagagatggtagtacttgattaaattatattgttactgtagaaacagataactgagaaattagtaggaatttgggaagtagataccttatgtataatggaatatacagttaggggggacaatgacaaccctgtacaatcctcagatcctggcattcatgcctgtgtgccaccccttctgtttcagtgccatgaggacgtgtgatttgcttcttatagaatattataaaggtgatcaaatgtgccatataatcatattacataggatttttacttactgagaggctatgtctctttctggctttgaaaacttaagttccttgttgagagctgccttatggagaggggcacatagtgaggaactgtgggtaattctctaccttgacaaccaatgagaaaaatgaaacctccagtttggcagtatgggaataactgaatgctgccaacaattgagtgatcttggaaacaggttcttttgtgacttgagcattctgtgagccctacctgacactttaatggaagctttgtggaaccataggcagaaggtattgctatcctgtgcctcgattaatggccccacaaaacctatggaacagtaaatgcattttgcttccaatatctacttttgatattattaatattattatgaaataatacatgacacaactggaaagtcactagtcagtattgcataacattggtttagaaaaaggttagtaaataagagggcactgaggaatccagaaataaggacttgtgtgcattacttaataaacgaagcaggatgtttttctagtgggagaaagctagttttaaatgcttatggtactactagatatggaaaagtaattggagcttttgcctaaaccacataaacattttcagttaatttaagtgttcaaatataaaataaagcaaaaattacatttatatataaaatataaaaagtataattttatatagacataatatgtagagctaggcttgatggcacacaccttcccagcatacttatgaggtagaagcaggcagatctctgagttcaaggccagccaattctatcaagcaaatttcaggatagtcaggattacacagagaaaccctattttgaaaaaccaacccccccaagaaaacccaacatagatacaatataggtataagaaagatggcttactaaattagacactcagaagcaaataaaatactgatatatttggttattttttaaaagtatttaacaaaattgtaatttttgttaaatttgtcaactaaactgtggtgaggtcaaacaaacaaacaaacaaacaaccttgtgccaactgttaacattgctttcttcatttagccatttatacaaaagctcttatttctaatggacatcgtctctcaatatagaccaatgactctgttttatgacatttatgctaaggacatttgaggcaatctagagaaacatctagagaaacagttggcacagctttactatccagggccagatagtaaatatttttggttttatggaccatgcatctaattagtgttaaatgaagcctatgcagcatagataatgacgtagataaatgaataaggcactagcccaagcaaattgtatttaccaagccagatggacagcgaggtttcatgcatggactgaaattgattgacccctgctctataggctgcagatagaagggaggtctaacccttactttcagtaaatcatagtgtaaattttactatgggccagtgagagtgggaacaaagcaagcctcacatcttctacattgacaaaggctacttagaccctgtccaacaaagtaaccactacagtatttcagatatgaatcttctaaagtaaaatgtgccgtgttaaattcacatcagattttgaagttttagtaccaaatgcaaagcatctcattttgttttggttgcatattgaattggtaatatttcagatatatattggcttaagaaaatcatattagtaagacttaattatatataattttaacttgagtgttgttcaaaatttaaagctataaatgtgagctgggtatggtggcttatagctatactccctgcattcatgtggctgaagcaggatttctatgagtacaaggccagcctaggctgcatagggagtttctggccaacatgagctacatgtgaagaccctgtctatatggcttgccattctatctcatttggatagctctgaactagaaaagtgatatagtgtactcgtgtttggagggactagaatgagtttagtcatactaaagggaaaggtgtgtggtctatttaggtaagctagggataggttttattattggttgactaggactggctggctagcacaaggaatactctttcacagttctgaacacatagatgagagatacactttacaggtctagtctgaaagcattaaattgccatacaaaggcaagagaaagtgaaaccagcttacctagctaggaagtgaagtctaatttcaggtgacttgagaatgagcagtggaggacagaagatggcttctttaggatatatggcaagaacagtattctgcgcttaaagatcctagctgatgttgatacccctgtggcactgtagaccctaaggagctggtttaacattgataggatctgttatagtttgtatatgcttagtttgagataacagtaactttgaaggataggttgactctcagaagtttgctgtattttctagctgatggtggtgaagttttggccatctctgtactgtgtggcacctacctctcaccctccgtggtcacagttggttgacctggggagaaagatacgacttgtatttgtatattggctggtcagtgaaatgtggggtcaggtgagcagaagagaatggctcttcttttgcactgggagagtagagaaagcacctgttgatgttgggcaggagaaactcagaggaaggtaacagtagatgcatgcacgctggagacctggaatggacactgtgaactcccagtcagtaactcatataggttcctggacagccaggtagcagcccaatcatttcccttccagctggaagtggcacttcatgtttctgggaggcctgtccaactggggagtgactcctagcctcctcggctcctgttctcttaaatttcttgtctaaccaggaaaggtgatgagttggatgtttgaagtggttagaaaggcaggggtggaattactagagcatcacaggagcagtgtgtggctgtcagacaaggttggggaaagcccattaggtcatttaagaggcatgagacagtatagctatccttttcaactgtgtggtacgcccagaattctaagcacagttaatgctatgttgcttgctgataataggtgtagcaaagcattgcgccaccaggactaaaggaagcctgtgtttccagtaagtcctgtctaaaggataaaggtcctccttcatggtagtagcaaatcatttgagcaagttactcattaagctccttaatagcagctgctctttttggagagtgagctttgaagttctttaggtttgtattcttcaaagatgtttcaaggacaaacaagtaattgctttgtatgttgtacttttttaaaaaagaagggggtgcctagaatacagtggtattgcccaccctgatggggttatacatgctttcagacaggtaactctttgagaggtgcctcaatgcctacttacagtcagtgatggtgggtggtggaggggccttccttaaagtctaatgaccactggaaaagaaatgcactgctccatattgtcaggaacacaggacaaagtatgagatgttgggagtgagctctggatagagcatctcaaatatctttaaaataaatatagaaaaagagaggctcataaatgaacactccaattaagaaggtattcaaatgagtagtctaagcaaacagcatggtatatgacatgctgcttttgtaaagaaaaataagtgcatggaacagttactgaagaggtctccacacacaatgttagcacttatggctaagaggcaaaatactttatgggttcccttttggtgtgttttccaaggcttcaactagcattgcatatagaaggtgttacttttataatgaagaaagcaagaaatgcttaagacattctatatattacatcctatctgattttatttctcaaatatggagtgctttttaaacatatatcatttcatttatcatggaacagtttatcagctcgatcctctcttattgggttgagtaaatgaagagcaaaaccaaatttaacttgattctttctaagtcttaagtctcttcaaaataaaggaaaatgtctgttccttttgggcattaactttctgtgctatattataaatataatttaaggaaataatataattgcctgccaatcagctctatcagatcttatcgttatgctatttttgccttaagcaactagttcttaaagaaatatgaaaattttacactcagtgccctatcctgtcctctctgtcttaaatatagttcattagttgagtctattttgtacatatttaatcatatatatgtatatacacatatatatatccccataattgctataaagcattatttttatatttttaaagtccacataaataaatcattctaagcatattgccttgaatcttagcattttggtttaacatattctgtcacgtttccatgttaatagatgaggctcaaccttagggattttccatgaaccaaatctacagacatctctttttaaaaaatttttattatatattttcttaatttacatttcaaatgctatcccctataccctccccctgccctgctcccctacccactcactcctacttcttggccctggcattactggggcatataaagtttgctagaccaaggggcctctcttcccaatgatggctgagtaggccatcttctgctacatatgcagctagagacatgagctctgggggtactggttagttcatattgttgttccacctatagggttgcagaccccttcagctccttgggtactttcgctagctcctacattgggggccctgtgtttcatcctatagatgactgtgagcatccacttctgtatttgccaggcactggcaaagcctcacacgagacagctatatcagggtcctttcatcaaaatcttgctggcatctgcagtagtgtacagacatctctttttggaaacaagcttcatgtgtagttgatggatgctttcatgccatgacagctgtcacaaaagattgttgtggagaaggatgaagaacaccttagccaatcctacttcaataatgtgattttttggctgaggctaagaatttagccaagttgacacaaggcagattaacaggaaaatatatatatattcacactgtgttgactttacatatatgctgaactgtcacaagagagcaatggtctgaagacatgatcaaaacagaaagcttttagatttttaaaacaagtaccagtaaatactggagttagtgatgggacaaggtgatcttgacaggggataatgaattctagtgatgtaattaggagacatatagagggtgtaaagctagtgaaagataagggctatttcactaggtttatttgtatgagtccattgtggcatggctccccagtgattgtgggttagttctcattctggtttgggtatacttccccctcccaaaggaatctttatggtttgcttcctgtacaaagaggccagttagacagttcttctgaagctacagtgtctcagatgttactagatcaaaatgatcaataaccagtgagcatctttgggataggatggtcttcactcctttgctgtatgccttggaaaatatagagtatttgctatctcttcctttatagaaatctgtgaatccctagttcatttgttgtgtgatatgtcgttgtccattcatttttttccttcattggggccttttatgtttacttataagaagtaaaatttgattaaagtttagctacaaacacacacatgtgtataccatatatttccttactgtgtaagtttaagtgtctccaatatagcgtattgaacattaacattaatcaattcaatttttatgcattttgatcctattttctgacagttagaaaaaacaaattcaagatagactttaccctgttagcttctaggtgttttatttggcagtttggaaggggatggtattttctccttgattagattatttttgtctccaagtggactattatgacttgaatggagaaaagggctgtgttgtccatatggatcaaacatgagaatcatgactgctggcagcaacagtatctactctacgaagatcactggattagatcaaggtggtgatattgctatgaacccaactactgctgtatgattattgagcagttagtaaaggcaaggataaggttgaccatttaacatgtgttatcttgtttagtcctcatgcaaacttgctgaggtagtaattactgttccttattttgagaggaagtcccctgacgtccagagtgtggcccacagtcatgcctgaaaggggtttttgttatagacctcttcacccttcttgggcccagtgtcctgtttccagaagcacatttctccagggtaagcctttggagatgattagaggttactctttgagtcctttcttagtcatcaatttgctttcctgcaaaaaagaaaaattgtttttgctcctatggactggcaaaaatttcctgtacaagaaagaaatcttctaatttccagaatgatccaagtttacagctctagtgtctctggttattttggtttatagttttggaagtattcccatttttttctgtccttatagctccaagcttcagttttcctagtaagaataacaatactttgcagactggggatacaggataaggaaccctaataggagatacactcttcttgtcaacaactaagcaacaactcctgcttttctttcaaaagtctgagtctataacgaatcttcctttttttcctttttagttcatggttgatgtaagttagataaggcatcaaaagtcctgagaatttccactgggtagatgatactctgactgtcatttaagattaaattatcttatgccttaaagattctaaattgttgctccaaagcacatgaatattatttatcccactgctataaaatatagtcgacatatgaaactgattcctatggcaacaagccccagaccactttgaacagccggaaaccaaagaagtaaaaactgctagagatgcaacttttccccctgcctttgccctgaagagtgctaaaggcagtgggaactgtcaggcattttcctttggagctgacactagctaagctgttatctaatccacacatggacacacagataaggctcatttgcacagctgccaactcaggctttgcctgttgatgtgatcttgtttccactctctgtatctgcttttaggggggaaaacaaacctgaccattcctaatttctgtgaatagtgacaggaattcttgcctgtataaggttaattggctgtgttatctctgatgagacgagcttaagggactggagaacactggataaagtctagttcaaaaacagaaatttcccaatgctgctaaattccagtttcaaaaaaaagacatttgtagatagacatctctatttttttgcttgtaaaaccaattctatgatagcagtaatacacacacacacagagagagagagagagaaagagaaagagagagtaaatactacattatgtttggatcctctgacttccctctacatcaagcctctttaattgtaaagatttgattaataaggattttggaatattttgttttaaaaaaaatctatttgtagggccagctgaatggcttattcagtaaatggtctgatccttaggacccttaaggtaaagagagagagagagagagagagagagagagagagagcgcactcaatctcaaacgttatcctcttttatgacttcaaaagttatccttatatgacttctgtactcatgcttagaatgtccccaccccacacaaaataaataagcataaaattttaaagagtatttaaaactattggtagactggtgtcatgagccagagacagaaaccttcattcaaattaaacctgaactgagcagcgtatgtagagttgtattgcttttttgttttaactgtaaagtagttccctgtgcttatttccagcgactaaaacatggaatttgtctttaattccccccccccatctcatttctagctttgtcaaatctctctcttatctgttgtagccagttgccgtaaatcagcggttctgaacttgggtcctgaccctttaggggtcacatatcaaacactctacatatcagatatttacattatgattcatacagtactaaccgctcaagtaccaacaaaaatcatgttatggtggggggtcaccaaaacttgagcaactttattaaagggttgcagcatgagggaggctgagagccactgactgatgtttggctgtcttctcattcatgtagtacagatcaccaagtcctgttgagtattttttgtttgtttgtttgtttgttttgttttgtttttaaagatttgagagattttaattgacaggcatggctgtacctagtctttaagtctgcccaaagcagacagactgagagctttctaatcctttagaattttatctgggagtgaccttggaaagcatttacatccaatcccttctctccattgcattgccaattcattttcatctatattgtccagagaccatgacaacagtaaaaccagtgctaccatcttgctcttggtcttggaccatcacagcgatttagacccctactccaaatcccttcatttcactcctgtttgtgatttttattctaaacaagcaatttgttttttttaaagccaaattgaaaaagaaaacagccattataaaacctataaaaccaagttcaaattttttgcctgctgataaaacattaatatccccacacagcctcattccctttcctatttttagcttccattcaggtcactgtctccagttctctggttactaaatcttactagtcttcaagagtttattcagtgatcacagtccctaggaagccatttgtaaactttccctgccctctctctctctctctctctctctctctctctctctctctctctctctctctctcaactttgcccagctattatattctgcttgtatagtaatcatttaaccatttatttgcttgcctgtcagctttcctcattctctgcttttatgccagagagaatatttatgctcagaatatcgagggcctgttaaatgctaagtgctaggattcagttggaccaaatgaacaaggtgatctggtgagaaggtaggaaatagacaataaacacggagagaaagaataacacttcaagcggcggtgagtgctccaaaggaatagttcaagaagtgatggtatagggccctagtaatagagatatcacaaaagctctctaaggaggtggcatttaagttgaaacctgaggggtaaggaggctcagaatgtagattgagatagttcagaacccagtgtgatttctggtatttgctatccattgttaagctgattaccccagttatctgagctgaagcaagtaatttagaagtcaatttattgtttgattgctattacttgactcctattgacagctgggccagatttgccctcctaaagatgaattcttgtaacaggaaaaacaaagcagagcacaggaacctcattttgggtaattggcacccttctttgtaatgacaagaaaaacattttgacatgaaatagagttgtcgctcaatgattgtttacggctaatgtttttcagttgtagatctggtccacatggaggcttatgtacacaatgttaagtctctcaaatcctccttgcctgtttgccatctgaaattgtctattaagcatcagttcacgctttaattatcctaaagccattgtcaattgaatctctttgttagattgatttgttttaatactaccagctctagagttaatctgttatgtgacaccaatcaaattgttttgaaattatgaacttaagaacgcctacaggaaaagcacctcgtgctcttgaccaccaaagcacttccaattctcttgtagcctttgttttcatatcttcctcgtagtgtagataaaaagcatcccaaacacacagaattccatttttcctagttagtgctattcaggtataggtttgggtatggctaactggttgggtgtcttgtgcctgagatgaaatcttttgttttgtggaagaaatgtaaaatatttgtctactttaattaaaaatcaagtaatagtgtagttaaattgttgtcccttccagaagctactaagtcactgtgatacagactttcgctcctctaccccgtgctctaggcagttctatggagatgttttactttcttcttgactttccctggagttggtcctcctgtgtgatcagaaggcatggaagactatttcgttttcataatgtacaaaaatacgccaaagtggaaggaaaaacagagaaggaatcgagaaacaaaagaaaagaaagcaaacccctccccttgattttgaaagtgatatagatcggtgagaactgtagttcttcacatgttctggctaatctactcaatattcttccagcctagcagacgtgtgatagtattgtagtgtttccattgtgtatcttcatagttcataatggagaagtatattttcatatctgtgctatccattcttagatcaatttgggtctgtatttcattttttcccctaagagacatcttattttgccctaaccattatgagttgaacatcggttgctcagattattctcaaccactattttgcctgtcataaagcattttgttgccttgtctccctttacagaattgggagttgtagaataattgataagctattaatgctttgagtacttttggtcttgtcttgaggggaggttatttccttgaatatttttccaaatgtgaagtcacgtaacagtttgtttctttaaagctggtatggcacatgttaaaaaacaaaaaaagtaaaacgatcagattagctccttacacagagtctgtattacaagaggccttatttactaggcatttttgtaaaagttaagagtattatggattttttaaaattagactgaatgttgaaattagaggttaaaatgtaaaaaaacaatttcttgaaagtaatttattaaaagtctaatatgtattagcaatccctcatcagtgtagggatgtgatcaattccttaaattcccctgtgttctgctggagcaaatggcccatctatggagctacttgggagaggtagtcaatgacagtgattgatggttataaaatttatcacatgagctttgtgacagctcttgaaaaagtgtacttgaggtgtctccagccttgggtattctcgcattagctagagcagattacattgattgcctgtatttgaaggtgtcccaaaagactggtaagctatcatcagtcttccattattgctctttctctgaaattgtgacctttctacttggtctttagcagactttacatattacaccttgcaatgggtgtctagtccatgggatcttggagagatgttagttctgttcccattccaccctcatcgccatttggcagtgtctgcaaagagttttcgctgtcacagttaatggagggaagtgtgaatcgcatgtagtgaggacagagtaggaaggcgatgaatatgtgactagcatcacacagtagacataactgttaagtgttcagaattaagtagccctaggtattgggaatgctaaaaccaaaaagctccaacttaaataaatttctcttttcctttttgtttctttcaagatgttatgtccatggttgtcagttatttatcagttcatattcatgttctgggagaccttaattaatatttcccagccagctttgatttggagattttatacacacacacacacacacacacacacacacacacacacacacgtccacaagcccataatttggtgaatgaattttgacatgaacactcattcacatgtatatagctatatctgtctatgcatataaacatttggggggatactaacaaaaccatgtaactttgcatacaggatgaaatttaagccccatggtcgttcccttgccttggagtcaattcccagctctgaacaataacaacaaaattagtgtgtttacagtatagttctgtagtttcaaatatgtcttagttaaatggcattacattttagatgaaggggatacctgtaatctaggtattgattggtagcttgtgactaattagtaacatctatgtggtaattaatgaagacagccatgggcgggtgtgacatttccactctctcttagtattaacacgatgctgctttatgttacgtaattacagggtcacatttcaacatctggatgattagcataggagttgtgtttcacattacaaaatagatctctacattagcctatggcagaaggtgtcaagttttatggccacaagtttcggggttcccgttgtattttctggagccaaatgtttttcttggaattataaattagaactaggtatctggtgcaaaatcagagcttccatttttctcctaaaggataatttccagaaggttggctttaggggagacagaaatcgactttgataggtagtcatagcgctacttgtctatggtgaaacgcatggaagctcatacttccatagctgaacagtgagaggtttgctttggtcactaattaccataaatacagtttggcaggtgttttctcatcccctgtaagtccctttccagtcaatataaaatttgtactcctagttctggaatgagctggccaatatagctccagaaggaaacacagaaagtttagaaggctggtgctggcacgtattctccattcatggtcttctatttgtgttataatgagaacacaccagttctcattggatagcagaaagggaagtgcatagcagagctgcaactgttagagctatttaactaagtgctaacactgttgcctatgggttacagcgatcatggtaatgtttctggttttctttgggggcttattgtaggccaatatcaacagtacaaaaatgatacactgggaaaaatgtgcctacaagttgaaaatgttgggcttcctgtttttcccctctcttgaacttgcccagcaatcaaaactgctggagaaagaaatcatacttcaataatcctgccaaatccactatgtaatcttgggattatttgtgtggttctacatggtagctttagtatttcagaacattcctgaattaagtagccttctaacttgacaaaaatcatggcttggcttgtggtagcacacagtgtttcaaatgataagaaaagattattggaggaggggctggagagatggctcagtggttaagagcacttactactcttccaaaggacccaggttcatttcccagcaacaacatggcccttaacagacatttatatgtatttactttaaagggatccaataccatcttctgacctccttgggcaccaagcatgcccatggtgtacatacatatatacaagaaaacatttaaacataaaattaaatgaccaaacaatgtttttttttaagaaaagactttgaggattaatgtttgtcttagtccccttttcctgggtctctgagcaccaggcatcatctttcttttaagacagttgagttctgagaataatcccaactactctactgatgagaagaagtgggtataaaatcccatccctgaccaagaaactatttgtagttggtagctgctgagagagggaaatcagttttcttcagtggtctaacactggttatatcagccacactccagggtaggccttatgctcagtagtagttatccaatacaaaatggacttcatggttttgtatataatgtcttttgttattccttgttggatttttgcctttttgtgtgtgtgtgtgtgtgtgtgtggattttgtttgtttgtttggttggttttcttcttcaatttagtttggcgggggtagtgagaaagaacatgaagttgtgttagattgggatttggttggaatttggttatacattttctattgtgttgtcctcactgttgatggtgtttgattctttttcagactgcaaatacattaaagctaactatccaatgctttgttgcacattaacaatttttccatttctcttcgactttatgatgtagatgctgtttaaactgagttgggtggacaagggcatgaggacgctgcagtgttatagatgattggaatttaacattccttaacctctctataaagccctatgtacggcatactattaaggcatcatgactagaaattctggtctgctttagattctataatattccattttttgtgattattttctactgtattcctgtatcattcttttagattttgtgacattaagctccttaaaccatgaataaaacctatactaccaggatatggccataccaccttaaacacaactgggcttgtgtaatcttggaaggtacataaggtcaggcttactgagtacttgggtgggagaatttatatatccatgtctctgagagttgttgttgttgagtgagtttcctgtgtctgtctaagttattaaggatttccttttatactaatttctggatgtgatttgcagccttggtattcattactcctgaaatgattagtggatttctccagtaaagctattgaggcttttctttgggggaaaaatatatatatatatatataaagtataaatgtaacctctttaatggagtaatttatggcatctacatatttattactgtagtatggtcatttctgtctttcaagtaattagtttattttatctataataggtttttagattaatgagcataaagtattaagtaacacaagattaggatttcaacagctgtagaatctatagtaagttgcttctcttaatcctcatattggcaatttgtgaaggactgatcaattttgttgatttttccaataaacaaacaaacatttttgtgggattgaacttttttctctctgttgattattgaagtttgatcttttgctatgtactgtaatactaaatactggcccctagggcctggttgtccccagggaggagagaatctaaatgtagaccaagtgatgccatatgaccttgtcccccatgttatccctgattggtgaataaagatgcctacagcctatagctgggcagaattgagaatggcaaggttttgggttcccaggcttgggatctgagaacttctaggaggagagagagaaagtggggagagcaggaggcaccatggggtaagaagttcaaaacatggccatgagagctggccagttggagttaataggaacccacatggaacatagcaagttataacttggggcttttgatagggaagtagacataatagcatagagggtagatatctgcccagctctaggactgattaaggcttaatataaatgtaaaggttatgtgtcttttttctgggaactgaatgatcaaaaacaggactgagattaaatactttctacaacaattgatatcttttttatttcattagtttcagctctgattttatttctcttgcttgcttattttaggatccgtgttctcatatgtgaaggtaaaatctggtgccattactcttaagattttttgtttctcatatcacttagtgctataaaaatttcctggagcactgttttggctacaaaacatttttaaaaaaaataaatagttttcttttatttccttgccattgtatcggtttagtttcttgtgttttgagcctcagttatgatgtgtataaatgtttagattgtggcctgctatcatatgatactgtgtaacttgatttatagtctaaagaaccttgtagctatatgtaatatatttcatgtctaacctttttctatttgtacagttagtctttatacatggttcaaacactatacatgatctttgacttcttagtctctaggactgtgaggaattgacttctattacttataacttttgcaacgtcagatatactcttagagcagcacaaaatacttaagatcccttcctttttcccttttctttctcgctgtcttttcatctgccatttctccacccatccatctcttcatttatttctaaaaagctatgagcttctggtggtatctttgattctagttcaataccatatagttcatttctgccttctttctctggcgatgagaaaccttgcttcccataagtaatgtacttacatacatttctgtactcaatcttagttacacaaactagtttcagaactgctcatctagactttttggcgaacacctttaatggcttaaatatttctttcaagctcttatttttatcaaaaaaagagttttcaggcaatatattctgattatgcttacccatctctcacctcttcccagatcctccccttcccctcccatcctattccacaacctttctctttttaaaaaagcaaacaaaaaaccagatacgcgcgcgcgcacacacacacacacacacacacacacacacacacacatcccacaaaattggaaactaaaatatacaagtaaaagatgaataaaaccaaaatttcccaaatcaagatgtaaaaaaaaaaaaaagacagaaaacaccattgagatagcgttggccatctactcctagccatgtggcctagccttgaacatggttaatatagccagtgtgccaccatagaaggcacgtaattctcccaatgtgagtgattatcaattggagataccttcttgcttgcagatgagagattgtccactaacctttggtacttctgaggccctttgtacgctgctttaatctctgtgagttcatatgtacatcaatcctgttgtgtctagaaggcactgtttccttgttatcctcttacaacaaccatttgttcttgcctcccgtttatatatagatccttgagccccaaggggagggatttgtgtaaacattttttaaaatattaatttagtggccaaatactgtttatacggttaggaaaattcgttctattcttgtctacccacttcagcatagttatattagttactcatggtgcaattttttttgtttagtatttgtactatattatgtttcctccaacaaaaacatcccctttgatttttattgcttgtttatatgttcgttgctatgcttctcagaatcagtgctataaaaaaatatgtatgccaagaagtaccattctcctatctccagtactctttcccattccccctgcaccccgtttcttcctgtctactgccttaaacaaatttctttggtttctggcttatccttatcctatttcttgtacctttcttacatgaactgtagcattctacagattactttatatatttttctttttaaaatgtttgacaagtagaatatatatgtatccaaaacagacaattccttccttcctgtctgcttaatacttaccatgatcaaatgaacacatctatcatctatagttactgttttgcacgtttgcttatgtatggtgaggacttgtcctcatgaacaatcttgtacattatttcatattgcttctagagagagatcttcatattttttttacttgtatgtctaccatgtggctgtattataatagctaatctccattttatggtaattttggtaatctccattttggtgatttgcaatattttgtaatttcaaatgaattttcagtgaataatattgtatagatatattttcatattggaggtactttcttaatatagatacttcctaaaacacaatttccttcagtgtgtgtgtgagagagagagagagagagggagagagagagagagagagagagagagagagagagagagagagagagagaggggggcaggtgtggagggagggagggaggggagagagaggtgaagttgtctacataggccagaagaaggcatcagattccctgaagctggagtttcatgtggttttgagtcaccctgtgggcaactgagaacccaactctagtcctatggaagagtaatagaggcccttaatcactgagccatctcttcatctctttatatgaagtcttagcagactccttggagaaatagctctttatgtcccttaaattcctttgagattttttttttaatttttataggaaatagaaagcacctcccataattttgagaaaagcaaaacaaaatttgtatggagctataaataggatccttggaatattccttcatatttccaacgatgcttctttgagtattagattttgaaattcttttcctctccttttagtcatcactttacatataattctcttactttctggaatgttcacagttagagcttgagccgagctctgcttacaatgatcaacatttttgtttcttatcttgtcaaagtcaaacaaaatataacagccgagatgtttacattattgacatggagttggatgcagactgttaatttttccttagctgcaattggcgccatgtgtgcggaaagaaccttggggtaaggagaaagggcagctgtggagagttctttagtatggtggaaaaatcaaaccggcttaaatggtggatgctcctatgttggatctcaaattgaacttggaggttttcaattattaaacacaaactagcaatttggacgcagtgatgtgaagggatgagcgttaaatgcctttctcaaccttagcctccctcagatggtgacccatttgaagtacccttcctttcatctgctttgtgcttgtttctaggagctctgattctttgtattcttctgaatatcttatagatcaaatttccactggaggttttgcttcaaactgcccttctcccaggctctttggtgccagacttccttgcactatgacagtttgcctgacccgcacttccctgcccttatttcacaaagtcatctttgatttattgtatctcggggtaagagcagagaggcagcgaagagcaaatgtcttcatctgcagatagcagcttcctaataaccccaagccttatctgcatgttaagacacacaaggggtgtttttgcctgctagtgtcagctgcctgcaaactaagcattctgagccttgcagaagtttgcaccgtggctctctaaatgctctctgtggtctgtttcgaagaggaagggggaaaaaatccaggatgggagatcctatttggaaagtaacagtgagatctgagtatattgtttattttccttatagttttgataaatttagacagatgaatggatgtcattgtcttttatagaatattttacttgtatatctctcgatactctaaaagcttatttttcaagtatgcactctgtagccatgagcagaagagatttgtttgcttgtttcctgcaaggagttatcatcagtgagacatttgtccttgctggcaccagtacatttcatctacacccttcttactctgagcatgtgcaccatcagcattttctggaagctcggtcgaaagacaggattgcctcagatatcacttcaggcctcctgagtcagaaactaaactcgttacaacatcccctaggggaatgggcattgcacagtttgagaaaaactactagtgaagatggaaatcctgcttaggaacaagggagtctacacattcataatctctctctctctctctctctctctctctctctctctctctctctctctctctgacaaaaatggcatgtttcacaattttctagagcttggatttttctcatttaaatacccattgtaagctagattttttttcaggctcccgggaaaagagcgaagggatatgaggtctagagagaggtccattgtgatctcacccaaggagagcatatacctaaaaaactgatattgtcattacttggctctgcacatctattaaagtacattttgatgcctcgaggtaggcagggatttcttgaaatggaatcactcctcactgttcacagattgtatatttgagaatttgcctactcgctagaatttattcgtagctccagatcaatgtttgctgtgcatttttagttgctcacagatatgcatggggagaacaaacaaatgaattgcctagtagacacagatttgggttaggccatataaggcagttctttcccttattgttttcccactcattctgtaacacctttccttgtcagagtcagtgtagtaccagggtctccatggtttggtttctagcttttgcgacttacggtagtctccaagcatgccattaatgcaatgtttattatttctaagtctaaaagggtggtaatataccttacagggaaaatatgtgtgtttcataagcttccttcaaggataaatgctgatagtagtgactgcaaggtaatgccaaggaactaacaatgtaaacaacatatattaaatgaggtattttcaaacagaagcatacatgcaggaagggtcatgtatttctcgtttaatggggtaatcaaagacttgtgtgaccctaatacaacatttcctccaaggaacaatattctcatagatactttagtatttggagtgactttgtagaacctgagtgctgcacagagtgacagggagctttatagaaaacaactggcctagaatttcagtcagccaccctttccctttggtgcttgacactgagatgcgattgttaggttgtggttggattctaagcacagtaacaaaggaactcggtagtttacaaaagcgcatttcagtattttgtgaatgttcttgcgataaagcagtatttcagagagggtcttactgtcctgtgcaaatgtcattcttatgggcctggcatttgagacaattatattaccattactccagaacaagtgtctatgttaactacgcccctcccttttgtttaattgaagatttatgtttagaacggtctatgtcagctttggtgcctaaatatcacaggctcctaataccctcttttcctgtaacataacccttccagctgctctagttcaggttcacatcaaagtcccaacagctcgtactgtggcccactctgcagtgatacgggttttctgatacagcccccaggcttgctgttacgcttgaaggtctcttgacggcgtaatacatcttccaactgtgtggctttgtgcatcatttctttttcatgaatctggaagtggcctcacaggctaagactataataagcctattgtactactactattgtacagtggtagccttactatttccatcctacagaagtcagtgagagcctcaagggacagacaggaatggttcagctccacttggtttcacaggtaccctttaccttgtgcaaggagtttctgagcatgacaatgcaggagctgcctcgtaaatcagaatttagggataagtgtgacttagtaacagtgaacttcctgcctcagcagcttgagtctgctccgaggtatagaacatatacgtgatccctattggacagtgtccaaacagctgaagtacagggaaaaccgtgctaacttcttctgtggccaatcatttcccatcttacgatatgcagtgcaacactggttaataagtaaagaaccatagaggaaaccagtgcaggaaagtcttaagaagctaatgtccctcttgtctgtgtgtgtttgcttgttttgagacagggtctcgctatgtagctccactgccctgaaagcattacagcatgcaaaatgacagacgaatgcaaagcaaaccatcagggtttcatgactggagtatctgaaagactcccacatgattcctgatagtggtgatctcaggatgaaggtaggataaagagatggggggggcttaaaaagaggaagatgaggtgtgtattgtctgtattctggtctctgatggacactgggttagcatgtatggtaatataataaatgcaagtaaacaaggtcattgtgagtggattattcatcagagatttagcttaatgtggtctattcagttctcagtattaaaacaccatattttaagatctccatctcagggattggtaagggagcctccgccattgaattgatcccatgtggaagggttttgtatgtttggtgtgtggagtgtgggagaaacaaaatgaccaaatataaaatgtaataccagtggtgaactcaaagacaatggacattgtgaaaataagaaaataataaggacactgcacaaagatacagcctttttgagtcaatcagggactcggggtatggagatgaattgcaatcaactgtaatggcgtcccattttgtgctgcttgcattagcttgtcctacattttcttggcagcagggaagcaaagggcactcatcaaaaaaaaggggggggactgcaaggcttgcaagaagaatgttcgtcgtatttcttctacatgccttagcacagaaagaagcccctgctttctaattatatgagaacactccttttcatttcttccagcagtactggttctttttttttcaattttgtgtcaatcatctactctcttccctacttgaatccttgaattttcattttaacattagtcagtagaagacaatgtgcagttctttttctagttgccatgacagaatgtttgccttgacaatgagctgctttgaaggcacttcaggtttctgctcattcccagcatcagccgcgaacagacaaaattttgtctggaagtgaactttctcattatcaatcaggcactttcattaacctctcgacagaactagagaaccagaaagaggaaccgggtattatttggagtcccataaaaaagctatcatgggggtcttcctgtctccgtgatgaatgtgcagacattttcttcttagaacaactatcccatgtattttttagaagcagcaggagaggatggctatttggttgagctgtctacccagctgggaaacttaaacatacaaagggtcttaaatttcccttgatcttgttttccctcaatctttttttttttttttttttttttgcacagaaacggaaggtgcacttcgaagcatcagcctccaggcctgctggctggctgtggctctctgctcctttgttctgtttcttctctcagtgaaagaagtatgtaagccctgctagctgcttgtcacgttcagaactattatcctgtttctgtcatgtctgtctgaccaaactaagaggaggatcttatgacgggaccagctagctataaatagtcctagtgaggcataatttcacttgcctttatgttttccaaagtcctttccgcttgcttagttggagagctagtgctgtaaacttgtaagagtttctaactaaaagtggccattttttccttatgaaaagtaggaaaactactttgaattctttctcatttcaactgagttgtgatgtcagcacctatccagatcacacgcccaatgcaaagagttggagtaaacttggggtttttttgttgttgtttgttttctgatgcgtgtgtgtgtgtgtgtgtgtgtgtgtgtgtgtgtgtgtgtgtttaattttaagatgctagtaatggtggttttgtttttggcatcttcctggtgtaggttaacttacccaattgtgaccaacttgaacaccatcaacagattgagaatcaaactgtgctatctgaatttccattctctggtcacagggagaagtgtggatcctgagtgcacctttggtttgcccttcccaattctcttttgcagacagtggtttgtaaacactctaggaacagggtcaggaatagtgagtagagaatgcagaacatgctgttctcaagcagatttggaaattggaagtgactgcggctgttaattagtaaagcagagaaatcgctctttttggaagtgtgcgctgtacaggatatgtcatgcaagtgagctcatttcactttgggctttttaaaatactacgactcattcttgaatatacactggtagagatgatgtcccctgccataaaataaggtgtagttgtagaagaaaccacagattacaaacactgcaaatctatcttaaaaggcttttttcccctgaaagagtttgtttacaaacttacaaagttcacatgaaggaaataatacacataaatttggggactggaatatagcataattggtagaggactggcctagcatgcacaaacccttgggtttgatttccaatactgaataaaccagaaataatggcatttgccccaaccccagcacttgagagaagaagggaggacaaaaggatcaacagttcaaggtcatcctttgttacatagtgaatttgaggccagcctgggatatatatgataccacatacatatgtatctataatgaacatatatgaaattagtaattatggaaatacccagagaccatcggccatttaacaaatctccatatacacaaatatgtatcctacctaatttttctataaccaagtgggacgtgttgatttttcaacttgacaagttctacagtttcccacaagacaagcatctggattaacccttaggcaggcttattaaagacttcttgtgttttgaagtgtatgcttggctgtataagcctttattgatttgcactatgtgtgtactatcagtaagagaacaattagttgttgctgtgtctaaattgatcccaaaatttagcaactgaaactaactatgaattatttgttcggaatgctataagttagtggcatagagtagataggaatagaccatctctgcctctgtgctgatctgggatcattctcgtgattcttcgtcagctgtgatgtctctccataccatagcagaagatctctcagtagtaatgtacaagcagtttttagttatttatttttattttatgtgcattggtgttttgcctggctgtatgctatgtgaaggtgttggatcctctagaactgacaaagttgtgagctgcgatgtgggtgctgggcaattgaacctggatcctctggaagaacagcattattcttaatggctgagccgtctctccagcctctaaactcttcatgcctctatttaaatagcattttcttgtgttaggctggccaaaacaagtgagtgtctttaagcgcagtaccattgtaggaggggagcctagacaaagggttgactatgagaagatattacttattggaatgttaatataatcatctcccatggtagaatatcaggtttccaaatcattttaaagagaaaggcacattctagttgctgggataaggtatgacagatgaggtctaaggaataccaaggttctaattaatatgatgaatgtactttctgagagagaagtcatagaacagtttagcaggggtattttaatgaaaatagtcataagtgtataatctagtcatttctgtgtattctttggaagaaagggcaccaaaggtagtgaattaatttaaagacagacacacatactaatgaggaaaaagcaagcatcatgacatgaataaacaagaaaaacacaaagtggggaaattattggtggcagacaaatgagctgtattcttaaaaaaattcatgccagcgagaaagcaaaggatataaacagatatttcactgaagcatgtttgcaaaatgccaaagaacacatgatcaatatttaatattatattcttagtcattaggaaaaagcaaatcaaaaccacaagatactactcatactcactcgactgcctagataataaacaaaatgtttctagctgtgaaagaattggaactcttatgcatttctggtgggaacttctagtggtacagatgctttggaacacagcctggcatttctttaaatgactgacacagagttaccctacacgcagcagttctactgttagatacagatccaagagaattcaatcaacttgtatggggctcatcgcttaagagactgtgctgttcttccagaggactggaattcagtttctagcacccatgttgggtggcatacagccacctgtaactctagggattctaaacagttttcgagcttctgtgggcactgacacatacatgaacatgcacacaaacacatacattatatattaaaaacaccttgaggagcaagggtctatttggcttacatgttctgatcatagtccatcacagagggaagtcacggcaggagcattagaagcccattcttttctaataacagacagaaagaaagtggatctggaggggagcagaggggaggaggagcagttgatttgaaccttaggaaatagaggagccagagctacagtcttcttgaatgcagcaggtcagcgttagtagctggtaggatgactataaacctcttggtcttaaacattgaatcctaagtccatagcatcacttctcaacatcctagaggttaggcatttaacagagggcaccttcctccacatctcttgtcttatcagagctagagctgtgaccccatacgtagcatatttgctctgtgttagctctgcctctcaaaaagcttgaagctttttcctaagaagctgccgttttatatgagttgatttcattatcatgacagtttattgcaaatctagtctcatgtcagatcatcatggtgtgaagaatgcatccaggcctcaattacatgtctcacatagaattctttggatgagatggaactgcctgcattcaggggagacagtctatgaaaaaaagacaaagaactctaggcttaggtgaaaatatggtcattatcaagttcccactccagcacttggtgccctgactttctgggagttcatgtagagatgcgcagtgtagcttgttagatgtgttttgcatgtagctgacatccaagaacatccatgtttgacaaatttcattaatccagtgatttgccagaggagcttgagttaagcacatcttcgtgctccagagactgcactgggctgcctgctgttggtcagcagagtttttccagacacagtgaagtaaaaaatgaaaagacagctgggaatgcaagatgcctcggagacacatgggaatggcattggcgactgtggaataaggaaaagaattgtgatgctatttagctgtccaacttataattgcttaaaaaaacttttgtgagataaaaagctataccctcactcaacttcagtttcttatcttacagtaataatttccaacgatgcagagcccaagctcttggagagcttgtatgctcgcatatgtatagagccagcacttgggcctgtggtgaggccagaaaatagacatttaaacaaatggccacgaaatgctgtgggctgattctcctgctgttgccaaaccagctactcatccataaaagtcagaaaattcttttcaactctgctatcctttaattacccttctgggtgtctgagactcatgcataggaccaaaggtgaccactgatctttcaatttgctcagaggattcagtctttctgaccttgcagaggccaaagcatggccagggttcctatgtgcagaaaggctgctgtaattagatttaagagatgggtcctaggagaagctggttttgacatggaattaagctttgagtgatttttgaatatcttccagagctctatcggtcttgtttgaggcatcacttgcaatctagtagtgaagccattagaaagtggaaatgaggagagaaagtagaagctaaggttacagggaggactgacagatgtctacagggacttcattatttattttgtatgtaagtacaactgcagctgtcttcagacacaccagaagagggcataggatcccattacagatggttgtgagccaccatgtggttgctgggaattgaactcaggacctctggagcagccagtgctcttaacctctgaggcatctctccagccctagggtatgcttttaaaacttcgaaaacttcctttaggcagtttgaatgtgcagtggctttatggagatgatgctgtggaaaaagaaccaagggaggtaagaaaactggtagctttgtcctgagctacacgatctagaaaatgaacataccaaatagtgtgtctgccctgtagccctgcagcagaatcagtgcatggaaggtactttctgtggatgaagtttattttgtgaagctcagcactgctgctttggttttctgaccctttcttagttaatgaacacttaaatggaaactttctgaggcgccactgctcgagcttgttgtagataattcttgagaaatgtgaggaaggggtgggcaaaggggttctcccctccctcctctttgttacatactatattattccatggatgtcttataactaatttaacatcttattatatttaaatttttgctctacacccagttttcttcagggcttacaaaatggagccctgctccctggcctatgtaaacactctctcctgaaaatagtattatgtatttacatttctcttaatatgtccacatgcctggagactggctcaggatgagagcttcctagaagctgagtcttgtgttagaggtatacaggctttaaattgcatttgatgcccaaatggctcattcattgccctacagaaatgtggtacccctcctaagtccttagcagtgtttgaatagcatcctgtggcctataaaatgagctactgttatttttaagaagggatgtagagagtttgggggttagtttcttgaatgaaaatgttaagaagcagaatgtatctgaagtgtttctggggaatattattggagctttctgtcgtcatacagtcccttgtagcatttcctgggataaggaacagcttctattcttagtgaaagacagtgtgagagacaccaaatgtttaccctcgggtttcctctgcgtttcgagcttcgtctatggaaatagttttccttaaatactattttatatttatctgcagttctgtagttgaaaagcttattcagccaacgatctgctcacacatgcatctcaagactgccttcagttttgatctctaactttgacatcatttagaatcactggatttctgtgcatcgtgtttgcctgcagtgttttgttttgtttgacaattacagtaaaaaaaattcatggacctctgtttcttacaagggtgcagagaagtctttggtaaaaagttattttctgagtgaggctgtggcaaacacctttgaaaataaagctcagggtccggaccagaggacaggtgcccgcccggctggggaggcggcctaagccacagcagcagcggtcgccatcttggtccgggacccgccgaacttaggaaattagtctgaacaggtgagagggtgcgccagagaacctgacagcctctggaacaggcagaagcacagaggggctgaggcagcaccctgtgtgggccggggacagccggccaccttccggaccggaggacaggtgcccgcccggctggggaggcggcctaagccacagcagcagcggtcgccatcttggtccgggacccgccgaacttaggaaattagtctgaacaggtgagagggtgcgccagagaacctgacagcttctggaacaggcggaagcacagaggcgctgaggcagcaccctgtgtgggccggggacagccggccaccttccagaccggaggacaggtgcccacccggctggggaggcggcctaagccacagcagcagcggtcgccatcttggtcccgggactccaaggaacttaggaatttagtctgcttaggtgagagtctgtaccacctgggaactgccaaagcaacacagtgtctgagaaaggtcctgttttgggccttcttcttcggtcaggaggaggtccaaatacaagatatctgcgcaccttccctgtaagagagcttgccagcagagagtgctctgagcactgaaactcagaggagagaatctgtctcccaggtctgctgatagacggtaacagaatcaccagaagaacaatctctaaacagagtcaactataactactaactccagagattaccagatggcgaaaggtaaacggaggaatcttactaacaggaaccaagaccactcaccatcaccagaacccagcacacccacttcgcccagtccagggaaccccaacacacctgagaacctagacctagatttaaaagcatatctcatgatgatggtagaggacatcaagaaggactttaataaatcacttaaagaaatacaggagaacactgctaaagagttacaagtccttaaagaaaaacaggaaaacacaatcaaacaggtagaagtccttacagaaaaagaggaaaaaacatacaaacaggtgatggaaatgaacaaaaccatactagacctaaaaagggaagtagacacaataaagaaaactcaaagcgaggcaacactagagatagaaaccctaggaaagaaatctggaaccatagatttgagcatcagcaacagaatacaagagatggaagagagaatctcaggtgcagaagattccatagagaacattggcacaacaatcaaagaaaatggaaaatgcaaaaagatcctaactcaaaatatccaggaaatccaggacacaataagaagaccaaacgtacggataataggagtggatgagaatgaagattttcaactcaaaggtccagcaaacatcttcaacaaaattattgaagaaaacttcccaaatctaaagaatgagatgcatatgaacatacaagaagcctacagaactccaaatagactggaccagaaaagaaattcctcccgacacataataatcagaacatcaaatgcactaaataaagatagaatactaaaagcagtaagggaaaaaggtcaagtaacatataaaggcaagcctatcagaattacaccagatttttcaccagagactatgaaagccagaagagcctggacagatgttatacggacactaagagaacacaaactgcagcccaggctactatacccagccaaactctcaattatcatagagggagaaaccaaagtattccacgacaaaaccaaattcacgcattatctctccacgaatccagcccttcaaaggataataacagaaaaaaaccaatacaagaacgggaacaacgccctagaaaaaacaagaaggtaatccctcaacaaacctaaaagaagacagccacaagaacagaatgccacctttaacaactaaaataacaggaagcaacaattacttttccttaatatctcttaacatcaatggtctcaactcgccaataaaaagacatagactaacaaactggctacacaaacaagacccaacattttgctgcttacaggaaactcatctcagagaaaaagatagacactacctcagaatgaaaggctggaaaacaattttccaagcaaatggtatgaagaaacaagcaggagtagccatcctaatatctgataagattgacttccaacccaaagtcatcaaaaaagacaaggagggacacttcattctcatcaaaggtaaaatcctccaagaggaactctcaatcctgaatatctatgctccaaatacaagagcagccacattcactaaagaaactttagtaaagctcaaagcacacattgcacctcacacaataatagtgggagacttcaacacaccactttcaccaatggacagatcatggaaacagaaactaaacagggacacactgaaactaacagaagtgatgaaacaaatggatctgacagatatctacagaacattttatcctaaaacaaaaggatataccttcttctcagcacctcatggtaccttctccaaaattgaccacataataggtcacaaatcaggcctcaacagattcaaaaatattgaaattgtcccatgtatcctatcagatcaccatgcactaaggctggtcttcaataacaaaataaataacagaaagccaacattcacatggaaactgaacaacactcttctcaatgataccttggtcaaggaaggaataaagaaagaaattaaagactttttagagtttaatgacaatgaagccacaacgtacccaaacctttgggacacaatgaaagcatttctaagagggaaactcatagttatgagtgccttcaagaaaaaacgggagagagcacatactagcagcttgacaacacatctaaaagctctagaaaaaaaggaagcaaattcacccaagaggagtagacggcaggaaataatcaaactcaggggtgaaatcaaccaagtggaaacaagaagaactattcaaagaattaaccaaacgaggagttggttctttgagaaaatcaacaagatagataaacccttagctagactcactaaagggcacagggacaaaatcctaattaacaaaatcagaaatgaaaagggagacataacaacagatcctgaagaaatccaaaacaccatcagatccttctacaaaaggctatactcaacaaaactggaaaacctggacgaaatggacaaatttctggacagataccaggtaccaaagttgaatcaggatcaagttgaccttctaaacagtcccatatcccctaaagaaatagaagcagttattaatagtctcccagccaaaaaaagcccaggaccagacgggtttagtgcagagttctatcagaccttcaaagaagatctaactccagttctgcacaaactttttcacaagatagaagtagaaggtattctacccaactcattttatgaagccactattactctgatacctaaaccacagaaagatccaacaaagatagagaacttcagaccaatttctcttatgaacatcgatgcaaaaattcttaataaaattctcgctaaccgaatccaagaacacattaaagcaatcatccatcctgaccaagtaggttttattccagggatgcagggatggtttaatatacgaaaatccatcaatgtaatccattatataaacaaactcaaagacaaaaaccacatgatcatctcgttagatgcagaaaaagcatttgacaagatccaacacccattcatgataaaagttctggaaagatcaggaattcaaggccaatacctaaacatgataaaagcaatctacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattccaacagagaactcctaaacctgataaacagcttcggtgaagtagctggatataaaattaactcaaacaagtcaatggcctttctctacacaaagaataaacaggctgagaaagaaattagggaaacaacacccttctcaatagccacaaataatataaaatatctcggcgtgactctaacgaaggaagtgaaagatctgtatgataaaaacttcaaatctctgaagaaagaaattaaggaagatctcagaagatggaaagatctcccatgctcatggattggcaggaccaacattgtaaaaatggctatcttgccaaaagcaatctacagattcaatgcaatccccattaaaattccaactcaattcttcaacgaattagaaggagcaatttgcaaattcatctggaataacaaaaaaccgaggatagcaaaaactcttctcaaggataaaagaacctctggtggaatcaccatgcctgacctaaagctttactacagagcaattgtgataaaaactgcatggtactggtatagagacagacaagtggaccaatggaatagaattgaagacccagaaatgaacccacacacctatggtcacttgatcttcgacaagggagccaaaaccatccagtggaagaaagacagcattttcaacaattggtgctggcacaactggttgttatcatgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtactgtaagatcgagaattgacaaatgggacctaatgaaactccaaagtttctgcaaggcaaaagacactgtctataagacaaaaagaccaccaacagactgggaaaggatctttacctatcctaaatcagataggggactaatatccaacatatataaagaactcaagaaggtggacctcagaaaatcaaataacccccttaaaaaatggggctcagaactgaacaaagaattctcacctgaggaataccgaatggcagagaagcacctgaaaaaatgttcaacatccttaatcatcagggaaatgcaaatcaaaacaaccctgagattccacctcacaccagtcagaatggctaagatcaaaaattcaggtgacagcagatgctggcgaggatgtggagaaagaggaacactcctccattgttggtgggattgcaggcttgtacaaccactctggaaatcagtctggcggttcctcagaaaattggacatagtactaccggaggatccagcaatacctctcctgggcatatatccagaagaagccccaactggtaagaaggacacatgctccactatgttcatagcagccttatttataatagccagaaactggaaagaacccagatgcccctcaacagaggaatggatacagaaaatgtggtacatctacacaatggagtactactcagctattaaaaagaatgaatttatgaaattcctagccaaatggatggacctggagagcatcatcctgagtgaggtaacacaatcacaaaggaactcacacaatatgtactcactgataagtggatattagcccaaaacctaggatacccacgatataagatacaatttcctaaacacatgaaactcaagaaaaatgaagactgaagtgtggacactatgcccctccttagaagtgggaacaaaacacccatggaaggagttacagaaacaaagtatggagctgagatgaaaggatggaccatgtagagactgccatatccagggatccaccccataatcagcttccaaatgctgacaccattgcatacactagcaagattttattgaaaggacccagatgtagctgtctcttgtgagactatgccggggcctagcaaacacagaagtggatgctcacagtcagctaatggatggatcacagggctcccaatggaggagctagagaaagtacccaaggagctaaagggatcttcaaccctataggtggaacaacattatgaactaaccagtacccctgagctcttgactctagctgcatatgtatcaaaagatggcctagtcggccatcactggaaagagaggcccattggacacgcagactttgtgtgccccggtacaggggaacgccagggccaaagggggggagtgggtgggtaggggagtgggggtgggtgggtaagggggacttttggtatagcattggaaatgtaaatgagctaaatacctaataaaaaagggaaaaaaaaaaaaaaaaaaaaaaaagaaaataaagctcagaattctcaagcttatgtttttgttaatccttgcaaatgcaacattcaatttttattaataaagacatgggtacctgaaatgaggaggaggagaagggcggatacagcaagaatgtttctatgtaatgctaaattcccatcttggatctcaaaaatgtcccctcttccagagctaacattcttttataagaggttggtccaaaaggttgagaggtttgtattccccatgtgtgcatacggtatctccaagacagttccatttcattcagtttgtaattaattcagttgctgggatttaaaagattatttttactttttgtatattagtatctgcctgcatatactgtgtatatgcctgaagaccattgagactagaagagggcattagatgcctagtactggagttacagatggttctgagtcacagtgtagattctgggaactgaacctgggtcctttgcaagagcagaaaatgctctcaactactgagcccccccagttactgtttggttttgttttgtttttaattgtttgtctttggcagaaagtaatgactaatagtcattcattcagcaaacatttctgtggcatattgtggatcttagtcatttttgagaattttataagtatcaactaagttaatgcccactcatattagcccacctcacttatgaggatggttcacagtcattgacaaattgttcagaatgaatgaggtagtccaaattatctggcagcctgaactgtttggcatttatatagtttgcagctatgatagttttttaatagtgaattataatttttgaataatatgtatattcatttttattaaatgtttgttgtattttattaaatgttcattcgaagtattggggttcatccagatacatcaagtactttgaccatattcatcccattatcctctcagcttcctctcccttctactagtttccttccctgctccaagaagtcctcttatattgtcatgacctatagatagatagatagatagatagatagatagatagatagatagatagatagatagagatagagatagagatagagatagagatagagatagagatagatatgtggtatatggtatatatatggtagcttccacatgagtgaaaacatgtgatatttgtctcctctatgtctggcttattttgctcaacaggatgatctccaattccaattccagcatgttttcttgaaaatgacatttggataaaaggaaatgatccccttttctcccccccccccaatcttgtttatagccttgactgggtattaagctaacctttgaacaattcaagtatcctaccccagcctcctgtctggggaaagccttctcaggagggaagatccagagctagctccctgggtggatttcatggcaaccaagaggaagcaactttgatcttagagaaggaacatattccgatgtcctatatgtcgtcagaaatcactgacgaaagattatcactggacccttgatttggttcactttactgtgtcttctgagaggtgaacctccttccaaagggccggtcggtcttcttcaagtacaagtggttaaaggttgggaaaaaccaattccttctgaagagtctgtttctgaggacactgtacaaaagttacactggagattcatttgtgttcatttgtgttaacatactttaaccagatgttttcatttgttatattagtgactgaatgaagttgcttttattgaaatcagtagctaggtggtttgaattttccacatctgaatctgtaaaaagtctaccgatggtggtagaccaggcaggcctcatttcaaccagatagataaacaacacaaggcatgggcattttcaatcctctgcaagggctctactcttgtccattcctttgtttgactggccaagcagtcagcacataaaaatttggaaagacttgttctgttatagcagcttcgaaaaaggaaacaccaaaatgcctctgaaaaaaatgtggctcttggtaactgtaagcataggctatattgcatttggagaagttcatcaaacatagttcagtatttaatgcacaacatgttttctctgcttcatctgaatcaactgccattttattcaaacaagactgtctcgaggagaatggtaagaacagccccttttgaacagacactagtttgttgtccctagaagcctgtcagcttgcagaaatcttaaggagcatgaaggcattttttttctcactatggccatacatgaaagctaattacagagaaccctgtttctgtttgtccctgcctaacgtgtcttctcaacttccattttggtgactgccgtctctgaattggtggtgataaaaatatactgtcactgctattctcggggagagcagagacaaataggacacatcacgataccctctgtggcataatctgtgactcaaattatttttatatttgtgaaatgttctgggaatataaaaaagtcaacaaagatggagtataaaaaaaataataaaacccatacctatgcatcaaccaccctgcttaagaaatggaacaagagttgttatttaaaggtctcttatgtgtcctttcacatttgcattatcctccctcccaccagagataatcccttgtattacacttcttgctttttctactttagctaaacatgctacacagtatgattttgaaagcagcatctaatataaatttagcttttaaggaaggaacggcattgtatccaataaaagcctcaaaagttgtagctgtgtgcaactctgagtacagaagacggggttcatcacaatcagggtatctgatcaccacatagggtgcgctgtgtattgaatgtcagtaagaatatggccccaggcagaggtcatctctcattttctgctcttgagctaacagacactcctctccagctctcaggaagagggcaaaggggaggaaatgagggtccttgatgctgcaggcagcacaaaagagcaggaagcactttaacccatagcccacaaaagccaaacagaaaaatcttcatccagttgacttgctccttgttttacacttcaaagacatatagctggaaaaacaggcctcagcatgtctttttttctttctttctttctttttcttttttttttttttgaggtactggttagttcatattgggtttttttgttttttgtttgtttgtttatttgtttttgtcttgattgacagtgcttcagtttgcatcggcttccctacttctggtgcaggtgtccatttgggataattctgtacttttatccatagttttccttaacttctatcccatgctagagcttagtttactgtttttccttttacaattgtactagaatacattctagtaacttcctgagagagtatacatgagaactctgtttttgactctttatttactttgaaatatctattcttctatcaattcctgagagattgtgaggataataaagtagaaatctgggacctgaggctcagtgatagaacatgtccttgtcttgtgtgagctctgaggtcatccctagcatcaaaaagtaaagtagaaataaactttctaatgaaaatgtgcatattgctctctgttattttcaatttatattgttagttgtaggggaatggaaaggcatttagatcgccaaagggctacttatggcctcatttcttttcctttctgtgaacatgtgaagtctcagatatcacacacaacagggctatggcatgggtctacttgcatctactgtttgcggctttctgtgaactactgtatataccttcattctggcaccttgactcctgagggattaacatttctcgaattattttatcttttcactttcctctttccattctgagactaatatccagaagctgaaagtctccatagcaaatgctttatggcatccaggctgcccttaaaccactgaccttggttctattccctgtatgccaggattacaatcatgtggccctttcttcagctttgtcttatatttttaatatcttggtctttactgtgtcattctcatggggggggagaggctgttagtatttctgttgtttttgatttttcaagagttttcaattccaaacatatttaggtttttcaaatgtttaaattatttcatgggcaccatctattatctttttgaaaattcaactggtatgtgtgtgtgtgtgtgtgtgtgtgtgtgtgtgttcgtgtgttctagctgcaaagcctctattccatgcaagttggtcttttgtgctcttgttttgatctgtcttccttggcagaagcttttctcagataatccgtggttgcttggaaaccagatagctgctgaagctctaaataggtgggtgtggctttggaatttggatctaagttgggcactggctgagaaactccagggttagtatctttaggtcattcttttaccttgagtcacatgccctagagaagctgagggcacttaggtctgatgcccagtctggtaacctctaggggcaagaggactggaagactgcctctacatgcatctgatcacttcatgcccattgttcaattagtatgctcctagcatgcctctacctcccaggcccagatcctttccttgggtggcactgggccgtccctccaccagataaaatggagaagtaagcataatggctttcttcctagcccacgtgcttccgccatcctcttcatcccagtttcagaggcccattgtcagttttctccccgctgggtagaggttatttgtttcccacatagcctgctgagcaacttactctttacccagcagcgtctaaagcactgttgctgttacaggctgctttcacctcctgagtttatcttgtaaagaaaaaaaaagacaaatgacttcttttggcgctcttggtgtggtttcaagggaatgaaatcctaaggatgtgttctgttcatcttggtagctggggttctgtgttcctttttgtattatgggaatctgtcagcattgatgatgcaaagtcaaaggcttctgggtctttatggaatgcctttggaggagacgacttagccgttaagagcacttggcttttcttccagaggacccaggttggattcccaacatccacattgcacctcccaatcatctattacttaagcaccagaggatctgatgctctattctggcttctgtgtgctacaggtgcctgcttgatgcacaagcatacatgcgggcaaaatacttacacacatagaataaaataataatgaaagctttttataaatgaaaatagagcagggaatgatggcaggtagaggcaagcagatctcttgagttcaaggccaacctggtctataaagtgaggtccagaacagtcagggcaacagagagaaatcttgtatcaaaaagacaaaagacaaaagaaagaaaaagatgaataaaaatgaatataatcaaaaatatggttcaaaacaccgtgaaagctttggacaagtccaactcttccctttgccagggctaatttttaatcatgcctgtgaaccctatcaggaccagtacgagttaactaggttttgaaggaaaaaaactattctaatatgctttgaattgaccaacattgcttcctctttctggaagcaaacaggattcccagaaagcatgagaaatgtgccttcctcagctgcaggaactctctccctgctagcctggcgtgtggcttgagggcattcatggtcactgttgcgccttctgcgcagagaacaaaacacatatgctgctctggtctacccagtggaatatatgcctgtaagtgagactgcactgtcaggaaggacttcttttctatatgagtacaaggctaggcaactcattattcattcaatgtcatgagcatcagcatctcaatttcctattgatgcttttgctgtctttttgcagcagtaggaagccattgatccataaaatgaatatagctattactgtgatctttacagtctttgcagatttaattacttgctattagtattttgtgcagacctttgtcaaaccaactacattatgtttcaaaagttatttcagcactgacgagctttaaataggggctagataagtttgtatgttagagtattagaaatattgacaaatatattttctgagtacacagggtttaattcttagcttgcaactgcagtgaaccttctatgcatagctacttagttagtaactataagattctgcctgtattgtttcccatacctataggtagcctttgcttagaacaatatattataaaatgcctacaaatggcttaagatataaagaattatcaccctgctgctgcctgtgaaccataaaatacctgagctggtattccatgtcttagggtaaattattttttgtactaataggacgaacccttttcagttaaaaggattaaacaagtgctggaccagtttaagctgttctaagaaacaatttgagccttaaaaagaattgtaaggacacatgttaaacttccttattctgtttaactagaccttttaccttggagaaaatggtggagaacatatgttatatgttctatatgttataaaatgtttcatattttataattttagtgttgggttttagtgttgttgttatcatgtggatcatctcttaccattcttgcccaagagaaaaaatataggcttgtcagactagacctttgtcagactagaaagaaaatgctgtctcaaagcaaatgttgaattccagagaacttggaaagaccagcgcctccaacctggtactgttgaggatggggttacttcaaatcttcggagagagttcacattggactttggacttggacttaggttttaagtccgcctccattttgtattcttagaattgggaacaaaacacccatggaaggagttacagagacaaagtttggagctgtgacggaaggatggaccatatagagactgctatacctggggatccgtcccataatcagcctccaaacgctgacaccattgcatacactagcaagattttgctgaaaggacccagatatagctgtctcttgtgagactatgccgggacctagcaaacacagaagtggatgctcacagtcagctattggatggatcacagggcccccaatggaggagccagagaaagtatccaaggagctaaagggatctgcaaccctataggtggaacaacattatgaactaaccagtaccccggagctcttaactctagctgcatgtgtatcaaaagatggcctagtcggccatcactggaaagagaggcccattggacatgcaaactttatatgccccagtacaggggaacgccagggccaaaaagtgggagtgggtgggtaggggagttggggggagggtatgggggacttttgggatagcattggaaatgtaaatgaggaaaatacctaataaaaatatttaaaaaaaaaaagaagaagagggggaaaaaggttctttgacctttctaggcttattcttcatcataaaatgagggtaactagcagttcgaatggttaatgtgaagtttaggaaaaaatatgcctgatgggtataatggaatgactatagtgtagttgggggctttaaccatagctatggcactgatcacctgtactttgtacctgttaacctatatctattccatacttaccatatagagagtatgtgtgtgtgtttgtgtgtgtgtgtgtgtgtgtgtgtgtgtgtgtgtgtgtgtgtgtgccatctctgtggtactcactatgttaatattcccactttataaaggagaaagctgaagcacagaaagcacgctttacactgcctgttatgtgggagaactggtctctccactcagatggcttggctccagaaactctggctttactactatccaggaagtgattaataaagacatgctagcttgtgttcctcaataggacagtgttcctctcctgttcatttgcttaatataggcagtgataggtcatccatagtgtataatggattggggagacagttgaagacatttccataaccttcctgaggccactcgggactccccaaacctgaggtgctatgctcaacttccccacacatctgcagacatcctcccacctctgggagctgtgtcaagccttgtgttgatatttctacttagcatcccaacctgtccattagctacaatgtcgtggccgtgaaagatttgctcaatggagacctttgaaggctacttcctagtagcaggggttagctgagttcttctggaaagtaccagatagtaaacgttttaggcttttcaagacataaggcctctggcactactccaccatagctgcaaaacagccacggacagtgtttgtggctttgtgccaaaaaaactttatttaccaagagcctggctgactgccatctgctgccttttgctgaacctgctttcagggtcgtcttccccactttgtattgctgaagaatcaccttttaaaaatagagtttcctggacgtgtccctgtttagtgataatattcattaaaaaaacacagtcattactttcatacagataaacttgaacttgagttaaaattttcattgtattcatgtgtggaaacctggctggtgctacacagttcagagagggcaaggtcagaatgcatacatttacattgaggaaacaaactaaactgcaaagggaggcaaaactaacccttccccttgcagggaacatggcaggtgttatatctgtcaggggcctgtaacttataaaggtacaaaaataccctgcaggcaaggggagcttagaatttagaagcatggaagggtatgttctatatagacagtgtgcaattttcctctgacgtgaggggtttagacagcctgaagactgtttctttgcaaatttttaacacactgagaaaacatgcttttgtgaagcagggtagctccacaacacgcttggagcagcagtatggacatctcccttgcttgcaggctcttctccatcctttgaggcttacaaacctctgacttagtctgactcttgcattgtgaagctcatccttccatttgaccaaatcataaatgtttctctctgtctctgtctctgtttctctctctctctctctctctctctctctctctctctctctctctctctctctctctctctcttctctttctttctctctttctccgatcctctcttcctctcttcctcccttcctctgttccctcctcttcctcctcctcctcgttcttgtacagggtgatggagacagagaaagattgggaattggggaaaatctcatccttttatcttccgtttgcacatatcaaagatggccgttaaagatgtggaagatgtaacttgtactgatcgttaaagtattttatatggattaaggaaaagatgtttacactagagagaaaccgaactttggaagttcttggtgtgtttataagaaggagaaggagcagaaatgggggaggagcaggttacctctgtgcaggattgtcatgttgaccggctgggataggagcaagcaggaatttgtaaacagtctagataatagagacatcagtaaatatgccagggaagcaaaaaccctttagcttggcaatccagtatacagttatgctcttgcagaactttgaagcagctgttctgctaggttgaatatgattcttccctgaacagaacaggaagtctggcttgtacatttctaaagagaggaaattcagaagacccaacccccatacgttccgttgtacacctccacttagtttgaaaatgcaatgggataaacaggtggatgggtgtcaaagcggttgacttttattggaagttggagcaggcaaggagcaaggctcttctttctggaagttaaactgtcttgaagcacattgtgctactgtgcacatggacctccctaaggattccatcccaagtgcatcttttctatgacatgtgatcttaggacctgctaaatgtccagggaatgttacgtcactattcatcttgagatcttaggcaggtggctagtgttacaatcctaaaggaaaaggctattcattagccactgctggccactgccatgtctcaagtctcttgctttgtgagaggtagagaaagaagaagtcatagcagctccttgcactcttggagtaccagaatgtacactagaatccagcctggcctactgggatttggtttgctgccctcttgctgagttcagcctgctctgagcacttggagtttcctaaaagagcccagcaagtgtgctatattctttttttccacaggcagtgtgttctttccttgtttagatgacaaaatctgtctctagcatagggtgctcatcagtattaattagctaaggcccaggcttgtccttcagtccttcctgaggactgcaggagaggccttcttcttgtctctgaaaccatcatttgctgcaggtttttagaattgtggccacagtacccataagggggcttagagttgtatgcaagacaagaacctgttttcaggagacacgtgttgccattttctattcataacccttaggtcctaatttagactgagaatctacccccctcttttaaaatttttatgttttatttttaatggtcagataattgtgttcgtgtgtgtgtgtgtgtgtgtgtgtgtgtgtgtgtgtgtgtgtgtatgttttactatgtggtgctttgctatatgtgtgcattatgaaatgatcaaagaaggtcagttaacatatccatcaccaggattatttgctgtttttgataagtatagataaaagtcctcggctcttttgagatatgttttgttaacgatactcactgcggtgtgcaattggaccctagaactcatttctcttatctaatggaactttattcccattaaccagtatgtctctctttatcctgtccattctaggcctctagaaatctccattttactctctattgttatgactttttgattctacatctgagtgaaaacataagatatctgtctttcaaagtttggagctgagatgaaaggatggtccatgtagagacttccatatccagggatccaccccataatcagcatccaaacgctgacaccattgcatacactagcaagattttatcgaaaggacccagatgtagctgtctcttgtgagactatgccggggcctagcaaacacagaagtggatgctcacagtcagctattggatggatcacagggctcccaatggaggagctggagaaagtagccaaggagctaaagggatctgcaaccctataggtggaacaacattatgaactaaccagtaccctggagctcttgactctagctgcatatatatcaaaagatggcctagtcggccatcactggaaagagaggcccattggacacgcaaactttatatgccccagtacaggggaacgccagggccaaaaagggggagtgggtgggtaggggattgggggtgggtgggtatgggggacttttggtatagcattggaaatgtaaatgagctaaatacctaataaaaaatggaaaaaaaaagatatctgtctttatttgccttccttattttatttaacattatgtcttccagatttattcatgttgccataagtaacagaattttctggttttatggctgaatattactattccgtgtgtgtgtgtgtgtgtgtgtgtgtgtgtgatagttggtttttaaatctacttttctattaatcgacacttagctttttcctatgtcttagccattacaaattaacgctgcaatgaatatatgatttaagctggaaatttttatctaatttacaaatgaaattttaggactattggtgctttcctatattttacaaattatctgttattttatagttagatataataataagcaaaataattttaaaaccgtatattaagaatggggaatggtagctcacacctataatgcagcaactgggagtctgaagcagtaggattgccatgagtttgaggcaagtctgggcatatagtgagttattgtcatcagcctgagctacagtgtgagagtctgactaaatccaagaccagtaagaacaacaaaactgtaactgaaatttaaaaaagaaagactaaagcatttaagctatccaaagcttatatatgtggtatagctactcagatctccccctctctcattcactcactctgtgtgtgtgtgtgtgtgtgtgtgtgtgtgtgtgtgtgtgtgtgtgtgatccctcacaggtgtatcctagtgcaattccccatgtcataaggaaaaccatcatcaggctgtggatagacatagaaagctggcgttgactgcatttcagcaccccatttggcaaggaataatgaatttgggaatgtatgtggctagtctctgttccttgccattcagaaattgctgactcatagaggccagtacaagtagtttttgttgttgttttgttttgtttgtttgtttgtttttcgagacagggtttctctgtatagccctggctgtcctggaactcactttgtagacaggctggcctcaaactcagaaatctgcctgcctctgcctcccaagtgctgggattaaaggcgtgcgccaccacacccagctacaaatagtttttactgccttctttttttcctcccaacatgtagcacgatccttgctactcacagaagctccataaatatgtacttggagctccataaaatatgtacttcgagcctgccagaattacagatattcgcccatctgaatagattgatcacatcatatggatcttcttgacaggcgtgatataagcaagaacaacagcaaaatatttactactttgctttcatttttttaaagcaaagcctgcctatgatacagaattttggtttcttgctgttaaggcaatgttcttttctttgtcatttcttttaaatacttgattgacatagtagtttaataactcctaggtaggggctggaaacatggctcagtgggtagagctcttgttacttttgtagaggactcaagttcagttcccaacactcacatggtatctcacaaccatctctaattccagttccagggaatcccattttctcttcttacctccgtgggcaccaggcaaacacacagtagatatacatacgagcaagcgcaacagtcatatacataaaataaataaatataagaagttttaatatattttttcaagaagccctaggtgaagactagagagataaattaatcttttaaagacattctaggaagtgatacttgttattttgtcacaagatgtattgtttgtttgttttacctttcagtgttttcctagtaaatggtaccccaggctttgaatgttgactgtcttggtaggtatataagacacatgatagaccacagctatttatagttatttttaatgaactatcttaaaataataaataacaaactgctagagaaatgattttttaaaaaacattgtaataagtctacagctacaaggaacattaaattagtgctggagtttaaccccagggaataacgagaatatggggtgctgagtggaaggcagattctcttcattatccatctccttgtgtcttttaaatgttatgtggcacttatttatgatcttttggaagtaaatgaattaaaagcaaaatttgatcaaagccagagtagtctctgtgtcactttgcctgtcagaagcataacgggcagactgatggaggctgtgatgagccatctccctctgctttaccaatgtgattaatgtcagtgacgctgactctcaaaacagatatagtcaccgaagagataagcaacttcttcatttacaacccaccattggtcttctgatagtctgccagctaaattaacttcttaagccaagaataacggcttcagtgtggtacatacaataattctagagccctgaactgaatcagaaaaaaaaaattcaggtttccttatcttggccaagcaaatgattggcatggagcttagatctttatggcagcttgaaactgttgatgtttagttatagaatataacattctttggtttgtctaggcttgaaaaagctcagaagaacagaatttcttggcttcaagtaagttttcatgcctttgatcaagagcctgactgactggtgtgtgctctcttgatcattattgggctctgcttagagtggattgattatcaagttagctactctccttcaacaaaataggaccatcaaagacaaaggaaaccatgctagatctcatgtccatcattaattttggttctccctgcttgttccattgagacttggttattttcccccgtaccctaatattggccatgtcactagtatgatgtgagagataggatgcaaatatttcttgtggcccaccatgatggcatacacttgtaattatagtacccaggagactgaggcagtgagaccacaggcttaaagccagtctgagaatcctgctgaaattctctctctcagacaaaacaggacagaatttagttgtatgcctatttctgtgtttgagattttcttgcttatagagactaaaaccctgatttttttttaaaaaaaatcatttgtataacaactcatatgttgtaagaaacagcatcaaaggtttaaggtcagatgaacccaatgccaatccatcttttcaaggctctgtagagttgtaggtgatgtgtgggcactgtcaagttcatttcctcttatccatgagctctcccagcagcaggccctttgtatggggtttactgtgataatggcatgggtgctgatactgttattccctagtaagatcagaggtcccattcctccaaataagctagaagaagatgcagaatgtgttgccctacattctggagctttcgctttctgatcttccagagtactctgctcacttagttttcttcttacatcatatgttttttttttcctcagcctcctttatcagatcttcccctttgccttagtttctcacattggggcaggctcaggcctctgctccttgatgacctcatccacttttatgattttaaatatcatctcaatcttcaaaacacacactctctctctctctctctctctctctctctctctctctctctctctcaatattgaggcttttagcccacgctctctctgctttcatatttaaagctcaccggattcctaaactcagataatcttttcccctcaagaattaaacaaaacccagttctacttacagttgtgacctttcttagaccccccacttctttctctctgaaactgtgtgctgtatccttcttcttgacccactgtcaccctccatgtcaagaagaagagatgcagtagaactgaaacacattataagttggttcctatcccttggatttttaagaacaaggaaacagacccaatgccatatagccaaaatacatggattcttcttctctcagaaaagaactctgtgatgatttggagggctttgtgtttccagagccccccacccccagagttcctttataaagataggatatcccagggtgattccaagcaagagagataacctgtgatgtatagctataattttcttttcagtgtttctctttctacctggtaagctgtaacctccagcccacaagattctattattaaaacactgaatcatagagtttaatcaagccaacctattggaaaaaaatgctggcagattgtctcgaagaccgttgagtcatgagcaaattactgcacttcctcttaggtcatcacgttattctattaacatttgagaggtgtctctgcttttggggggcaatcaatcttgactcctctttatagggtctttttagtgcttagtaatcttataggtcacatagaataggattcaattattgatgtttcctaagcccagaagtattacctagaagtagttcctaaaggatcaagaagaaaaaaatgattcaagtaggatcacctagtctgacccataagtaccatatttgacttttctgcatgttgctcacttgaatttaaaggcaaacatatcaagttgagtggactttactgtaagattgtgattatctatggtggatgcacttttgtactgctagaggtactaaagaggtctgatgcctagggctcacaacaaaatctgatttttgtctttggatacgctcaggaccaggattttaaaaactcctcaggtgatactaatgtggaatcagtggtaaggagtctctacagtaataagtatggaactaaaaaagagtcagaaaggagatggtagttagtgcccagtatcagtgatatagtctattgaagatggggtttgtgggactgtcactgcaaagatgttcttgcttgatgctatttctccagtgctttgtgtgatgccagtaagtggcaagtgatgaataatgattgactgaccaattaataaatatagtagcactgaagaaatgagaactggaccaaacaaggtaggcaatgggcaaaaggtgtgatttgtaattgacttctagaagtcatttatttctaagtgctaacaaatgttgtatacaaaggaatagctgccagttatggagtggaggtaaagatcattgccactgggggtactttgaggtgccaaaaggcagaagttacgtggatgatagggcatagaggggagtgcacaataattagcaagctgtcagtacttgcaaagccataaacagactggtagttgtagctaatagaaagggttgtaatagatggtatagacagatggtctgagtatcaggggagaaggctggccattagggaatggagtggcagtggtctgggagttgcactggaacacgatagagaagctgtgtttaatggcaatgagagtgctgagcgttagagaaatggcacagaatatgcagttgtctctaaggagaaccgtgttctataaagggctaagaagtgagtggcactttcagaagacaaaaaaagggaactgatttactagaaccagctttggggggagggggtttcagtatgtacccggattccttgccagattaattttgcacaccaagaaaccatccaacttcaggggcatccaacagtatttgttgcatatttattgtgtcaagttttggagttaaatgggagtcacttaagtggctgtggtgatgttttggctggacctgatcacatgcctgggtgttagctaactgtcagctgatctctactgtcttaggctggaggtacttgaatatactgtgtggatctcatctacctcctgggacctgaggacttgtctggacatgaccttatcagagtgaagatgagggcaaggtgaagaacaagttcaactgctcaattcctttcaagtctctgcttgggttccatttgctaataccctgttgtctaaaattgtagctaagtcacgatgggaatgatactgttgcatagcaaagggtaggaatgttaagcaggggtagaaaattgattccatttttttttctatctaccaccaaatgggaaaggagagaaggagacagattgaaaactccaactggaaaaactatagctggaaaagttcccacctatggatgagcaacagcttgtaaatgaagcagccatgctatttggcttatttgtctgcatttccatagtcatcttgatggatagggatgaactacctgaggcctcttagcagaacactggacctactcgctctcttcgcctttgtgtatacatagtaaagagggatttcttgacattttttccaaattgttgggttatagtgaggtaataattttgcaaatcatgaaattaatgccacgggtagatcatacctcaccatcttttcacatgtagatcaactgacaattggctaacatccaggtctgtaagtccagccaagataaacagagccactttaaagaatgttgtggccaagttactacctaattcctctcagggatatcaaacacctactaatgtcaagccacaagtctcttgaaaacaatgacttatttttttaggctctgaaattgagtattgactctgtattcgtctactctgttttactataacaagaatagttgaggctgagttctttggctttttttccagaataccgattatttggttaatagtttggaaaggtcaaaggcctgagcttcttacccgctggtgaggcacttatggctctggcacagcatggccaatggcaccatagcaggagtatgtataggtgagagtagtggtgtacatgggtcagaattcatacaagagaagcaagacactggagagggactaggtttactctttcataagaattcactctcacgggactaacttggccatgtaagaactacattaatatcatctgaaagtgatggccctagaaccaaatcaccttcttgtaaggcaccacttcttcaagatctgttattttttaaaattatcgcattggtttgcaattacatgaacttttgagggacacacccaaacttctatgttacagagtaacattgattctaaacctgtagtaacacttatctcctctggggggcagtgctctctacatagccttgggcccataggacttggttttcttcagagaacccgctctggacttgaacatgggtaacaagtatacctaactgccagaatgcttgtgttaggctagctttctaacctcccatggctcaaggacaacttccttgctgtctagataggtctttcagatagacgcaggacttttagtgcaacatcattttcctgagagctgtccaggaacagagttctattggcattaatgttaagtgccctttagatgcctcatcccactgtccaccatggggtatgaggactgtgttggtaaccggacactgagtcagatgttcaggtgactcttggagtcatcacagttctgtctctgaacaaggacatgcttgtgactatgaagtgttgtgccaaatatggttttttgaccttaggtccacttgtggtggctattctggtggtttagtgttatcctctatcctctggtgctcaacagggaaagagaccttgcctatgggttttgggggcctggtgcatgatatctacctgtgaaggctcaccgatgaaatgttgcttaactggcttagtaaaaattgcacatgcacacttgtgctgttgccttcttcttctgtgactcactgcaggtcagtcttagagttgcatgttaaagctacttgttttcttttttcttttttttttaaattaggtattttcctcatttacatttccaatgctatcccaaaagtcccccatacccactctcccccaaccccctacccacccactccccctttatggccctggcgttcccctgtactggggcatataaagtttgcacgtacaaagggcctctctttccagtgatggctgactaggccatcttttgatacatatgcagctagagacaagagctctggggtactggttagttcatattgttgttccacctatagggttgcagatccctttagctccttgggtactttctctagctcctccattgggggccgtgtgacccatccaatagctgactgtgagcatccacttctgtgtttgctaggccccggcctagtctcacaagagacagctatatcagggtcctttcagcaaaatcttactagtgtatgcaatggtgtcagcgtttagaagctgattatgggatggatccctggatatggcaatcactagatggtcctattcagctggtgtccagctgctcttatatgtctagtgcctctgatggcttgcccattcattggtaggtttggaaaactgaattgcttcaaacattcgtatctatcaagttattgacttgcttctccttcatgattactaaacatttggtttttttgaggtttgatgacatcgtctttaagtggaactccatgaactagctgggtgtgtttagatctgctttctaaaactgacatatggcatgtgtataaaaactggtatctataaagtgaaatttctgccatttattttagaaataaatatgcaacttagtattggcctcaagtcgataatgtggattcctaccgggaagctctacattttgactacaagccaacccatttacagttacacttaaatataaacatagcatagcaatctggcaaacagtctcagaaatccaaagcacaaccggcctatttgctacttgtatatttaaggaaatgtatctgtcattgagcgctggggtctagaataggacttaggagaatcagggcaggaggtactgtcactgtagtgttccatgaggttgcctaatggtcttagcttttctgagacactagagtatcctgggagaggttagctcttggcttctctctcactcagccaccattctgtgctaagattggtggctctagtgtagcctggtttgtgcccatagctttttcttcataaatcatgtaatgtatcctatttcatccagtcctttattttcacattgcatatctaggtgttttcatacaacaatgaggaattatgtagagaaataccaagagtagcatctttacgcatgaggaaaattgagaaactctgacatcaggatactgtgatgcaggtggctttgcattttggtccttaaatagtatttgagcttggctaagtaacagatgtatgcatagccaagaaccatagtacacacttcaggtgtatctcttttgagatacacgttatcttttaaaagaagttttattcaataggaatgcaatatatgcctcatgtggaatgttcaagtactcttattcaaaattaaaaacaagtaagggggattaggcattttatccttaatttctcatatttgctgaaatccaatatatattttccacttacgctacctctcagtttttagcagccgcatttgacatgctcagtagccactgtggtgaatggttgtggcgtgagcagtaccgtgctgtgaaactgagaaggtctgcatgtcaggaagagtggtatgcgtctgtaatcctatctctcaggaagcagggacaggggaattttagcttcaaggccagcctgagccacagagtgagattctgtgtcgagaaagaaaaagtatttacgatacagtgtggagagcctttaccacaattcttgtggagtattgtgctatggttttctcatggattttgttgtgagcagcagcatcttgattaaatttgcaacagtgcacccaaatcacttacactacagccatgaatatctcgctgttcaccgttcagcaccttgttgctttttgaatagcattagagaaaaaaaaagagagagaactattgttatctctattaaaaagttttcttcttgattaacattttattatcatccaaaataatgggtttaattatggcacagccctgtatctgtgttcttattgtttgcacttctcctgaccctcccatcgccccatcttgctctttgaggtcctgctggtccccctcctcctcctccctctgctttcatgtcattttttaaaaatctaaatccacatgagaaaatacacaagagattgatctgaaagcgtttcttgatgtgaaagctaggctgagaattcagggctagctgtaatgaggcacaacactcgtgcagatgcagcaccatgattaaaggctcactacatcagtgactcttgaggaggaaggcgggagatgataggagggtcaaaaggcctaagtgcattagcccttgttcaattcaattcaatgcccctttgacttgaggccctctagcaacctgagctgtggctcccaccaaacaggtaaataggagcatataggacttccagatatttgggacttcttgtgacatctatcctactgcagacttgtttcattggaggtctgtttagtttggtatctgctgctctccaatggtagagatgccgtcagagccttgcctattaacattggggactcgttacctcagcaccttccttcgcattgtccgggctagacaattggacacttgtgattagaatggttggctcgtaacttactatcttatactatggaaggcttaggacacttgtggtgatgcttgaaaggggacagtttcagtagaattttcattagagtgttgctaaggggaaaggggacaaataataatgataatgctaatttatgattttagtttttcttaagatatattctaaagcatttcaaatcattttagtaaatgattatatgcttcatgtaagctaaaagtgctgtcatatattgctaactttatgttgtggttttgattttttgttaccaaatatggtaattgttgaaagtacatggtggctttttaaaatttctttccattaatgcttttggaaaatcaacaagccatatacttacagtatggggacaatggaggcttctcctaacaacgaatcgtctgaaggctttccactttttcaaatagaaatttaaattcagaatgactgaatttatctccatctagattcaaagttgggcgtatttggtctggatgtgagaacttttgggaattagagcattcttgctgtaatatcattttaaaaatgcaagcatacaaaggaggaccaaatatgtatagtgcgttgctttggtatcttctgctatcatcatgtttaatttactgtatgcctttaggtgatttagagagctagcatgctcttcttccctgttatcccttccacctttagcaatttctcttgttttgtttgtttgtttgttgattcatcatttagtttttttgtttttgtttaggtctggctttttttgagtatttttctcatcgactcttttttttaattactagatattttctttatatacatttcagatgctattctgaaagttccctatacactccctccgccctgctcccctacccacccactcccgcttcgtggccctggcattcccctgtaatggggcatataaggtttgcaatatcaagggcctctcttcccagtgatggtcgactaggccgtcttctgcttcatatgcagctagagacacgagctctgggggtactgattagttcatattgttgttccacctatagggttgcagaccccttcagctccttgggtgctttctctagcttctccattgggggccctgtgttccattttatagatgactgtgagcatccacttctgtatttgccaggcactggcagagcctcatacgagacagctataacagggtcccttcagcaaaatctttctggcatatgcaatagtgtctgggtttggtggctgattatgggatatatccctgggtggggtagtctctggatagtctatccttttgtctttcttctggcttttttgagactaggtctttcatgtatcctaggctttcttcaaactccctaagttccctagtgctaagtgggattacatgtgtgtaccaccaccaccccaaagtctttccagatgatctccttttatatctgaaattcctagagaagaatcctatgacagagacacaaaatggcacagcactgtcgcatctgtgatgacaagtgagtagagctcatggttccctgtgcccagagtgagcagaaacagagcaccaagaacaggaataatctcaaacccttgccttcttatttgtactgcccacttagacaagtatttggggggaaaagaggaagaacagatgtttttcctcttatattagatagtaaatgatcaattaactatggatataattcttaaaatatgaactggctttaaataaattgttctaaatttttattcaatcaaacttgaagtacacatctttccacttgactctttagtttgcttgtcagccatctagattgtggttttatttcttcatcgtttttattagcacaaattcactgcagaaagaatcggtttgtgtgtagcatacaatatatgtaaatcatgttctttgatcagatatacctcctcttagcctctcttgacccccaatacctcttctccttcctaaataatctcccatttgctttcaacacacacacactaaaatctagacaacacatatgaatgcaacaataacacttgtctttcagagtctgactaatagcccctaatatggtgattggcagtctacttaagtcgaaatcacacagtatcaattttctttgcggctgagtaaaagtttatgtgtatatgtcatggcattcctatctatttgttgacttcagttgaatctttaaacattggctatgagtcagattttaattctgacatcttaatggagatgctttcagtacatcttaggatataaagttcatagaactccttagagcagtggaactggtgtgggtatggctttgaattgctgccttccttagggaatcttgattgaccccctatttacatagagactatttcaacaagcatagttttacacttttatatttttgttgttcacccagaatttagggtttgcaataaagtcattcttatagtttcaagacatcttatttatctcttgttcccgtaatgtgaggcatgggatgggatgtgattgctccttgtctgtctgatttcatagcctcaatgtaagggcatgtgtatttctctaaccctctaaggtttttcatggtgtgacactatcctaagaaaaccttctttaccatatgtaaaatttccaaaggctttctatgctattttacaaatttaacatatcatttgtaattattttttgtattactagctcttatggcctgccccatagtaaagtatggagaagaaagaggcattatacagaggacatcctctaggggatggattctaaatttagaacttcattaattggagtaattgattaattgatgtaaactattccccttctaattgtgctaatgttattgaagcttcaagagcaccacatgctaaaactgccccagactgttaagcagcattttgtgtatgtagcaatgatggtaaaccgtatctacctgagctatagaattcttggttagtgcatcttttgttcactttgcctgaaattcaccctctctatttaactgctccaacaacatgtctagttgactttttcaaaataaattatttctaagccatacctgtgttgacgtttgagccaggggtgctaggaactgagtccaggtatctgcagcaaaacaaggccttcttactgttgagtcatctctcaaaccccaggtttctttcttatgtttattctatgaccaattatacgctgttcctcagtatatactgatctgctaatttggttttcttattgttttattttagtgaacattttattacaattaacctattaatggtgcagattaatggatttcaccgtgacatccccatacgtgtacattttgagatttgatcatgcccattttctccattttgcgaagaacctcactttgacccagttcactacagcatccggtggtttctcgtaacgaattctttcccagcctctcatgaacatgagcatagagattccgaagtataaaaacaagctcttgaacctcagcaaactgatactgctaaactgctgcttgagagcagagcctggtaagccttggtcaagtggggaccaggaaataagctctctgcaaagcataaagtagggacatttatctagagccaaagcaactcgaaagccagatgaggcactccagggagaggacaaaggtctgcttctgaattcctgctgaacatgcaggcagtgaccttgaatgctgctgcttcagattgtccttcctgtccttgtcctttcacaactgtgtattggatgggcacatctgtgacttatgacttcccttgcgagaaatagattacatcttcaactggaattctgaagcttagacatgagacaggccagctaatccattctgaaactggttttaaatacatgctaaacaacacacaccatgatcgagtttgaatttgtccacattagcttggaagcaaggggttctagaagaggccaggggacctccaagggaagaaagtattatgaaatggttcttctgaagtgatggtaagactttgggggacaggcagtgccataatgtgaccttctgtaatagtttcatttcctaaggaagatgaaagagacattggatgatgtttcttaagaaagagacactctttcctatctctattgatgagtactgatactattttgtttccagaaataaataaaatatttattgattgatgaaaataaattccactttataatcatctaaaggaataatgataatactatctctcaattgtttactatatgcctcaaagtaccttaacattcaccatggagtgagaacctcatttagttgtcagtacagctttgtgagtcacggtaattgcagtaatgctatcatcatttaatagacagggacactgagacagagaataggccacttgccctagttttcacaacagccagcagcagagcgagactgtactgcagctgtctgtacaactcttacagcagccatgcgggctctttgtcatcatggactctgcattaggaatttcagagatgcaattcaggccttccttttatgaagccccactgtgcaaggttcgttgcaaccatctcatttctagcaaaggattttgttattcgtgtttagatagtacttttttaatgccctaatagcagcaccaataaatttatttatgcacattaactagggctgactgcaattctgtctttcttttcttcttttttctccctttctttttggaagtttaagtgagtcacagactcagggtcagtggatcagcaagcttttgtcccctgtaccttctacaataaaggtatagtcctgttgaaagaaatgcagagaagctagccaagatgctacaaaccctgtggctttaagaaagaacatcttactagtgcaggctcattgattcctcctgactttctggaaggtgtttccttactctgctgcactggaagctcctgtgtctggctaggatttccgcttactgctgcattccggtatcttaaaaactggcctttgggtgctctgataggccaatcttcttcctgtaaaattccagaagtggtgtttcagtttcatgtgacctatacgttcttttgaatacagtgactcaaaagtcactttaatcttgtgacccctggctatgtttgcttccttttaatactccttccagtttgtgtctggtgtatgtgcttaaagctggtctattctaagtgatgtataatttgatgtccttggcctgaaacttagaaatgccctgccagttgttgctacaattcaataccagattcccaggagggagccaggtccacagggcttttcttccttcatatgttacttagtgattggtaaggatgctgagtttcctgctgcctcttaaaacacagcatctttcctcatgggactggaagcccctgccgataggaggaaatctttctgtgtgcatatggacccagcagtttgccagcatgtgtggctgccaacagttttctcctagttgcaaagactttattttccctggacagcagtgctatgcaacccagtaacacagtaagctcccattgataggaacttattttatgtatgtggtgaagtgcctaaaatatacttgggtttttaatgtgtgacacttgagtgatgaaacgtgacattttgcttattttatgcaaagaatgtgtcaatgttacaatatgctacaggtctgtcctaagataacgaattgccccagacccaagagtgttgtctatctcttaaaacagtgttggagccactagagaggcctcagtacctgtatctgttgaatggtgctggggagaatttgctttctctactgcattacctggtcaagtatgtgaaggggaaagaaccaagagcaaccctaaactcctccttcttcttcaattcatgaaaacatcacagcctttcatctttttttccattgtttttttttcatccgaaatagtgtctttttaagtagcccacagcctccttatgtacctctgactagcttgaattttggaatctaccttcttcaggctccctagtgcaataacaggtgtgtgactatacctgactcttcacattctctttttttggagagatttatttatttatttatttatgcattaacagttaaattttttattggatattttctttatttatatttcaaatgatatcccctttcctggttcccccctcccaaaaaccccctatcctattctccttccccctgcttctatgagtgttactccacccacccatccacacccacctccccaccctcaatttatttatttttatataagtacactttagacacaccaaaacagggcatcagatcctgttacagatggttgtgagccaccatgtggttgctgggaattgaactcaggacctcggaagagcagatgggtctcttaacctctgtgctatttctctagctgctctttgctttctcttaattgaatttatattggcttacagtctttgcctctggaattacatgtaggcccccgttgatacaaacccaagtgctaatataaggtttgtcagacagcgagatactaagacgaatctagtgatccacaatcagccattaaaaactgaaatgcataaaatagaatatatatgtctgttcatagtgaagctaagtgtgggtttaagaagccatttaatacatgaatgtgtgtgtgtgtgtgtgtgtgtgtgtgtgtgtgtaaagagattcagtataaatcttatttcttttttgttctcttattttccccaagacagcatcttacattctagcctaggctggcctggcattggctagtatgccaggctgatccaaagaacacagtgatctcactgcctagtttcctgaatgcttggatcacggactcatgccaacatacccagataaactttagttcttatgtggatcacagtcaagtctgaaagaccaaactgtctccttggcctagcagtttgattttatagttgttccagatcttgatcatcgaagtgtcaattatgtggaaccttcctttattatctggacaaggccactgctaaatcatcaaggacagatgaaattatggccactttgcatgctataaggcaataagtatacacattgatataagggattcttgagttaaggattctgggaaagaattcgttaagagaaaccaccggatgctgtagtgaactaactctctctctctctctctctctctctctctctctctctctctctctgtgtgtgtgtgtgtgtgtgtgtgtgtgtgtgtgtgtgtacttggttttctattaattcctggcccccaggaaggtcagcttattgtcatttccagcttctctccagaatacaagtgtttaaagaaaggacttctggaaagaggtgtgctacattttattttcataccttagtggataggaggagctccctagggtacatagaaaaataacttcagctatctattaacattatctgctgtggactaatggcctgggttagagaatcattgtagctagctgtagctgttctctctctctctctctctctctctctctctctctctctctctctctctctctgtgtgtgtgtgtgtgtgtgtgtgtgtgtgtgtgtgtgtgtgtgtatactcatgtggggatgaccttgcctgtgtgggtacatgtggagaccagaggctggtgttgaaatgtcttcttgaatccctttccaccttctgtttttgagatagaatctcacactgaatgtggagctcatgactttgactgtctggtcatcgaacccacagaatctacctgcctccatccttcagaacttatgttatgcatgcacactcccagcttttatatggatgctcataattcaggtgctcatgagttataggttcttttcagtggcacattaaataaggaaggtttcacctaaggttacatgtgaaggattcatgagaggtggactttgtatctcccagtacttagtgtttctctgaggatatctgtttgtaaattgttcactgtggagactactgaatagcccacctgcatgagagacctcagatctgtcaatagtgtgactgatgttctgagtacactaccccaagtatttcttcctgctgccattctgaagaaaggccatagaagtgaaagtttgtcctttctgatgtttgcttgtagtcgaggaacaaagaaaattatgtggcatgggtgatgacagctcccttgccagttaacttgataaacccaagctctctcttatctttaccttcaaagtgatgttaccagaggtgactgaggaagtgaggtccaaagcttacacacacacaccaaaaagaagaagaaaaagaagaagaagaagaagaagaagaagaggaggaggaggaggaggaggaggaggaggaggaggaggaggaggaggaggaggagggcggccctggtccagatgttttccagtgctatactggaaaaagaagaacccatcctgtaccccctccccacttcattcctttttctctcttaagtactgctaaagagcaagtagttttgaattttggtaaactttaggatgtctacacacacacacacacacacccatgttgtcacccatagagcaaatagcatcttcctcttatagattaaaggttgaatcagcaatgttaggcaagatcacagcaaggcagtggccaaggtcagatgaaaagggagtcagtagatagcagccaagaaagaaaaaaaatgcctttctctgtgacctctccatctacgctaggaagctctcatctcaattccacattgggaactgtctccattctgcagcctcatgctaccatggcttgtttagtttccattacaaactgtgagatagtagtctctttccagtagttctcctttttctttttaattgaaaaaaaattatacagtatattcttatccccttttcccctctcccaaatcctgcccaaatccccacacactcaactctatagtacccccctctttctccctctccctcttcctctctctctttctctgacacacacacacacacacacacacacactcaccgtaaaattacaaaatcagaaaacatacaaataaaagatcatttacattagatacttttcgtgttgggtttatgtggtgtttagggtgtagaagtgtgttgcgagagcagatctgcagtttctctgtaactttctgcaatggtctccccaggttaaagggtacgtatgtccagcttgcatgtgccgtgatataaggccgctatgaataggacatctcaagactacgcttagcattcatggtgaccatgattagttgggaaagtcaaaaaaatatatatgttctggcaggctaaacgtcatcccatccaccaatgggtattcataaattagcttctcagtgtgctcggtactgtgatggggactgatcagaggtgagttctacctttcactgtttaatgtctagatcaacaaagacaagaggcacatgatgggctggggaagactctgcagcggatattgtttggatattgttgtgatatcagatttaagtgtaggacatttaagtcctgagagaaaatatgaccctagttagactttaaggcattagtaaaatagttattatctcagtttaaggagactatataagcaaatatatagttaaataattataaaagagtttatcagtatagcaaaaagggtcgtgaaaggcatgtttctgtagtctttgattgataagactccaaaagtgtttaatattataacatgaaattgaaatttggcttgtaacaaactagaatattctctgttctgctgaggaaagcaaaatcactgcataggaagctaaatataagaggaagagaattctttacaaggagacaaagtcatagttaagatatttaaagaaatctgggaatttatgcccattttcttatgactgtaaggaatgagaaatgatggaaatgaaggacaagaaagatgatggtggtggtggtgatggtggcagtagtggtggtggtgtgtgtgttgctagacctgggacacagtgccttgtatatgttgtacaactgctctctaccactgattggcatgctcaccctaaggatagtatctttgctgtaaaagaccaactggggttcatgggagtctgcaaacagacatctgtgcttctctggctctgatgtggttaagtgttattcttgagatggggcagttagtttcaatgtatgtgaaaatttagcagaaaccaactcccacccacctccaatccacacacttttcagactccactgacttctgtaaactatgctgcagggagagggtttaattcaatagtgtaatctatgagctaaaattatttccagctgtctgtttggagggatattctgttgacaataattgatgcttctgaccttgtgcttaagaaatagtcagcaccgttgttctgatgatattttcttatattaaatctttatctcaaccttgtatgaccaccagatagtaattggataggagaagacacactactatgaaaataaatcttcaagcaacatactctagtttgttttttcaactatttcacacatctctttttgatttctatcttcatttccttaatagaatttgaatttcagattatttttacatgttattataaatacgatcactacaaacagttctgctaaatctttccaggcaactcagagactttttaatgcaaggcacctagaaatttaaaggcaacattttaatggactctatatggattcatgaaaggtttgggttccagttttgtcagtgtctctaactcactgtatgatcttgagcaagtcctttgcttctctggaccctgtcttttcctatgtgagattgtaaggattcgactagatgttgataatgactgatatcaatcagaagcttctgattcatgaaatattttgaatattttagatgcatctatttaatcctctcatccacaccatcaggtaggtgcttgatcctaagtttagctcgcaactgaacaccctgaccaaaactccattgcctttcgaagaactaatttttaagacagttaactatcactgatgaaaaagaaatgctagcgagctttcactggaactgagctagaaatggccatgcagaaatggggcctaactagctgcaaaacaagatgctttattttccatgaaatctagaacagacatctggagccatagctctagatacccaattgcataaagactgctaaaaaagtaataaaatgtaaagaaattctaggtagtacagattctttttttaaagaattatttatttgttttatgtacatgagtacactgtagctgtcttcaggcacaccagaagcgggcatcagaccccattcattacagatggttgtgagccaccatgtgtttgctgggatttgaactcaggacctctggaagatgaagtcagtgttcctaactgctaagctatctctccagccccagtagtacagagtcttagaaggtatagctgtggaaatattcagaaatgctcaagtaatgtaagtagtatactagtaaagccacaggtccatttaaattttcctgtttaccaaacctgagttccccctgagtagtagttcagcaagttacatctagctaagccactcagcaatcatagaaaacagtaacgctgagctagcttgcacatgcgacgtttgaactaataggactatgagggttttgctaagttggttttggtgtctgcctaccttatatttaagctgatatacttcttgccaattccctgctaatgagttactgacctggcaaattcctgacttctattgatcgaacagactacagattcggtttttcattagtaacagttggtgtggcttctaacagagcctgtaaaactaatgaaacatggaggaaatgcacctcgctattactgccgaggcaatggcacagagcttctgctacactaccttttgtcttacatactcacccatgaaagaaaaggctgcagaattgtgtggctggtgggatgtggcaatggctttgcttagtacaccttgaggaagcatggctcaaatatatagtatgtttagctctggggtcttaaaatgatgctgcacagtattgtgccttcttgggtgtcagcataatcaaatggaaagatgtggagggatgactagctgtggacactagacatgttctaaagcacactggagaggtggatatcgttaggaaaaaatctattccttgttttgggggggaaaaaaacctctaaagttataaatgatcttcaaggtggagtcatgatgtgtttgccaaaaggaataatctggtttctaggttcaagggcatagtgtacggtgtagatgcactaaatatatgcatttccatggagcaaactgattccaaatttcaaagtttacattctggcgataggctcatgagatgtggttcaactcttggcttttaagaacaagacctggtgttgctttactgccatctttccattacttctggaatctgtgtctttgtgctgctaggtaccagtggccacaggagagcaggttgttttctcctctcccgtcccgctctgagctcagtgctcacattccctagtgttctactcaggaagaaacaggctcccaagcctctttaactcaacctgaacgccatctgtgctgctgagagaacagagccctgcaggaggaggcctgcatcatagctgagagaaccccaccctgcctacagaagtccttattaggatactcaggaaaggcatccattaaaaaattaagagcaccttctttctaatgtgctcaaatacatttctgaaagtggcttttgctgactgttctgcctaagttaagctctgtaaacgatgcccgtacttgcatcagagcagaagcgcctactccattagcacataaaccaccttgacgtttactgagatacttttttgtctatgatatgaaactgtcttcttgacactgttgatagaatatatcaagtatatagtacaaaacaaacatttattatggattatatggaaggcaccattctgtgtgcccctagaaatgtaaaaagattcagctgctcccatgctattttaagaggaccaggttgacatccatggagctgtaacaagtgcaaattacagcccacaaagtgacacagttatgggaatgtaatagaatttattttaaccctttaattatcagttttttaatactatattttgattactggatagcctatagtgctaaatgttaaacctagtggaaattgtgcccaatggaatgcagtagtttgtagactcgatccatatatatttaggtaatgatgatgttaataagctcattgctccagggagctaaccacttagagagaagcagatcactgaaaatcacatatacaaaattcagtaagttaaagtaaacaagaggaattcatacatattcccagcatagtctagtccagaggcgtggcctaggagtcagagtgttgcctttttgttattggccccttagagtctgagggtctggggttgcacttaatttcttctgggctcccttctctgtcttacagccaggcatgctaatcatgtgggctttgtggacggttgttttcgagatgtggaattttgtgagagaaaagactgtacaaaccacagatgctacaagatattttaagtggtggtaaagactccaagagccattctctttctcctgctgtcagtgaccgtgaattaatatttctgcactcacatttttgggcttgtatagtgaggtccttctggcaacccctcttgcacacttgcagacgttttgcttcattgttatttcattaacaataacagctgttgacagagcacttgcatcatagaactagttagtataagtaacctaagaatgtttcaagggatccaggacaaggtgtagggattatgagggaaaactacaccatatatatatatatatatatatatatatatatatatatatatatatatatatatatatataagacttgaacataggaaatgtggttgccatgagcttgctgaaaccgagtctcttgagtaatgactatctgcttggcagtaggcccttggacttcccaaatgaatacagtaacagactgtgcataatgcggcatcttgctatatgctatgtttttttaaaaatatatatttatctgtttgtttatgtgtgtgtggttattttgctggcatgtagtcctatgaaccattttgagtgccagaggcagatggaggccagaaaagggtgtcagatcccctggagccagagttacaggttgttgtgagtcacctgatatgagtgttaggaagagaaacccggatcctctgcaagagtagcaagtggtttttcctcttgagccatgtcttcagcccctatactatattcttacctctcctattagccaagcccttgttctagtagtggcaataactatgggctgaacttgcaagtctgaaatgggtagtatcgagccagatgtgagaaggttgctccaagttggagggtgtccttcaaatcccaccaatgctgatggatcattaaaagaaacattcgttaaatggtacatagagtatggtgtgtttgggaaccaaccagttattttaatgtgccttgatttatttgtgatcattctgcatatagtctcatataaatagtcaagggcccctgccatgctttggaagggcctaagtgaagaatggtttgatcttttaggagttacctgtgctatatcttccctcactcaccctggataacagcccaggcttcccacccttgcaggctggtcctagctatctaggttccctagagtcttcaggacaaaggcatctgcaggtaattggtctaatactggaattttctagagtgctacatagactacagattatttcaagtcaagttgaacacctatactgcttcatagtccctgtcttctatttcaggaggaaaatttcatggtaccgggcattcataggttgccttgatcacagcattttctgggctgatttgcctaagaccacagtagacattgtattttgtaaagcaaaacatgaaattagtagcaataacttctactatgtatttcacacttggctgtcatgtctctctagcaaccacccacaacacacacacaaacctcttaggccatatgacccacttatactccatccacagccttttagcaacctaggagacagagtggaaatttagtttcctaagtaaaagctacttgcattcaaagcccacttgctaatggtatttcaatatcaaaaggaggtaactgggaatgcaaacaatatattcataaagattccaaaccatccatgagagatatatagaaaaccctaagcatgttcagaggggactattatctttgcatgtcagaaaaaaatgttgggggaacagagcttacttgtgttcgaaggaagaaacagcatacattctgtaggagcaggcttggcaactgtgttattgatgactaaaagctacagctgagtttgcttcattcccatctatagaactacatagttgtttaaaggaatggttctctaatgaagtagaccactattcatagatgccctctaagtagttccagtatatatgtcaggttttaaaataattagaatcctttttatatatgttaaagttaggcaagttacctctatagcttttgaaaacttacctttaactaagttgactgattgttaaagtaatacatgatttctgactatggccaagaaatgcaaaggaatgtattttcccagggaaaatagagatttaagataacagggcaaatgttccttcaagtgcagaacatggctcgttttatttgcaacctctttacactgagcaggtatttctgtttgctcttcatgtcacagaattaggtggcgtatcatttcctctggtattctgaaggcgatgaaactctgggcctgagaaaatggtctcaggggctcttacattgctgcagttcctgttcattcatgtatagaaatccagggaaggagataattgggggaaaatcataaggcttcctggatgatgcagacgataagagcgtctgagaatctctgcatttcagcctggacatcttgcctctgtaggctctgtgaagacaccagagagcttctgttattatacctctcaaggcaacctacaccgttctgggcaatggttattatataaaaacctcatactgagccagaaactctgtctcactatagctttccctaatgctgtctttaaatattgactgctggcatagaaacacagccaccgtatataacactgctcctcaaagaagagcagtcgcagttccagacaagtaatgtatgaacagtattgcagcacacagccctgctcatctattggagcattcccaataggggagactgcccaaggaaaggagaaaggagcaggtaagttctcatagagtcaatcgggagaggctgtctcccaactccgcttttctttttcagtattgacaaaaactacctaagaaaactctttctgttccacaatggttcagagtgctgccttccttgtaactcactctcaagaaagccttcctttcatggctcttatttagctatgggagagtgggtgcctggcaatattgaatgaaggagaactcagccctccggcctgcctggtttactttggctggctacagcaagcaggagagcatactggcttggaaaactgcctccagttggacaatgaatttgactctagggcgtgtcatttatctattatacgctccatgtgtttgaacaagttgttgactctgatgcctcaggttcgcacctgtaagacagagatggagaatgcatgtgatgaagcgtaagagaaacacagtctgctcaataaatgacatttatcacccgcatcctctgtgaactgtgtttctagatcgtgtgtcgttagttgggagacatatcagattccactctagaacttagggtgaatagctttaatgctccccaacctgttacttaggatcggagattccttgaagttctgcaaaggaactgcttgctttctattatttcagctatgatgccctcttattcttcttagggctcaaagcagagtactgtagtttaagatgtttttgtttgtttgtttgtttgttttcttactcaaatatacttgatgaaaaacagtactcatgacactgtatttttgtttatatgtcaaactagtctggatctgcagattgattattccgtaggtttgcacctgctccttgtaatgtttaaaatctctagtctaacccctacatatacaacaggatatgtattccttgaccttgctattaaggaattgaagtatgcatagcttgaagtggaatatatttccattttgggggagatgtatgtacctgaaagtaatggataatgttttaaaataagtgggtcagagtccatgcatacagattttaatttttagtggtggcagtcaaattctcaaggttgtttcatgctacatcagtgccaagatggaccacactggcttgtgagttcttcttgagggatgaggaggaagaaagtcctagagacgaactgaaggatacattaaggattgagggtcagaagttgttacgtttctgttttctcagttagttgtaagtaacctaggattaatttctttggcttatccagcagattgggccaattaaaacgctggagaccttgacatagtgcccagcactgggtcctagtactgggtccattctctggactcctgtcaattaattgcagctactgtgctaaatgaaaaaaattagagcttcaacttatttttccatagtgggaaggaaccattcccatgctatcttatttagtcctccctgtggcccctaaacagacaatttagaaagcattctgctggactagaagcaaatgaacaggtttaattttgttgctttgttttgttttgttttgttttttgtgctaatatagctgcatgaatcatatgggagtcaggcctcatatttgacttccttaatatggtgctaatgtaaataggattcatgacttcagaacctgcctatcatccaacatttaataagtacatactaataagcatttattatcaacaggctgtcttatgcttggggaataaaccaacaaataagatcaaatcttgcccttgtggagtttagattcatttttggatatagacaaagtgagtacatctaagtgttccagataagtccagtggtaaaacaaatcaaaaccaaaaccataaaacaggatccttattggagggaaggctatagtgttccagataagtccagcagtttaaaacattttaaaaagatttatgcatgtatatgagtgatctatttgcatgtatacctgcacaaaaaagagggcatcagatcccattacagatggttgtgagccaccatgtgatttctgggaattgaactcaggacctctggaaaaccagccaaatgctcttaacctctgagccatctctccagccccaagtccaggggtttaaaaaaaccaacaggaccattactggagggaaggctttagtttaaattattctgttaaagaactcattgagtaaaaaggaagaaattggagatctcaaaagtcttccaggagaagtagcaaatatggagagaatgaatcagtttaaagtcagttaagattagacctatgagagattagaaaacagggggagagccacatgagatcaaaagagtaagccgtaaaagctgcaggtcaagcagccccttcctagtcagataagaacttgagaatatcatcctgagtttagtaacccagtcacaaaagaaaacacaaggtatgcactcactgtaagtagatattagccaaaaatctcggaatacccaagatacaactcacagatcatatgaagcccaagaagaaggaagaccaaagtgtagatgcttcagtgcttcttagaagagtgaacaaaatactcacaggaagaaatatggcgacgtgtggaccagagactgaaggaaaggccatccagagactgcctcacctggggttccatcccatatacagccaccaaacccagacactattgtggatgccgggaagtgcttgctgacaggagcctgatatggctgtctcctgagagctcttccagagcatgacaaatacaggggtggatgttcacaaccatctattgaactgaacacggggtccccaatgaaggagttggagaagggactgaaggaactgaggggatttgcaacctcatgaggtgaagcaacagtgtcaactggccagacatctaggagctcccagggactggaccaccaaccaaagagtacacatggagcgacccatggcgctggccacatatgtggcagaagttggccttgttggacatcagtgggaggagaggcccttgggcctgagggggtctgatgccccagtgtaggaaaatgccagggcaggaaggcgggagtgggtgggtgggtaggggagcaccctcatggaggcagggggaggaggaatgggatagggggtttctgaaggggagacctggaaaggggaaatgtaaataaagaaaatatccaataaaagggaagggaaaaaagaatgttggttctttttctaggaggtgagacaccgtgtgagtatctttagcagaggagtgggattgttggatgcagggttcattggagtctcccttgctgctttgctgagaaaggagtatggggacaagggtacggtctaccaccagggagcgtgggagactgccagtgtgtgggggggtactatatcacctttttctgaaacaatttatttgcagtttaattgattgttgttgttttctggtgttttgctttgtcttgttttgtttgccaagagcgttataaccttagagtctgttatttcaataatactttatcagtactaaatgcatgaacttagccagtacaatctgtacatcacttcactggtatatttcccgagaaatgtactgcagggtattttttccacagtgtgactatcagagcaaagatgtgtaaactttgtaagtccacatgtcacggcaatataatcttgtgggatcacagtgacatgggtgattctttattactgaagtgttgtcatccagcacaggactatgcatcttacttagtggtgtgatcacacatgcatgcagtgtggacatgacagggctgagggcaacttatttcagtcaccagaggggttttatcttccttatattattatctcaggagagagttaaggaaagactatctcaccggtttttgtgtgttgctgctgctgttgttgttgttgttgttgttttcatgagaatcttgcttggaatccctcacatggattttctttggtattaacctcttttcatagttgatccttttctgaaagtatgatccccagccctaggtttgctttaaaggagatatgaagttcccatcccacatagctcccccttccaccacactcccagaatataaagccacagaaagtgtgggaactgaatgactactgtttgggtgtttgggttcatctattttcatatgtgtatatacgatatctattcatatctgtttttatttttgtgacttagagatgatatgcaaaacacaatctcccttttggaaataatgaaaacccagaacaacaatgtgttgagtgccataatcatgacatgcacgctactctgtcacagattgttgattagattcatattcatatggaataattgttgagatgagtcgattcaggcttattcccatctgatagctcctaaggatacagcccatgaaggaagcattgctaagacatacattgtatttgtcaaaccctcattatgggccccagggggccattgtgctataggcaccagtgactgatttttttcaaagttgaaaatttggactcagaatcaaagaagcagtggtttagctgaatggctattaggacagaatgaatgacagattgtctcggaaatcagacacaggaagtggctgagacattgggtgctacaaagaagcaaagggctttattctctttattctccttcacatgactcttaagtccctggtgtgtacacagtaatacagaatgggataaacatgtggttacagaaattttcaatacacattaagatcattgtagcttcttgatcatgcacttgtttgatgtgatcttttaaaaaaaatctctcttgttttttgcttgtgtgggatttgagccaccaagttctcaaagggccagtgccatgagccagggcagtgctttctcccacaagtcttccttcagtggtggttggctcccttccaatggcagtcagccttttagcactgctggtagtcatgcggcctctttgtgaattaaactgcaccagccgagttttaaaaacaagtgtgattaaccttggagctttgtgagagagctgtagcatggagggaattcccccaacattaagtgtctcccactcttaactactacagctggtcccggtttctaagtacataaaatctcttcataagtggctttgctatctccaattactagttcacctggatgattgctatttctgtatctaggtcataaggaagccagaggtgtgagtgccttctgaatagtcttatgctctgctatgctcattccatactttcaaggctttctggacagttgaaaaggagcaattcactctctatgagtggaagtcaaagccctagaacctgttttcaacttttgcaagtgcagaacagtgcttcttaataaaaataagaaccatgctgtacagctaccgttgccatccctctctggtgttttcagttcactcctccaagttaaatgcaaagttaggttagtgaacgtccttagcaaatgaagttagcaacctagaaaatagttggcttggtcttgacttttcttttccttttcctttttcagaaaacagattttttttctcatataatatatcctgattacaatttcccctccctttgctcctcccatttcttccccatcttacttcccatccagatctgccctctctctatttctcattaaaaacaatgaggcttctaaaggaatagaataataaaatagaaattaatacattgggataacacaaaacaaacagaaggaaaggggcccaagaggaagtacagatttttctacctcctgatctcactggagaaggaatcgaagccaagaaagctttggtgatctgccaaagcccacacaactaaaagaaactgcaagccctatctcctaaccctcaagtctggaactccagcatacatcccccttttaaatacaccaggttccttttccttgcctatcctcgactgggttcccaagcccactagaaacccctttatacattcatattcttagtccattttgctgtactggctacagaggtaaataactaataataaaaaaaaaacaaaattgtaaatgcaatgggcatgtacttctcagagtttaaagagaaaatcatgagataacagaggcttctgatttccctgccagtctgactcctttcggtcctctctagaatgatgtccctgatgcttcagaaaacatccctctctagtctcccttcagcaagcacattcacctactaagtaaggacagggatactctcttgcctacgtttcctcttaaatctagcacccgagggatctatattttaactattgataattgccatagactttctgcatcatccattttgtctctgagttccagaggcatgggagtggaaggcactagtctacagtccctctgtgtgtagtcaacaagaacaaatgaacctgtgaagctctggaatgcttgagccatagattcctcatgaaaatgtgaactggctgcaattccctcctactgtctctttggtgattcttttttatcagtgcttagacacagtgccttctatctcatagagcttcttaggacaggtctcttagctgtaccttatacctctatgacttcatttcccaccgttgccctctaagatatcatttagttgttaatatgctaaactcgtatcatcattgaaatgattgggtgtgttcatttagaaggtggagctcccaggctaggtgctagggagtttgagtaatgatggagactttgccctctcatacgcaaatctggcatatcatgtgtgcagctttagcaggttggtcagatctatggtctatgctctaacaaagcaagaaggaatcacatggctctggatgcctgagaaaaaccaggagggtgcagggttggcaaggagcctcccagtgttacctggaatgacctgataagaacaaagaggatcacttatgtctactgcccgctccccaaatattctgtttatgattaaaaatgccgcctggcgagtctcttccaggagcctttgggaacactgtggcatatggccaaacttctccaggactttctttcattgaaaatttaaagcaacatatgctagtttttcaaagcttttctcagtctaatctaatgttttgggtttttttttctcctgtactaaatattgaacttagaatttcattcatgctgggctgtgtaactgagttaacctccccagcgccaatatacctctgctagtgctgctactattatagttttctttggccttgtttcagagcctgtattagtagcagctggtggtatcctgttcctaagtttaagctgtgcccaaactgtactggaaagttaagacctagctctgaaatgtccttagtcccaaacgcattctctctctatctctgtctgtctgtctgtctgtctgtctctttctctatatgtatatctgtctctgagtgtgtgtgtgtgtgtgtgtgtgctcgcgcgcgcgcacgcgcgtgtttgtgtgtgcgcaggcgtgtgtgtgcagtgccaaatgtcaactgtcatatgtatcatatgtacagccttgcccttgctgttgaacatcttagaatggaattctttgtagctaatttaagggtagaaagttgatgatgagcatcttattttaccaatatggtctgttttcacccctggtaacatgagacttgattctagtgggtaaagctactgttagatttctatttggcagagtatggcaaaggaaactgttcagagaatgtgcttttttacaaatgaccaccaggtgtcagcagaggatgtgaaacttttggcaacatctgcattattggatttaattcactgaaaccattcattcccgtcacaggaagcctctactgggccccttctcctcacaattagcatcaaatgctttctcctcaagtctgcatcatttcttcacccttttctcatctaacacttaagtctggcatgcacagtggtagttctacaaaataagctattgggacaagacaggggagttaccattacaaagttcatgtgttttactaaagttcataaggagattaattatgcagcacacaatgttaaggctgcctatgcctatgccttttccttcaaaaggcaatttagcgtgtgtgtgtgtgtgtgtgtgtgtgtgtgcgtgtgtgtgttgctgttttcctctagcttctcatcttgcctcttcatttggatagactgagcagaaacctgcggtctttagtacagagcattgagctttaggctgggacagcactgaactccctgagtagaactcggaaagcacttaagcctcgggtcctaaaggtagcaatttgaaaacggttacttttgaatatgtcatcaagttctaaatgcaactgtgggatggtgggggacacaagccagcatatggcttcaccagccacaattgctgaggcctgggatcttcaggcaatggagagtaaggcctaatacatagcactgaatgcactaccttaggtaaggggctgataaatgcacggggctagagtttaaacatgttataaagatttcaattggaatggttaatgatatttgacaaatagcgttacaaacaataccaagagatgttcagactcttctgttgctctacaatgaataaggtggcacctcaatggggattcaaaactgtctagaatattttctttatagagatttcgatgataatgggcaagaagaatatccttgttcttaaagtgttgtaaaagatggccataaaacctattctaccctcacatgccgttgatgaaaggagccagcattctctctgaagtcatgcctagttcagtgtcggacagacacacattggaggaatgcctctccaaagtgtcttatgatgttctttaagcagctttttaaaaaaaatgtcctttattgacttgatttccaattaatattaaaactatgtataggatatataaggggaagatataatttgcatactatcaatgtgcgtttactgtgtgacagttttagctaatgatctctgacatttcttgccattgaggacaaagccttcagcaaatacaccttgtttgtggaagcttgaatcttaatggccacattgctctgtgtctgtgatggtttgaatgaaaatgtcccccacaggcccatatatttgaatgctaaatttgtacttcctctcttggtgaacctgtttgagaaggattaggaggtgtggccttgttggaggaggtgtgtcattgggcgttagctttgaggtttcaaaataccatgccattcccaattagttagttctccctctttgcctatacttgtggatcaggatgtaggctctcagcttctgctacagtactgtacctgcttccatgctccccaccttgatggacatgtactccctctggaactgcaagctcccaataaactcttttgttataagttgccttggccatggtctctcgtcacagcaatggaggaggaactaagacaatgtcttttggcaatagcttcatgtttcatgttctcttctctcctttcgcagatcactggggtgatcctgttggccgttggagtctggggaaagctgactttgggaacctatatctccctgattgctgagaactccacaaatgctccctatgtgctcattggaaccggcaccaccatcgtggtttttggcctctttggatgctttgctacatgccgtggtagtccatggatgctgaaactggtgagtacaactcagcatgatgtgatgtgctttcttggttatttttataaaacaataaattcatgcagcagttaagtagcccttcttgaagccacatacacacacacacacacacacacacacacacacacaaaagactttaatattcattgattttaattttacactagactcttaactaatccagcctttaaacctcccagtgggaaaagctaccccaaacacagcctggcacaataaacgtagtcccagcttcctgaggtaaattggcaaagcactggccattgattccaatgaacgattaatgtcttcttggcaagatgccttgtgccagtctcaaactggcttagaaatcccttgtgggatgtgatgtgcagcttcggcgggcaagggatcattctgaacatgaacagccttccacgtccaagatcccactggagtagacctctctttctccttgaatcttgtcatgcaaggaggtgtgcacatgcttttctctccagttgtactatctggccctgtgctgtgggagttgaactaagccagaagctctcactcaaagggctgatgcaatgacaattagcttccagggccacagcagaggcctatgtctaatagtgcagacagagcaataatacatccctaaaggtaagggcaggctgctgaaagacccttacggcggttttaactaccattagaatcttatggtactcttttagctttaaccttaataactgaaaaaatcatcaataagaacaatttatcctatagggaggcccaaagaagatgtctgaccacagagttaaatgtccattttcccacttgccttctgatagttatctttccacataactttgtggtgaattgtagtgtttggtatgagcctctccacagagtagtgcatgcttctgatcatattttctatgaactatacaaagaaattatgtagattgcatataattaccgcatgcttaatattttactggttgtgtgcttatatagaatttcatcaatatttagagaaatggatattttaacccaatgctttcttcttttagcatatgtgtcagtaagatttttttatgatcccatacaaatttatatacttataagtcatatgtatatattatagctaagctatgtggtattgtgtagtccacccacagcatcatttagggtccttgcaaacattcaaaatggccctattttgagacacaaagaagaaggttataatatatatgacatgttggtaaggagttgattcctcttccctttttctgtttttcaaagtcagaaaaatagcaaagccttcataactcgtaagtgctatgtaatgtccttgaactcagatatttgtatgcatgtgttcagaaagacagtgacagagacacaatctttcgaattgaaaagtgcaggtaagataggatgagaaacactgggatgattgttagtagtcttggtcacttgctttgttagaggttgtaaattcaatgaattgcccagcccagaggcaaggatccccacatgaactggttgaggggatcagttcagagatggccagcaaagtgaagaagtatgtcatgctatatacacccgggcctttgacacaagatgacaggctgcacttccaagtaaaatgggtctgtagtcatttactgtgagatgtggctaaaaaaaaaaaaaaaagaaaaagaaaaatagagaagtttgcccaatgcacagcttcgcatcccagccatactcatacatacaaaggactaatgtatatacatgtgcttgggcccttatgctttctaaagcagaaccactactggctaaaattggaagtaggaagacctgtggccagaagcaaagaagtttttctgataattgcaacaattaggaaatagaacagtcagggctggggcagcacctcagcggggtagtattgaaggccttgggttctatgcctggcattaaaaagagggtaaaaagaagatttaattttcaggttctagctcactgttaagatggttgcaacgcctcctctaggcagaacaatgtcctgtgagaactccagagcaaatatttttttttctagcttaagtattttcatattaaaagtaaaacaacactttggagcacatgaccctttcatgtttctcctgatcgatctgagctgatggacacagtgtcagtggaggtctcctcagcatccgtaccccaagatgtttgtacatcttaaaatgacaattttctaaattgctacttctgtgaaattctaacaagggtatttacatttctgaatttgctctagtaatagtaaggacttacctaattgcccctagcagaaagatactctaaagataccttctcagctatgtgtctgtctgtctgtctgtctctcttctcctctctttttccctctctatccatgtgtctgtgtctgtgtggggctatgtatacatgagcacaggtgcccacagtggccagaggcattggatgcccttggagacgaaataatgggcatttgtgaaccaactgatgttggtgctgtgaagtgaacttgagtcctctacaagagcagtctgtgcgctgaactcttgagaaatcttcccagccctgaaaagccctcctcttaatcctgccttctgactttatcctcgttcacttcgtttgtagtatgccatgttcctgtccctggtgttcctggctgagcttgttgctggcatttctggatttgtgtttcgtcatgaggtgagtatgctcagggtggaaagacctagagtctgtgtgtttagatgcattttggaaacgaatggcttgtgtaaagggtgcgtgaaggctaggcaggaacttccccaaaattttacacccttcactgttaaccctcacttaagttttctctgtagctctttcataaaatgacttcttatatggattagatactcctttgaaagtagctttttccacaaagcatttcgtgctattataagatttctgacactagaggcaagctgagctaattgtcttgcttgtaaatccactcttacaaagaacaggaaagctgtaatagaaaggtgtgtggtgatggagccagaacaccatagacagtgaatgcactgagggggttggctgtggctcttgagtgcccggcagcacatcccaggctctttgtttttatcctgctgagctatcttctctgggagcttggcatatggatgatccattcctttccccattaccctgattttgactgtaggtagtgttcaaaatgccaacgctaacttccagaacctgttgctcatggatgctgcctctaggtagattacccattcttacagtgagctggagagaaatggggtgaagtgggtggtggcctcaacagccctgctggagggcatcagtgtaagtgtgaaaaccagaagtcctattctccctttcattatattcattagggattgcagtctcaccctgattacaaaataaaggttgactttggtcaagttgtgaaattcactgggtaacagtaagtcgcattgataccatttacttggaccgatgttgtaaagaagcctggattgcctttagggcagccacagtcttgtttcttaagcctgtgtcctcggggtaacacaagccttattctatatacaacaccccaccctgagaatttaagagtgaagtgaggtacagagttggctatggtagccactttgccttgtagctgtccgatgggcattactttcagaatttagtcaggaatatatatccctgcttggaagagttaccatatttagcttggagcttgccaccagataattattgccactttctgttctcctaatcccaaggcattgcatcaatcaggccttagttttaccataagcgacatggcctagttgtatacctaacacctcacttaccccatatttcaaagggatgggacttgaaaatgagcccaagggcaaatatgttcactgacaaggagaaagggtttcattaactttttactaacaagaaagcccttgtcctttagcctctttcattttggcctcagtaattagagttaagtgaaagatggcttttgttccactcctgcatggtggaaaaagggtcagtttggggccaataccttaatcttcacatcacgctggtgtctggcctgttaccattctgtctgcataagtcaaagaatggtatagaaaggaagtttgccatgaatcaattaaaagaaaaataactagaaaattcatgcctgatgattggccagttggtcacctttatagcacttttaaaacttacctagccacttcagtgagccatctgacaggactgattccctctaaattggtggttgaaaccaactttgtctttaaattcctcagctagttaaacctttggtgaattttctgagctccgttgtctcagagaataggctttccctgcctagtcaattgagaaaatttcagaagagatggtcctgggagactgagaggaacctgagtcagattaggacacaatggacttgatatacattccccctttatcttctgtagatcaaggacaccttcctgaggacttacacggatgccatgcagaactacaatggcaatgatgagaggagccgggctgtggaccatgtgcagcgcagcgtaagtttcagggagagatgtgggtatagagcctgcctgtacagttctgggcttaatcctctaggcttggtgggtaggtggggtaggccagttgcatatactgttgattctcatccttgagtgcttagtccagttctgttttcaagagttgaatctaagcatttgcctaggctttgatttttctagaaagttagcatcaagaaggcacatgctccaatgtgtcttgtattggtaagagtgctgaacccgtcaacaatactccatttgtccttaaaagctgaaccattggaaaggaggtaggtaggtagtgggtatgtgttgatctagtaacggctgattcctgaaggctggctatctagaattggtaactccaggctagacagagaagtcagatgagcagcatctacttggggcagtgcactaaaagtgtaaatggaccaaaaggaaactgagaatctgtcaggtatagtctgcaaaggggagtatgatgtaattatatttaaacttcatacaattttaaaaaattaaaaccgtaatattttccattttattttggtgacatttcagactttttggaaactcaaaaactatacactcaggttttaccaaccagtaacattttttgtcgcatttgctttcatattctctatgtgagatatcagaaaacttttataaaggggataaatagaaaatattttagactatggggatggtcttatactctgtgtcacaatcaactgtgccaccctagcacaaaaggagccatggacaataggcaatacataaacaaatggcatgatcaggtctcaaaacacctgtataaaacctggcaggtgataggcttaccaataccagctttccatcccacataaaaagtattatctctaagctatttatttacttattattgtaggtctagtggagaacatttagaaaccattaattgcctatcagtattctgggtgtaattaccatgtgcatctgcatgtttaatagcactcttatatgattgtgatattaagcaaggtcagagacatattactctacttgttgaggtagtaagaaagacagtgtaatgtgacctcatcttccttctcagagttcaaatgggcaccaaagatgattgatagtagagcttaagttgatttttccacaccaaaggtatatgctacattgggaacctggctgatgtacaaccccgactgtcctcctgtatctgccttctgagtgctaggattaaggggatgtgccaccactacccagcttgatgtttttctcatagaagcttcagagcaaggagtgaggaggtcccagcatctgctcaagcactcttggattcttttcttttcttgttaacagctgagctgctgtggcgtgcagaactacaccaactggagcagcagcccctacttcctggaccatggcatcccccccagttgctgcatgaacgaaactgactgcaatcccctggatctgcacaatctgactgtggccgccaccaaagttaatcagaaggtacttcttcctcccagccctaatgggacaggcaggcgggctgtgtttgggaggattttattacttttgtgaaattaagacaaatagattagaaaacgttgtctcagagggagttgggcttcttcctttgtggtgtttgctcgcctaggagaagcccttgaggctgctcacttctaaaggaggaagctctgcctccagttggtctcttgtggctctcccacagcaagcctccaccaggcacagatatgtaggtttagcaaatggttcctgttaaccccgatgcctgtgtcagacagagagtgctttctttcttttttttttctttctgggcgcctttcttctacttaatataccatcaaaacataaaattattcacagctgggtgccagtctttgtcaggaagaagggagtagagttgacagacagcatctgcttctgctaggagggtggcctttattttagggagttcactggtgtaggaaaagaaataaacaactccaattcaactcactgtcaacatctgaattcccaaaaagagagcaggaaaacaaaacaaaacaacaacaaaaaaagatggtggaaggagatatagacaccagttcatagggagaaaagaagagtgaacttccagtagtcaaagagaagggaaagcaatcctgtattacactttacagagaatacaatgaagactgttacagctgtgtgctacagctgtgcatggagcctatcaacattcttaaacatttaaagaaatgccctatataaactatgatttgagaaacaaaggaggagaatacgctattgactttgtctttagctctctagacatggggcaaattttattctcttaccaaggaaacattctattctagtctattcttccaatatcttcccagttctgtgttatatggaccatgtactgaataattcatagagagatgatagctgttctctcaagattagaattctataaggtcatttctgtattttactcattttgtattgggatctgtaacagtgagtgttttgattcatatggctggtaaatgcagcagccatccaattttggttaaaaaaaaaaacttttttcacataaacattctcttttaggaaatttaaggaccaaatctaaattcagagactagagacagtttaaattctgaaccaggcatttgttcattggaggatcttgttgaagttaacctttctcaggatttttttctcatatgtaaatgatagataatagtagtacttgatctttagaattaatatgagggggactagagagatggctcagtggttaaaagcactgaccgctcttcctaaatgttcaattcacagcacccacatgatggctcacaatgatctgtaataggatcagactctctcttctggtgtgtctgaagacagattgcacatatacataaaaatagattaactaaaaattagtatgaggaatgagtgaaataaattatctaaaacataatgtcaggcacagaccacagacactatgagtattaactgtgatgccaggcagtggtggcacacgcctttaatcccagcacttgagaggcagaggcaggtggatctctgagtttgaggccagcctggtctacagagtgagttccaggacagccagggctacacagagaaaccctgtcttgaaaaaacaacaacaacaacaacaaactgtgatgcgaatatgacctcagcagggttcctagaaatgatgcagcacacccttatatggaatagcttctgtttgggggccagagaggtggctcaggggtgaagagagcttgttcctctggtgcagagtaggaattcatttcccaacactgaggctgtcaaactcataattgcttctaactccagctccagggaatcttacaccctcttaaggactccacaggaacatttgaatacccacagacaagcacacagacacacacacacacacacacacattcatgtgttgtgatcatttggtgttttgaaccctaccctgtgaaagatgaagtttggcttttactcagtgacctggggagcctccattatacagacttggactggagagtaggcaggaggaagtggggaccgttacacaggggattgattggttggtttggggcataggatttcgttttctttcggtggcgagatgatgaagtgcctgcaggttcatttagctgattgcactggctgagcccctaccataggaatttcttgcccggtttctaagaacagaggtagaactactggccctggttggcagctacagagatgcctttgggacctttctggaacttgtgttctcctgcaaatacttaaaggctgccacttgcagacacctttgcattggtggctgttgacttagacacaccaagagggtgaggaagttaaccactcggtttctcagtgtgtcctgggagacctagcaagtctctagatttatctcatgcttgacaaccaggctctcatgttaggaaattgagagagatgattgtgggtagataagatcatgccttagcacacgactttagggtgaatgccaatatgacctatagttgtaccaaagcaatccttgtatctgtagaggtgtgtgggaacatggagagaagagtgtaaagctgaatgatgaataatagagaaaataaattcagggatggaaaacatttttcaaatcgtcctcatcttctctttttggttcactctattactgataggatgtattcattttatttcttatttgtagtaaatctagctaactcttctttaccgaagaatattgacacttttcaagctttaatggacatatgaaatacctggagggcttgttaaagtgcattcaaattcaccaaaaaaaaaaaaaaaattaaagaggaatatcccaagcacatggcaggtgctggttcctcaagtctcgggtagaacctccagtttggcctttctcataagttctgtgctgcccgttgaagaacaacacattgtgtaacagggagaactgtttcggccacagttgaacaggccattacttatgtttgtgttttctcctcctggttgacatgagtatatcaaaaataaagttactctaaaaatgtccaaaactggcgctgagatgtggctcggtgatagaaggtttccctagtacgcgtgaagccctgtgttccaggcctctcatgggagaaacacaagcaaaagtcctccccctaaaacagtagcactcatacttatagaaacacatacttgctttgagtgcagaattaaagtcacaatgagagcaagcagaaaaatctcagccagctacttccctgttgctcctctctgttgggattcttaggcttgtgtttttatatgctgggtcaatgtaatgctgaagatttgaagctcattcttccatttggccatcactgtgggggaaagggctgtgatgatggccagcttagagaagcatcgtttggaaaagtgtttgaataactgcttgtcttcgtgcctattgaagtcttcctaacccacttgttgctctcctgctacctgtttgggaagtactacgatgtatcatatccttagtaaaagtgagatcagcaggtttcaactggaaagaatcaaattgtacaagtcccccatgagccagcgtgcacttaccttcatatttacatcagataggaaggagtatggcttgtaaattgcattgaagccatgttacagcactgctccaagttcatcttctctctgtaaagatactgtgaagatgaagatgatttagagccaagaatattagtagaattttcacacactatgaactttgttaaacaaaataggaatttaaaaataaaagacagtgagactagttgttgtggtggttcagatgttattatgacttacaatgactgtctagataaacaagaactactttgattctgtcctttaaatgtcttcccttttttttttttttcttaatttttatattccagtcaggttccttcactggaaaaggccatgtattctttgctgaagaagtcaactcagaaataggttgatttggttagtttcatgtaaatgtacgtttaaacacacacacacgtacacatgcacacatgcacacactcacacttctggtcctaccatttgatctgaaaggaagggattttctagtaaccgcagcttttgcctttctttgtgttgtgggagatacaaaagaaataggtgtttccttcctggactaggttgataaaatatagtctacctccacaacatgttaattttaatgttaatatattaattataatattaggaaaatatatattaattataatattaggaaaagtgtcctatgtgggttcatcgtactatcctctatactttttttgtatgtttgaattctttggtttgatggatggttggctgtttagttggttggttggttggttggtttgttggttggttggttggtgggtttgacttaccaatattttgtttttagggctgttatgatctggtgaccagttttatggagactaacatggggatcattgctggagtggcatttggaattgcgttctcccaggtactcaaatgattatgctgagtctagcctcgcccagcctcccaccctggtttgcctccctagcctccagtgtccagcttatctttctgtgctctgggaaaggtggatagaggaaggcaaggattcttgctccttaggccttaggtcatctgtttattgatttttttttcaacttaaatgaagtttttctgtcaagggaatagcggttacagtttaactaatgactatctccagtaaagcatcttgcttcttcacaggtcaaatggggggggggggacagaagaaggagctggctttattgggacttaaacaactctaaacatcaactgactggtctagatttgagggaggctctttcctggttgatctctctctctctctctcattctctctctctctctctctctctctctgtgtgttctttcttagtttctttggattatgcgtgacattaacaggcttcatcttgtgaactttaatctttagatttgaatatcccatttctgaagaggaaacttaattatttgtgtattcaactgctcatctcttcatctctattcaccttttacaaaccattgggagatataattaggccagttaagtaagctaaaggtattaacggatacaacacatataaactaaatctaaaatttagcctgcctatcgccagtaaggtcctgttttacaggcttcttgatctggggagcaaatggtatatccttgttataatagtctacaagtgtaagaactgacatgtatacttagcagcttaataaaaattttaggtttaacttagttttttttttcagactaacagatcatttttcatagaaagcccagttgacatgtcagtaatggctccaatgttccatttctatagagaccatctcaaagtctaactctctccctccccatctgttgttctgctcagcaatgcgaatgcagttctgctgtgttctaacttgtttctgaggtgttttcattgaaatatgaacttcaaagaaaagtgactaaattataattttgtagtttagtaggttattatttatgtggcccttgcttagatcaggggatagattcttaacttgatagtgtgtgtctctgtcaagcaggatttagtattaaagacagtgaaatgcttttcttccatgtaattatcaaaacttgtgtgacatggcatctcccaagagcatgtgaagtcagtcactatgagtatgtcttgtgttgcagttttaaaattctccttaaacagacttcattgctttctcccttatggactgaattaacaccccctacacacacacacacacacacacacacacacacacacacacacacatgccaacacagacaaactctaatcggatcacaagcagggcaattaactcagtctccagagacatttgaaaggcacttactgccctgaactttctcccaattgcttcaacacttcagtaataatacttagcaacatctctgtaatgtaatggcctagggacaattctgaggattccacaccctgtgactcatacaaatgtttaggatacacacaacagccttgagcacacagtttcctcaatacaggctgttaaaaacagaaatatggaagcatggttgacacttgggtatatgtgtacacacacacacacacacacacacacacacacacctctgaagtcttcatggcttccctagagaaataaagtgtcacattgctgatataatacatgaggagaatacctcagcgatcctcatctgatagataaagtttctcatctaagaatatgcctaggtgcctatgtagtcatgggtaggtatgtgaaagggtaggaagagcttgagggttttttggctggttatttttgttttgttttgttttacaaaattcattcagatattgtagagccaaacctctcggatgctgcttgatgtgaatgaaagtggtctgccgtggctctcctagaatgtagcaggctctactgaatgaatgccatcttccctgcttctctctcttcctccctcacggtgtccctttcttccttccacttttcttcatctactttccatcttcttgccctctccccacacactgttgtgagagaccggcatagtgcccacctattgtgtcagattggaaaggcagtataaaggtgcaaggcaaaatatgctgagtccagttttctttgactcaccatgtcccataggtaatttggcttagagcccttgtttgaatctggcgccccctagtgctcctgttgcctttgtcctctcaaagacaaagaagttgagtgttgactggatgttttctttccttttcttcagggaagagacaatctcactgtttgtcactccccatataaactcagtttgagttggctaaactcaatttgaggcgttcccactccctgagccaccagacctgtttcaccctacgattttgatagttaccatcttcaagagggaacatgggcaagaagagaggagaggataaggatgggatgggtagtctctgggaagagaggccccttggtctagcaaactttatacatcccagtacaggggaacgccagagccaagaagtgggagtgggtgggtataaaggatggggggagggtataaaggactttcgggatagcatttgaaatgtaaataaagaaaacatctaataagaattttttaaaaaggattggatggatgggaaagagctaggggaagttgctagatgtgcattccttattctctatctttccatctctccttcttctctcccttatttccctcttcctctttctttattaggaaagagattaagtctcttaattcaaagacaaaagatattcaccaagaaatatagaatgcattcctacaaattcacctcttggcctcccacccccttccatgacattccttagggcccagaatctgataggatgatttcttctgtgccagtaattctttactagaaccttaaaggggcctgtttcccctttctctctacagggcagagcaagttagggctgttctcagatacgaaagtggctgcaacataaatctttggaaggattacctgcatagtttggggaagagagttgaacctattaaacccattttcttatctggaaagttgaaaaaaatattacaaagagttgtagtaaaaacagtcaacattttattttatcggagtttgttatatacattcaatgcctatttatttatttatttattagtagaatataaattttcacactgtgacatataatctagaattgttgattttggaaaataacagtctcatagaatgggacatgctgtaaatttaaaagttcttgcacacctagaggaatttaggttctcagtcagcaatataatctgaacattatagccatggtaccttcggccactccgcgtaagtgtatgacaatgtgtattttgtggcatggagtgacagaggccacaaggtaataagtacttaattcctgacaggggttattgtttgcacattttttttaaagataagaagtggggattggagcctgcaaggtgagtaaagaggtaggtgaacactgtgcaggtgttcccaagcaacagagcaggcaccaatggccacaagtccctcacggatcacgcgagggtgatgaggtaggctagcaacatgattcttacctctgcgtggcttgtggaaataccacttgctggattgtcctcagtggctggttcacaggtaggtggtgggacctgaaaacactcatttctgataaaatcgcaggtgatggtggcactattgtcctgcaccagactatcttgagaggtccctactacctataagacaacaaaacatagccagtttcttctttttttttaagattgatttatttatttcatgaatgtgagtactgtggctgtcttcagacacaccagaagagggcatcggatccccattacagatggttgtgagccaccatgtggttgctgggaattgaactcaggacctctggaaaagaagtcagtgctttaagcctctgagccatctctctagtaccccatagccagtttcttaaaggcaccattagccaaaagaagatggtctctggactcaagtttaccactgagcacctctccaaagaagctgatcctctgggtttataaagctatcagttattaaccaatgaagaaagatgtgactgagggtgtcttgacactgtcagaatcatttctcatcaggttcacctgcgccacaggctaatccaaggcgttaagaaggttaggagccaagatactctatggaagtggtgggacaaactgagaggagtttttgtgcggcctctgaaaaacatggaagtggtctctcaatgtatgtgggcctatttaggcctgtgagagctacaggattgagagacagaatttaaagctctcccttcctattctcctttccccacccacctcttataaatgatgactttgttatcttactggcaaatggacctagtcaagaataatgtctctattcttgtctcaaggaaagaaccactattctgcccgccaagtataaccagagtatcatactatgttgaaaaatctgccaaatatatctagccttccaaataattcaaagtgtattagcctttcagttaatatcataccaatttcaggtcatttaattatttcttgcattaatctcatagcatggtcatattttaatacatgttgatatcagaagctgttctgaaatgtccagagtgagctacctctgaaccttgttgccaatttcagaacttcctcttggtcccataccagtacttagactagctcaaactttgatcccataattcaaatctgatttattcttcagtcctgacctttgccctttccaaataagaaaacttctatttattaaaagtcatgtctggatattcatgtgtatcaggacaactctttgtgttggtagatagatgcagttggtatgtatcaaagcttaatttcaagtatttctagagttgaaagcaggggatagctttgtgacgtaagattcttcttttatacttgttcttcttgatcacagttgattggcatgctgctggcttgctgtctgtcccggttcatcactgccaatcagtatgagatggtgtaaagagaaggtgagtgggagtagggagggttggatctgggaattttcccctttattgcccagactccccttgaagtgggcaggaagattgccgagccactgagccactgaactgcctggtggcgttgcccacttgtagaaacctcatatccgtatgttggggaagaggtggagtggatgccattggggaaagtgggaacacttgctcttcaccttaaaccttttggggcaggctgttagcaatggtgaatccctcacatgtcttctctttctcttttctcttagtctttcaagaactttggaataagaggcctgtttttaaaaaggaactgccgcaatctctgaaagacttccaaagaacgttagagcacagtacatactatccctgccctgctcccacccccagctccctgcagcccctccccctacgtgcaactgacactcctacccagtcaaagctctgcctttcagcccacgtcatacgtagtgtccatcttgtgaagccctgttgtgccccacagtgtagccaggccccctgcagctagtcatagtgaagcccaccctaaggccctgtgagcgccagctccctcacatgtacttggtccaactgtaggtgactggttatcacatcttcactggcccctgtggccctgcatgtagtaggggaggcttcagtcagcccctcactgtggtccaagaatgccacacacctttccgtagatatgccgatggtaattatcttttcttttggcttaatccgatttggtttggtttttccctttccctggattctttcctaccttcttcaggctgtcaagcacgggagaggagacacagtgggagggattcataaggagaaaacagcgtctggcaggcatggcagaaagtgctgttaagcattagctggcttccttgttcattgttccaagagatgggtgtggagagacggcttagtgtaggatcctctcgaatgaagcctgtgtaatcctgttacaggttgtgttgttacttccctgatttgccccaactacttactattatttcgctttcgttttcctgtatttttttcttgcattgacattattgacgttgaggacctcatcagatcaatttaaaagtgagtgtggaagggaaacgaaagtc

SEQ ID NO: 232 - DNA, 111484 bp, mus musculus
cgcccgccgccactgccgccgccggagctgagtagtatggcatcgaggagaatggagaccaaacctgtgataacctgtctcaaaaccctcctcatcatctactccttcgtcttctgggtgagtgcccacttctggctactggccgggccgcggtctatcagaccgtgtggtgatgctcttagaaagaaaggtggaaggaaaacccaaaccccaaacccgatcttagccggtggacaaggagacagccgcaggctgctgggtcggggctgtgagatggtagggtgcaggtctgggctgctccaaccctcgagtttgtccgacgaaggctgaagtgggctgtgtggtggcggtggttgcagatttttccactcttccaaaaaaaaaaaattttttttaatgcattgatttcttaaactctcaggacaggatcagcccctggggaaagttgttgtgatttgtctgtttgctcttttggacttctctccttaccttaccaagccagttttgggtgcctgttggagctaatggagctaacctgtggcgggctgggagcgggcgcaggacggcggggttagatctaagatcccgacttagtcctaaccctgcagggctgtgggagagagtcgccaggaatcttctgcctgactggacaagggcgatcagtctcccaagcgcactaatgcgggacaggcgccgccaccgcgtggaggcgcacggagagggtcttacataagccaggggtatctttgagcttcctcagcgactggctcttacgacccctttcagatttctttccaccccttactgtttccactcggttattgtgtttttctgtgtgaacccaatctgcaatgcccaagaggaggaccccctaccacctggtggctgcggcagcgcccctgttccccacctaactggtactgctactagtccttgagctcaatgcagaaaggtgacgtcagcccttcagcccaggcccgcgaagggctgcgtggtgcacctcgctgagggatgcgcccttctgtgcgcaggaggagggaaaaggggaggagggggctctgggcttatgccttacctcatcctgtttggcaattcatggaatcagtgcagggttgacactgcagtgatttcatttgcagaggtgggtggtacctaaagaccatttccagttctttctctcttcacatagatgcccaccctagttccctcttcccacctcaagtcacagccaccctgcaaaggaatgaatacctgccaccaccaccctggccccccgcaacaccatgatctgggtcattccagctcccaaagcagtcattttgaaacctgaatccctgtttaaaaagatagacagacagacagacagacagacagacagatagagaaagaaagaaaaaagaaccaggcttgcctttggttggttttttttttcttgcccttcctaccccaatattaaccctgtttttgcttcagaagtggagcacagtattgaatgatgtacctatatcaggattgatggtaaactggattgtttgcagtagccaaggcaggagctgagatttattacagatttaaaacaaaatccctaatgtttctaggcttttccttgccactgacattggtgatccttcgggtctggaaaaccatggagtgtggcaacagaacagaccaggggctctgcagtgagatagagtagcaagaccaaaacagcccatcacataagccaaacatagaagctgagtctttctggaatggaaatgacacaggttgaatcatctcaggaatggaactgtgtgctagctatacattcaaggatcttagcttatgtttgcctggaaaaagcagcaatacttggtggtgatggtccaacttcaaagaagccattgctgggcactggttttgctctttatatatccctttaagtctgcttttgttttgccctttgttatatacttcctatttgttaactggagtaaatctatgggtggttatcttaggctcctgaaaaagaaggtttatggtgcaggagaaagaaggaatgctggttttggagcatttctgaagcctggtaaaggaggaggcatttcaggcttcggcttttcatatggattatttaactctttttgtctcaccccatccccatccaatgactcagtgcctcctaaaacatctgaaatggtcaatgtgttgtctgcccctgcaagttgctcatgatggcgttttcatttatttttttaaactttcaagattttcatattcttaaatatttacccagagtattttcacctgttaaaataggattcaaggatcatttcagattttacaatcaaaagaataagatctctccagaaaataggacacttcaaagatgtttttcttaataagccgtagtccaaatgctgtttttttaactgtaccttaagtgctattttgtacaacgcagctttactgaggcgtacttcatatgatatatgtcacccatttaaagcatggtatatgcatacatgcttaacatatagataatttgcattttaggtatttgttatcttttttgtgtattcacaaatacagccatttactacagaccattttcaattgtttcatcatctctgaaaagaaaccctgtcctgtccctttccttcccattttccctcccacttgtttctctcctggagccagtcctaggcaatcatgaatctactttcagttgctatagattttactgttgtgaacatctcatacacttgaggtcatgtatttgccccttttgactggttggtttcagttagcatgacacattcacgattcatgcatgttgttagtctgtgtgagtacttcgttcagttgtatggccaaatagaatacctttttgtgaagatactgtgttttatttctcctttttccattggtggatatttgggttgatgggggctcttgactgttatggatggtgaggttctgatttatgtgccatttgtgtgtgtgcctatattttcattgtttttggctatgtatttggggatctgtatggaatcatatagctctatgattaattgtttgaagaatggccatactagtctttcagggcaagtgttccattttatagtcctttcaacagcgaggattccagtttctccatgtgcttgccagaatttgtcactatctggctatttaatgtagccatcctggttcctgtgcatttagatatcttactgtgtgattctgctttgaatttccttaatgaatgctaatgttgaatattttatagtgcttaatggttgttggtcatctcttgaaaagatatatattcatattctttgaccatcttatttatctattattacattattaatttcttttatattccaggtataaaatcctatcaatatgaagtttttgcaaacagttttttttccattttttgggttcccttccccttagctgttttttgaactgtgaaaattacatatatatgtgtgtgtgtgtatatgagtatacacatatatgtacaaatgtatatgtattatatatgtatatgaagtgcaaatggattggctttttgtttgttgcattgttcatgcttttgatatcacatgaaggaatcctttgccaaagatcacaagaataacctgttaaaaactgtttataagtgttattcctgaattgggtaaatataattgatatatgactatttcttgaatacctagcactatgtctgacacatggtaagtactccacttgttttttacatttctggacttatgccatgtaatagaagaaaaggatgagcttgcactcttttaaaagtaatgcagagacatgattagtcagagtaatttccattgtgttttctgtgagttgttttaattttacttctttcacttcagtttaggccgaggagtagaaggtgcttcatgttaaaatgatggtaggttagtaacatcaagaagtattggcctgtaccaaagcaaacagattgttgtttttatctgtattcttaggtttacagtcatcccctttgactgctatatttcgataaagctatgattctcaacaggggacaattcttccatgtttggccatgcctaaagccctttttggttccatctagagtgggttccactggcatttagtaggtagagaccacaggtgttgctaagcagccacctgatgactccttgcagtggttgagctctgcccagtatctggctcaaaagattaatagtactggtgacctttatcctatcgagattgagcagtaatgaatgctatgaaggaaagaagagtgtgatgggaaatttactgtttcaccatatcacagacagcatgttcaacacaaccacttttaagaagaaaaaaaaatatcctcaatggtgtgccatgctggtttatttgaagattaaaggtaagcgactctttacagattgtgtttctaatggataggatggttttcctttcacttcagtgatatcaaccggaatgctggagaacatgttcttattttccatgatttgtatgttttattttcaggttttatttcaggttttcagagggaaaaagccacctaggagcaagttattctgtgctttaaagaccagaaagagtattgcatggtagtttccttgggaaatatttacattctaaataaatgaatgaaaaatgaaatgtatcaactactactggcttagttattaaacccaccacagctgggggaagctttcaaacgtgtactattttgagtctgtttatgctggattaaatgtgttctttctatttacatgtcgatagatgactaggggacttagggacttgcttacataataaagactgttaaatccttatacttttgtgatctcttttgttggatatttcggttaactgtaattgaacttaagtttgtataaaaatatcaatcttaccctatataaaactaaggttcttattttcgtgagaaatataattcagaggcaaacaagaaaaccttgtaaatctaactgttacttaccagagaattgttttgatttataagcttttatggactttcaatactcatctgagttctaaggtaagatttaaattgactagactacatctgaacagtatcgtgaagagaaatatcctttgcttcattttatgcttcattttagtgaatattgggtttgattattttattgtttaagaatgtaattagcttactaatagcattattaaatcattccagtgaaataccagtgatttttcttttccttcataaacaatcattttggggtaattttaaaataatattattttgttctctttttatggagcaactttcagtgattaaattgaataaagaggggaaaatcctaaagagaggccctaacatttacagagtgtttgcgacgcacacttactcctgacaaaattgtttctgttcagttcagcaaacgttggttggaatgtctgtcatatatcagatatgaaatagtctaaaagatgtcatctgttcactgtatacacacttggcattttcgttacatttatttgtaatacactcaattccaaattgtttgtttctaggtgttatctgttgttgtcacactatagaagatgaagatttagttcctttgtccccttccttttctctcatgagcccatttcccagggatgtcatttatcagtgtatcatttggtttaaagcagtatactcttttcatagtggagccatgtggcatggatatttccctgaagttagcaaacacctccctttttccctttgcatctagtatagtattcacttccatagttttttcaataattctatctttgctcagtgtattcaagcagttcatgggagctttctgtggcctaatgttatagacatttgtcttggattgggttggctttcaatttgaactaattttctctgggcctccactctgttaaatcctcaaagttcctaaatatttgtttgttctacttcttgatttttccccccttcattttggtagagcaaattttcatgtagttttctttctaggaaaggaaacatgggaagtcatatacttaagtctttacaaattcaaaactcttatttgatgcttcatttatcttgatagtttaggggaagatacaattgttgtttcgaaagcatttacatcaaaagctttactgtctactctatacattaaacaaagtaataaagtctttttgttattaatgttgaaaatttgatattattataattcttcttcaatcttgctttcccccctttgaagtttttttattacttgcatattcacaatgctctgaaatttctctctgaaaataataggaatttttattttaataaagttttaattttttcattgtttcttccaaaccattttgttttagggtatgttataatcacagatttcgggttttttttctgctaattattttatatatgtttaaaagggggttatcaccaaccaaagagtacacatggtgggactcatggctccagctgcatatgtagcagaggatggccttgccagtcagcaatggaaggggaggccctatgaaggcttgatgtcccagtgtaggtgaatgtgagagtggggaggcaggagtgggtgggtgggcaggggcacactctcatagaagcaggaggaaggtgaatgggataaggagtttccaagggggatatcaggacatgtaaataaataaaatatccaatttttaaaaaaagagggggttatctaaaaacatttggaagctattatcatgattctgttcacatgtttgctgcttttaagttgtgtgactttgttggtctgggtgagttttatgatcaagatcaatactttccccacccccacccctagattttgtctgttggtctaatcagatgacttacagatgaatcttttcattactttctgaacaagaaggtagcaatataacagaccccacatatggtatacaaatgtccactgtgttcttgggtcagggactttctgctttgctcttctagggttacatccctgaacctatggcagagtaagacaaaaaccagaaacaggaagttggagatttcctaattgctccttaaaacgttttgctagctctttcttctttcagcctccttccttccctaacttcagccctctgggtcttctggaggtgttttggaataaatacctttattctgggatttttcaaagtgactaaaatatttttggttagctctaaggatatcaatatggttgtctcttctcccctctttgctactgtagggttttaaaaagatgttttcagtgtcacatcaggggaattttaggagttagccaagataaatgaatgtatacaatccatcatctttaactagaagtcctttctatctacatctctactttgcatgctattaattaaataagcaattgattctgagtgtttgaatagagcatgtaaatggaaatagttggactatcataagtactggtacaaacacacatacacatacatatacacacatatacacatatagttagactgacttaggtatgtcagggaagcacactatcctattagtatatttataaaaacctgttttgatgacaaggaaaatattctatgttggaataggcttactaaagcagtctctaaaatgaaatctggttatcggggactggacaaatagggatgatgccctgaaggttactggaaatttttctttccttctaatttcttcctgctaggaaaagactcaatatggtgttttctgacttaattcagactggactagaccaacttaatatggctgcctaagagtttagcgtgtgatgttcgtatggtgggagagtcgatgtgaaactactctttttatgctattacagttatagggcatccatatgataatctagagaatattctctttttcagtcatctttatttcttatatacactacgaggttaggagatgcatattatcttctataccatctggggaacattaagccatttctatctaggagttgcttagaacctagctgaaattttgtcaaaatcaaatgaaattcacttcactttaatcccagcgagagttcttgatttgctcttactgtggactacattgtgatgaggcattagctcagcatcacatcctgtttgaagtatgtatctcagaaggtgctgagaactggaagtcatttgtgactgcttctttgtttaagcacattaaacccttgagactgatgactaatgccatgtcaaaccaacactttacaataccttcttaagtttttctactttggtccaattccagtagcttctgatacgagctatcatcatcacttcatggtagcaagcaggtcattgaattgacgaggaaacttctgttggctgttagccctcttgctgggacaggatgctttccatacttggcaaagcattttattctcttaataccgatcaagaaaagaatgaaagagagagaaaatagaagagaggttttttcccccttttttgtttttgttttccattttggtttctgatcagttgaatgtgtaagcattttaaacaatctaatgataaaatcaaggatcctgcttctgtctagaaatattctctttagtgccttcttgaaggtgagtatttcccatcataatctattttaggagaagtttgtaagtatttatgttaagggataatcagttgggtctagaacagatactaattgagcagcttaaatcagtgatttttaacccattttttctcaacaagaattgccttaagttgccctaaaataaatgtctaagctatgttctaagatgctgtgattcagttggtccagatggggttccaacataatagtttggaaataagtaatttcaaagatttccactgttcaaattggattcagttataaacccccaactctaaaaacacatagcagctaaaagcaggccatttcatattgagtctcttggatttggaggtagctaggaagtgttcagaatgggcttactaactgactcatctttgtctgaggcaagatctataatgctttcctcaaaactaaagtagctttgtcaccctgaagagactgcacttatcattgctaaataaaacaatgcttatctaatcagcaagggtcttccttttggcatttatttattgagggtagaggtacgtcacagtttgtaaacaagtaaaaggacaacttgcacaagtggcttcttctaccatgtaggttcttgggatcaaatttagttcaggcttggtggcaagtgcttttatctgccaagtcattttgctggcccactaaaggtcttcttaaagaacaaattagcagtcataattttgaaacctaaattaaaatttgttatgcttagttgctatgaagaggggcctgggtatgtacattaggaagagaaccccacaaagtggttctgatgttcgcttgcgatatagctattaattatacataattatacataactctcattatgaagttttcatatgtggatataatgtatacaattttgtttttttatacccacagaactggtatttggtaaacatttacagatgaattattggagattagatatctttctgttcctagaaatgtacacagagagagagagagagccatcatctaatatataaagcaaaatgatgaatttactacttatcaaaggaagaaagagctgtgttagtcaattgtagtttataactaaagcatatcttttgagctggcttcaaatttgcatctacaaaatagtgggcttagagaaccaagtcaccatgctaaactaccactgttatttatgattcggtttatctttcaaatgcataaatacaaaacattaagatagaaaaagataaaaccatcttctgtggctaaagttgttatttacctcaaattccagagtctagttaaaaaaaaaaaaaacactaagagaatttgatatacaggctggatataaggtaagcataaaacattagctgcctttcattggttcatcacacaagccttagaaggaaaaagtactttctttgcagcaccaacaaaaatcatgactattgcagaaaatagttaataagaaatgtaaggaagactctgatacagtggaatggaagagaaacgtcactgaaaataagccctgaacagattgaaagaaacctacgtactcttgagttgggagatgcaatatcataaaatgaccagttttctaaaaagttatttgatgtatattttttttcatatagaattctggtagaatttggggagagatggtagtacttgattaaattatattgttactgtagaaacagataactgagaaattagtaggaatttgggaagtagataccttatgtataatggaatatacagttaggggggacaatgacaaccctgtacaatcctcagatcctggcattcatgcctgtgtgccaccccttctgtttcagtgccatgaggacgtgtgatttgcttcttatagaatattataaaggtgatcaaatgtgccatataatcatattacataggatttttacttactgagaggctatgtctctttctggctttgaaaacttaagttccttgttgagagctgccttatggagaggggcacatagtgaggaactgtgggtaattctctaccttgacaaccaatgagaaaaatgaaacctccagtttggcagtatgggaataactgaatgctgccaacaattgagtgatcttggaaacaggttcttttgtgacttgagcattctgtgagccctacctgacactttaatggaagctttgtggaaccataggcagaaggtattgctatcctgtgcctcgattaatggccccacaaaacctatggaacagtaaatgcattttgcttccaatatctacttttgatattattaatattattatgaaataatacatgacacaactggaaagtcactagtcagtattgcataacattggtttagaaaaaggttagtaaataagagggcactgaggaatccagaaataaggacttgtgtgcattacttaataaacgaagcaggatgtttttctagtgggagaaagctagttttaaatgcttatggtactactagatatggaaaagtaattggagcttttgcctaaaccacataaacattttcagttaatttaagtgttcaaatataaaataaagcaaaaattacatttatatataaaatataaaaagtataattttatatagacataatatgtagagctaggcttgatggcacacaccttcccagcatacttatgaggtagaagcaggcagatctctgagttcaaggccagccaattctatcaagcaaatttcaggatagtcaggattacacagagaaaccctattttgaaaaaccaacccccccaagaaaacccaacatagatacaatataggtataagaaagatggcttactaaattagacactcagaagcaaataaaatactgatatatttggttattttttaaaagtatttaacaaaattgtaatttttgttaaatttgtcaactaaactgtggtgaggtcaaacaaacaaacaaacaaacaaccttgtgccaactgttaacattgctttcttcatttagccatttatacaaaagctcttatttctaatggacatcgtctctcaatatagaccaatgactctgttttatgacatttatgctaaggacatttgaggcaatctagagaaacatctagagaaacagttggcacagctttactatccagggccagatagtaaatatttttggttttatggaccatgcatctaattagtgttaaatgaagcctatgcagcatagataatgacgtagataaatgaataaggcactagcccaagcaaattgtatttaccaagccagatggacagcgaggtttcatgcatggactgaaattgattgacccctgctctataggctgcagatagaagggaggtctaacccttactttcagtaaatcatagtgtaaattttactatgggccagtgagagtgggaacaaagcaagcctcacatcttctacattgacaaaggctacttagaccctgtccaacaaagtaaccactacagtatttcagatatgaatcttctaaagtaaaatgtgccgtgttaaattcacatcagattttgaagttttagtaccaaatgcaaagcatctcattttgttttggttgcatattgaattggtaatatttcagatatatattggcttaagaaaatcatattagtaagacttaattatatataattttaacttgagtgttgttcaaaatttaaagctataaatgtgagctgggtatggtggcttatagctatactccctgcattcatgtggctgaagcaggatttctatgagtacaaggccagcctaggctgcatagggagtttctggccaacatgagctacatgtgaagaccctgtctatatggcttgccattctatctcatttggatagctctgaactagaaaagtgatatagtgtactcgtgtttggagggactagaatgagtttagtcatactaaagggaaaggtgtgtggtctatttaggtaagctagggataggttttattattggttgactaggactggctggctagcacaaggaatactctttcacagttctgaacacatagatgagagatacactttacaggtctagtctgaaagcattaaattgccatacaaaggcaagagaaagtgaaaccagcttacctagctaggaagtgaagtctaatttcaggtgacttgagaatgagcagtggaggacagaagatggcttctttaggatatatggcaagaacagtattctgcgcttaaagatcctagctgatgttgatacccctgtggcactgtagaccctaaggagctggtttaacattgataggatctgttatagtttgtatatgcttagtttgagataacagtaactttgaaggataggttgactctcagaagtttgctgtattttctagctgatggtggtgaagttttggccatctctgtactgtgtggcacctacctctcaccctccgtggtcacagttggttgacctggggagaaagatacgacttgtatttgtatattggctggtcagtgaaatgtggggtcaggtgagcagaagagaatggctcttcttttgcactgggagagtagagaaagcacctgttgatgttgggcaggagaaactcagaggaaggtaacagtagatgcatgcacgctggagacctggaatggacactgtgaactcccagtcagtaactcatataggttcctggacagccaggtagcagcccaatcatttcccttccagctggaagtggcacttcatgtttctgggaggcctgtccaactggggagtgactcctagcctcctcggctcctgttctcttaaatttcttgtctaaccaggaaaggtgatgagttggatgtttgaagtggttagaaaggcaggggtggaattactagagcatcacaggagcagtgtgtggctgtcagacaaggttggggaaagcccattaggtcatttaagaggcatgagacagtatagctatccttttcaactgtgtggtacgcccagaattctaagcacagttaatgctatgttgcttgctgataataggtgtagcaaagcattgcgccaccaggactaaaggaagcctgtgtttccagtaagtcctgtctaaaggataaaggtcctccttcatggtagtagcaaatcatttgagcaagttactcattaagctccttaatagcagctgctctttttggagagtgagctttgaagttctttaggtttgtattcttcaaagatgtttcaaggacaaacaagtaattgctttgtatgttgtacttttttaaaaaagaagggggtgcctagaatacagtggtattgcccaccctgatggggttatacatgctttcagacaggtaactctttgagaggtgcctcaatgcctacttacagtcagtgatggtgggtggtggaggggccttccttaaagtctaatgaccactggaaaagaaatgcactgctccatattgtcaggaacacaggacaaagtatgagatgttgggagtgagctctggatagagcatctcaaatatctttaaaataaatatagaaaaagagaggctcataaatgaacactccaattaagaaggtattcaaatgagtagtctaagcaaacagcatggtatatgacatgctgcttttgtaaagaaaaataagtgcatggaacagttactgaagaggtctccacacacaatgttagcacttatggctaagaggcaaaatactttatgggttcccttttggtgtgttttccaaggcttcaactagcattgcatatagaaggtgttacttttataatgaagaaagcaagaaatgcttaagacattctatatattacatcctatctgattttatttctcaaatatggagtgctttttaaacatatatcatttcatttatcatggaacagtttatcagctcgatcctctcttattgggttgagtaaatgaagagcaaaaccaaatttaacttgattctttctaagtcttaagtctcttcaaaataaaggaaaatgtctgttccttttgggcattaactttctgtgctatattataaatataatttaaggaaataatataattgcctgccaatcagctctatcagatcttatcgttatgctatttttgccttaagcaactagttcttaaagaaatatgaaaattttacactcagtgccctatcctgtcctctctgtcttaaatatagttcattagttgagtctattttgtacatatttaatcatatatatgtatatacacatatatatatccccataattgctataaagcattatttttatatttttaaagtccacataaataaatcattctaagcatattgccttgaatcttagcattttggtttaacatattctgtcacgtttccatgttaatagatgaggctcaaccttagggattttccatgaaccaaatctacagacatctctttttaaaaaatttttattatatattttcttaatttacatttcaaatgctatcccctataccctccccctgccctgctcccctacccactcactcctacttcttggccctggcattactggggcatataaagtttgctagaccaaggggcctctcttcccaatgatggctgagtaggccatcttctgctacatatgcagctagagacatgagctctgggggtactggttagttcatattgttgttccacctatagggttgcagaccccttcagctccttgggtactttcgctagctcctacattgggggccctgtgtttcatcctatagatgactgtgagcatccacttctgtatttgccaggcactggcaaagcctcacacgagacagctatatcagggtcctttcatcaaaatcttgctggcatctgcagtagtgtacagacatctctttttggaaacaagcttcatgtgtagttgatggatgctttcatgccatgacagctgtcacaaaagattgttgtggagaaggatgaagaacaccttagccaatcctacttcaataatgtgattttttggctgaggctaagaatttagccaagttgacacaaggcagattaacaggaaaatatatatatattcacactgtgttgactttacatatatgctgaactgtcacaagagagcaatggtctgaagacatgatcaaaacagaaagcttttagatttttaaaacaagtaccagtaaatactggagttagtgatgggacaaggtgatcttgacaggggataatgaattctagtgatgtaattaggagacatatagagggtgtaaagctagtgaaagataagggctatttcactaggtttatttgtatgagtccattgtggcatggctccccagtgattgtgggttagttctcattctggtttgggtatacttccccctcccaaaggaatctttatggtttgcttcctgtacaaagaggccagttagacagttcttctgaagctacagtgtctcagatgttactagatcaaaatgatcaataaccagtgagcatctttgggataggatggtcttcactcctttgctgtatgccttggaaaatatagagtatttgctatctcttcctttatagaaatctgtgaatccctagttcatttgttgtgtgatatgtcgttgtccattcatttttttccttcattggggccttttatgtttacttataagaagtaaaatttgattaaagtttagctacaaacacacacatgtgtataccatatatttccttactgtgtaagtttaagtgtctccaatatagcgtattgaacattaacattaatcaattcaatttttatgcattttgatcctattttctgacagttagaaaaaacaaattcaagatagactttaccctgttagcttctaggtgttttatttggcagtttggaaggggatggtattttctccttgattagattatttttgtctccaagtggactattatgacttgaatggagaaaagggctgtgttgtccatatggatcaaacatgagaatcatgactgctggcagcaacagtatctactctacgaagatcactggattagatcaaggtggtgatattgctatgaacccaactactgctgtatgattattgagcagttagtaaaggcaaggataaggttgaccatttaacatgtgttatcttgtttagtcctcatgcaaacttgctgaggtagtaattactgttccttattttgagaggaagtcccctgacgtccagagtgtggcccacagtcatgcctgaaaggggtttttgttatagacctcttcacccttcttgggcccagtgtcctgtttccagaagcacatttctccagggtaagcctttggagatgattagaggttactctttgagtcctttcttagtcatcaatttgctttcctgcaaaaaagaaaaattgtttttgctcctatggactggcaaaaatttcctgtacaagaaagaaatcttctaatttccagaatgatccaagtttacagctctagtgtctctggttattttggtttatagttttggaagtattcccatttttttctgtccttatagctccaagcttcagttttcctagtaagaataacaatactttgcagactggggatacaggataaggaaccctaataggagatacactcttcttgtcaacaactaagcaacaactcctgcttttctttcaaaagtctgagtctataacgaatcttcctttttttcctttttagttcatggttgatgtaagttagataaggcatcaaaagtcctgagaatttccactgggtagatgatactctgactgtcatttaagattaaattatcttatgccttaaagattctaaattgttgctccaaagcacatgaatattatttatcccactgctataaaatatagtcgacatatgaaactgattcctatggcaacaagccccagaccactttgaacagccggaaaccaaagaagtaaaaactgctagagatgcaacttttccccctgcctttgccctgaagagtgctaaaggcagtgggaactgtcaggcattttcctttggagctgacactagctaagctgttatctaatccacacatggacacacagataaggctcatttgcacagctgccaactcaggctttgcctgttgatgtgatcttgtttccactctctgtatctgcttttaggggggaaaacaaacctgaccattcctaatttctgtgaatagtgacaggaattcttgcctgtataaggttaattggctgtgttatctctgatgagacgagcttaagggactggagaacactggataaagtctagttcaaaaacagaaatttcccaatgctgctaaattccagtttcaaaaaaaagacatttgtagatagacatctctatttttttgcttgtaaaaccaattctatgatagcagtaatacacacacacacagagagagagagagagaaagagaaagagagagtaaatactacattatgtttggatcctctgacttccctctacatcaagcctctttaattgtaaagatttgattaataaggattttggaatattttgttttaaaaaaaatctatttgtagggccagctgaatggcttattcagtaaatggtctgatccttaggacccttaaggtaaagagagagagagagagagagagagagagagagagagcgcactcaatctcaaacgttatcctcttttatgacttcaaaagttatccttatatgacttctgtactcatgcttagaatgtccccaccccacacaaaataaataagcataaaattttaaagagtatttaaaactattggtagactggtgtcatgagccagagacagaaaccttcattcaaattaaacctgaactgagcagcgtatgtagagttgtattgcttttttgttttaactgtaaagtagttccctgtgcttatttccagcgactaaaacatggaatttgtctttaattccccccccccatctcatttctagctttgtcaaatctctctcttatctgttgtagccagttgccgtaaatcagcggttctgaacttgggtcctgaccctttaggggtcacatatcaaacactctacatatcagatatttacattatgattcatacagtactaaccgctcaagtaccaacaaaaatcatgttatggtggggggtcaccaaaacttgagcaactttattaaagggttgcagcatgagggaggctgagagccactgactgatgtttggctgtcttctcattcatgtagtacagatcaccaagtcctgttgagtattttttgtttgtttgtttgtttgttttgttttgtttttaaagatttgagagattttaattgacaggcatggctgtacctagtctttaagtctgcccaaagcagacagactgagagctttctaatcctttagaattttatctgggagtgaccttggaaagcatttacatccaatcccttctctccattgcattgccaattcattttcatctatattgtccagagaccatgacaacagtaaaaccagtgctaccatcttgctcttggtcttggaccatcacagcgatttagacccctactccaaatcccttcatttcactcctgtttgtgatttttattctaaacaagcaatttgttttttttaaagccaaattgaaaaagaaaacagccattataaaacctataaaaccaagttcaaattttttgcctgctgataaaacattaatatccccacacagcctcattccctttcctatttttagcttccattcaggtcactgtctccagttctctggttactaaatcttactagtcttcaagagtttattcagtgatcacagtccctaggaagccatttgtaaactttccctgccctctctctctctctctctctctctctctctctctctctctctctctctctctctcaactttgcccagctattatattctgcttgtatagtaatcatttaaccatttatttgcttgcctgtcagctttcctcattctctgcttttatgccagagagaatatttatgctcagaatatcgagggcctgttaaatgctaagtgctaggattcagttggaccaaatgaacaaggtgatctggtgagaaggtaggaaatagacaataaacacggagagaaagaataacacttcaagcggcggtgagtgctccaaaggaatagttcaagaagtgatggtatagggccctagtaatagagatatcacaaaagctctctaaggaggtggcatttaagttgaaacctgaggggtaaggaggctcagaatgtagattgagatagttcagaacccagtgtgatttctggtatttgctatccattgttaagctgattaccccagttatctgagctgaagcaagtaatttagaagtcaatttattgtttgattgctattacttgactcctattgacagctgggccagatttgccctcctaaagatgaattcttgtaacaggaaaaacaaagcagagcacaggaacctcattttgggtaattggcacccttctttgtaatgacaagaaaaacattttgacatgaaatagagttgtcgctcaatgattgtttacggctaatgtttttcagttgtagatctggtccacatggaggcttatgtacacaatgttaagtctctcaaatcctccttgcctgtttgccatctgaaattgtctattaagcatcagttcacgctttaattatcctaaagccattgtcaattgaatctctttgttagattgatttgttttaatactaccagctctagagttaatctgttatgtgacaccaatcaaattgttttgaaattatgaacttaagaacgcctacaggaaaagcacctcgtgctcttgaccaccaaagcacttccaattctcttgtagcctttgttttcatatcttcctcgtagtgtagataaaaagcatcccaaacacacagaattccatttttcctagttagtgctattcaggtataggtttgggtatggctaactggttgggtgtcttgtgcctgagatgaaatcttttgttttgtggaagaaatgtaaaatatttgtctactttaattaaaaatcaagtaatagtgtagttaaattgttgtcccttccagaagctactaagtcactgtgatacagactttcgctcctctaccccgtgctctaggcagttctatggagatgttttactttcttcttgactttccctggagttggtcctcctgtgtgatcagaaggcatggaagactatttcgttttcataatgtacaaaaatacgccaaagtggaaggaaaaacagagaaggaatcgagaaacaaaagaaaagaaagcaaacccctccccttgattttgaaagtgatatagatcggtgagaactgtagttcttcacatgttctggctaatctactcaatattcttccagcctagcagacgtgtgatagtattgtagtgtttccattgtgtatcttcatagttcataatggagaagtatattttcatatctgtgctatccattcttagatcaatttgggtctgtatttcattttttcccctaagagacatcttattttgccctaaccattatgagttgaacatcggttgctcagattattctcaaccactattttgcctgtcataaagcattttgttgccttgtctccctttacagaattgggagttgtagaataattgataagctattaatgctttgagtacttttggtcttgtcttgaggggaggttatttccttgaatatttttccaaatgtgaagtcacgtaacagtttgtttctttaaagctggtatggcacatgttaaaaaacaaaaaaagtaaaacgatcagattagctccttacacagagtctgtattacaagaggccttatttactaggcatttttgtaaaagttaagagtattatggattttttaaaattagactgaatgttgaaattagaggttaaaatgtaaaaaaacaatttcttgaaagtaatttattaaaagtctaatatgtattagcaatccctcatcagtgtagggatgtgatcaattccttaaattcccctgtgttctgctggagcaaatggcccatctatggagctacttgggagaggtagtcaatgacagtgattgatggttataaaatttatcacatgagctttgtgacagctcttgaaaaagtgtacttgaggtgtctccagccttgggtattctcgcattagctagagcagattacattgattgcctgtatttgaaggtgtcccaaaagactggtaagctatcatcagtcttccattattgctctttctctgaaattgtgacctttctacttggtctttagcagactttacatattacaccttgcaatgggtgtctagtccatgggatcttggagagatgttagttctgttcccattccaccctcatcgccatttggcagtgtctgcaaagagttttcgctgtcacagttaatggagggaagtgtgaatcgcatgtagtgaggacagagtaggaaggcgatgaatatgtgactagcatcacacagtagacataactgttaagtgttcagaattaagtagccctaggtattgggaatgctaaaaccaaaaagctccaacttaaataaatttctcttttcctttttgtttctttcaagatgttatgtccatggttgtcagttatttatcagttcatattcatgttctgggagaccttaattaatatttcccagccagctttgatttggagattttatacacacacacacacacacacacacacacacacacacacacacgtccacaagcccataatttggtgaatgaattttgacatgaacactcattcacatgtatatagctatatctgtctatgcatataaacatttggggggatactaacaaaaccatgtaactttgcatacaggatgaaatttaagccccatggtcgttcccttgccttggagtcaattcccagctctgaacaataacaacaaaattagtgtgtttacagtatagttctgtagtttcaaatatgtcttagttaaatggcattacattttagatgaaggggatacctgtaatctaggtattgattggtagcttgtgactaattagtaacatctatgtggtaattaatgaagacagccatgggcgggtgtgacatttccactctctcttagtattaacacgatgctgctttatgttacgtaattacagggtcacatttcaacatctggatgattagcataggagttgtgtttcacattacaaaatagatctctacattagcctatggcagaaggtgtcaagttttatggccacaagtttcggggttcccgttgtattttctggagccaaatgtttttcttggaattataaattagaactaggtatctggtgcaaaatcagagcttccatttttctcctaaaggataatttccagaaggttggctttaggggagacagaaatcgactttgataggtagtcatagcgctacttgtctatggtgaaacgcatggaagctcatacttccatagctgaacagtgagaggtttgctttggtcactaattaccataaatacagtttggcaggtgttttctcatcccctgtaagtccctttccagtcaatataaaatttgtactcctagttctggaatgagctggccaatatagctccagaaggaaacacagaaagtttagaaggctggtgctggcacgtattctccattcatggtcttctatttgtgttataatgagaacacaccagttctcattggatagcagaaagggaagtgcatagcagagctgcaactgttagagctatttaactaagtgctaacactgttgcctatgggttacagcgatcatggtaatgtttctggttttctttgggggcttattgtaggccaatatcaacagtacaaaaatgatacactgggaaaaatgtgcctacaagttgaaaatgttgggcttcctgtttttcccctctcttgaacttgcccagcaatcaaaactgctggagaaagaaatcatacttcaataatcctgccaaatccactatgtaatcttgggattatttgtgtggttctacatggtagctttagtatttcagaacattcctgaattaagtagccttctaacttgacaaaaatcatggcttggcttgtggtagcacacagtgtttcaaatgataagaaaagattattggaggaggggctggagagatggctcagtggttaagagcacttactactcttccaaaggacccaggttcatttcccagcaacaacatggcccttaacagacatttatatgtatttactttaaagggatccaataccatcttctgacctccttgggcaccaagcatgcccatggtgtacatacatatatacaagaaaacatttaaacataaaattaaatgaccaaacaatgtttttttttaagaaaagactttgaggattaatgtttgtcttagtccccttttcctgggtctctgagcaccaggcatcatctttcttttaagacagttgagttctgagaataatcccaactactctactgatgagaagaagtgggtataaaatcccatccctgaccaagaaactatttgtagttggtagctgctgagagagggaaatcagttttcttcagtggtctaacactggttatatcagccacactccagggtaggccttatgctcagtagtagttatccaatacaaaatggacttcatggttttgtatataatgtcttttgttattccttgttggatttttgcctttttgtgtgtgtgtgtgtgtgtgtgtggattttgtttgtttgtttggttggttttcttcttcaatttagtttggcgggggtagtgagaaagaacatgaagttgtgttagattgggatttggttggaatttggttatacattttctattgtgttgtcctcactgttgatggtgtttgattctttttcagactgcaaatacattaaagctaactatccaatgctttgttgcacattaacaatttttccatttctcttcgactttatgatgtagatgctgtttaaactgagttgggtggacaagggcatgaggacgctgcagtgttatagatgattggaatttaacattccttaacctctctataaagccctatgtacggcatactattaaggcatcatgactagaaattctggtctgctttagattctataatattccattttttgtgattattttctactgtattcctgtatcattcttttagattttgtgacattaagctccttaaaccatgaataaaacctatactaccaggatatggccataccaccttaaacacaactgggcttgtgtaatcttggaaggtacataaggtcaggcttactgagtacttgggtgggagaatttatatatccatgtctctgagagttgttgttgttgagtgagtttcctgtgtctgtctaagttattaaggatttccttttatactaatttctggatgtgatttgcagccttggtattcattactcctgaaatgattagtggatttctccagtaaagctattgaggcttttctttgggggaaaaatatatatatatatatataaagtataaatgtaacctctttaatggagtaatttatggcatctacatatttattactgtagtatggtcatttctgtctttcaagtaattagtttattttatctataataggtttttagattaatgagcataaagtattaagtaacacaagattaggatttcaacagctgtagaatctatagtaagttgcttctcttaatcctcatattggcaatttgtgaaggactgatcaattttgttgatttttccaataaacaaacaaacatttttgtgggattgaacttttttctctctgttgattattgaagtttgatcttttgctatgtactgtaatactaaatactggcccctagggcctggttgtccccagggaggagagaatctaaatgtagaccaagtgatgccatatgaccttgtcccccatgttatccctgattggtgaataaagatgcctacagcctatagctgggcagaattgagaatggcaaggttttgggttcccaggcttgggatctgagaacttctaggaggagagagagaaagtggggagagcaggaggcaccatggggtaagaagttcaaaacatggccatgagagctggccagttggagttaataggaacccacatggaacatagcaagttataacttggggcttttgatagggaagtagacataatagcatagagggtagatatctgcccagctctaggactgattaaggcttaatataaatgtaaaggttatgtgtcttttttctgggaactgaatgatcaaaaacaggactgagattaaatactttctacaacaattgatatcttttttatttcattagtttcagctctgattttatttctcttgcttgcttattttaggatccgtgttctcatatgtgaaggtaaaatctggtgccattactcttaagattttttgtttctcatatcacttagtgctataaaaatttcctggagcactgttttggctacaaaacatttttaaaaaaaataaatagttttcttttatttccttgccattgtatcggtttagtttcttgtgttttgagcctcagttatgatgtgtataaatgtttagattgtggcctgctatcatatgatactgtgtaacttgatttatagtctaaagaaccttgtagctatatgtaatatatttcatgtctaacctttttctatttgtacagttagtctttatacatggttcaaacactatacatgatctttgacttcttagtctctaggactgtgaggaattgacttctattacttataacttttgcaacgtcagatatactcttagagcagcacaaaatacttaagatcccttcctttttcccttttctttctcgctgtcttttcatctgccatttctccacccatccatctcttcatttatttctaaaaagctatgagcttctggtggtatctttgattctagttcaataccatatagttcatttctgccttctttctctggcgatgagaaaccttgcttcccataagtaatgtacttacatacatttctgtactcaatcttagttacacaaactagtttcagaactgctcatctagactttttggcgaacacctttaatggcttaaatatttctttcaagctcttatttttatcaaaaaaagagttttcaggcaatatattctgattatgcttacccatctctcacctcttcccagatcctccccttcccctcccatcctattccacaacctttctctttttaaaaaagcaaacaaaaaaccagatacgcgcgcgcgcacacacacacacacacacacacacacacacacacacatcccacaaaattggaaactaaaatatacaagtaaaagatgaataaaaccaaaatttcccaaatcaagatgtaaaaaaaaaaaaaagacagaaaacaccattgagatagcgttggccatctactcctagccatgtggcctagccttgaacatggttaatatagccagtgtgccaccatagaaggcacgtaattctcccaatgtgagtgattatcaattggagataccttcttgcttgcagatgagagattgtccactaacctttggtacttctgaggccctttgtacgctgctttaatctctgtgagttcatatgtacatcaatcctgttgtgtctagaaggcactgtttccttgttatcctcttacaacaaccatttgttcttgcctcccgtttatatatagatccttgagccccaaggggagggatttgtgtaaacattttttaaaatattaatttagtggccaaatactgtttatacggttaggaaaattcgttctattcttgtctacccacttcagcatagttatattagttactcatggtgcaattttttttgtttagtatttgtactatattatgtttcctccaacaaaaacatcccctttgatttttattgcttgtttatatgttcgttgctatgcttctcagaatcagtgctataaaaaaatatgtatgccaagaagtaccattctcctatctccagtactctttcccattccccctgcaccccgtttcttcctgtctactgccttaaacaaatttctttggtttctggcttatccttatcctatttcttgtacctttcttacatgaactgtagcattctacagattactttatatatttttctttttaaaatgtttgacaagtagaatatatatgtatccaaaacagacaattccttccttcctgtctgcttaatacttaccatgatcaaatgaacacatctatcatctatagttactgttttgcacgtttgcttatgtatggtgaggacttgtcctcatgaacaatcttgtacattatttcatattgcttctagagagagatcttcatattttttttacttgtatgtctaccatgtggctgtattataatagctaatctccattttatggtaattttggtaatctccattttggtgatttgcaatattttgtaatttcaaatgaattttcagtgaataatattgtatagatatattttcatattggaggtactttcttaatatagatacttcctaaaacacaatttccttcagtgtgtgtgtgagagagagagagagagagggagagagagagagagagagagagagagagagagagagagagagagagagaggggggcaggtgtggagggagggagggaggggagagagaggtgaagttgtctacataggccagaagaaggcatcagattccctgaagctggagtttcatgtggttttgagtcaccctgtgggcaactgagaacccaactctagtcctatggaagagtaatagaggcccttaatcactgagccatctcttcatctctttatatgaagtcttagcagactccttggagaaatagctctttatgtcccttaaattcctttgagattttttttttaatttttataggaaatagaaagcacctcccataattttgagaaaagcaaaacaaaatttgtatggagctataaataggatccttggaatattccttcatatttccaacgatgcttctttgagtattagattttgaaattcttttcctctccttttagtcatcactttacatataattctcttactttctggaatgttcacagttagagcttgagccgagctctgcttacaatgatcaacatttttgtttcttatcttgtcaaagtcaaacaaaatataacagccgagatgtttacattattgacatggagttggatgcagactgttaatttttccttagctgcaattggcgccatgtgtgcggaaagaaccttggggtaaggagaaagggcagctgtggagagttctttagtatggtggaaaaatcaaaccggcttaaatggtggatgctcctatgttggatctcaaattgaacttggaggttttcaattattaaacacaaactagcaatttggacgcagtgatgtgaagggatgagcgttaaatgcctttctcaaccttagcctccctcagatggtgacccatttgaagtacccttcctttcatctgctttgtgcttgtttctaggagctctgattctttgtattcttctgaatatcttatagatcaaatttccactggaggttttgcttcaaactgcccttctcccaggctctttggtgccagacttccttgcactatgacagtttgcctgacccgcacttccctgcccttatttcacaaagtcatctttgatttattgtatctcggggtaagagcagagaggcagcgaagagcaaatgtcttcatctgcagatagcagcttcctaataaccccaagccttatctgcatgttaagacacacaaggggtgtttttgcctgctagtgtcagctgcctgcaaactaagcattctgagccttgcagaagtttgcaccgtggctctctaaatgctctctgtggtctgtttcgaagaggaagggggaaaaaatccaggatgggagatcctatttggaaagtaacagtgagatctgagtatattgtttattttccttatagttttgataaatttagacagatgaatggatgtcattgtcttttatagaatattttacttgtatatctctcgatactctaaaagcttatttttcaagtatgcactctgtagccatgagcagaagagatttgtttgcttgtttcctgcaaggagttatcatcagtgagacatttgtccttgctggcaccagtacatttcatctacacccttcttactctgagcatgtgcaccatcagcattttctggaagctcggtcgaaagacaggattgcctcagatatcacttcaggcctcctgagtcagaaactaaactcgttacaacatcccctaggggaatgggcattgcacagtttgagaaaaactactagtgaagatggaaatcctgcttaggaacaagggagtctacacattcataatctctctctctctctctctctctctctctctctctctctctctctctctctctgacaaaaatggcatgtttcacaattttctagagcttggatttttctcatttaaatacccattgtaagctagattttttttcaggctcccgggaaaagagcgaagggatatgaggtctagagagaggtccattgtgatctcacccaaggagagcatatacctaaaaaactgatattgtcattacttggctctgcacatctattaaagtacattttgatgcctcgaggtaggcagggatttcttgaaatggaatcactcctcactgttcacagattgtatatttgagaatttgcctactcgctagaatttattcgtagctccagatcaatgtttgctgtgcatttttagttgctcacagatatgcatggggagaacaaacaaatgaattgcctagtagacacagatttgggttaggccatataaggcagttctttcccttattgttttcccactcattctgtaacacctttccttgtcagagtcagtgtagtaccagggtctccatggtttggtttctagcttttgcgacttacggtagtctccaagcatgccattaatgcaatgtttattatttctaagtctaaaagggtggtaatataccttacagggaaaatatgtgtgtttcataagcttccttcaaggataaatgctgatagtagtgactgcaaggtaatgccaaggaactaacaatgtaaacaacatatattaaatgaggtattttcaaacagaagcatacatgcaggaagggtcatgtatttctcgtttaatggggtaatcaaagacttgtgtgaccctaatacaacatttcctccaaggaacaatattctcatagatactttagtatttggagtgactttgtagaacctgagtgctgcacagagtgacagggagctttatagaaaacaactggcctagaatttcagtcagccaccctttccctttggtgcttgacactgagatgcgattgttaggttgtggttggattctaagcacagtaacaaaggaactcggtagtttacaaaagcgcatttcagtattttgtgaatgttcttgcgataaagcagtatttcagagagggtcttactgtcctgtgcaaatgtcattcttatgggcctggcatttgagacaattatattaccattactccagaacaagtgtctatgttaactacgcccctcccttttgtttaattgaagatttatgtttagaacggtctatgtcagctttggtgcctaaatatcacaggctcctaataccctcttttcctgtaacataacccttccagctgctctagttcaggttcacatcaaagtcccaacagctcgtactgtggcccactctgcagtgatacgggttttctgatacagcccccaggcttgctgttacgcttgaaggtctcttgacggcgtaatacatcttccaactgtgtggctttgtgcatcatttctttttcatgaatctggaagtggcctcacaggctaagactataataagcctattgtactactactattgtacagtggtagccttactatttccatcctacagaagtcagtgagagcctcaagggacagacaggaatggttcagctccacttggtttcacaggtaccctttaccttgtgcaaggagtttctgagcatgacaatgcaggagctgcctcgtaaatcagaatttagggataagtgtgacttagtaacagtgaacttcctgcctcagcagcttgagtctgctccgaggtatagaacatatacgtgatccctattggacagtgtccaaacagctgaagtacagggaaaaccgtgctaacttcttctgtggccaatcatttcccatcttacgatatgcagtgcaacactggttaataagtaaagaaccatagaggaaaccagtgcaggaaagtcttaagaagctaatgtccctcttgtctgtgtgtgtttgcttgttttgagacagggtctcgctatgtagctccactgccctgaaagcattacagcatgcaaaatgacagacgaatgcaaagcaaaccatcagggtttcatgactggagtatctgaaagactcccacatgattcctgatagtggtgatctcaggatgaaggtaggataaagagatggggggggcttaaaaagaggaagatgaggtgtgtattgtctgtattctggtctctgatggacactgggttagcatgtatggtaatataataaatgcaagtaaacaaggtcattgtgagtggattattcatcagagatttagcttaatgtggtctattcagttctcagtattaaaacaccatattttaagatctccatctcagggattggtaagggagcctccgccattgaattgatcccatgtggaagggttttgtatgtttggtgtgtggagtgtgggagaaacaaaatgaccaaatataaaatgtaataccagtggtgaactcaaagacaatggacattgtgaaaataagaaaataataaggacactgcacaaagatacagcctttttgagtcaatcagggactcggggtatggagatgaattgcaatcaactgtaatggcgtcccattttgtgctgcttgcattagcttgtcctacattttcttggcagcagggaagcaaagggcactcatcaaaaaaaaggggggggactgcaaggcttgcaagaagaatgttcgtcgtatttcttctacatgccttagcacagaaagaagcccctgctttctaattatatgagaacactccttttcatttcttccagcagtactggttctttttttttcaattttgtgtcaatcatctactctcttccctacttgaatccttgaattttcattttaacattagtcagtagaagacaatgtgcagttctttttctagttgccatgacagaatgtttgccttgacaatgagctgctttgaaggcacttcaggtttctgctcattcccagcatcagccgcgaacagacaaaattttgtctggaagtgaactttctcattatcaatcaggcactttcattaacctctcgacagaactagagaaccagaaagaggaaccgggtattatttggagtcccataaaaaagctatcatgggggtcttcctgtctccgtgatgaatgtgcagacattttcttcttagaacaactatcccatgtattttttagaagcagcaggagaggatggctatttggttgagctgtctacccagctgggaaacttaaacatacaaagggtcttaaatttcccttgatcttgttttccctcaatctttttttttttttttttttttttgcacagaaacggaaggtgcacttcgaagcatcagcctccaggcctgctggctggctgtggctctctgctcctttgttctgtttcttctctcagtgaaagaagtatgtaagccctgctagctgcttgtcacgttcagaactattatcctgtttctgtcatgtctgtctgaccaaactaagaggaggatcttatgacgggaccagctagctataaatagtcctagtgaggcataatttcacttgcctttatgttttccaaagtcctttccgcttgcttagttggagagctagtgctgtaaacttgtaagagtttctaactaaaagtggccattttttccttatgaaaagtaggaaaactactttgaattctttctcatttcaactgagttgtgatgtcagcacctatccagatcacacgcccaatgcaaagagttggagtaaacttggggtttttttgttgttgtttgttttctgatgcgtgtgtgtgtgtgtgtgtgtgtgtgtgtgtgtgtgtgtgtgtttaattttaagatgctagtaatggtggttttgtttttggcatcttcctggtgtaggttaacttacccaattgtgaccaacttgaacaccatcaacagattgagaatcaaactgtgctatctgaatttccattctctggtcacagggagaagtgtggatcctgagtgcacctttggtttgcccttcccaattctcttttgcagacagtggtttgtaaacactctaggaacagggtcaggaatagtgagtagagaatgcagaacatgctgttctcaagcagatttggaaattggaagtgactgcggctgttaattagtaaagcagagaaatcgctctttttggaagtgtgcgctgtacaggatatgtcatgcaagtgagctcatttcactttgggctttttaaaatactacgactcattcttgaatatacactggtagagatgatgtcccctgccataaaataaggtgtagttgtagaagaaaccacagattacaaacactgcaaatctatcttaaaaggcttttttcccctgaaagagtttgtttacaaacttacaaagttcacatgaaggaaataatacacataaatttggggactggaatatagcataattggtagaggactggcctagcatgcacaaacccttgggtttgatttccaatactgaataaaccagaaataatggcatttgccccaaccccagcacttgagagaagaagggaggacaaaaggatcaacagttcaaggtcatcctttgttacatagtgaatttgaggccagcctgggatatatatgataccacatacatatgtatctataatgaacatatatgaaattagtaattatggaaatacccagagaccatcggccatttaacaaatctccatatacacaaatatgtatcctacctaatttttctataaccaagtgggacgtgttgatttttcaacttgacaagttctacagtttcccacaagacaagcatctggattaacccttaggcaggcttattaaagacttcttgtgttttgaagtgtatgcttggctgtataagcctttattgatttgcactatgtgtgtactatcagtaagagaacaattagttgttgctgtgtctaaattgatcccaaaatttagcaactgaaactaactatgaattatttgttcggaatgctataagttagtggcatagagtagataggaatagaccatctctgcctctgtgctgatctgggatcattctcgtgattcttcgtcagctgtgatgtctctccataccatagcagaagatctctcagtagtaatgtacaagcagtttttagttatttatttttattttatgtgcattggtgttttgcctggctgtatgctatgtgaaggtgttggatcctctagaactgacaaagttgtgagctgcgatgtgggtgctgggcaattgaacctggatcctctggaagaacagcattattcttaatggctgagccgtctctccagcctctaaactcttcatgcctctatttaaatagcattttcttgtgttaggctggccaaaacaagtgagtgtctttaagcgcagtaccattgtaggaggggagcctagacaaagggttgactatgagaagatattacttattggaatgttaatataatcatctcccatggtagaatatcaggtttccaaatcattttaaagagaaaggcacattctagttgctgggataaggtatgacagatgaggtctaaggaataccaaggttctaattaatatgatgaatgtactttctgagagagaagtcatagaacagtttagcaggggtattttaatgaaaatagtcataagtgtataatctagtcatttctgtgtattctttggaagaaagggcaccaaaggtagtgaattaatttaaagacagacacacatactaatgaggaaaaagcaagcatcatgacatgaataaacaagaaaaacacaaagtggggaaattattggtggcagacaaatgagctgtattcttaaaaaaattcatgccagcgagaaagcaaaggatataaacagatatttcactgaagcatgtttgcaaaatgccaaagaacacatgatcaatatttaatattatattcttagtcattaggaaaaagcaaatcaaaaccacaagatactactcatactcactcgactgcctagataataaacaaaatgtttctagctgtgaaagaattggaactcttatgcatttctggtgggaacttctagtggtacagatgctttggaacacagcctggcatttctttaaatgactgacacagagttaccctacacgcagcagttctactgttagatacagatccaagagaattcaatcaacttgtatggggctcatcgcttaagagactgtgctgttcttccagaggactggaattcagtttctagcacccatgttgggtggcatacagccacctgtaactctagggattctaaacagttttcgagcttctgtgggcactgacacatacatgaacatgcacacaaacacatacattatatattaaaaacaccttgaggagcaagggtctatttggcttacatgttctgatcatagtccatcacagagggaagtcacggcaggagcattagaagcccattcttttctaataacagacagaaagaaagtggatctggaggggagcagaggggaggaggagcagttgatttgaaccttaggaaatagaggagccagagctacagtcttcttgaatgcagcaggtcagcgttagtagctggtaggatgactataaacctcttggtcttaaacattgaatcctaagtccatagcatcacttctcaacatcctagaggttaggcatttaacagagggcaccttcctccacatctcttgtcttatcagagctagagctgtgaccccatacgtagcatatttgctctgtgttagctctgcctctcaaaaagcttgaagctttttcctaagaagctgccgttttatatgagttgatttcattatcatgacagtttattgcaaatctagtctcatgtcagatcatcatggtgtgaagaatgcatccaggcctcaattacatgtctcacatagaattctttggatgagatggaactgcctgcattcaggggagacagtctatgaaaaaaagacaaagaactctaggcttaggtgaaaatatggtcattatcaagttcccactccagcacttggtgccctgactttctgggagttcatgtagagatgcgcagtgtagcttgttagatgtgttttgcatgtagctgacatccaagaacatccatgtttgacaaatttcattaatccagtgatttgccagaggagcttgagttaagcacatcttcgtgctccagagactgcactgggctgcctgctgttggtcagcagagtttttccagacacagtgaagtaaaaaatgaaaagacagctgggaatgcaagatgcctcggagacacatgggaatggcattggcgactgtggaataaggaaaagaattgtgatgctatttagctgtccaacttataattgcttaaaaaaacttttgtgagataaaaagctataccctcactcaacttcagtttcttatcttacagtaataatttccaacgatgcagagcccaagctcttggagagcttgtatgctcgcatatgtatagagccagcacttgggcctgtggtgaggccagaaaatagacatttaaacaaatggccacgaaatgctgtgggctgattctcctgctgttgccaaaccagctactcatccataaaagtcagaaaattcttttcaactctgctatcctttaattacccttctgggtgtctgagactcatgcataggaccaaaggtgaccactgatctttcaatttgctcagaggattcagtctttctgaccttgcagaggccaaagcatggccagggttcctatgtgcagaaaggctgctgtaattagatttaagagatgggtcctaggagaagctggttttgacatggaattaagctttgagtgatttttgaatatcttccagagctctatcggtcttgtttgaggcatcacttgcaatctagtagtgaagccattagaaagtggaaatgaggagagaaagtagaagctaaggttacagggaggactgacagatgtctacagggacttcattatttattttgtatgtaagtacaactgcagctgtcttcagacacaccagaagagggcataggatcccattacagatggttgtgagccaccatgtggttgctgggaattgaactcaggacctctggagcagccagtgctcttaacctctgaggcatctctccagccctagggtatgcttttaaaacttcgaaaacttcctttaggcagtttgaatgtgcagtggctttatggagatgatgctgtggaaaaagaaccaagggaggtaagaaaactggtagctttgtcctgagctacacgatctagaaaatgaacataccaaatagtgtgtctgccctgtagccctgcagcagaatcagtgcatggaaggtactttctgtggatgaagtttattttgtgaagctcagcactgctgctttggttttctgaccctttcttagttaatgaacacttaaatggaaactttctgaggcgccactgctcgagcttgttgtagataattcttgagaaatgtgaggaaggggtgggcaaaggggttctcccctccctcctctttgttacatactatattattccatggatgtcttataactaatttaacatcttattatatttaaatttttgctctacacccagttttcttcagggcttacaaaatggagccctgctccctggcctatgtaaacactctctcctgaaaatagtattatgtatttacatttctcttaatatgtccacatgcctggagactggctcaggatgagagcttcctagaagctgagtcttgtgttagaggtatacaggctttaaattgcatttgatgcccaaatggctcattcattgccctacagaaatgtggtacccctcctaagtccttagcagtgtttgaatagcatcctgtggcctataaaatgagctactgttatttttaagaagggatgtagagagtttgggggttagtttcttgaatgaaaatgttaagaagcagaatgtatctgaagtgtttctggggaatattattggagctttctgtcgtcatacagtcccttgtagcatttcctgggataaggaacagcttctattcttagtgaaagacagtgtgagagacaccaaatgtttaccctcgggtttcctctgcgtttcgagcttcgtctatggaaatagttttccttaaatactattttatatttatctgcagttctgtagttgaaaagcttattcagccaacgatctgctcacacatgcatctcaagactgccttcagttttgatctctaactttgacatcatttagaatcactggatttctgtgcatcgtgtttgcctgcagtgttttgttttgtttgacaattacagtaaaaaaaattcatggacctctgtttcttacaagggtgcagagaagtctttggtaaaaagttattttctgagtgaggctgtggcaaacacctttgaaaataaagctcagggtccggaccagaggacaggtgcccgcccggctggggaggcggcctaagccacagcagcagcggtcgccatcttggtccgggacccgccgaacttaggaaattagtctgaacaggtgagagggtgcgccagagaacctgacagcctctggaacaggcagaagcacagaggggctgaggcagcaccctgtgtgggccggggacagccggccaccttccggaccggaggacaggtgcccgcccggctggggaggcggcctaagccacagcagcagcggtcgccatcttggtccgggacccgccgaacttaggaaattagtctgaacaggtgagagggtgcgccagagaacctgacagcttctggaacaggcggaagcacagaggcgctgaggcagcaccctgtgtgggccggggacagccggccaccttccagaccggaggacaggtgcccacccggctggggaggcggcctaagccacagcagcagcggtcgccatcttggtcccgggactccaaggaacttaggaatttagtctgcttaggtgagagtctgtaccacctgggaactgccaaagcaacacagtgtctgagaaaggtcctgttttgggccttcttcttcggtcaggaggaggtccaaatacaagatatctgcgcaccttccctgtaagagagcttgccagcagagagtgctctgagcactgaaactcagaggagagaatctgtctcccaggtctgctgatagacggtaacagaatcaccagaagaacaatctctaaacagagtcaactataactactaactccagagattaccagatggcgaaaggtaaacggaggaatcttactaacaggaaccaagaccactcaccatcaccagaacccagcacacccacttcgcccagtccagggaaccccaacacacctgagaacctagacctagatttaaaagcatatctcatgatgatggtagaggacatcaagaaggactttaataaatcacttaaagaaatacaggagaacactgctaaagagttacaagtccttaaagaaaaacaggaaaacacaatcaaacaggtagaagtccttacagaaaaagaggaaaaaacatacaaacaggtgatggaaatgaacaaaaccatactagacctaaaaagggaagtagacacaataaagaaaactcaaagcgaggcaacactagagatagaaaccctaggaaagaaatctggaaccatagatttgagcatcagcaacagaatacaagagatggaagagagaatctcaggtgcagaagattccatagagaacattggcacaacaatcaaagaaaatggaaaatgcaaaaagatcctaactcaaaatatccaggaaatccaggacacaataagaagaccaaacgtacggataataggagtggatgagaatgaagattttcaactcaaaggtccagcaaacatcttcaacaaaattattgaagaaaacttcccaaatctaaagaatgagatgcatatgaacatacaagaagcctacagaactccaaatagactggaccagaaaagaaattcctcccgacacataataatcagaacatcaaatgcactaaataaagatagaatactaaaagcagtaagggaaaaaggtcaagtaacatataaaggcaagcctatcagaattacaccagatttttcaccagagactatgaaagccagaagagcctggacagatgttatacggacactaagagaacacaaactgcagcccaggctactatacccagccaaactctcaattatcatagagggagaaaccaaagtattccacgacaaaaccaaattcacgcattatctctccacgaatccagcccttcaaaggataataacagaaaaaaaccaatacaagaacgggaacaacgccctagaaaaaacaagaaggtaatccctcaacaaacctaaaagaagacagccacaagaacagaatgccacctttaacaactaaaataacaggaagcaacaattacttttccttaatatctcttaacatcaatggtctcaactcgccaataaaaagacatagactaacaaactggctacacaaacaagacccaacattttgctgcttacaggaaactcatctcagagaaaaagatagacactacctcagaatgaaaggctggaaaacaattttccaagcaaatggtatgaagaaacaagcaggagtagccatcctaatatctgataagattgacttccaacccaaagtcatcaaaaaagacaaggagggacacttcattctcatcaaaggtaaaatcctccaagaggaactctcaatcctgaatatctatgctccaaatacaagagcagccacattcactaaagaaactttagtaaagctcaaagcacacattgcacctcacacaataatagtgggagacttcaacacaccactttcaccaatggacagatcatggaaacagaaactaaacagggacacactgaaactaacagaagtgatgaaacaaatggatctgacagatatctacagaacattttatcctaaaacaaaaggatataccttcttctcagcacctcatggtaccttctccaaaattgaccacataataggtcacaaatcaggcctcaacagattcaaaaatattgaaattgtcccatgtatcctatcagatcaccatgcactaaggctggtcttcaataacaaaataaataacagaaagccaacattcacatggaaactgaacaacactcttctcaatgataccttggtcaaggaaggaataaagaaagaaattaaagactttttagagtttaatgacaatgaagccacaacgtacccaaacctttgggacacaatgaaagcatttctaagagggaaactcatagttatgagtgccttcaagaaaaaacgggagagagcacatactagcagcttgacaacacatctaaaagctctagaaaaaaaggaagcaaattcacccaagaggagtagacggcaggaaataatcaaactcaggggtgaaatcaaccaagtggaaacaagaagaactattcaaagaattaaccaaacgaggagttggttctttgagaaaatcaacaagatagataaacccttagctagactcactaaagggcacagggacaaaatcctaattaacaaaatcagaaatgaaaagggagacataacaacagatcctgaagaaatccaaaacaccatcagatccttctacaaaaggctatactcaacaaaactggaaaacctggacgaaatggacaaatttctggacagataccaggtaccaaagttgaatcaggatcaagttgaccttctaaacagtcccatatcccctaaagaaatagaagcagttattaatagtctcccagccaaaaaaagcccaggaccagacgggtttagtgcagagttctatcagaccttcaaagaagatctaactccagttctgcacaaactttttcacaagatagaagtagaaggtattctacccaactcattttatgaagccactattactctgatacctaaaccacagaaagatccaacaaagatagagaacttcagaccaatttctcttatgaacatcgatgcaaaaattcttaataaaattctcgctaaccgaatccaagaacacattaaagcaatcatccatcctgaccaagtaggttttattccagggatgcagggatggtttaatatacgaaaatccatcaatgtaatccattatataaacaaactcaaagacaaaaaccacatgatcatctcgttagatgcagaaaaagcatttgacaagatccaacacccattcatgataaaagttctggaaagatcaggaattcaaggccaatacctaaacatgataaaagcaatctacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattccaacagagaactcctaaacctgataaacagcttcggtgaagtagctggatataaaattaactcaaacaagtcaatggcctttctctacacaaagaataaacaggctgagaaagaaattagggaaacaacacccttctcaatagccacaaataatataaaatatctcggcgtgactctaacgaaggaagtgaaagatctgtatgataaaaacttcaaatctctgaagaaagaaattaaggaagatctcagaagatggaaagatctcccatgctcatggattggcaggaccaacattgtaaaaatggctatcttgccaaaagcaatctacagattcaatgcaatccccattaaaattccaactcaattcttcaacgaattagaaggagcaatttgcaaattcatctggaataacaaaaaaccgaggatagcaaaaactcttctcaaggataaaagaacctctggtggaatcaccatgcctgacctaaagctttactacagagcaattgtgataaaaactgcatggtactggtatagagacagacaagtggaccaatggaatagaattgaagacccagaaatgaacccacacacctatggtcacttgatcttcgacaagggagccaaaaccatccagtggaagaaagacagcattttcaacaattggtgctggcacaactggttgttatcatgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtactgtaagatcgagaattgacaaatgggacctaatgaaactccaaagtttctgcaaggcaaaagacactgtctataagacaaaaagaccaccaacagactgggaaaggatctttacctatcctaaatcagataggggactaatatccaacatatataaagaactcaagaaggtggacctcagaaaatcaaataacccccttaaaaaatggggctcagaactgaacaaagaattctcacctgaggaataccgaatggcagagaagcacctgaaaaaatgttcaacatccttaatcatcagggaaatgcaaatcaaaacaaccctgagattccacctcacaccagtcagaatggctaagatcaaaaattcaggtgacagcagatgctggcgaggatgtggagaaagaggaacactcctccattgttggtgggattgcaggcttgtacaaccactctggaaatcagtctggcggttcctcagaaaattggacatagtactaccggaggatccagcaatacctctcctgggcatatatccagaagaagccccaactggtaagaaggacacatgctccactatgttcatagcagccttatttataatagccagaaactggaaagaacccagatgcccctcaacagaggaatggatacagaaaatgtggtacatctacacaatggagtactactcagctattaaaaagaatgaatttatgaaattcctagccaaatggatggacctggagagcatcatcctgagtgaggtaacacaatcacaaaggaactcacacaatatgtactcactgataagtggatattagcccaaaacctaggatacccacgatataagatacaatttcctaaacacatgaaactcaagaaaaatgaagactgaagtgtggacactatgcccctccttagaagtgggaacaaaacacccatggaaggagttacagaaacaaagtatggagctgagatgaaaggatggaccatgtagagactgccatatccagggatccaccccataatcagcttccaaatgctgacaccattgcatacactagcaagattttattgaaaggacccagatgtagctgtctcttgtgagactatgccggggcctagcaaacacagaagtggatgctcacagtcagctaatggatggatcacagggctcccaatggaggagctagagaaagtacccaaggagctaaagggatcttcaaccctataggtggaacaacattatgaactaaccagtacccctgagctcttgactctagctgcatatgtatcaaaagatggcctagtcggccatcactggaaagagaggcccattggacacgcagactttgtgtgccccggtacaggggaacgccagggccaaagggggggagtgggtgggtaggggagtgggggtgggtgggtaagggggacttttggtatagcattggaaatgtaaatgagctaaatacctaataaaaaagggaaaaaaaaaaaaaaaaaaaaaaaagaaaataaagctcagaattctcaagcttatgtttttgttaatccttgcaaatgcaacattcaatttttattaataaagacatgggtacctgaaatgaggaggaggagaagggcggatacagcaagaatgtttctatgtaatgctaaattcccatcttggatctcaaaaatgtcccctcttccagagctaacattcttttataagaggttggtccaaaaggttgagaggtttgtattccccatgtgtgcatacggtatctccaagacagttccatttcattcagtttgtaattaattcagttgctgggatttaaaagattatttttactttttgtatattagtatctgcctgcatatactgtgtatatgcctgaagaccattgagactagaagagggcattagatgcctagtactggagttacagatggttctgagtcacagtgtagattctgggaactgaacctgggtcctttgcaagagcagaaaatgctctcaactactgagcccccccagttactgtttggttttgttttgtttttaattgtttgtctttggcagaaagtaatgactaatagtcattcattcagcaaacatttctgtggcatattgtggatcttagtcatttttgagaattttataagtatcaactaagttaatgcccactcatattagcccacctcacttatgaggatggttcacagtcattgacaaattgttcagaatgaatgaggtagtccaaattatctggcagcctgaactgtttggcatttatatagtttgcagctatgatagttttttaatagtgaattataatttttgaataatatgtatattcatttttattaaatgtttgttgtattttattaaatgttcattcgaagtattggggttcatccagatacatcaagtactttgaccatattcatcccattatcctctcagcttcctctcccttctactagtttccttccctgctccaagaagtcctcttatattgtcatgacctatagatagatagatagatagatagatagatagatagatagatagatagatagatagagatagagatagagatagagatagagatagagatagagatagatatgtggtatatggtatatatatggtagcttccacatgagtgaaaacatgtgatatttgtctcctctatgtctggcttattttgctcaacaggatgatctccaattccaattccagcatgttttcttgaaaatgacatttggataaaaggaaatgatccccttttctcccccccccccaatcttgtttatagccttgactgggtattaagctaacctttgaacaattcaagtatcctaccccagcctcctgtctggggaaagccttctcaggagggaagatccagagctagctccctgggtggatttcatggcaaccaagaggaagcaactttgatcttagagaaggaacatattccgatgtcctatatgtcgtcagaaatcactgacgaaagattatcactggacccttgatttggttcactttactgtgtcttctgagaggtgaacctccttccaaagggccggtcggtcttcttcaagtacaagtggttaaaggttgggaaaaaccaattccttctgaagagtctgtttctgaggacactgtacaaaagttacactggagattcatttgtgttcatttgtgttaacatactttaaccagatgttttcatttgttatattagtgactgaatgaagttgcttttattgaaatcagtagctaggtggtttgaattttccacatctgaatctgtaaaaagtctaccgatggtggtagaccaggcaggcctcatttcaaccagatagataaacaacacaaggcatgggcattttcaatcctctgcaagggctctactcttgtccattcctttgtttgactggccaagcagtcagcacataaaaatttggaaagacttgttctgttatagcagcttcgaaaaaggaaacaccaaaatgcctctgaaaaaaatgtggctcttggtaactgtaagcataggctatattgcatttggagaagttcatcaaacatagttcagtatttaatgcacaacatgttttctctgcttcatctgaatcaactgccattttattcaaacaagactgtctcgaggagaatggtaagaacagccccttttgaacagacactagtttgttgtccctagaagcctgtcagcttgcagaaatcttaaggagcatgaaggcattttttttctcactatggccatacatgaaagctaattacagagaaccctgtttctgtttgtccctgcctaacgtgtcttctcaacttccattttggtgactgccgtctctgaattggtggtgataaaaatatactgtcactgctattctcggggagagcagagacaaataggacacatcacgataccctctgtggcataatctgtgactcaaattatttttatatttgtgaaatgttctgggaatataaaaaagtcaacaaagatggagtataaaaaaaataataaaacccatacctatgcatcaaccaccctgcttaagaaatggaacaagagttgttatttaaaggtctcttatgtgtcctttcacatttgcattatcctccctcccaccagagataatcccttgtattacacttcttgctttttctactttagctaaacatgctacacagtatgattttgaaagcagcatctaatataaatttagcttttaaggaaggaacggcattgtatccaataaaagcctcaaaagttgtagctgtgtgcaactctgagtacagaagacggggttcatcacaatcagggtatctgatcaccacatagggtgcgctgtgtattgaatgtcagtaagaatatggccccaggcagaggtcatctctcattttctgctcttgagctaacagacactcctctccagctctcaggaagagggcaaaggggaggaaatgagggtccttgatgctgcaggcagcacaaaagagcaggaagcactttaacccatagcccacaaaagccaaacagaaaaatcttcatccagttgacttgctccttgttttacacttcaaagacatatagctggaaaaacaggcctcagcatgtctttttttctttctttctttctttttcttttttttttttttgaggtactggttagttcatattgggtttttttgttttttgtttgtttgtttatttgtttttgtcttgattgacagtgcttcagtttgcatcggcttccctacttctggtgcaggtgtccatttgggataattctgtacttttatccatagttttccttaacttctatcccatgctagagcttagtttactgtttttccttttacaattgtactagaatacattctagtaacttcctgagagagtatacatgagaactctgtttttgactctttatttactttgaaatatctattcttctatcaattcctgagagattgtgaggataataaagtagaaatctgggacctgaggctcagtgatagaacatgtccttgtcttgtgtgagctctgaggtcatccctagcatcaaaaagtaaagtagaaataaactttctaatgaaaatgtgcatattgctctctgttattttcaatttatattgttagttgtaggggaatggaaaggcatttagatcgccaaagggctacttatggcctcatttcttttcctttctgtgaacatgtgaagtctcagatatcacacacaacagggctatggcatgggtctacttgcatctactgtttgcggctttctgtgaactactgtatataccttcattctggcaccttgactcctgagggattaacatttctcgaattattttatcttttcactttcctctttccattctgagactaatatccagaagctgaaagtctccatagcaaatgctttatggcatccaggctgcccttaaaccactgaccttggttctattccctgtatgccaggattacaatcatgtggccctttcttcagctttgtcttatatttttaatatcttggtctttactgtgtcattctcatggggggggagaggctgttagtatttctgttgtttttgatttttcaagagttttcaattccaaacatatttaggtttttcaaatgtttaaattatttcatgggcaccatctattatctttttgaaaattcaactggtatgtgtgtgtgtgtgtgtgtgtgtgtgtgtgtgttcgtgtgttctagctgcaaagcctctattccatgcaagttggtcttttgtgctcttgttttgatctgtcttccttggcagaagcttttctcagataatccgtggttgcttggaaaccagatagctgctgaagctctaaataggtgggtgtggctttggaatttggatctaagttgggcactggctgagaaactccagggttagtatctttaggtcattcttttaccttgagtcacatgccctagagaagctgagggcacttaggtctgatgcccagtctggtaacctctaggggcaagaggactggaagactgcctctacatgcatctgatcacttcatgcccattgttcaattagtatgctcctagcatgcctctacctcccaggcccagatcctttccttgggtggcactgggccgtccctccaccagataaaatggagaagtaagcataatggctttcttcctagcccacgtgcttccgccatcctcttcatcccagtttcagaggcccattgtcagttttctccccgctgggtagaggttatttgtttcccacatagcctgctgagcaacttactctttacccagcagcgtctaaagcactgttgctgttacaggctgctttcacctcctgagtttatcttgtaaagaaaaaaaaagacaaatgacttcttttggcgctcttggtgtggtttcaagggaatgaaatcctaaggatgtgttctgttcatcttggtagctggggttctgtgttcctttttgtattatgggaatctgtcagcattgatgatgcaaagtcaaaggcttctgggtctttatggaatgcctttggaggagacgacttagccgttaagagcacttggcttttcttccagaggacccaggttggattcccaacatccacattgcacctcccaatcatctattacttaagcaccagaggatctgatgctctattctggcttctgtgtgctacaggtgcctgcttgatgcacaagcatacatgcgggcaaaatacttacacacatagaataaaataataatgaaagctttttataaatgaaaatagagcagggaatgatggcaggtagaggcaagcagatctcttgagttcaaggccaacctggtctataaagtgaggtccagaacagtcagggcaacagagagaaatcttgtatcaaaaagacaaaagacaaaagaaagaaaaagatgaataaaaatgaatataatcaaaaatatggttcaaaacaccgtgaaagctttggacaagtccaactcttccctttgccagggctaatttttaatcatgcctgtgaaccctatcaggaccagtacgagttaactaggttttgaaggaaaaaaactattctaatatgctttgaattgaccaacattgcttcctctttctggaagcaaacaggattcccagaaagcatgagaaatgtgccttcctcagctgcaggaactctctccctgctagcctggcgtgtggcttgagggcattcatggtcactgttgcgccttctgcgcagagaacaaaacacatatgctgctctggtctacccagtggaatatatgcctgtaagtgagactgcactgtcaggaaggacttcttttctatatgagtacaaggctaggcaactcattattcattcaatgtcatgagcatcagcatctcaatttcctattgatgcttttgctgtctttttgcagcagtaggaagccattgatccataaaatgaatatagctattactgtgatctttacagtctttgcagatttaattacttgctattagtattttgtgcagacctttgtcaaaccaactacattatgtttcaaaagttatttcagcactgacgagctttaaataggggctagataagtttgtatgttagagtattagaaatattgacaaatatattttctgagtacacagggtttaattcttagcttgcaactgcagtgaaccttctatgcatagctacttagttagtaactataagattctgcctgtattgtttcccatacctataggtagcctttgcttagaacaatatattataaaatgcctacaaatggcttaagatataaagaattatcaccctgctgctgcctgtgaaccataaaatacctgagctggtattccatgtcttagggtaaattattttttgtactaataggacgaacccttttcagttaaaaggattaaacaagtgctggaccagtttaagctgttctaagaaacaatttgagccttaaaaagaattgtaaggacacatgttaaacttccttattctgtttaactagaccttttaccttggagaaaatggtggagaacatatgttatatgttctatatgttataaaatgtttcatattttataattttagtgttgggttttagtgttgttgttatcatgtggatcatctcttaccattcttgcccaagagaaaaaatataggcttgtcagactagacctttgtcagactagaaagaaaatgctgtctcaaagcaaatgttgaattccagagaacttggaaagaccagcgcctccaacctggtactgttgaggatggggttacttcaaatcttcggagagagttcacattggactttggacttggacttaggttttaagtccgcctccattttgtattcttagaattgggaacaaaacacccatggaaggagttacagagacaaagtttggagctgtgacggaaggatggaccatatagagactgctatacctggggatccgtcccataatcagcctccaaacgctgacaccattgcatacactagcaagattttgctgaaaggacccagatatagctgtctcttgtgagactatgccgggacctagcaaacacagaagtggatgctcacagtcagctattggatggatcacagggcccccaatggaggagccagagaaagtatccaaggagctaaagggatctgcaaccctataggtggaacaacattatgaactaaccagtaccccggagctcttaactctagctgcatgtgtatcaaaagatggcctagtcggccatcactggaaagagaggcccattggacatgcaaactttatatgccccagtacaggggaacgccagggccaaaaagtgggagtgggtgggtaggggagttggggggagggtatgggggacttttgggatagcattggaaatgtaaatgaggaaaatacctaataaaaatatttaaaaaaaaaaagaagaagagggggaaaaaggttctttgacctttctaggcttattcttcatcataaaatgagggtaactagcagttcgaatggttaatgtgaagtttaggaaaaaatatgcctgatgggtataatggaatgactatagtgtagttgggggctttaaccatagctatggcactgatcacctgtactttgtacctgttaacctatatctattccatacttaccatatagagagtatgtgtgtgtgtttgtgtgtgtgtgtgtgtgtgtgtgtgtgtgtgtgtgtgtgtgtgtgccatctctgtggtactcactatgttaatattcccactttataaaggagaaagctgaagcacagaaagcacgctttacactgcctgttatgtgggagaactggtctctccactcagatggcttggctccagaaactctggctttactactatccaggaagtgattaataaagacatgctagcttgtgttcctcaataggacagtgttcctctcctgttcatttgcttaatataggcagtgataggtcatccatagtgtataatggattggggagacagttgaagacatttccataaccttcctgaggccactcgggactccccaaacctgaggtgctatgctcaacttccccacacatctgcagacatcctcccacctctgggagctgtgtcaagccttgtgttgatatttctacttagcatcccaacctgtccattagctacaatgtcgtggccgtgaaagatttgctcaatggagacctttgaaggctacttcctagtagcaggggttagctgagttcttctggaaagtaccagatagtaaacgttttaggcttttcaagacataaggcctctggcactactccaccatagctgcaaaacagccacggacagtgtttgtggctttgtgccaaaaaaactttatttaccaagagcctggctgactgccatctgctgccttttgctgaacctgctttcagggtcgtcttccccactttgtattgctgaagaatcaccttttaaaaatagagtttcctggacgtgtccctgtttagtgataatattcattaaaaaaacacagtcattactttcatacagataaacttgaacttgagttaaaattttcattgtattcatgtgtggaaacctggctggtgctacacagttcagagagggcaaggtcagaatgcatacatttacattgaggaaacaaactaaactgcaaagggaggcaaaactaacccttccccttgcagggaacatggcaggtgttatatctgtcaggggcctgtaacttataaaggtacaaaaataccctgcaggcaaggggagcttagaatttagaagcatggaagggtatgttctatatagacagtgtgcaattttcctctgacgtgaggggtttagacagcctgaagactgtttctttgcaaatttttaacacactgagaaaacatgcttttgtgaagcagggtagctccacaacacgcttggagcagcagtatggacatctcccttgcttgcaggctcttctccatcctttgaggcttacaaacctctgacttagtctgactcttgcattgtgaagctcatccttccatttgaccaaatcataaatgtttctctctgtctctgtctctgtttctctctctctctctctctctctctctctctctctctctctctctctctctctctctctctcttctctttctttctctctttctccgatcctctcttcctctcttcctcccttcctctgttccctcctcttcctcctcctcctcgttcttgtacagggtgatggagacagagaaagattgggaattggggaaaatctcatccttttatcttccgtttgcacatatcaaagatggccgttaaagatgtggaagatgtaacttgtactgatcgttaaagtattttatatggattaaggaaaagatgtttacactagagagaaaccgaactttggaagttcttggtgtgtttataagaaggagaaggagcagaaatgggggaggagcaggttacctctgtgcaggattgtcatgttgaccggctgggataggagcaagcaggaatttgtaaacagtctagataatagagacatcagtaaatatgccagggaagcaaaaaccctttagcttggcaatccagtatacagttatgctcttgcagaactttgaagcagctgttctgctaggttgaatatgattcttccctgaacagaacaggaagtctggcttgtacatttctaaagagaggaaattcagaagacccaacccccatacgttccgttgtacacctccacttagtttgaaaatgcaatgggataaacaggtggatgggtgtcaaagcggttgacttttattggaagttggagcaggcaaggagcaaggctcttctttctggaagttaaactgtcttgaagcacattgtgctactgtgcacatggacctccctaaggattccatcccaagtgcatcttttctatgacatgtgatcttaggacctgctaaatgtccagggaatgttacgtcactattcatcttgagatcttaggcaggtggctagtgttacaatcctaaaggaaaaggctattcattagccactgctggccactgccatgtctcaagtctcttgctttgtgagaggtagagaaagaagaagtcatagcagctccttgcactcttggagtaccagaatgtacactagaatccagcctggcctactgggatttggtttgctgccctcttgctgagttcagcctgctctgagcacttggagtttcctaaaagagcccagcaagtgtgctatattctttttttccacaggcagtgtgttctttccttgtttagatgacaaaatctgtctctagcatagggtgctcatcagtattaattagctaaggcccaggcttgtccttcagtccttcctgaggactgcaggagaggccttcttcttgtctctgaaaccatcatttgctgcaggtttttagaattgtggccacagtacccataagggggcttagagttgtatgcaagacaagaacctgttttcaggagacacgtgttgccattttctattcataacccttaggtcctaatttagactgagaatctacccccctcttttaaaatttttatgttttatttttaatggtcagataattgtgttcgtgtgtgtgtgtgtgtgtgtgtgtgtgtgtgtgtgtgtgtgtgtatgttttactatgtggtgctttgctatatgtgtgcattatgaaatgatcaaagaaggtcagttaacatatccatcaccaggattatttgctgtttttgataagtatagataaaagtcctcggctcttttgagatatgttttgttaacgatactcactgcggtgtgcaattggaccctagaactcatttctcttatctaatggaactttattcccattaaccagtatgtctctctttatcctgtccattctaggcctctagaaatctccattttactctctattgttatgactttttgattctacatctgagtgaaaacataagatatctgtctttcaaagtttggagctgagatgaaaggatggtccatgtagagacttccatatccagggatccaccccataatcagcatccaaacgctgacaccattgcatacactagcaagattttatcgaaaggacccagatgtagctgtctcttgtgagactatgccggggcctagcaaacacagaagtggatgctcacagtcagctattggatggatcacagggctcccaatggaggagctggagaaagtagccaaggagctaaagggatctgcaaccctataggtggaacaacattatgaactaaccagtaccctggagctcttgactctagctgcatatatatcaaaagatggcctagtcggccatcactggaaagagaggcccattggacacgcaaactttatatgccccagtacaggggaacgccagggccaaaaagggggagtgggtgggtaggggattgggggtgggtgggtatgggggacttttggtatagcattggaaatgtaaatgagctaaatacctaataaaaaatggaaaaaaaaagatatctgtctttatttgccttccttattttatttaacattatgtcttccagatttattcatgttgccataagtaacagaattttctggttttatggctgaatattactattccgtgtgtgtgtgtgtgtgtgtgtgtgtgtgtgatagttggtttttaaatctacttttctattaatcgacacttagctttttcctatgtcttagccattacaaattaacgctgcaatgaatatatgatttaagctggaaatttttatctaatttacaaatgaaattttaggactattggtgctttcctatattttacaaattatctgttattttatagttagatataataataagcaaaataattttaaaaccgtatattaagaatggggaatggtagctcacacctataatgcagcaactgggagtctgaagcagtaggattgccatgagtttgaggcaagtctgggcatatagtgagttattgtcatcagcctgagctacagtgtgagagtctgactaaatccaagaccagtaagaacaacaaaactgtaactgaaatttaaaaaagaaagactaaagcatttaagctatccaaagcttatatatgtggtatagctactcagatctccccctctctcattcactcactctgtgtgtgtgtgtgtgtgtgtgtgtgtgtgtgtgtgtgtgtgtgtgtgatccctcacaggtgtatcctagtgcaattccccatgtcataaggaaaaccatcatcaggctgtggatagacatagaaagctggcgttgactgcatttcagcaccccatttggcaaggaataatgaatttgggaatgtatgtggctagtctctgttccttgccattcagaaattgctgactcatagaggccagtacaagtagtttttgttgttgttttgttttgtttgtttgtttgtttttcgagacagggtttctctgtatagccctggctgtcctggaactcactttgtagacaggctggcctcaaactcagaaatctgcctgcctctgcctcccaagtgctgggattaaaggcgtgcgccaccacacccagctacaaatagtttttactgccttctttttttcctcccaacatgtagcacgatccttgctactcacagaagctccataaatatgtacttggagctccataaaatatgtacttcgagcctgccagaattacagatattcgcccatctgaatagattgatcacatcatatggatcttcttgacaggcgtgatataagcaagaacaacagcaaaatatttactactttgctttcatttttttaaagcaaagcctgcctatgatacagaattttggtttcttgctgttaaggcaatgttcttttctttgtcatttcttttaaatacttgattgacatagtagtttaataactcctaggtaggggctggaaacatggctcagtgggtagagctcttgttacttttgtagaggactcaagttcagttcccaacactcacatggtatctcacaaccatctctaattccagttccagggaatcccattttctcttcttacctccgtgggcaccaggcaaacacacagtagatatacatacgagcaagcgcaacagtcatatacataaaataaataaatataagaagttttaatatattttttcaagaagccctaggtgaagactagagagataaattaatcttttaaagacattctaggaagtgatacttgttattttgtcacaagatgtattgtttgtttgttttacctttcagtgttttcctagtaaatggtaccccaggctttgaatgttgactgtcttggtaggtatataagacacatgatagaccacagctatttatagttatttttaatgaactatcttaaaataataaataacaaactgctagagaaatgattttttaaaaaacattgtaataagtctacagctacaaggaacattaaattagtgctggagtttaaccccagggaataacgagaatatggggtgctgagtggaaggcagattctcttcattatccatctccttgtgtcttttaaatgttatgtggcacttatttatgatcttttggaagtaaatgaattaaaagcaaaatttgatcaaagccagagtagtctctgtgtcactttgcctgtcagaagcataacgggcagactgatggaggctgtgatgagccatctccctctgctttaccaatgtgattaatgtcagtgacgctgactctcaaaacagatatagtcaccgaagagataagcaacttcttcatttacaacccaccattggtcttctgatagtctgccagctaaattaacttcttaagccaagaataacggcttcagtgtggtacatacaataattctagagccctgaactgaatcagaaaaaaaaaattcaggtttccttatcttggccaagcaaatgattggcatggagcttagatctttatggcagcttgaaactgttgatgtttagttatagaatataacattctttggtttgtctaggcttgaaaaagctcagaagaacagaatttcttggcttcaagtaagttttcatgcctttgatcaagagcctgactgactggtgtgtgctctcttgatcattattgggctctgcttagagtggattgattatcaagttagctactctccttcaacaaaataggaccatcaaagacaaaggaaaccatgctagatctcatgtccatcattaattttggttctccctgcttgttccattgagacttggttattttcccccgtaccctaatattggccatgtcactagtatgatgtgagagataggatgcaaatatttcttgtggcccaccatgatggcatacacttgtaattatagtacccaggagactgaggcagtgagaccacaggcttaaagccagtctgagaatcctgctgaaattctctctctcagacaaaacaggacagaatttagttgtatgcctatttctgtgtttgagattttcttgcttatagagactaaaaccctgatttttttttaaaaaaaatcatttgtataacaactcatatgttgtaagaaacagcatcaaaggtttaaggtcagatgaacccaatgccaatccatcttttcaaggctctgtagagttgtaggtgatgtgtgggcactgtcaagttcatttcctcttatccatgagctctcccagcagcaggccctttgtatggggtttactgtgataatggcatgggtgctgatactgttattccctagtaagatcagaggtcccattcctccaaataagctagaagaagatgcagaatgtgttgccctacattctggagctttcgctttctgatcttccagagtactctgctcacttagttttcttcttacatcatatgttttttttttcctcagcctcctttatcagatcttcccctttgccttagtttctcacattggggcaggctcaggcctctgctccttgatgacctcatccacttttatgattttaaatatcatctcaatcttcaaaacacacactctctctctctctctctctctctctctctctctctctctctctctcaatattgaggcttttagcccacgctctctctgctttcatatttaaagctcaccggattcctaaactcagataatcttttcccctcaagaattaaacaaaacccagttctacttacagttgtgacctttcttagaccccccacttctttctctctgaaactgtgtgctgtatccttcttcttgacccactgtcaccctccatgtcaagaagaagagatgcagtagaactgaaacacattataagttggttcctatcccttggatttttaagaacaaggaaacagacccaatgccatatagccaaaatacatggattcttcttctctcagaaaagaactctgtgatgatttggagggctttgtgtttccagagccccccacccccagagttcctttataaagataggatatcccagggtgattccaagcaagagagataacctgtgatgtatagctataattttcttttcagtgtttctctttctacctggtaagctgtaacctccagcccacaagattctattattaaaacactgaatcatagagtttaatcaagccaacctattggaaaaaaatgctggcagattgtctcgaagaccgttgagtcatgagcaaattactgcacttcctcttaggtcatcacgttattctattaacatttgagaggtgtctctgcttttggggggcaatcaatcttgactcctctttatagggtctttttagtgcttagtaatcttataggtcacatagaataggattcaattattgatgtttcctaagcccagaagtattacctagaagtagttcctaaaggatcaagaagaaaaaaatgattcaagtaggatcacctagtctgacccataagtaccatatttgacttttctgcatgttgctcacttgaatttaaaggcaaacatatcaagttgagtggactttactgtaagattgtgattatctatggtggatgcacttttgtactgctagaggtactaaagaggtctgatgcctagggctcacaacaaaatctgatttttgtctttggatacgctcaggaccaggattttaaaaactcctcaggtgatactaatgtggaatcagtggtaaggagtctctacagtaataagtatggaactaaaaaagagtcagaaaggagatggtagttagtgcccagtatcagtgatatagtctattgaagatggggtttgtgggactgtcactgcaaagatgttcttgcttgatgctatttctccagtgctttgtgtgatgccagtaagtggcaagtgatgaataatgattgactgaccaattaataaatatagtagcactgaagaaatgagaactggaccaaacaaggtaggcaatgggcaaaaggtgtgatttgtaattgacttctagaagtcatttatttctaagtgctaacaaatgttgtatacaaaggaatagctgccagttatggagtggaggtaaagatcattgccactgggggtactttgaggtgccaaaaggcagaagttacgtggatgatagggcatagaggggagtgcacaataattagcaagctgtcagtacttgcaaagccataaacagactggtagttgtagctaatagaaagggttgtaatagatggtatagacagatggtctgagtatcaggggagaaggctggccattagggaatggagtggcagtggtctgggagttgcactggaacacgatagagaagctgtgtttaatggcaatgagagtgctgagcgttagagaaatggcacagaatatgcagttgtctctaaggagaaccgtgttctataaagggctaagaagtgagtggcactttcagaagacaaaaaaagggaactgatttactagaaccagctttggggggagggggtttcagtatgtacccggattccttgccagattaattttgcacaccaagaaaccatccaacttcaggggcatccaacagtatttgttgcatatttattgtgtcaagttttggagttaaatgggagtcacttaagtggctgtggtgatgttttggctggacctgatcacatgcctgggtgttagctaactgtcagctgatctctactgtcttaggctggaggtacttgaatatactgtgtggatctcatctacctcctgggacctgaggacttgtctggacatgaccttatcagagtgaagatgagggcaaggtgaagaacaagttcaactgctcaattcctttcaagtctctgcttgggttccatttgctaataccctgttgtctaaaattgtagctaagtcacgatgggaatgatactgttgcatagcaaagggtaggaatgttaagcaggggtagaaaattgattccatttttttttctatctaccaccaaatgggaaaggagagaaggagacagattgaaaactccaactggaaaaactatagctggaaaagttcccacctatggatgagcaacagcttgtaaatgaagcagccatgctatttggcttatttgtctgcatttccatagtcatcttgatggatagggatgaactacctgaggcctcttagcagaacactggacctactcgctctcttcgcctttgtgtatacatagtaaagagggatttcttgacattttttccaaattgttgggttatagtgaggtaataattttgcaaatcatgaaattaatgccacgggtagatcatacctcaccatcttttcacatgtagatcaactgacaattggctaacatccaggtctgtaagtccagccaagataaacagagccactttaaagaatgttgtggccaagttactacctaattcctctcagggatatcaaacacctactaatgtcaagccacaagtctcttgaaaacaatgacttatttttttaggctctgaaattgagtattgactctgtattcgtctactctgttttactataacaagaatagttgaggctgagttctttggctttttttccagaataccgattatttggttaatagtttggaaaggtcaaaggcctgagcttcttacccgctggtgaggcacttatggctctggcacagcatggccaatggcaccatagcaggagtatgtataggtgagagtagtggtgtacatgggtcagaattcatacaagagaagcaagacactggagagggactaggtttactctttcataagaattcactctcacgggactaacttggccatgtaagaactacattaatatcatctgaaagtgatggccctagaaccaaatcaccttcttgtaaggcaccacttcttcaagatctgttattttttaaaattatcgcattggtttgcaattacatgaacttttgagggacacacccaaacttctatgttacagagtaacattgattctaaacctgtagtaacacttatctcctctggggggcagtgctctctacatagccttgggcccataggacttggttttcttcagagaacccgctctggacttgaacatgggtaacaagtatacctaactgccagaatgcttgtgttaggctagctttctaacctcccatggctcaaggacaacttccttgctgtctagataggtctttcagatagacgcaggacttttagtgcaacatcattttcctgagagctgtccaggaacagagttctattggcattaatgttaagtgccctttagatgcctcatcccactgtccaccatggggtatgaggactgtgttggtaaccggacactgagtcagatgttcaggtgactcttggagtcatcacagttctgtctctgaacaaggacatgcttgtgactatgaagtgttgtgccaaatatggttttttgaccttaggtccacttgtggtggctattctggtggtttagtgttatcctctatcctctggtgctcaacagggaaagagaccttgcctatgggttttgggggcctggtgcatgatatctacctgtgaaggctcaccgatgaaatgttgcttaactggcttagtaaaaattgcacatgcacacttgtgctgttgccttcttcttctgtgactcactgcaggtcagtcttagagttgcatgttaaagctacttgttttcttttttcttttttttttaaattaggtattttcctcatttacatttccaatgctatcccaaaagtcccccatacccactctcccccaaccccctacccacccactccccctttatggccctggcgttcccctgtactggggcatataaagtttgcacgtacaaagggcctctctttccagtgatggctgactaggccatcttttgatacatatgcagctagagacaagagctctggggtactggttagttcatattgttgttccacctatagggttgcagatccctttagctccttgggtactttctctagctcctccattgggggccgtgtgacccatccaatagctgactgtgagcatccacttctgtgtttgctaggccccggcctagtctcacaagagacagctatatcagggtcctttcagcaaaatcttactagtgtatgcaatggtgtcagcgtttagaagctgattatgggatggatccctggatatggcaatcactagatggtcctattcagctggtgtccagctgctcttatatgtctagtgcctctgatggcttgcccattcattggtaggtttggaaaactgaattgcttcaaacattcgtatctatcaagttattgacttgcttctccttcatgattactaaacatttggtttttttgaggtttgatgacatcgtctttaagtggaactccatgaactagctgggtgtgtttagatctgctttctaaaactgacatatggcatgtgtataaaaactggtatctataaagtgaaatttctgccatttattttagaaataaatatgcaacttagtattggcctcaagtcgataatgtggattcctaccgggaagctctacattttgactacaagccaacccatttacagttacacttaaatataaacatagcatagcaatctggcaaacagtctcagaaatccaaagcacaaccggcctatttgctacttgtatatttaaggaaatgtatctgtcattgagcgctggggtctagaataggacttaggagaatcagggcaggaggtactgtcactgtagtgttccatgaggttgcctaatggtcttagcttttctgagacactagagtatcctgggagaggttagctcttggcttctctctcactcagccaccattctgtgctaagattggtggctctagtgtagcctggtttgtgcccatagctttttcttcataaatcatgtaatgtatcctatttcatccagtcctttattttcacattgcatatctaggtgttttcatacaacaatgaggaattatgtagagaaataccaagagtagcatctttacgcatgaggaaaattgagaaactctgacatcaggatactgtgatgcaggtggctttgcattttggtccttaaatagtatttgagcttggctaagtaacagatgtatgcatagccaagaaccatagtacacacttcaggtgtatctcttttgagatacacgttatcttttaaaagaagttttattcaataggaatgcaatatatgcctcatgtggaatgttcaagtactcttattcaaaattaaaaacaagtaagggggattaggcattttatccttaatttctcatatttgctgaaatccaatatatattttccacttacgctacctctcagtttttagcagccgcatttgacatgctcagtagccactgtggtgaatggttgtggcgtgagcagtaccgtgctgtgaaactgagaaggtctgcatgtcaggaagagtggtatgcgtctgtaatcctatctctcaggaagcagggacaggggaattttagcttcaaggccagcctgagccacagagtgagattctgtgtcgagaaagaaaaagtatttacgatacagtgtggagagcctttaccacaattcttgtggagtattgtgctatggttttctcatggattttgttgtgagcagcagcatcttgattaaatttgcaacagtgcacccaaatcacttacactacagccatgaatatctcgctgttcaccgttcagcaccttgttgctttttgaatagcattagagaaaaaaaaagagagagaactattgttatctctattaaaaagttttcttcttgattaacattttattatcatccaaaataatgggtttaattatggcacagccctgtatctgtgttcttattgtttgcacttctcctgaccctcccatcgccccatcttgctctttgaggtcctgctggtccccctcctcctcctccctctgctttcatgtcattttttaaaaatctaaatccacatgagaaaatacacaagagattgatctgaaagcgtttcttgatgtgaaagctaggctgagaattcagggctagctgtaatgaggcacaacactcgtgcagatgcagcaccatgattaaaggctcactacatcagtgactcttgaggaggaaggcgggagatgataggagggtcaaaaggcctaagtgcattagcccttgttcaattcaattcaatgcccctttgacttgaggccctctagcaacctgagctgtggctcccaccaaacaggtaaataggagcatataggacttccagatatttgggacttcttgtgacatctatcctactgcagacttgtttcattggaggtctgtttagtttggtatctgctgctctccaatggtagagatgccgtcagagccttgcctattaacattggggactcgttacctcagcaccttccttcgcattgtccgggctagacaattggacacttgtgattagaatggttggctcgtaacttactatcttatactatggaaggcttaggacacttgtggtgatgcttgaaaggggacagtttcagtagaattttcattagagtgttgctaaggggaaaggggacaaataataatgataatgctaatttatgattttagtttttcttaagatatattctaaagcatttcaaatcattttagtaaatgattatatgcttcatgtaagctaaaagtgctgtcatatattgctaactttatgttgtggttttgattttttgttaccaaatatggtaattgttgaaagtacatggtggctttttaaaatttctttccattaatgcttttggaaaatcaacaagccatatacttacagtatggggacaatggaggcttctcctaacaacgaatcgtctgaaggctttccactttttcaaatagaaatttaaattcagaatgactgaatttatctccatctagattcaaagttgggcgtatttggtctggatgtgagaacttttgggaattagagcattcttgctgtaatatcattttaaaaatgcaagcatacaaaggaggaccaaatatgtatagtgcgttgctttggtatcttctgctatcatcatgtttaatttactgtatgcctttaggtgatttagagagctagcatgctcttcttccctgttatcccttccacctttagcaatttctcttgttttgtttgtttgtttgttgattcatcatttagtttttttgtttttgtttaggtctggctttttttgagtatttttctcatcgactcttttttttaattactagatattttctttatatacatttcagatgctattctgaaagttccctatacactccctccgccctgctcccctacccacccactcccgcttcgtggccctggcattcccctgtaatggggcatataaggtttgcaatatcaagggcctctcttcccagtgatggtcgactaggccgtcttctgcttcatatgcagctagagacacgagctctgggggtactgattagttcatattgttgttccacctatagggttgcagaccccttcagctccttgggtgctttctctagcttctccattgggggccctgtgttccattttatagatgactgtgagcatccacttctgtatttgccaggcactggcagagcctcatacgagacagctataacagggtcccttcagcaaaatctttctggcatatgcaatagtgtctgggtttggtggctgattatgggatatatccctgggtggggtagtctctggatagtctatccttttgtctttcttctggcttttttgagactaggtctttcatgtatcctaggctttcttcaaactccctaagttccctagtgctaagtgggattacatgtgtgtaccaccaccaccccaaagtctttccagatgatctccttttatatctgaaattcctagagaagaatcctatgacagagacacaaaatggcacagcactgtcgcatctgtgatgacaagtgagtagagctcatggttccctgtgcccagagtgagcagaaacagagcaccaagaacaggaataatctcaaacccttgccttcttatttgtactgcccacttagacaagtatttggggggaaaagaggaagaacagatgtttttcctcttatattagatagtaaatgatcaattaactatggatataattcttaaaatatgaactggctttaaataaattgttctaaatttttattcaatcaaacttgaagtacacatctttccacttgactctttagtttgcttgtcagccatctagattgtggttttatttcttcatcgtttttattagcacaaattcactgcagaaagaatcggtttgtgtgtagcatacaatatatgtaaatcatgttctttgatcagatatacctcctcttagcctctcttgacccccaatacctcttctccttcctaaataatctcccatttgctttcaacacacacacactaaaatctagacaacacatatgaatgcaacaataacacttgtctttcagagtctgactaatagcccctaatatggtgattggcagtctacttaagtcgaaatcacacagtatcaattttctttgcggctgagtaaaagtttatgtgtatatgtcatggcattcctatctatttgttgacttcagttgaatctttaaacattggctatgagtcagattttaattctgacatcttaatggagatgctttcagtacatcttaggatataaagttcatagaactccttagagcagtggaactggtgtgggtatggctttgaattgctgccttccttagggaatcttgattgaccccctatttacatagagactatttcaacaagcatagttttacacttttatatttttgttgttcacccagaatttagggtttgcaataaagtcattcttatagtttcaagacatcttatttatctcttgttcccgtaatgtgaggcatgggatgggatgtgattgctccttgtctgtctgatttcatagcctcaatgtaagggcatgtgtatttctctaaccctctaaggtttttcatggtgtgacactatcctaagaaaaccttctttaccatatgtaaaatttccaaaggctttctatgctattttacaaatttaacatatcatttgtaattattttttgtattactagctcttatggcctgccccatagtaaagtatggagaagaaagaggcattatacagaggacatcctctaggggatggattctaaatttagaacttcattaattggagtaattgattaattgatgtaaactattccccttctaattgtgctaatgttattgaagcttcaagagcaccacatgctaaaactgccccagactgttaagcagcattttgtgtatgtagcaatgatggtaaaccgtatctacctgagctatagaattcttggttagtgcatcttttgttcactttgcctgaaattcaccctctctatttaactgctccaacaacatgtctagttgactttttcaaaataaattatttctaagccatacctgtgttgacgtttgagccaggggtgctaggaactgagtccaggtatctgcagcaaaacaaggccttcttactgttgagtcatctctcaaaccccaggtttctttcttatgtttattctatgaccaattatacgctgttcctcagtatatactgatctgctaatttggttttcttattgttttattttagtgaacattttattacaattaacctattaatggtgcagattaatggatttcaccgtgacatccccatacgtgtacattttgagatttgatcatgcccattttctccattttgcgaagaacctcactttgacccagttcactacagcatccggtggtttctcgtaacgaattctttcccagcctctcatgaacatgagcatagagattccgaagtataaaaacaagctcttgaacctcagcaaactgatactgctaaactgctgcttgagagcagagcctggtaagccttggtcaagtggggaccaggaaataagctctctgcaaagcataaagtagggacatttatctagagccaaagcaactcgaaagccagatgaggcactccagggagaggacaaaggtctgcttctgaattcctgctgaacatgcaggcagtgaccttgaatgctgctgcttcagattgtccttcctgtccttgtcctttcacaactgtgtattggatgggcacatctgtgacttatgacttcccttgcgagaaatagattacatcttcaactggaattctgaagcttagacatgagacaggccagctaatccattctgaaactggttttaaatacatgctaaacaacacacaccatgatcgagtttgaatttgtccacattagcttggaagcaaggggttctagaagaggccaggggacctccaagggaagaaagtattatgaaatggttcttctgaagtgatggtaagactttgggggacaggcagtgccataatgtgaccttctgtaatagtttcatttcctaaggaagatgaaagagacattggatgatgtttcttaagaaagagacactctttcctatctctattgatgagtactgatactattttgtttccagaaataaataaaatatttattgattgatgaaaataaattccactttataatcatctaaaggaataatgataatactatctctcaattgtttactatatgcctcaaagtaccttaacattcaccatggagtgagaacctcatttagttgtcagtacagctttgtgagtcacggtaattgcagtaatgctatcatcatttaatagacagggacactgagacagagaataggccacttgccctagttttcacaacagccagcagcagagcgagactgtactgcagctgtctgtacaactcttacagcagccatgcgggctctttgtcatcatggactctgcattaggaatttcagagatgcaattcaggccttccttttatgaagccccactgtgcaaggttcgttgcaaccatctcatttctagcaaaggattttgttattcgtgtttagatagtacttttttaatgccctaatagcagcaccaataaatttatttatgcacattaactagggctgactgcaattctgtctttcttttcttcttttttctccctttctttttggaagtttaagtgagtcacagactcagggtcagtggatcagcaagcttttgtcccctgtaccttctacaataaaggtatagtcctgttgaaagaaatgcagagaagctagccaagatgctacaaaccctgtggctttaagaaagaacatcttactagtgcaggctcattgattcctcctgactttctggaaggtgtttccttactctgctgcactggaagctcctgtgtctggctaggatttccgcttactgctgcattccggtatcttaaaaactggcctttgggtgctctgataggccaatcttcttcctgtaaaattccagaagtggtgtttcagtttcatgtgacctatacgttcttttgaatacagtgactcaaaagtcactttaatcttgtgacccctggctatgtttgcttccttttaatactccttccagtttgtgtctggtgtatgtgcttaaagctggtctattctaagtgatgtataatttgatgtccttggcctgaaacttagaaatgccctgccagttgttgctacaattcaataccagattcccaggagggagccaggtccacagggcttttcttccttcatatgttacttagtgattggtaaggatgctgagtttcctgctgcctcttaaaacacagcatctttcctcatgggactggaagcccctgccgataggaggaaatctttctgtgtgcatatggacccagcagtttgccagcatgtgtggctgccaacagttttctcctagttgcaaagactttattttccctggacagcagtgctatgcaacccagtaacacagtaagctcccattgataggaacttattttatgtatgtggtgaagtgcctaaaatatacttgggtttttaatgtgtgacacttgagtgatgaaacgtgacattttgcttattttatgcaaagaatgtgtcaatgttacaatatgctacaggtctgtcctaagataacgaattgccccagacccaagagtgttgtctatctcttaaaacagtgttggagccactagagaggcctcagtacctgtatctgttgaatggtgctggggagaatttgctttctctactgcattacctggtcaagtatgtgaaggggaaagaaccaagagcaaccctaaactcctccttcttcttcaattcatgaaaacatcacagcctttcatctttttttccattgtttttttttcatccgaaatagtgtctttttaagtagcccacagcctccttatgtacctctgactagcttgaattttggaatctaccttcttcaggctccctagtgcaataacaggtgtgtgactatacctgactcttcacattctctttttttggagagatttatttatttatttatttatgcattaacagttaaattttttattggatattttctttatttatatttcaaatgatatcccctttcctggttcccccctcccaaaaaccccctatcctattctccttccccctgcttctatgagtgttactccacccacccatccacacccacctccccaccctcaatttatttatttttatataagtacactttagacacaccaaaacagggcatcagatcctgttacagatggttgtgagccaccatgtggttgctgggaattgaactcaggacctcggaagagcagatgggtctcttaacctctgtgctatttctctagctgctctttgctttctcttaattgaatttatattggcttacagtctttgcctctggaattacatgtaggcccccgttgatacaaacccaagtgctaatataaggtttgtcagacagcgagatactaagacgaatctagtgatccacaatcagccattaaaaactgaaatgcataaaatagaatatatatgtctgttcatagtgaagctaagtgtgggtttaagaagccatttaatacatgaatgtgtgtgtgtgtgtgtgtgtgtgtgtgtgtgtgtaaagagattcagtataaatcttatttcttttttgttctcttattttccccaagacagcatcttacattctagcctaggctggcctggcattggctagtatgccaggctgatccaaagaacacagtgatctcactgcctagtttcctgaatgcttggatcacggactcatgccaacatacccagataaactttagttcttatgtggatcacagtcaagtctgaaagaccaaactgtctccttggcctagcagtttgattttatagttgttccagatcttgatcatcgaagtgtcaattatgtggaaccttcctttattatctggacaaggccactgctaaatcatcaaggacagatgaaattatggccactttgcatgctataaggcaataagtatacacattgatataagggattcttgagttaaggattctgggaaagaattcgttaagagaaaccaccggatgctgtagtgaactaactctctctctctctctctctctctctctctctctctctctctctctgtgtgtgtgtgtgtgtgtgtgtgtgtgtgtgtgtgtgtacttggttttctattaattcctggcccccaggaaggtcagcttattgtcatttccagcttctctccagaatacaagtgtttaaagaaaggacttctggaaagaggtgtgctacattttattttcataccttagtggataggaggagctccctagggtacatagaaaaataacttcagctatctattaacattatctgctgtggactaatggcctgggttagagaatcattgtagctagctgtagctgttctctctctctctctctctctctctctctctctctctctctctctctctctctgtgtgtgtgtgtgtgtgtgtgtgtgtgtgtgtgtgtgtgtgtgtatactcatgtggggatgaccttgcctgtgtgggtacatgtggagaccagaggctggtgttgaaatgtcttcttgaatccctttccaccttctgtttttgagatagaatctcacactgaatgtggagctcatgactttgactgtctggtcatcgaacccacagaatctacctgcctccatccttcagaacttatgttatgcatgcacactcccagcttttatatggatgctcataattcaggtgctcatgagttataggttcttttcagtggcacattaaataaggaaggtttcacctaaggttacatgtgaaggattcatgagaggtggactttgtatctcccagtacttagtgtttctctgaggatatctgtttgtaaattgttcactgtggagactactgaatagcccacctgcatgagagacctcagatctgtcaatagtgtgactgatgttctgagtacactaccccaagtatttcttcctgctgccattctgaagaaaggccatagaagtgaaagtttgtcctttctgatgtttgcttgtagtcgaggaacaaagaaaattatgtggcatgggtgatgacagctcccttgccagttaacttgataaacccaagctctctcttatctttaccttcaaagtgatgttaccagaggtgactgaggaagtgaggtccaaagcttacacacacacaccaaaaagaagaagaaaaagaagaagaagaagaagaagaagaagaggaggaggaggaggaggaggaggaggaggaggaggaggaggaggaggaggaggagggcggccctggtccagatgttttccagtgctatactggaaaaagaagaacccatcctgtaccccctccccacttcattcctttttctctcttaagtactgctaaagagcaagtagttttgaattttggtaaactttaggatgtctacacacacacacacacacacccatgttgtcacccatagagcaaatagcatcttcctcttatagattaaaggttgaatcagcaatgttaggcaagatcacagcaaggcagtggccaaggtcagatgaaaagggagtcagtagatagcagccaagaaagaaaaaaaatgcctttctctgtgacctctccatctacgctaggaagctctcatctcaattccacattgggaactgtctccattctgcagcctcatgctaccatggcttgtttagtttccattacaaactgtgagatagtagtctctttccagtagttctcctttttctttttaattgaaaaaaaattatacagtatattcttatccccttttcccctctcccaaatcctgcccaaatccccacacactcaactctatagtacccccctctttctccctctccctcttcctctctctctttctctgacacacacacacacacacacacacacactcaccgtaaaattacaaaatcagaaaacatacaaataaaagatcatttacattagatacttttcgtgttgggtttatgtggtgtttagggtgtagaagtgtgttgcgagagcagatctgcagtttctctgtaactttctgcaatggtctccccaggttaaagggtacgtatgtccagcttgcatgtgccgtgatataaggccgctatgaataggacatctcaagactacgcttagcattcatggtgaccatgattagttgggaaagtcaaaaaaatatatatgttctggcaggctaaacgtcatcccatccaccaatgggtattcataaattagcttctcagtgtgctcggtactgtgatggggactgatcagaggtgagttctacctttcactgtttaatgtctagatcaacaaagacaagaggcacatgatgggctggggaagactctgcagcggatattgtttggatattgttgtgatatcagatttaagtgtaggacatttaagtcctgagagaaaatatgaccctagttagactttaaggcattagtaaaatagttattatctcagtttaaggagactatataagcaaatatatagttaaataattataaaagagtttatcagtatagcaaaaagggtcgtgaaaggcatgtttctgtagtctttgattgataagactccaaaagtgtttaatattataacatgaaattgaaatttggcttgtaacaaactagaatattctctgttctgctgaggaaagcaaaatcactgcataggaagctaaatataagaggaagagaattctttacaaggagacaaagtcatagttaagatatttaaagaaatctgggaatttatgcccattttcttatgactgtaaggaatgagaaatgatggaaatgaaggacaagaaagatgatggtggtggtggtgatggtggcagtagtggtggtggtgtgtgtgttgctagacctgggacacagtgccttgtatatgttgtacaactgctctctaccactgattggcatgctcaccctaaggatagtatctttgctgtaaaagaccaactggggttcatgggagtctgcaaacagacatctgtgcttctctggctctgatgtggttaagtgttattcttgagatggggcagttagtttcaatgtatgtgaaaatttagcagaaaccaactcccacccacctccaatccacacacttttcagactccactgacttctgtaaactatgctgcagggagagggtttaattcaatagtgtaatctatgagctaaaattatttccagctgtctgtttggagggatattctgttgacaataattgatgcttctgaccttgtgcttaagaaatagtcagcaccgttgttctgatgatattttcttatattaaatctttatctcaaccttgtatgaccaccagatagtaattggataggagaagacacactactatgaaaataaatcttcaagcaacatactctagtttgttttttcaactatttcacacatctctttttgatttctatcttcatttccttaatagaatttgaatttcagattatttttacatgttattataaatacgatcactacaaacagttctgctaaatctttccaggcaactcagagactttttaatgcaaggcacctagaaatttaaaggcaacattttaatggactctatatggattcatgaaaggtttgggttccagttttgtcagtgtctctaactcactgtatgatcttgagcaagtcctttgcttctctggaccctgtcttttcctatgtgagattgtaaggattcgactagatgttgataatgactgatatcaatcagaagcttctgattcatgaaatattttgaatattttagatgcatctatttaatcctctcatccacaccatcaggtaggtgcttgatcctaagtttagctcgcaactgaacaccctgaccaaaactccattgcctttcgaagaactaatttttaagacagttaactatcactgatgaaaaagaaatgctagcgagctttcactggaactgagctagaaatggccatgcagaaatggggcctaactagctgcaaaacaagatgctttattttccatgaaatctagaacagacatctggagccatagctctagatacccaattgcataaagactgctaaaaaagtaataaaatgtaaagaaattctaggtagtacagattctttttttaaagaattatttatttgttttatgtacatgagtacactgtagctgtcttcaggcacaccagaagcgggcatcagaccccattcattacagatggttgtgagccaccatgtgtttgctgggatttgaactcaggacctctggaagatgaagtcagtgttcctaactgctaagctatctctccagccccagtagtacagagtcttagaaggtatagctgtggaaatattcagaaatgctcaagtaatgtaagtagtatactagtaaagccacaggtccatttaaattttcctgtttaccaaacctgagttccccctgagtagtagttcagcaagttacatctagctaagccactcagcaatcatagaaaacagtaacgctgagctagcttgcacatgcgacgtttgaactaataggactatgagggttttgctaagttggttttggtgtctgcctaccttatatttaagctgatatacttcttgccaattccctgctaatgagttactgacctggcaaattcctgacttctattgatcgaacagactacagattcggtttttcattagtaacagttggtgtggcttctaacagagcctgtaaaactaatgaaacatggaggaaatgcacctcgctattactgccgaggcaatggcacagagcttctgctacactaccttttgtcttacatactcacccatgaaagaaaaggctgcagaattgtgtggctggtgggatgtggcaatggctttgcttagtacaccttgaggaagcatggctcaaatatatagtatgtttagctctggggtcttaaaatgatgctgcacagtattgtgccttcttgggtgtcagcataatcaaatggaaagatgtggagggatgactagctgtggacactagacatgttctaaagcacactggagaggtggatatcgttaggaaaaaatctattccttgttttgggggggaaaaaaacctctaaagttataaatgatcttcaaggtggagtcatgatgtgtttgccaaaaggaataatctggtttctaggttcaagggcatagtgtacggtgtagatgcactaaatatatgcatttccatggagcaaactgattccaaatttcaaagtttacattctggcgataggctcatgagatgtggttcaactcttggcttttaagaacaagacctggtgttgctttactgccatctttccattacttctggaatctgtgtctttgtgctgctaggtaccagtggccacaggagagcaggttgttttctcctctcccgtcccgctctgagctcagtgctcacattccctagtgttctactcaggaagaaacaggctcccaagcctctttaactcaacctgaacgccatctgtgctgctgagagaacagagccctgcaggaggaggcctgcatcatagctgagagaaccccaccctgcctacagaagtccttattaggatactcaggaaaggcatccattaaaaaattaagagcaccttctttctaatgtgctcaaatacatttctgaaagtggcttttgctgactgttctgcctaagttaagctctgtaaacgatgcccgtacttgcatcagagcagaagcgcctactccattagcacataaaccaccttgacgtttactgagatacttttttgtctatgatatgaaactgtcttcttgacactgttgatagaatatatcaagtatatagtacaaaacaaacatttattatggattatatggaaggcaccattctgtgtgcccctagaaatgtaaaaagattcagctgctcccatgctattttaagaggaccaggttgacatccatggagctgtaacaagtgcaaattacagcccacaaagtgacacagttatgggaatgtaatagaatttattttaaccctttaattatcagttttttaatactatattttgattactggatagcctatagtgctaaatgttaaacctagtggaaattgtgcccaatggaatgcagtagtttgtagactcgatccatatatatttaggtaatgatgatgttaataagctcattgctccagggagctaaccacttagagagaagcagatcactgaaaatcacatatacaaaattcagtaagttaaagtaaacaagaggaattcatacatattcccagcatagtctagtccagaggcgtggcctaggagtcagagtgttgcctttttgttattggccccttagagtctgagggtctggggttgcacttaatttcttctgggctcccttctctgtcttacagccaggcatgctaatcatgtgggctttgtggacggttgttttcgagatgtggaattttgtgagagaaaagactgtacaaaccacagatgctacaagatattttaagtggtggtaaagactccaagagccattctctttctcctgctgtcagtgaccgtgaattaatatttctgcactcacatttttgggcttgtatagtgaggtccttctggcaacccctcttgcacacttgcagacgttttgcttcattgttatttcattaacaataacagctgttgacagagcacttgcatcatagaactagttagtataagtaacctaagaatgtttcaagggatccaggacaaggtgtagggattatgagggaaaactacaccatatatatatatatatatatatatatatatatatatatatatatatatatatatatatataagacttgaacataggaaatgtggttgccatgagcttgctgaaaccgagtctcttgagtaatgactatctgcttggcagtaggcccttggacttcccaaatgaatacagtaacagactgtgcataatgcggcatcttgctatatgctatgtttttttaaaaatatatatttatctgtttgtttatgtgtgtgtggttattttgctggcatgtagtcctatgaaccattttgagtgccagaggcagatggaggccagaaaagggtgtcagatcccctggagccagagttacaggttgttgtgagtcacctgatatgagtgttaggaagagaaacccggatcctctgcaagagtagcaagtggtttttcctcttgagccatgtcttcagcccctatactatattcttacctctcctattagccaagcccttgttctagtagtggcaataactatgggctgaacttgcaagtctgaaatgggtagtatcgagccagatgtgagaaggttgctccaagttggagggtgtccttcaaatcccaccaatgctgatggatcattaaaagaaacattcgttaaatggtacatagagtatggtgtgtttgggaaccaaccagttattttaatgtgccttgatttatttgtgatcattctgcatatagtctcatataaatagtcaagggcccctgccatgctttggaagggcctaagtgaagaatggtttgatcttttaggagttacctgtgctatatcttccctcactcaccctggataacagcccaggcttcccacccttgcaggctggtcctagctatctaggttccctagagtcttcaggacaaaggcatctgcaggtaattggtctaatactggaattttctagagtgctacatagactacagattatttcaagtcaagttgaacacctatactgcttcatagtccctgtcttctatttcaggaggaaaatttcatggtaccgggcattcataggttgccttgatcacagcattttctgggctgatttgcctaagaccacagtagacattgtattttgtaaagcaaaacatgaaattagtagcaataacttctactatgtatttcacacttggctgtcatgtctctctagcaaccacccacaacacacacacaaacctcttaggccatatgacccacttatactccatccacagccttttagcaacctaggagacagagtggaaatttagtttcctaagtaaaagctacttgcattcaaagcccacttgctaatggtatttcaatatcaaaaggaggtaactgggaatgcaaacaatatattcataaagattccaaaccatccatgagagatatatagaaaaccctaagcatgttcagaggggactattatctttgcatgtcagaaaaaaatgttgggggaacagagcttacttgtgttcgaaggaagaaacagcatacattctgtaggagcaggcttggcaactgtgttattgatgactaaaagctacagctgagtttgcttcattcccatctatagaactacatagttgtttaaaggaatggttctctaatgaagtagaccactattcatagatgccctctaagtagttccagtatatatgtcaggttttaaaataattagaatcctttttatatatgttaaagttaggcaagttacctctatagcttttgaaaacttacctttaactaagttgactgattgttaaagtaatacatgatttctgactatggccaagaaatgcaaaggaatgtattttcccagggaaaatagagatttaagataacagggcaaatgttccttcaagtgcagaacatggctcgttttatttgcaacctctttacactgagcaggtatttctgtttgctcttcatgtcacagaattaggtggcgtatcatttcctctggtattctgaaggcgatgaaactctgggcctgagaaaatggtctcaggggctcttacattgctgcagttcctgttcattcatgtatagaaatccagggaaggagataattgggggaaaatcataaggcttcctggatgatgcagacgataagagcgtctgagaatctctgcatttcagcctggacatcttgcctctgtaggctctgtgaagacaccagagagcttctgttattatacctctcaaggcaacctacaccgttctgggcaatggttattatataaaaacctcatactgagccagaaactctgtctcactatagctttccctaatgctgtctttaaatattgactgctggcatagaaacacagccaccgtatataacactgctcctcaaagaagagcagtcgcagttccagacaagtaatgtatgaacagtattgcagcacacagccctgctcatctattggagcattcccaataggggagactgcccaaggaaaggagaaaggagcaggtaagttctcatagagtcaatcgggagaggctgtctcccaactccgcttttctttttcagtattgacaaaaactacctaagaaaactctttctgttccacaatggttcagagtgctgccttccttgtaactcactctcaagaaagccttcctttcatggctcttatttagctatgggagagtgggtgcctggcaatattgaatgaaggagaactcagccctccggcctgcctggtttactttggctggctacagcaagcaggagagcatactggcttggaaaactgcctccagttggacaatgaatttgactctagggcgtgtcatttatctattatacgctccatgtgtttgaacaagttgttgactctgatgcctcaggttcgcacctgtaagacagagatggagaatgcatgtgatgaagcgtaagagaaacacagtctgctcaataaatgacatttatcacccgcatcctctgtgaactgtgtttctagatcgtgtgtcgttagttgggagacatatcagattccactctagaacttagggtgaatagctttaatgctccccaacctgttacttaggatcggagattccttgaagttctgcaaaggaactgcttgctttctattatttcagctatgatgccctcttattcttcttagggctcaaagcagagtactgtagtttaagatgtttttgtttgtttgtttgtttgttttcttactcaaatatacttgatgaaaaacagtactcatgacactgtatttttgtttatatgtcaaactagtctggatctgcagattgattattccgtaggtttgcacctgctccttgtaatgtttaaaatctctagtctaacccctacatatacaacaggatatgtattccttgaccttgctattaaggaattgaagtatgcatagcttgaagtggaatatatttccattttgggggagatgtatgtacctgaaagtaatggataatgttttaaaataagtgggtcagagtccatgcatacagattttaatttttagtggtggcagtcaaattctcaaggttgtttcatgctacatcagtgccaagatggaccacactggcttgtgagttcttcttgagggatgaggaggaagaaagtcctagagacgaactgaaggatacattaaggattgagggtcagaagttgttacgtttctgttttctcagttagttgtaagtaacctaggattaatttctttggcttatccagcagattgggccaattaaaacgctggagaccttgacatagtgcccagcactgggtcctagtactgggtccattctctggactcctgtcaattaattgcagctactgtgctaaatgaaaaaaattagagcttcaacttatttttccatagtgggaaggaaccattcccatgctatcttatttagtcctccctgtggcccctaaacagacaatttagaaagcattctgctggactagaagcaaatgaacaggtttaattttgttgctttgttttgttttgttttgttttttgtgctaatatagctgcatgaatcatatgggagtcaggcctcatatttgacttccttaatatggtgctaatgtaaataggattcatgacttcagaacctgcctatcatccaacatttaataagtacatactaataagcatttattatcaacaggctgtcttatgcttggggaataaaccaacaaataagatcaaatcttgcccttgtggagtttagattcatttttggatatagacaaagtgagtacatctaagtgttccagataagtccagtggtaaaacaaatcaaaaccaaaaccataaaacaggatccttattggagggaaggctatagtgttccagataagtccagcagtttaaaacattttaaaaagatttatgcatgtatatgagtgatctatttgcatgtatacctgcacaaaaaagagggcatcagatcccattacagatggttgtgagccaccatgtgatttctgggaattgaactcaggacctctggaaaaccagccaaatgctcttaacctctgagccatctctccagccccaagtccaggggtttaaaaaaaccaacaggaccattactggagggaaggctttagtttaaattattctgttaaagaactcattgagtaaaaaggaagaaattggagatctcaaaagtcttccaggagaagtagcaaatatggagagaatgaatcagtttaaagtcagttaagattagacctatgagagattagaaaacagggggagagccacatgagatcaaaagagtaagccgtaaaagctgcaggtcaagcagccccttcctagtcagataagaacttgagaatatcatcctgagtttagtaacccagtcacaaaagaaaacacaaggtatgcactcactgtaagtagatattagccaaaaatctcggaatacccaagatacaactcacagatcatatgaagcccaagaagaaggaagaccaaagtgtagatgcttcagtgcttcttagaagagtgaacaaaatactcacaggaagaaatatggcgacgtgtggaccagagactgaaggaaaggccatccagagactgcctcacctggggttccatcccatatacagccaccaaacccagacactattgtggatgccgggaagtgcttgctgacaggagcctgatatggctgtctcctgagagctcttccagagcatgacaaatacaggggtggatgttcacaaccatctattgaactgaacacggggtccccaatgaaggagttggagaagggactgaaggaactgaggggatttgcaacctcatgaggtgaagcaacagtgtcaactggccagacatctaggagctcccagggactggaccaccaaccaaagagtacacatggagcgacccatggcgctggccacatatgtggcagaagttggccttgttggacatcagtgggaggagaggcccttgggcctgagggggtctgatgccccagtgtaggaaaatgccagggcaggaaggcgggagtgggtgggtgggtaggggagcaccctcatggaggcagggggaggaggaatgggatagggggtttctgaaggggagacctggaaaggggaaatgtaaataaagaaaatatccaataaaagggaagggaaaaaagaatgttggttctttttctaggaggtgagacaccgtgtgagtatctttagcagaggagtgggattgttggatgcagggttcattggagtctcccttgctgctttgctgagaaaggagtatggggacaagggtacggtctaccaccagggagcgtgggagactgccagtgtgtgggggggtactatatcacctttttctgaaacaatttatttgcagtttaattgattgttgttgttttctggtgttttgctttgtcttgttttgtttgccaagagcgttataaccttagagtctgttatttcaataatactttatcagtactaaatgcatgaacttagccagtacaatctgtacatcacttcactggtatatttcccgagaaatgtactgcagggtattttttccacagtgtgactatcagagcaaagatgtgtaaactttgtaagtccacatgtcacggcaatataatcttgtgggatcacagtgacatgggtgattctttattactgaagtgttgtcatccagcacaggactatgcatcttacttagtggtgtgatcacacatgcatgcagtgtggacatgacagggctgagggcaacttatttcagtcaccagaggggttttatcttccttatattattatctcaggagagagttaaggaaagactatctcaccggtttttgtgtgttgctgctgctgttgttgttgttgttgttgttttcatgagaatcttgcttggaatccctcacatggattttctttggtattaacctcttttcatagttgatccttttctgaaagtatgatccccagccctaggtttgctttaaaggagatatgaagttcccatcccacatagctcccccttccaccacactcccagaatataaagccacagaaagtgtgggaactgaatgactactgtttgggtgtttgggttcatctattttcatatgtgtatatacgatatctattcatatctgtttttatttttgtgacttagagatgatatgcaaaacacaatctcccttttggaaataatgaaaacccagaacaacaatgtgttgagtgccataatcatgacatgcacgctactctgtcacagattgttgattagattcatattcatatggaataattgttgagatgagtcgattcaggcttattcccatctgatagctcctaaggatacagcccatgaaggaagcattgctaagacatacattgtatttgtcaaaccctcattatgggccccagggggccattgtgctataggcaccagtgactgatttttttcaaagttgaaaatttggactcagaatcaaagaagcagtggtttagctgaatggctattaggacagaatgaatgacagattgtctcggaaatcagacacaggaagtggctgagacattgggtgctacaaagaagcaaagggctttattctctttattctccttcacatgactcttaagtccctggtgtgtacacagtaatacagaatgggataaacatgtggttacagaaattttcaatacacattaagatcattgtagcttcttgatcatgcacttgtttgatgtgatcttttaaaaaaaatctctcttgttttttgcttgtgtgggatttgagccaccaagttctcaaagggccagtgccatgagccagggcagtgctttctcccacaagtcttccttcagtggtggttggctcccttccaatggcagtcagccttttagcactgctggtagtcatgcggcctctttgtgaattaaactgcaccagccgagttttaaaaacaagtgtgattaaccttggagctttgtgagagagctgtagcatggagggaattcccccaacattaagtgtctcccactcttaactactacagctggtcccggtttctaagtacataaaatctcttcataagtggctttgctatctccaattactagttcacctggatgattgctatttctgtatctaggtcataaggaagccagaggtgtgagtgccttctgaatagtcttatgctctgctatgctcattccatactttcaaggctttctggacagttgaaaaggagcaattcactctctatgagtggaagtcaaagccctagaacctgttttcaacttttgcaagtgcagaacagtgcttcttaataaaaataagaaccatgctgtacagctaccgttgccatccctctctggtgttttcagttcactcctccaagttaaatgcaaagttaggttagtgaacgtccttagcaaatgaagttagcaacctagaaaatagttggcttggtcttgacttttcttttccttttcctttttcagaaaacagattttttttctcatataatatatcctgattacaatttcccctccctttgctcctcccatttcttccccatcttacttcccatccagatctgccctctctctatttctcattaaaaacaatgaggcttctaaaggaatagaataataaaatagaaattaatacattgggataacacaaaacaaacagaaggaaaggggcccaagaggaagtacagatttttctacctcctgatctcactggagaaggaatcgaagccaagaaagctttggtgatctgccaaagcccacacaactaaaagaaactgcaagccctatctcctaaccctcaagtctggaactccagcatacatcccccttttaaatacaccaggttccttttccttgcctatcctcgactgggttcccaagcccactagaaacccctttatacattcatattcttagtccattttgctgtactggctacagaggtaaataactaataataaaaaaaaaacaaaattgtaaatgcaatgggcatgtacttctcagagtttaaagagaaaatcatgagataacagaggcttctgatttccctgccagtctgactcctttcggtcctctctagaatgatgtccctgatgcttcagaaaacatccctctctagtctcccttcagcaagcacattcacctactaagtaaggacagggatactctcttgcctacgtttcctcttaaatctagcacccgagggatctatattttaactattgataattgccatagactttctgcatcatccattttgtctctgagttccagaggcatgggagtggaaggcactagtctacagtccctctgtgtgtagtcaacaagaacaaatgaacctgtgaagctctggaatgcttgagccatagattcctcatgaaaatgtgaactggctgcaattccctcctactgtctctttggtgattcttttttatcagtgcttagacacagtgccttctatctcatagagcttcttaggacaggtctcttagctgtaccttatacctctatgacttcatttcccaccgttgccctctaagatatcatttagttgttaatatgctaaactcgtatcatcattgaaatgattgggtgtgttcatttagaaggtggagctcccaggctaggtgctagggagtttgagtaatgatggagactttgccctctcatacgcaaatctggcatatcatgtgtgcagctttagcaggttggtcagatctatggtctatgctctaacaaagcaagaaggaatcacatggctctggatgcctgagaaaaaccaggagggtgcagggttggcaaggagcctcccagtgttacctggaatgacctgataagaacaaagaggatcacttatgtctactgcccgctccccaaatattctgtttatgattaaaaatgccgcctggcgagtctcttccaggagcctttgggaacactgtggcatatggccaaacttctccaggactttctttcattgaaaatttaaagcaacatatgctagtttttcaaagcttttctcagtctaatctaatgttttgggtttttttttctcctgtactaaatattgaacttagaatttcattcatgctgggctgtgtaactgagttaacctccccagcgccaatatacctctgctagtgctgctactattatagttttctttggccttgtttcagagcctgtattagtagcagctggtggtatcctgttcctaagtttaagctgtgcccaaactgtactggaaagttaagacctagctctgaaatgtccttagtcccaaacgcattctctctctatctctgtctgtctgtctgtctgtctgtctctttctctatatgtatatctgtctctgagtgtgtgtgtgtgtgtgtgtgtgctcgcgcgcgcgcacgcgcgtgtttgtgtgtgcgcaggcgtgtgtgtgcagtgccaaatgtcaactgtcatatgtatcatatgtacagccttgcccttgctgttgaacatcttagaatggaattctttgtagctaatttaagggtagaaagttgatgatgagcatcttattttaccaatatggtctgttttcacccctggtaacatgagacttgattctagtgggtaaagctactgttagatttctatttggcagagtatggcaaaggaaactgttcagagaatgtgcttttttacaaatgaccaccaggtgtcagcagaggatgtgaaacttttggcaacatctgcattattggatttaattcactgaaaccattcattcccgtcacaggaagcctctactgggccccttctcctcacaattagcatcaaatgctttctcctcaagtctgcatcatttcttcacccttttctcatctaacacttaagtctggcatgcacagtggtagttctacaaaataagctattgggacaagacaggggagttaccattacaaagttcatgtgttttactaaagttcataaggagattaattatgcagcacacaatgttaaggctgcctatgcctatgccttttccttcaaaaggcaatttagcgtgtgtgtgtgtgtgtgtgtgtgtgtgtgcgtgtgtgtgttgctgttttcctctagcttctcatcttgcctcttcatttggatagactgagcagaaacctgcggtctttagtacagagcattgagctttaggctgggacagcactgaactccctgagtagaactcggaaagcacttaagcctcgggtcctaaaggtagcaatttgaaaacggttacttttgaatatgtcatcaagttctaaatgcaactgtgggatggtgggggacacaagccagcatatggcttcaccagccacaattgctgaggcctgggatcttcaggcaatggagagtaaggcctaatacatagcactgaatgcactaccttaggtaaggggctgataaatgcacggggctagagtttaaacatgttataaagatttcaattggaatggttaatgatatttgacaaatagcgttacaaacaataccaagagatgttcagactcttctgttgctctacaatgaataaggtggcacctcaatggggattcaaaactgtctagaatattttctttatagagatttcgatgataatgggcaagaagaatatccttgttcttaaagtgttgtaaaagatggccataaaacctattctaccctcacatgccgttgatgaaaggagccagcattctctctgaagtcatgcctagttcagtgtcggacagacacacattggaggaatgcctctccaaagtgtcttatgatgttctttaagcagctttttaaaaaaaatgtcctttattgacttgatttccaattaatattaaaactatgtataggatatataaggggaagatataatttgcatactatcaatgtgcgtttactgtgtgacagttttagctaatgatctctgacatttcttgccattgaggacaaagccttcagcaaatacaccttgtttgtggaagcttgaatcttaatggccacattgctctgtgtctgtgatggtttgaatgaaaatgtcccccacaggcccatatatttgaatgctaaatttgtacttcctctcttggtgaacctgtttgagaaggattaggaggtgtggccttgttggaggaggtgtgtcattgggcgttagctttgaggtttcaaaataccatgccattcccaattagttagttctccctctttgcctatacttgtggatcaggatgtaggctctcagcttctgctacagtactgtacctgcttccatgctccccaccttgatggacatgtactccctctggaactgcaagctcccaataaactcttttgttataagttgccttggccatggtctctcgtcacagcaatggaggaggaactaagacaatgtcttttggcaatagcttcatgtttcatgttctcttctctcctttcgcagatcactggggtgatcctgttggccgttggagtctggggaaagctgactttgggaacctatatctccctgattgctgagaactccacaaatgctccctatgtgctcattggaaccggcaccaccatcgtggtttttggcctctttggatgctttgctacatgccgtggtagtccatggatgctgaaactggtgagtacaactcagcatgatgtgatgtgctttcttggttatttttataaaacaataaattcatgcagcagttaagtagcccttcttgaagccacatacacacacacacacacacacacacacacacacacaaaagactttaatattcattgattttaattttacactagactcttaactaatccagcctttaaacctcccagtgggaaaagctaccccaaacacagcctggcacaataaacgtagtcccagcttcctgaggtaaattggcaaagcactggccattgattccaatgaacgattaatgtcttcttggcaagatgccttgtgccagtctcaaactggcttagaaatcccttgtgggatgtgatgtgcagcttcggcgggcaagggatcattctgaacatgaacagccttccacgtccaagatcccactggagtagacctctctttctccttgaatcttgtcatgcaaggaggtgtgcacatgcttttctctccagttgtactatctggccctgtgctgtgggagttgaactaagccagaagctctcactcaaagggctgatgcaatgacaattagcttccagggccacagcagaggcctatgtctaatagtgcagacagagcaataatacatccctaaaggtaagggcaggctgctgaaagacccttacggcggttttaactaccattagaatcttatggtactcttttagctttaaccttaataactgaaaaaatcatcaataagaacaatttatcctatagggaggcccaaagaagatgtctgaccacagagttaaatgtccattttcccacttgccttctgatagttatctttccacataactttgtggtgaattgtagtgtttggtatgagcctctccacagagtagtgcatgcttctgatcatattttctatgaactatacaaagaaattatgtagattgcatataattaccgcatgcttaatattttactggttgtgtgcttatatagaatttcatcaatatttagagaaatggatattttaacccaatgctttcttcttttagcatatgtgtcagtaagatttttttatgatcccatacaaatttatatacttataagtcatatgtatatattatagctaagctatgtggtattgtgtagtccacccacagcatcatttagggtccttgcaaacattcaaaatggccctattttgagacacaaagaagaaggttataatatatatgacatgttggtaaggagttgattcctcttccctttttctgtttttcaaagtcagaaaaatagcaaagccttcataactcgtaagtgctatgtaatgtccttgaactcagatatttgtatgcatgtgttcagaaagacagtgacagagacacaatctttcgaattgaaaagtgcaggtaagataggatgagaaacactgggatgattgttagtagtcttggtcacttgctttgttagaggttgtaaattcaatgaattgcccagcccagaggcaaggatccccacatgaactggttgaggggatcagttcagagatggccagcaaagtgaagaagtatgtcatgctatatacacccgggcctttgacacaagatgacaggctgcacttccaagtaaaatgggtctgtagtcatttactgtgagatgtggctaaaaaaaaaaaaaaaagaaaaagaaaaatagagaagtttgcccaatgcacagcttcgcatcccagccatactcatacatacaaaggactaatgtatatacatgtgcttgggcccttatgctttctaaagcagaaccactactggctaaaattggaagtaggaagacctgtggccagaagcaaagaagtttttctgataattgcaacaattaggaaatagaacagtcagggctggggcagcacctcagcggggtagtattgaaggccttgggttctatgcctggcattaaaaagagggtaaaaagaagatttaattttcaggttctagctcactgttaagatggttgcaacgcctcctctaggcagaacaatgtcctgtgagaactccagagcaaatatttttttttctagcttaagtattttcatattaaaagtaaaacaacactttggagcacatgaccctttcatgtttctcctgatcgatctgagctgatggacacagtgtcagtggaggtctcctcagcatccgtaccccaagatgtttgtacatcttaaaatgacaattttctaaattgctacttctgtgaaattctaacaagggtatttacatttctgaatttgctctagtaatagtaaggacttacctaattgcccctagcagaaagatactctaaagataccttctcagctatgtgtctgtctgtctgtctgtctctcttctcctctctttttccctctctatccatgtgtctgtgtctgtgtggggctatgtatacatgagcacaggtgcccacagtggccagaggcattggatgcccttggagacgaaataatgggcatttgtgaaccaactgatgttggtgctgtgaagtgaacttgagtcctctacaagagcagtctgtgcgctgaactcttgagaaatcttcccagccctgaaaagccctcctcttaatcctgccttctgactttatcctcgttcacttcgtttgtagtatgccatgttcctgtccctggtgttcctggctgagcttgttgctggcatttctggatttgtgtttcgtcatgaggtgagtatgctcagggtggaaagacctagagtctgtgtgtttagatgcattttggaaacgaatggcttgtgtaaagggtgcgtgaaggctaggcaggaacttccccaaaattttacacccttcactgttaaccctcacttaagttttctctgtagctctttcataaaatgacttcttatatggattagatactcctttgaaagtagctttttccacaaagcatttcgtgctattataagatttctgacactagaggcaagctgagctaattgtcttgcttgtaaatccactcttacaaagaacaggaaagctgtaatagaaaggtgtgtggtgatggagccagaacaccatagacagtgaatgcactgagggggttggctgtggctcttgagtgcccggcagcacatcccaggctctttgtttttatcctgctgagctatcttctctgggagcttggcatatggatgatccattcctttccccattaccctgattttgactgtaggtagtgttcaaaatgccaacgctaacttccagaacctgttgctcatggatgctgcctctaggtagattacccattcttacagtgagctggagagaaatggggtgaagtgggtggtggcctcaacagccctgctggagggcatcagtgtaagtgtgaaaaccagaagtcctattctccctttcattatattcattagggattgcagtctcaccctgattacaaaataaaggttgactttggtcaagttgtgaaattcactgggtaacagtaagtcgcattgataccatttacttggaccgatgttgtaaagaagcctggattgcctttagggcagccacagtcttgtttcttaagcctgtgtcctcggggtaacacaagccttattctatatacaacaccccaccctgagaatttaagagtgaagtgaggtacagagttggctatggtagccactttgccttgtagctgtccgatgggcattactttcagaatttagtcaggaatatatatccctgcttggaagagttaccatatttagcttggagcttgccaccagataattattgccactttctgttctcctaatcccaaggcattgcatcaatcaggccttagttttaccataagcgacatggcctagttgtatacctaacacctcacttaccccatatttcaaagggatgggacttgaaaatgagcccaagggcaaatatgttcactgacaaggagaaagggtttcattaactttttactaacaagaaagcccttgtcctttagcctctttcattttggcctcagtaattagagttaagtgaaagatggcttttgttccactcctgcatggtggaaaaagggtcagtttggggccaataccttaatcttcacatcacgctggtgtctggcctgttaccattctgtctgcataagtcaaagaatggtatagaaaggaagtttgccatgaatcaattaaaagaaaaataactagaaaattcatgcctgatgattggccagttggtcacctttatagcacttttaaaacttacctagccacttcagtgagccatctgacaggactgattccctctaaattggtggttgaaaccaactttgtctttaaattcctcagctagttaaacctttggtgaattttctgagctccgttgtctcagagaataggctttccctgcctagtcaattgagaaaatttcagaagagatggtcctgggagactgagaggaacctgagtcagattaggacacaatggacttgatatacattccccctttatcttctgtagatcaaggacaccttcctgaggacttacacggatgccatgcagaactacaatggcaatgatgagaggagccgggctgtggaccatgtgcagcgcagcgtaagtttcagggagagatgtgggtatagagcctgcctgtacagttctgggcttaatcctctaggcttggtgggtaggtggggtaggccagttgcatatactgttgattctcatccttgagtgcttagtccagttctgttttcaagagttgaatctaagcatttgcctaggctttgatttttctagaaagttagcatcaagaaggcacatgctccaatgtgtcttgtattggtaagagtgctgaacccgtcaacaatactccatttgtccttaaaagctgaaccattggaaaggaggtaggtaggtagtgggtatgtgttgatctagtaacggctgattcctgaaggctggctatctagaattggtaactccaggctagacagagaagtcagatgagcagcatctacttggggcagtgcactaaaagtgtaaatggaccaaaaggaaactgagaatctgtcaggtatagtctgcaaaggggagtatgatgtaattatatttaaacttcatacaattttaaaaaattaaaaccgtaatattttccattttattttggtgacatttcagactttttggaaactcaaaaactatacactcaggttttaccaaccagtaacattttttgtcgcatttgctttcatattctctatgtgagatatcagaaaacttttataaaggggataaatagaaaatattttagactatggggatggtcttatactctgtgtcacaatcaactgtgccaccctagcacaaaaggagccatggacaataggcaatacataaacaaatggcatgatcaggtctcaaaacacctgtataaaacctggcaggtgataggcttaccaataccagctttccatcccacataaaaagtattatctctaagctatttatttacttattattgtaggtctagtggagaacatttagaaaccattaattgcctatcagtattctgggtgtaattaccatgtgcatctgcatgtttaatagcactcttatatgattgtgatattaagcaaggtcagagacatattactctacttgttgaggtagtaagaaagacagtgtaatgtgacctcatcttccttctcagagttcaaatgggcaccaaagatgattgatagtagagcttaagttgatttttccacaccaaaggtatatgctacattgggaacctggctgatgtacaaccccgactgtcctcctgtatctgccttctgagtgctaggattaaggggatgtgccaccactacccagcttgatgtttttctcatagaagcttcagagcaaggagtgaggaggtcccagcatctgctcaagcactcttggattcttttcttttcttgttaacagctgagctgctgtggcgtgcagaactacaccaactggagcagcagcccctacttcctggaccatggcatcccccccagttgctgcatgaacgaaactgactgcaatcccctggatctgcacaatctgactgtggccgccaccaaagttaatcagaaggtacttcttcctcccagccctaatgggacaggcaggcgggctgtgtttgggaggattttattacttttgtgaaattaagacaaatagattagaaaacgttgtctcagagggagttgggcttcttcctttgtggtgtttgctcgcctaggagaagcccttgaggctgctcacttctaaaggaggaagctctgcctccagttggtctcttgtggctctcccacagcaagcctccaccaggcacagatatgtaggtttagcaaatggttcctgttaaccccgatgcctgtgtcagacagagagtgctttctttcttttttttttctttctgggcgcctttcttctacttaatataccatcaaaacataaaattattcacagctgggtgccagtctttgtcaggaagaagggagtagagttgacagacagcatctgcttctgctaggagggtggcctttattttagggagttcactggtgtaggaaaagaaataaacaactccaattcaactcactgtcaacatctgaattcccaaaaagagagcaggaaaacaaaacaaaacaacaacaaaaaaagatggtggaaggagatatagacaccagttcatagggagaaaagaagagtgaacttccagtagtcaaagagaagggaaagcaatcctgtattacactttacagagaatacaatgaagactgttacagctgtgtgctacagctgtgcatggagcctatcaacattcttaaacatttaaagaaatgccctatataaactatgatttgagaaacaaaggaggagaatacgctattgactttgtctttagctctctagacatggggcaaattttattctcttaccaaggaaacattctattctagtctattcttccaatatcttcccagttctgtgttatatggaccatgtactgaataattcatagagagatgatagctgttctctcaagattagaattctataaggtcatttctgtattttactcattttgtattgggatctgtaacagtgagtgttttgattcatatggctggtaaatgcagcagccatccaattttggttaaaaaaaaaaacttttttcacataaacattctcttttaggaaatttaaggaccaaatctaaattcagagactagagacagtttaaattctgaaccaggcatttgttcattggaggatcttgttgaagttaacctttctcaggatttttttctcatatgtaaatgatagataatagtagtacttgatctttagaattaatatgagggggactagagagatggctcagtggttaaaagcactgaccgctcttcctaaatgttcaattcacagcacccacatgatggctcacaatgatctgtaataggatcagactctctcttctggtgtgtctgaagacagattgcacatatacataaaaatagattaactaaaaattagtatgaggaatgagtgaaataaattatctaaaacataatgtcaggcacagaccacagacactatgagtattaactgtgatgccaggcagtggtggcacacgcctttaatcccagcacttgagaggcagaggcaggtggatctctgagtttgaggccagcctggtctacagagtgagttccaggacagccagggctacacagagaaaccctgtcttgaaaaaacaacaacaacaacaacaaactgtgatgcgaatatgacctcagcagggttcctagaaatgatgcagcacacccttatatggaatagcttctgtttgggggccagagaggtggctcaggggtgaagagagcttgttcctctggtgcagagtaggaattcatttcccaacactgaggctgtcaaactcataattgcttctaactccagctccagggaatcttacaccctcttaaggactccacaggaacatttgaatacccacagacaagcacacagacacacacacacacacacacacattcatgtgttgtgatcatttggtgttttgaaccctaccctgtgaaagatgaagtttggcttttactcagtgacctggggagcctccattatacagacttggactggagagtaggcaggaggaagtggggaccgttacacaggggattgattggttggtttggggcataggatttcgttttctttcggtggcgagatgatgaagtgcctgcaggttcatttagctgattgcactggctgagcccctaccataggaatttcttgcccggtttctaagaacagaggtagaactactggccctggttggcagctacagagatgcctttgggacctttctggaacttgtgttctcctgcaaatacttaaaggctgccacttgcagacacctttgcattggtggctgttgacttagacacaccaagagggtgaggaagttaaccactcggtttctcagtgtgtcctgggagacctagcaagtctctagatttatctcatgcttgacaaccaggctctcatgttaggaaattgagagagatgattgtgggtagataagatcatgccttagcacacgactttagggtgaatgccaatatgacctatagttgtaccaaagcaatccttgtatctgtagaggtgtgtgggaacatggagagaagagtgtaaagctgaatgatgaataatagagaaaataaattcagggatggaaaacatttttcaaatcgtcctcatcttctctttttggttcactctattactgataggatgtattcattttatttcttatttgtagtaaatctagctaactcttctttaccgaagaatattgacacttttcaagctttaatggacatatgaaatacctggagggcttgttaaagtgcattcaaattcaccaaaaaaaaaaaaaaaattaaagaggaatatcccaagcacatggcaggtgctggttcctcaagtctcgggtagaacctccagtttggcctttctcataagttctgtgctgcccgttgaagaacaacacattgtgtaacagggagaactgtttcggccacagttgaacaggccattacttatgtttgtgttttctcctcctggttgacatgagtatatcaaaaataaagttactctaaaaatgtccaaaactggcgctgagatgtggctcggtgatagaaggtttccctagtacgcgtgaagccctgtgttccaggcctctcatgggagaaacacaagcaaaagtcctccccctaaaacagtagcactcatacttatagaaacacatacttgctttgagtgcagaattaaagtcacaatgagagcaagcagaaaaatctcagccagctacttccctgttgctcctctctgttgggattcttaggcttgtgtttttatatgctgggtcaatgtaatgctgaagatttgaagctcattcttccatttggccatcactgtgggggaaagggctgtgatgatggccagcttagagaagcatcgtttggaaaagtgtttgaataactgcttgtcttcgtgcctattgaagtcttcctaacccacttgttgctctcctgctacctgtttgggaagtactacgatgtatcatatccttagtaaaagtgagatcagcaggtttcaactggaaagaatcaaattgtacaagtcccccatgagccagcgtgcacttaccttcatatttacatcagataggaaggagtatggcttgtaaattgcattgaagccatgttacagcactgctccaagttcatcttctctctgtaaagatactgtgaagatgaagatgatttagagccaagaatattagtagaattttcacacactatgaactttgttaaacaaaataggaatttaaaaataaaagacagtgagactagttgttgtggtggttcagatgttattatgacttacaatgactgtctagataaacaagaactactttgattctgtcctttaaatgtcttcccttttttttttttttcttaatttttatattccagtcaggttccttcactggaaaaggccatgtattctttgctgaagaagtcaactcagaaataggttgatttggttagtttcatgtaaatgtacgtttaaacacacacacacgtacacatgcacacatgcacacactcacacttctggtcctaccatttgatctgaaaggaagggattttctagtaaccgcagcttttgcctttctttgtgttgtgggagatacaaaagaaataggtgtttccttcctggactaggttgataaaatatagtctacctccacaacatgttaattttaatgttaatatattaattataatattaggaaaatatatattaattataatattaggaaaagtgtcctatgtgggttcatcgtactatcctctatactttttttgtatgtttgaattctttggtttgatggatggttggctgtttagttggttggttggttggttggtttgttggttggttggttggtgggtttgacttaccaatattttgtttttagggctgttatgatctggtgaccagttttatggagactaacatggggatcattgctggagtggcatttggaattgcgttctcccaggtactcaaatgattatgctgagtctagcctcgcccagcctcccaccctggtttgcctccctagcctccagtgtccagcttatctttctgtgctctgggaaaggtggatagaggaaggcaaggattcttgctccttaggccttaggtcatctgtttattgatttttttttcaacttaaatgaagtttttctgtcaagggaatagcggttacagtttaactaatgactatctccagtaaagcatcttgcttcttcacaggtcaaatggggggggggggacagaagaaggagctggctttattgggacttaaacaactctaaacatcaactgactggtctagatttgagggaggctctttcctggttgatctctctctctctctctcattctctctctctctctctctctctctctgtgtgttctttcttagtttctttggattatgcgtgacattaacaggcttcatcttgtgaactttaatctttagatttgaatatcccatttctgaagaggaaacttaattatttgtgtattcaactgctcatctcttcatctctattcaccttttacaaaccattgggagatataattaggccagttaagtaagctaaaggtattaacggatacaacacatataaactaaatctaaaatttagcctgcctatcgccagtaaggtcctgttttacaggcttcttgatctggggagcaaatggtatatccttgttataatagtctacaagtgtaagaactgacatgtatacttagcagcttaataaaaattttaggtttaacttagttttttttttcagactaacagatcatttttcatagaaagcccagttgacatgtcagtaatggctccaatgttccatttctatagagaccatctcaaagtctaactctctccctccccatctgttgttctgctcagcaatgcgaatgcagttctgctgtgttctaacttgtttctgaggtgttttcattgaaatatgaacttcaaagaaaagtgactaaattataattttgtagtttagtaggttattatttatgtggcccttgcttagatcaggggatagattcttaacttgatagtgtgtgtctctgtcaagcaggatttagtattaaagacagtgaaatgcttttcttccatgtaattatcaaaacttgtgtgacatggcatctcccaagagcatgtgaagtcagtcactatgagtatgtcttgtgttgcagttttaaaattctccttaaacagacttcattgctttctcccttatggactgaattaacaccccctacacacacacacacacacacacacacacacacacacacacacacatgccaacacagacaaactctaatcggatcacaagcagggcaattaactcagtctccagagacatttgaaaggcacttactgccctgaactttctcccaattgcttcaacacttcagtaataatacttagcaacatctctgtaatgtaatggcctagggacaattctgaggattccacaccctgtgactcatacaaatgtttaggatacacacaacagccttgagcacacagtttcctcaatacaggctgttaaaaacagaaatatggaagcatggttgacacttgggtatatgtgtacacacacacacacacacacacacacacacacacctctgaagtcttcatggcttccctagagaaataaagtgtcacattgctgatataatacatgaggagaatacctcagcgatcctcatctgatagataaagtttctcatctaagaatatgcctaggtgcctatgtagtcatgggtaggtatgtgaaagggtaggaagagcttgagggttttttggctggttatttttgttttgttttgttttacaaaattcattcagatattgtagagccaaacctctcggatgctgcttgatgtgaatgaaagtggtctgccgtggctctcctagaatgtagcaggctctactgaatgaatgccatcttccctgcttctctctcttcctccctcacggtgtccctttcttccttccacttttcttcatctactttccatcttcttgccctctccccacacactgttgtgagagaccggcatagtgcccacctattgtgtcagattggaaaggcagtataaaggtgcaaggcaaaatatgctgagtccagttttctttgactcaccatgtcccataggtaatttggcttagagcccttgtttgaatctggcgccccctagtgctcctgttgcctttgtcctctcaaagacaaagaagttgagtgttgactggatgttttctttccttttcttcagggaagagacaatctcactgtttgtcactccccatataaactcagtttgagttggctaaactcaatttgaggcgttcccactccctgagccaccagacctgtttcaccctacgattttgatagttaccatcttcaagagggaacatgggcaagaagagaggagaggataaggatgggatgggtagtctctgggaagagaggccccttggtctagcaaactttatacatcccagtacaggggaacgccagagccaagaagtgggagtgggtgggtataaaggatggggggagggtataaaggactttcgggatagcatttgaaatgtaaataaagaaaacatctaataagaattttttaaaaaggattggatggatgggaaagagctaggggaagttgctagatgtgcattccttattctctatctttccatctctccttcttctctcccttatttccctcttcctctttctttattaggaaagagattaagtctcttaattcaaagacaaaagatattcaccaagaaatatagaatgcattcctacaaattcacctcttggcctcccacccccttccatgacattccttagggcccagaatctgataggatgatttcttctgtgccagtaattctttactagaaccttaaaggggcctgtttcccctttctctctacagggcagagcaagttagggctgttctcagatacgaaagtggctgcaacataaatctttggaaggattacctgcatagtttggggaagagagttgaacctattaaacccattttcttatctggaaagttgaaaaaaatattacaaagagttgtagtaaaaacagtcaacattttattttatcggagtttgttatatacattcaatgcctatttatttatttatttattagtagaatataaattttcacactgtgacatataatctagaattgttgattttggaaaataacagtctcatagaatgggacatgctgtaaatttaaaagttcttgcacacctagaggaatttaggttctcagtcagcaatataatctgaacattatagccatggtaccttcggccactccgcgtaagtgtatgacaatgtgtattttgtggcatggagtgacagaggccacaaggtaataagtacttaattcctgacaggggttattgtttgcacattttttttaaagataagaagtggggattggagcctgcaaggtgagtaaagaggtaggtgaacactgtgcaggtgttcccaagcaacagagcaggcaccaatggccacaagtccctcacggatcacgcgagggtgatgaggtaggctagcaacatgattcttacctctgcgtggcttgtggaaataccacttgctggattgtcctcagtggctggttcacaggtaggtggtgggacctgaaaacactcatttctgataaaatcgcaggtgatggtggcactattgtcctgcaccagactatcttgagaggtccctactacctataagacaacaaaacatagccagtttcttctttttttttaagattgatttatttatttcatgaatgtgagtactgtggctgtcttcagacacaccagaagagggcatcggatccccattacagatggttgtgagccaccatgtggttgctgggaattgaactcaggacctctggaaaagaagtcagtgctttaagcctctgagccatctctctagtaccccatagccagtttcttaaaggcaccattagccaaaagaagatggtctctggactcaagtttaccactgagcacctctccaaagaagctgatcctctgggtttataaagctatcagttattaaccaatgaagaaagatgtgactgagggtgtcttgacactgtcagaatcatttctcatcaggttcacctgcgccacaggctaatccaaggcgttaagaaggttaggagccaagatactctatggaagtggtgggacaaactgagaggagtttttgtgcggcctctgaaaaacatggaagtggtctctcaatgtatgtgggcctatttaggcctgtgagagctacaggattgagagacagaatttaaagctctcccttcctattctcctttccccacccacctcttataaatgatgactttgttatcttactggcaaatggacctagtcaagaataatgtctctattcttgtctcaaggaaagaaccactattctgcccgccaagtataaccagagtatcatactatgttgaaaaatctgccaaatatatctagccttccaaataattcaaagtgtattagcctttcagttaatatcataccaatttcaggtcatttaattatttcttgcattaatctcatagcatggtcatattttaatacatgttgatatcagaagctgttctgaaatgtccagagtgagctacctctgaaccttgttgccaatttcagaacttcctcttggtcccataccagtacttagactagctcaaactttgatcccataattcaaatctgatttattcttcagtcctgacctttgccctttccaaataagaaaacttctatttattaaaagtcatgtctggatattcatgtgtatcaggacaactctttgtgttggtagatagatgcagttggtatgtatcaaagcttaatttcaagtatttctagagttgaaagcaggggatagctttgtgacgtaagattcttcttttatacttgttcttcttgatcacagttgattggcatgctgctggcttgctgtctgtcccggttcatcactgccaatcagtatgagatggtgtaaagagaaggtgagtgggagtagggagggttggatctgggaattttcccctttattgcccagactccccttgaagtgggcaggaagattgccgagccactgagccactgaactgcctggtggcgttgcccacttgtagaaacctcatatccgtatgttggggaagaggtggagtggatgccattggggaaagtgggaacacttgctcttcaccttaaaccttttggggcaggctgttagcaatggtgaatccctcacatgtcttctctttctcttttctcttagtctttcaagaactttggaataagaggcctgtttttaaaaaggaactgccgcaatctctgaaagacttccaaagaacgttagagcacagtacatactatccctgccctgctcccacccccagctccctgcagcccctccccctacgtgcaactgacactcctacccagtcaaagctctgcctttcagcccacgtcatacgtagtgtccatcttgtgaagccctgttgtgccccacagtgtagccaggccccctgcagctagtcatagtgaagcccaccctaaggccctgtgagcgccagctccctcacatgtacttggtccaactgtaggtgactggttatcacatcttcactggcccctgtggccctgcatgtagtaggggaggcttcagtcagcccctcactgtggtccaagaatgccacacacctttccgtagatatgccgatggtaattatcttttcttttggcttaatccgatttggtttggtttttccctttccctggattctttcctaccttcttcaggctgtcaagcacgggagaggagacacagtgggagggattcataaggagaaaacagcgtctggcaggcatggcagaaagtgctgttaagcattagctggcttccttgttcattgttccaagagatgggtgtggagagacggcttagtgtaggatcctctcgaatgaagcctgtgtaatcctgttacaggttgtgttgttacttccctgatttgccccaactacttactattatttcgctttcgttttcctgtatttttttcttgcattgacattattgacgttgaggacctcatcagatcaatttaaaagtgagtgtggaagggaaacgaaagtcaacatatttttaaaagatcttaaaaataatgcctctgtctagcatgccaacaagaatgcattgatattgtgaacatttgtgatacatgtattaataaatagagcaattaaaaatggct

SEQ ID NO: 233 - DNA, 225 bp, mus musculus
atggccatcactcagtttcggttctttaaagtttgtacttgcctagcaatagtgttctcattcctaaagagattaatgtgcagatctggcagaggaaggaaattaagtggagatcaaataactttgcccaccacagttgattattcgtctgtccctaagcagacagacctggaggagtggacttcctgggatgaagatgagcccactagtgcatcgaaggaggga

SEQ ID NO: 234 - DNA, 34 bp, mus musculus
ctccgccccccccccccgtccgcccccctccccc

SEQ ID NO: 235 - DNA, 217 bp, mus musculus
gggagggctgtggtggggaaggaggatagggaggggaacgcgtccaacaagaactgctgtgttggaggaaacaatggcaggggcaatagcgatggtggcagccgaggcagccccactctgggcacctttctgaatgggcagaggcagctctggaagcagaagagagcaggcagagcccgcagaggctctgagccaagcagcccagggaggagaaggg

SEQ ID NO: 236 - DNA, 291 bp, mus musculus
aatggagaaaaggatatccagacagcactgaataacgcatatggcaaaacattacggcaacaccatggctgggtagttcgaggggtctttgcgttagcactgagggcagcgccatcctatgaggactttgtagctgcgctaaccataaaagaaggcgaccaccagaaagaagctttcagtgctggcatgcagagggacctcagcctttacctccccgctatggaaaagcagctggccatactggacacgttatatgagatccacgggctggaatctgatgaggtggtgtga

SEQ ID NO: 237 - DNA, 291 bp, mus musculus; identical to SEQ ID NO: 236

SEQ ID NO: 238 - DNA, 498 bp, mus musculus
atgccgcccaagttcaaccccaacgaggtcaaagtcgtgtacctgagatgcaccggaggcgaggttggcaccacatccgccttggccccaaagatcggtcctctgggtctgtcttcgaagaaagttggcgatgacattgctaaggctaccagtgactggaaaggtctcataattatagtgaaactgaccatccagaacagacaggcccagatcgaggtggtgccctctgcctctgccctgatcatcaaagccctcaaagagccaccgagagacaggaagaagcagaagaacattaaacacagtgggaacattacttttgatgagattgtcaacattgcccggtagatgagacaccggtcttgggctagagaactttctggaactatcaaggagatcctgggtactgcacagtctgtgggctgcaatgtggatggccgccaccctcatgacatcatagatgacatcaacagtggtgcagtggagtgcccagctagttaa

SEQ ID NO: 239 - DNA, 498 bp, mus musculus; identical to SEQ ID NO: 238

SEQ ID NO: 240 - DNA, 781 bp, mus musculus
atggctgccaaatgtttgagtccatcagaaagttcggcctggctttagcagttgcaggaggcatggtgaactctgctttttatgtggatgctgggcacagagctgtcaactttgactgattccatggcatacaggaccttgtggtaggggaagggactcattttctcatcccttgggtacagaaaccaattatctttgacagacactctcaacctcggaatgtaccagtcatcactgatagcaaagacttgcagaacgtcaacatcacactgcgcatcctcttccagcccgtggccagccagcttcctagttcgtatctataccagcattggcaaggactatgctgagcaagtcctgcggtctatcaccacagagatcctcagtctgcggtggctggatttgatgctggagaactgattacccagcgagagctgatctcacagagcaagcagcaacatttgggctcatcctggatgacgtgtccctcacacatttgaccttcgggaaggagttcacagagacagtagaagccaaacaagtggctcagcaggaagcagagagagccagatttgtggtggaaaaggctgagcagcaaaagaaagcagccattatctctgctgatggtgacttcaaggcagctgagctgatcgccaactagctggccacagcaggcgatggcctgatcgagctgcgcaagctggaggctgctgaggacattgcataccagctctcccgctctcggaacatcacctacctgccaggggggcagtccattctcctc

SEQ ID NO: 241 - DNA, 781 bp, mus musculus; identical to SEQ ID NO: 240

SEQ ID NO: 242 - DNA, 11646 bp, mus musculus
ccgacccgagagagggtgctgggcagcggggacagcccccgcctcagtggccccaattactgaagccgatctcctgcttgtatctattggtgaggatgttggcttttcgggtgagtttggagagcacggtgtgcagcccgcgcaggtggtagtggaactgctgctccagatcttcctcgcccgcatccgcgctctccaagtgactcaggcccaccaggatgtccttgggcttccaggtgctctcctcgctcccggccggcggagacgaaggctggtgcaggactccccactcgatatcattgcggatggacttgagcagcacgtagtggctgtacatgtcccgggagggcgcgaaaaagctttcattggcgctgcccgggcttggggccggggtcgtgcgctcctccaggcagccgccactgccgcctacctccacgctgacctcgtctatctccggctcggacaggggtacgtcgcgcagcagactgggcaccatcaccgtctggtccatgttgttcaccgcgccaatgaagcgattcatggcgttaaagagcgagtgcttctggttatatgtgtcgcagatttgcatcatggtggccgagcgggcgcggaaacacagggacgctggtacacggagatagaccgctggcgatgccgccttcaagcgctctcagaggctgatgccgggagcctgcttgaagccggtgtgacgggattcccagatccttctccgccctctctaacttgcttctttctcagctcagcccttcgtgaggcccggctgctcttatctttggctcaggattgacggtgggtggctgggtctagcctttttctgcttgggagacagagacgaaaagaacaaattacccacccggttaggatgcccggcatccggtccgcgcgatgctcccaccctgaccaaggctggccagagaaggcacaagggtggttccttgggaccagccggtatcacctcctccaatactagcagaagacctttgaaaaaaaaggagaaaaaaatctcccccatcccggactctctggtttctcccttctaaaacctaagcgaaagcaaccatattagcccgggctgccaaagggcggggacacccacctcttgcactgcgaaatcccctggttctcagtgcttgcgttgcggacggtggctgcccaagggcgctgctgcggtcactgatcggactgtgagtaagggcgactgtggttgctccggccccctgcccattccaggtgctcaatttatagtccgggaaaggtgtcccaggcgcccaggaccacccctgatgtctcctcctcctacctcctccagcagcacagataaaaggtcccagccctgaccgcgagtaacactcgcccaaccctttctaccgcgggggcggggcacgccgggtggctccgcctctcgcctgatacccgggctaaggcagggcggcccagcagggcaaggcagggtagggctgggaggatggagcggccgcaccccagcaccaaacccagaacaagctgtttgggggagggagggcgaggcactgagcccaaggagccgccgtccaaaccagagggcggactggcgcgcgcgggctgggcgggcttggcgcgcactctccgggtgggatgaccggaatgcttgtgtgtccgggttgcaaaagagcccctcaatcctgaacctagagtgactgcagtccggaaatttagcctcgatttattattagacgtcgggtaagagggattcacagctgccctgactccatacttgggaatcttatgtaagaagagttagcaggacatgccggatgcacgtggacatggggtgctccctccacggcccaggtcgtggtcagctgcagggggatgggaacactgaggcatttgcttccctcctggcggggtctttcctactactgctgccaggtatgaagagcaccctggtcatctgatctatagttttgtgtcccccaccaagagataagagcatggcaatggagtgtgaacttgggccttgtggcccttttggctatcaaaaagactaggagaaggtggcagaagttaggactggtgttgggtatatcttatcatttaaagaaaaaaaatgggagtatacccaataactttctggagtgtgtgtcaagtgctcctttcaaaagatagttcttaagcaagggttacttaataagcctaagctgtgtaccatagccctggatctacctttcaagttttacacttgaaactcctctttcaggttcccagccctgagcccatactcatttcccatctcatttcctttgccacatccctcaacctccagtcagctcttccattcctccagataagatgactcaggcttctaattttaaatttcttcccactaaagtcttcggggggaagttttagtatggcattcccctgcaagacaaaaaagcgccccaaacaaggagagacacttatgcatgtgggtttgtttgtttgtttgttttttcttgaaggactggtactgtctaccgaaaatcatgtctcttttcaattttgaagggaacaagagctgataacagacagaaaagtcattggtaactctagaacccagactggcaaatctccatctccctctggtttactggttctagatcataacccatgcttccaatgctttcttatgtatgtatgtatgtatgtatgtatgtatgtatgtatgtatgtatggagacacagtcccagccagccagccagcttgatttggaacgacagctactcatccttctgattcagtgtcccatgttcttttaaacatgaaataatgtttgttatctgccccgtggagctaaggagatcagtggaaagaagaatgtagatgggaaacatgcattgtgtaaacctgacacataacaataacctcagcctttctcttcttatgcccagatttgaaaacttttccaccctctgtttgtcaacaaaatggagtgtctcccatgagagaaaaatttccagtgttgctttagcaataaaaaggaacttcttcttgggctatggcaaagggttctattagggttcaatgaggtatcggcggtaaaactcttcactgtgtacactgtaaagtacttagggcttcatcacagtttagaggcattttctgccaagagtctgaacccttaaaaatagggaaataggctaagatgaaccagagaggacctcaccctcacctttaccacttcttctgcacagaggtgttcaaaacagtccaggcttgttttaacccttatggcagacaagagccaaggaagagagctttagaaaaacacattacctggttaccagtagttgatgtttctcataacttaaaatgtagtttgaccccttctgagacccagaccctctggatattttaagtatgcaccctaatgaaaatttggaattgctttgggttattaaatgctggaatcctgccttcttttctctaacagctcccagaaaacggaaatcccaactgcctagtaaaggcatcccactttgaaaattagctaagccgtggagaaagcctctagccccttccctttggcctccatccttcatctggatcaatttccttccttctgcttggatcttctagtgtcttgactctcggttgctgttcttacacatttctaaaactctgccaggtaatggctcatgcacctgccggcaaaacttcccaaaccgggcctcccagctcccccctgcccacacaataactcacacccaccgggtaacttcagaacgaaaaggtcctcaggccagagctccgggcccttggaatcaccccatcgccacccttcttgccccagccaatcagaaagcttctgagagacttatgcaaatgaatttttggccctagccagtcagaagccataaacccctccccccaagtgtcctctttcaccctggccctgaagagctaatggcaggcgtccctggcaaccggcctgcagccagttttctcctaaagcaaggctgtaaaaaaaataaagaacgattccgggggtcacatgggtactaaacgggttgggccaggcccagtaaaaactaggcagcttctctggttgctccaggcaccttccctatctcgatctggaattgacagaaagctcccagcgacctgtccaggattccttttgcctaaagagaaccctagtaacgatcagttgagtaaatggcttttgagtactgacttcaggtgaggcgccaaggtctctctttttctaaccagcgtgctagattcctgttagaagcctggtctgagatcctgcatcccctctacgttgtcctaagctctaactgagaagctcttaaatgctgaatggtagaatcccttctttaatcagtaaccaggaagtgatgcttgactggctcatcatccccctgtaacccccccccccacctcagtcaattcgcaaattacccttcctgttgcgtctctttgatggcttaggagaacaaggcattttagaggcgaacagaaattgcaaagcaaagttgtgagcaaaagtgaactggtggaagaagaaggaatgaagaaataaaaaggtctggcttggggttggacagaaagtaagaatttaagactagaaaccgcccccaagccaagacaaaggagagttttgatcacactgatacaaaacttagaagcaatatcttcatgaaaactgttctggaaatatgacatttgcactctccctttaaagaccatgtagtccaaccttctgcttgtattgaaattgctcacaacatctccaccaagtggtcacccttgcctacgttttgtgctttccatcctctggtatcaggtcaatggttttagagctcttcagaaagtcttgaagcacatagaggctggcgtgtgagtctagcagtggtctccctgagtccactccatctcaagtcagttaccttcagttcttgtaacaaattcatgctttgggttgagctcgtcctggtcactgtctttggaagttgtttgggcatgtctacaagtttcacatctggacctcattccaagtaccacctttcctgggacaaaaaggagtggtgaaagcacctattttattgtaaatggtaacttttctagacctaattctccagtgccagatgcaatgctcttttactacgcaacaaataaaaacttcttagaatgctgcctagcatttaagggacttgttttaatggttaggttacatttatatgttgctgtatatgcaacaaaacttgtgtatcctattactaagtagaagagattttgtggaccaaaatacaaaactttctattacttttacctaagtagattttggatcattacttcagcatgtttcagtagtttgaattctgattttgtgctctattacacttggatattacctacacatttgttaactgttcactatattcatccaaactactggtaatgggtaccagtgagtactgtacaaagagcaaagtgggattaaacatctggagagctccttcagagggatatcaattcattatttagtatttttggcgtatttttttccagtcagctatgaatcctgttaattataccaagatccagaagacagaatagtatgagcaaacttgctaagtgttctactgagctctcacggtaatgaccaccttccttcttatagagttagagaatatttttgtagtgttacagatcaaccactgttacatgatatatgaactagaaataggggctggagagatagttcagtgattaagaacatttgctactcttccagagcacccaagttctgatcctagcacccacatgaggtgatttacaactacctgagactctagctcaagaaggattcaatacactcttctgacctctgtggatataaaataaataaaacaggaacagtgtcatggcagaaattctgagtatagggaaaattatatatatatatatatataatattaataatatattatatattatttatattatattaattatatattaataataatatataatatataatataatattatatattaataatataatatatatattatttatattatattaattatatatttatatatatatatatatatatatatatatatatattcgagacagggtttctctgtatagccctggctgtcctggacctcactttgtagaccaggctggccttgaactcagaaatccgcctgcctttgcctcccaaatgctgggattaaaggcgtgcgccaccacgcccagctgaaaacttacagttttaatgaataactttggttttgttcttagcaattctatttatttgagaattctacgtagataatgatacattaaattttaatataacaggtaaaaagaagggcaaaacctgttgtaactttttaaaaataccaaataggaacttttatatgcatacctatatgtgtgtagcaataagttatgcaaaaagagcccatgaattcaaaagatatgggagcactttgagagagaaaggaaagatggaaatgatgaaatattatacctcccaaaaaataaaagaaaaaaattaaagcaataaaataaacttaattatttagtttcttcaaatgccaagatccacttaaaaaaaaaaagaacaacactcccccctcaaaaacaaaaacaaaaacaaaactgaaggactggaaggggacagcatttggagcttaaataaataaataaataaataagtaaatacaatgagaacgttcctctttgaaatcaaattcatagtttaaaagtatgtaacataaacttaaaataggaagcaaagatgaattaattacctacttcacatgatcaaactctaacatcatttgcattttattgagactatattgttataaatatattacccaatggacactttcaaatgtcccatcagtaagtatcttatacagtatttatttttctgactcaaataatgaaagaaacaaaacctagatgctataatctagagacttcatctatattttattatactgtccagatagaatgtgtaggctaatctcataatcatgagtaagaagcaaaagtaatatgcaaaattaataggctgaaattgatagtaaataaattatataagtctgtaaaaaaagtgtgactcaaaagaagtaataactatagaagattttgataaaaataggaaaataataaatccttaggaagactcataaaatgaaattgccaagttaaagaaaaaaacttgaattgaaatattactagaaagctaataaactaagtagcaacaacaaagaacaaaacaggtctgccatccttgtccacatagagagcttcaggccactccagttacatggtgggactgtgtctcacaatgaaatctacaataactaaataacaatgacatgatgatgtttcttcagcaaggtgttagatgcttgtcaaatggggatgttcaacttgtgaaaatgtgtcagactgacacatttgattgattatttcctgcatatatgttatgcttgattttggagagccacttctaggaatttggcaagaatttgacattgggctggggcaagaaagtaggctcaattaaatacagccaaagaatggatgtagtattccttttatcttggtcatcctgataaacccctagacttatcagtggtttcaagacagggtttctctgtgtatccctaagctggcctagaactcagaaatcctcctgcctctgcctcccaagtgctgggactaaaggctgggcccctgtgctaggcgtgtactttagtggtacagcacttaactgatttgtatgagattgtatgttcaatcttcactaccatagaaagaaaattctgatttttattggctcttggatcttagtgttaaagaggtgacattcttgaaggtgatcctattaaaggaatgtttttctataactccctaaaatctatttctaagtaatcatttgtatagcacatttatgcatggatactcacctttgtcattctgattgatcgcttatgattggaaatacttaaaaatatctcatattgggtattctttttgtaatctctctccttctaaacctaaaaatttaaaggagtacattagttgagttgtctccctatgccttcctatcttccctgaatctgatcagagacctatgttgtctatgtaagcttttagctaggttgcacagattttcatagccaattagcttgcaaagattgcattttgtgtcagcattagtcttgagcagtacaaaatccaactggaacatatgatcaatttctttgtctcctaaatgataccacaattactagaaatttggaaataaatttatgagtatgccattaatgggtaccttgattttgttctaattatcattttgttcctggaaaaaatattaaacaaggaaacccatttttaatttttaaaactctgagtgccatgtgtaatttcatttggtgcaaagtgagcgattatcttggccagaattataacaacactcatgtgtggcataatttgttcagcagtatttgttgtaaatatttatttagtactacatggtatccatagaaatgaccccttgatttctcctagaatggactcaaatgtctttccaattctgatttaaactagtttcaaatctaagcaggattgctgaaatgatttatgtagtaattggatctaggtttttagaaagagcaacctttgattagcttagcaaaaatatctgttaagtaagaggggaaaaaaaaccgagaatactgtggccagatattaaacacatcagtcttatttcgtctcttcctttaccagagggggattatctgaatcataggctttaggatgcagaattccaattggaactattccaaattgaagattcttgagactctgtgataggttttaaattaagaaatccgaagccaaggtttagtgtttgttcattccattctcagggtgttttatttttttttccatttaatttcaggcaacacattctacttcattatatacaagttgaagcaaatttgctgcctttctaacagccagttcagctgctttcataatgtagttcttgacctactgctgggaccataacttccatacattcaaccaattcgttcaagtgtttcacatttctttggactatttgtgtaatgcctccctggctagcaaatagaatgtttgagatattactacctaatgccatgtttagtcaaaaatctattttttatttgtttaagtataagacatttatttgactctctttgaaaacaccattctggagtgtatcttctagaccataaacagtggatgtcccctccccttctctctccaatccatatccttcgttgctccttttctatcttctcttctcccttttcttcctctattatctattttctttcctcatgggcccagaaattaaaatggaaatgttatatactttgacttcctagttatttggaatgctgttcaataggctcaaaaaaacaaaaacaaaaacaaaaacaaaaaaacaacaaagaaaaccccaaggagtaccaaggaatacaaggaaaattgtgttcacctatgatataataaattaagagaacagaaaaggactcactatacaatctacatttttttaaagatttatttattattataagtacaatgtagctgtctttagacacaccagaagaggacgtcagatctcattatggatggttgtgagccaccatgtggttgctgagatttgaactcaggaccttcggaagagcagtcagtgcacttaaccactgagaaatctcgccatccctctacattctttttttgttttggttttggttttggtttttcgacagggtttctctgtgtagccctggctgtcctggaactcactttgtagaccaggctggcctcaaactcagaaatcctcctgcctctgcctcccgagtgctgggattaaaggcgtgggctaccatgcccggctctacattctttttgtaaaaagatttatttacttatgtatatgcattctctatttgcatggatgcctgcatgacagaagagggtatcagatcccattatagatagttgtgagcaatcatataggtgctgggaattgaagtcatgacttcggggagagtagcaccaagccacctctccagccccaattgtgcattcttttaaagactactgttgtatttattgtgcttatccatttattggttttaaagtcattttgataaagtttcattgtgacacacccacaaaaaagaccatagaaatttctgagtaattttatgtatcaaaattaattttatgtatcaaaatctacttctctagtgaattttctatttacttggggtgaggggtggaagtgtttcacccaatgtaatgtaaaaagcaaaaagtctcaagtcataattatttgtcacccttccccagccctctataaactactatcttttctttcccttgtgttctcagaagccagctgtacctcttgtaaaccacaattccttaccttacagggttaatgaaacatgcgaaggtgtggtgatttgaataagaatggtccccataagatcaagtctgtggatgcttagttctcagactgggactacaaagaagaattagaaggtgtggccttattggaagaaatctgtgggccttggggtttcggaagcccaaaccaggcccagtggctctgtctcttcctgctgcctttgaagccactcagctacttctcaaacatcatgtcagtctacatactgccatatctcaacaccaccgccatgatgacaaacttctgaaactgtaaacaagtcccaaggaaatactttcttttatataagagttgtcatggtcatggtgtcccttcactgcattagaaccccaagtcagtgagatatatttcccatagaatacaaagataatggtagatagtaaatgtaagggtgttgctggctgagattttgtgttgtgctaatatatactatgatatactgtatatgggaactgtaactgaaaagaaatacttatacttttgtagcttatttgtgttttgtacagtaagacatttcttgggaattgtattcaaattgtatttttttctaatttgaaattgggggtggggggagcttcccaatgatattgctaaactacctttctttagccaggctttgccttctacaggttcaccctcccaaaacactgctaccagctggggccacgtgttcaaattagatcagtcagtggaagacaggccccattcaaactatactcattctttccttttcttcccctctttcattccttccttcctttctcactttctatctttcctactctcattaagtctcttacttccatgcaaactcatattctttattattgttgttattgttatatttttattatttaaaacaatttttcagtttaaatatattttgatcatattcttccccacccccaagtcttctccccttcccaaccaactttaagtgccttcttgaaaaacaaattaaaagtcagtacaacaacagaatctctccaaaccaaaaaaaccaaaatatgatttctcttctcccgaaaaaacaccaaactgtaaccaaataaaaacgtacaaaaaaactgtgggatcc

SEQ ID NO: 243 - DNA, 11646 bp, mus musculus; identical to SEQ ID NO: 242

SEQ ID NO: 244 - DNA, 387 bp, mus musculus
tctccaaagaaagttggcgatgacattgccaaggctaccagtgactggaaaggtctcagaattacagtgaaactgaccatccagaacagacaggcccagatcgaggtggtgccctctgcctctgccctaatcatcaaagccaccaaagagctaccaagagacaggaagaagcagaagaacattaaacacagtgggaacattacttttgatgagattgtcaacattgcccggcagatgagacaccggtcttttgctagagaactttctggaactaccaaggagatcctgggtactgcacagtctgtgggctgcaatgtggatggccgacaccctcatgacatcatagatgacatcaacagtggtgcagtggagtgcccagctagttaa

SEQ ID NO: 245 - DNA, 387 bp, mus musculus; identical to SEQ ID NO: 244

SEQ ID NO: 246 - DNA, 23616 bp, mus musculus
aaacttatcctcacagaagagtgagccataaccaacccgatgagaagactgtaaagactggagaatattcaaagaagaaaataagagatcaccaatttggtgaacacaagactgcctctacatttagtgacacaactttgcttctgaacaaagccattgacacatctgctcctcctggtactctctgtccttacactgtgaatactgctccagatactaacactgataacaatacttcagacacttactctctgaatactgtcttaaacagttgcactattgacagtgctccaagaaacatggctgacaataatccagacactaatcctactaacagaatcactagttcttctgctcataccccaagcatttctacctcaaatgtgggcttttacactgacatcaataacaatattataggcccttccataagtaattacaatcaagtcacctatgatgaaactcacgaaccaccagatgctaagagtattccaagctgtacttctgagaatgcttgcaacactttcttctcaactaatgatggcctcagaccttctaatgttgccagcatttctgaaaacgttcatggagagacagaggctaacatgggagctagagacaataagcagatattaggtgaaaaccaaaagaagagtcagtcgtcaaatgcatcactgaaaggtaaacacaggaaccccattctgttgtcaatgagggtacaagccaaataatttggactcacagtgcattttaaataaatttttattatacataattatctatttatatgtgtatgtgaacaagggagatcagaggggaacttaggggagtttgttttctcctttcaaagatgcaggtcactggttcaaactcaggttatagtgctttgtagaaagtacctttactgtccaggtcaccttgccagccaattcaaacttttagagtgccattctctgcttctgtttcccttcacatccactttttctaatttatttttaatgtattattaattgacatgtaataagcctaaacttataaaatgcaatgagacattttgataaacatttatatacgggatatataaatataatttggaattagaaaatgaagataactaacatccatcatctcacttatcgattaggattggatttttcttttcttttttatgttgaaacatatgaaaatgtatgtccactgtattgaaatataccttataacgactaagtcatcctgctgttcaataactccaaacacctattccttctacatgaattttatttcctttgatcggcaattccaccctgctccgatttcctgattattatgtttcttacaactttacctaattcaacatacaagtgagatcatgacgtttaatatatatgttcactgggttctgattcaaatctttaaatacaaatttaattgggtcttactagatttcatagtgatgacatatttgcagtctgatctaactcttttctcttgactttcccaaaatattatttttgtttgaggtcttttttcttacttttagaacacaatacagagtacagaacacagccatgttgttttgccattggaaaacctgtggtatgtaacaaaagtaaagatttcatgctcttccatcttttccatctaaaccctccaaattcatttctatttttaaagcatttactgtgttgatattttcatactcttctgcagcaatgcaataagatccagtgtggcatcattaaagataggagtggtggctaattagttaatcatagtatttaagcacctaatatgagaattggagctagtatgaaacaactaaagaaaagtttgcatttaaaagtagagattatgacttttaagtatactgcttgcattttcttcattttaggtttctaatattcaaacccaatctgctactgtttcatggactcagaagtgtaacaaaaaatgtgatattaattcttctatgacatatgaattggcactgtccagcaatggtaaaaatggaccctataaaaacatttatatgtaagtgtttttaattatcttgcattatttaattcaagcatacaatataaacatatagtcactgtgccccaacttgcacctaggctgaattcctcattttctcctaaattctttttgacaggagtgggtatctagtagtaacttaccaagccaatccacatagcttattaaaatcatggtatgtattcaaatatctactcatcagctaggcagtggtggtaatcacctttaatgctagcactcaggagatagaggcagggtgatctctgagttaaaggccagcctggactacagagggagggccaggaaagccagggctacaatacagagaaacactgtcttgaaaaacctagatagatagaaggatggatgaatggattgatacaattttattttgataatttttcttcttattcagagactcgatatgaaaatgtaaatttatgcaaagttttatttctttgataattaatacttaaagttgtgctatctaataatcttagccaacaatcctctatgctgtgtagcagagatggggttatgcaaaattggcttgcatggaaatctttctctggtatgtcatgtattttatgagcaccactaccttaaaaagataaacaagttagctttcagcattgtgaggaggagagggaagaggaggagctacatcaggaggaggagactgcctatttgcttccacctctgattaccctttgctcaaaagcaaagtagcctttgattaaaagtatcactatcttccattttagagatttctttttaggatctagagctctagatgtctttgctcaggaagacatagctgtaggaatataatccctctgttcgtgtgacagacaggatctcacccagaaagttcttcttaaactgaataaattaattgtatgaggcatgctgttcttctaaagcatttggtatctacacacttttgaataagctacttaagaccaaacctaaactattttggttaaatatatacagtaataaaatgcaaactggatagtttgaatgaatatggtataaatatatactgaatgaagagacaagacaaactcagaactacctggtggctgctttcctgatgactactttgttcagctccttcagcttcctcttggtgcaggtgtgcagatgagtagtagagtggatttgcagatgtgtatccccaccctctgaacttgagccttagagacatagagcagttctgtggtgtgtccactagatggtgagatagtaaaaaccacatagctcccagatcataccatccctcaaaaacttgatatgctcctcaatggaggctgcagcctactaagaacattactttgacctcatataaagtggtttaaagtgattgaaactttcagaagaattatggttctttatcagttgttcagtaattatgagactaaaacagtgtactttgctttaaaatgtgtgtgagttcccatataaacttagtttatcttcacagtagtgttggcattactgttgtcctacatgatctacaaccttgcatggtctactttttaaggtcagaactctgtcccacacaaccaaccaccagcctgtagctagcagagacttcttaacctatataagtttagtacttagaattgctacaggaagtctagctatttgctggcaaagcacccttgaacactcatgtaagcaaccatagtttaagctcaagaggctagaaaagaaaaaagaaaatagaaagcaggtgattagtttggaagataaaggggatcggggagaatgggaagtgaacaaaagagttttatggggaggtagggagatggtcatatatgaagatgccataatgaaagttgttactgtgtatactcaacatgtgctaacaaaagaacaacaacgaatatgtctagaatacaaacttgtaacttggggcctgaatgaaccaatttctgttcccctttcagagtaacaatcataagaggtgcagaacatagaagtgtgtctgaagtggttagcttcacaacaccaggctgtgaaccagaccctcctcttgctagcagaaccaagaacagcctgagtttacaatggaaagtaaggatttgactgacaaaagaatctcaatgtgattttcaaacactgtcctgtttcctgaatttaaccataaatgatgcatgcttcatctaagttatttctccatcacatctcttcacaatgatctttctgtttagtctaagagaccatgccaagtgacttgagaaatgtcaatactctttggaaaattaataaaaagctaactgtccatttttagaaatcatgttttggtgtcaatcatcccagttacaaataacactatgtctctggttccttatgtatccattttaacatccttttatgcagtctggaaacatgagatatacaaccggggtgtgtcttggagactggaaaatgtgtgttttaaacttaaatcccaattgccataaaaacaaatatccctacacaatttttgcagtacaaattcaacatactttaaatgcattaatgcatgcccagtgtgtgtacgatatatatatgctatataaaaataaaccaacataattttatcattctcaccttttcaggattccaatgaaaatggatccaaaataagcagctttcttttggaatgggatgaggtatgctcatttattattaataagagattttttcatataataaaatctgattactgtttcctttctaccaactccagatccctacaccccaacccacccctatgcaaatccaccctttctttttctctttagaaaacaggtctctcagaaaacatggaagggaaaaataatacaataagatatgactacaaacaaagaaaactgaacaggacaaaacacacaaatgaaaagaaaaaaaaacaaatgatacagcacaaggaacacatgtagacaaagatacacacactttcatacacaccaacatctcataaagacacaaacacagaaaacattatctttaagcaaaatacatgtagggtttttttaaatgacatgcaacacaacttatgtcacacaaatacacaaacacgcacacaaaaaacttcagaattactattgagtttattctgtgttggctaaccactgctgggcagagggtctgccctcttctgtggtttatacacccagtgaggctccattattggaaactaacttttttgcaagctgttaacactctgggttacggtccagttcccttgcgcagggctgggatcccattttgcttatacctggtacaaaggaatttttaaaaatcacctgattgggaatggttaatactatggtgaatgtgtgttaactgtggtatttttcgatatgtcaatattttgtgtgcattgtctagggtaaaggtgaagacttcaaaagttgttacagtggatgcctgaaacagcacaagctctttaaactgagcccttcaacaaagtattccttcagattagctgccaaaaatgactttggctgcaggtacactgaattatttgcaccactggaaaatctaaactgccaccaatcctgaaattaatgctttcatttcaacttattcttttagtaatttcagtgaaacaacagtcttctatacatcaggaaagatgcctacagcaccacttccacctaagttgaaagaagcaggaatctatagtttgtctctagaatggtgtgccccaacaaacccaaacctaaatgacactcttacttatgtgctagagatggaggaagaaaactttgtaagtcttcttttttcccctattttctaccataagcttaacctcatatttcaacaactttttatatttatttctcacttgaaaaaaatcccatccttgagtaccagtgtgcagaacgtaagcaatgcagagccattgttgggcaggtctgcataggcctccttatcccaaaactagctgaatgcaagagctccacactctacccagtgtctatacatagaagcctgttagcatcttcaactacaagcctgttctaggtgactctctgtggccacacatacttttaagttccttcaaaggaattctcaacctgtgtcttctcttcatctagtttcctcatgtgggttagcaactacttcattcattactgaactttcaaatctgtgtacaagagatagtcaatttaaaaagcagctataagttactgtgtccgtgtttccaaaatttaaatcaagcagataacattgagataagttccggtttgtaactaataagtacttacgtccatttgtgctatcttattacatcttgaaaaaatgaacttttgaaaagagaaattatctccaaattttattgaaaatagatttttctctctcagaatacaacacagctgaaccagtttcccctcctccactatcccactcctccaacctgccctcccgcccccatacacacacccctttccatcagaaaagggcaggcctcccaggtaaatcacctgaacatggcatatcaaattgcaataagactaggcacaaacactcctatcaaccctggaggaggaacccaacaagaggaaaaggatctcaagagcaggcaaaaagtcagagacaatgcccagtcccactgttaggagtctcacagaacaccaagctaactaacatcctaacatagatgcagaggacctgatgcagaccattttgagattcaaacccattcaggtagatagaaaattgaagctacaccttgaatctaggctttctcctaaatctttgtcctccattttcagggaataggttttaaacctgcatatgatggagaagacctcacctgcactgtaagaaatctgcagagaaatactacatataagtttcccatatgtggcatgatttataaggtggtattttctcttgaaatgaaaatttccgtggcatttgattctttgaaatccttgtgcagctggctctctacacattactaaaccacacattgatttcattgattacaaaatatctcatttacacaaacagatttttgcttgcaatctggaaggaaggagcaaccccagtggagaagtaaaatatactactcgtccagctaggcctggatgccctaataaaccatatgtagtgggaacgatccatgcacaccaagtgacaattggatggggtaattaaggcttttgtgttgaaactttcccctctccatactagtatttactgctcagaagaaatctgcctgcaatttcactaagcaaaatattctcatttgcatgtgaactatgctgccttataaatgtgtttagtggtaaaccttattattttttctatttcttattgctgtcttaactactcacaagtcaacaaattgttgaacttcatatggatctgcaaataagcttcttccaagttaaatatatttatagctaacataagacccatagctagaagtttgtgtgaaagatgaatgtcagcttgaccagaaattatatttaaatgaatttattacctattaactaggtaaattataattatcccatgtatacttatttagtctcttcataaaatctttgaaatgctatctaaatgcttgatggctagtatcacatgtatatagcttgtttagattatattagcatagagatgtcaatataacaatgtgacacaattataattttctgcaaaaagtataatctatgagataaagttttagtggaaacttgtgttttccaaaaacacacttaaaaaaagaatcatttaaactttatttctccttttagacttacccaaagacaacggtggaatgaacatttcaagttacagcctagaagtttatgaaaattcagatggtggtaaggcaacacaattttttttaatgttgtgatacacttattttttctaattagatatattcttcatttacattttaaatgctatccccaaagtcccctataccctcccctgccccgctccccaatccacccactcctacttcctggcccaggcattgccctgtaatgggcatatgatcttcacaataccaagggcctcgcctcccattgatggccaactaggccatcctctattacatatgcaactagagacacatctctagtatcattgtttacatcattgttagtttacatcattgttcctccaataggtttgcagaccccattagctccttgggtactttttctagctccttcattaggggccctgtgttctatccaaaagatgactgtgagcatccacttttgtatttgccaggcattggcactgactcaggcaagagacagctatatcagggtcctgtcagcaaaatctttctggcatatgcaatagtgtctgggtttggtggttgtatacaggatacatccccaggtggggcagtctctagatggtctttccttccacttagctccgaaatttgtctctgtaactccttccatgagtactttgttccccattctaagaaggaacaaaatatccacagattggtcttcttttcatgtgttttgcaaattgtatcttgggtattctaagtttctgggctaatatccatttatcagtgagtgcataccatgtgtgctcttttgtgattgggttacctcactcacagtgatatcctccagatgtatccatttgcctaagaagtttatgaattcattcttttaattgctgagtagtactccattgtgtaaatgtatcacattttctgtatccattcctctgttgagggacatctgggttctttctagtttctgcctattataaacaaggctgctatgaacatagtggagcatgtgtccttattacaagtggcaacacaaattttaaaagattttacattgaaataatcttacactaatctagacattattagaaaattctacagagtttctctgtgaaacttgcacttgacttcatcaaatagcagtgtctcatgcagatatagtacaattgccaaaccagaaaatctggattaatacacacctataaaccaaaacctacagcacacttggattcctttggattttaataagacattcttatttactggtcacttgcatttttcattaaatctactgggaatgaaattatttaacaaccataaaattattgttggattggggctggggatatggctcagatgttaagagtactgactgcttgccattccagaggtcatgtgttcaattcccaacatacacatggttgcccacaaccatctgtaaaagggtctgaaaaaagggggggtctgatagccgcttctggtgcgtctgaagagagcaaccgtgtactcaggtacatcaaatgaataaataaatatttaaaacaatatttaagatcaagttatttcccaaagtgattgtttcttaacatacatgtaatatgtagattgcgtataagctttatataatgcaaacattaactcttatggtggcctacaaaatttacacattatttatgaagaaattgtaccaaatttctcttcttccttcagcgaatctctggaaaatgatctacaatggcactcgacaggaatttctttatgatgacctccaaccagccaccacatataaactgagagtcttttgcacatcaccttcaggccaaagcctcgtaagaaaacagaataggaaatgttctccaattgagaattgaaataaactgttatattactaaatattttctgaagctcatcttgaatttagtatagtagtaaaatactttgtattctcttagccttcagatatattgacaattcagacgcctactcttcctcccgagtcttgccgttcacagcccttacgtggtaaaaccaagggcaaggatgccaaccttcctggtaagtaaggcttccttatgtgattcacaattgtccctaaacttcccgtcttgtgacttttgctttatgtgcatgtgttaatattagcaagtaccatttccttttagaacagaatggaataaaggttaacaaacaatccttggtaattgacaaccaactttttaatgtctaagtcaaattgagaagttaatggagctttgagtatctagacatgtgtagaattgtcctagctcactgtacagtatgttatattgttttaaacaaacatcactaaaaactaggacttggtgtgaagccaaatgatgctgtgtgtgcttagtattcacaactcacagggttacatccctactaccaaggtaaatttgagcagggaagggaaactgagtgcattttacatgttttgtagacaatcattctgttaatgggaagctggaagcacatgtgtgtgacaaaaaagcaaaaggtcctcatcaggacagaaaggcgtaccccagctctgaaaagaaatgtgcagtaagtaaactaattcccgaagaacccattcattctggataaaaacataaaacacaggtgagaagggatcaggagagatgtgatgtaaacagagaaaagagacagtggggcacatcctggccctagactactaggccagcccaaagaggtaccattcaattccccagggtgacaaagtctttgcctgtgagatgcccttggcagtgaatggtagcatccccttaagaaaatatgaatgcttcacagaggagagggaaaagactgtcattaatgatggtgttggcctttggtataaggaaaccattatctccaaatctaggaaatggggtgaatcatgctataggtaggtagctatcaagatagatgatcactgcagtgttccaggctgaggattagaccctggcaaatgcaatgagctctgcctgcttaagaaggaggaagtttgcctcttctactcactgaaaataaaagcagttgagattttcatgctatctcctcaaaaatgggaatcaaacaagtgtggggggggtgtctttgagggatctaccctcaatcaaacaatccaggtcacaggaaaggaggtagaattgatctggtgggaaactttaagggactcatctgctgtctctgagtaatggtgaggtgtgtctttgtgtcacaagaagggtattgtctgtagctgatagcagagtgtcagggatactgaagggaacaaactgtccagaggctgcagggtagagaaaactgatgtgacaagactggaagcaaaaggacgaaatagaggagaggacaggaaaaaacaacttagtaaaggatagattgaaggctatgatgcagagcaggaagagtcattgcctgaagggagagacataagactccagctcagatattttccacaggctgggggtaatcagagcagttgggatagaatgcctaaggcctggttgctagcactgaagaggtaaaggtgagaagcacttgggaaaggaagctcccttgagatctaacagagtgaagggaggttttgagggggctgtggggcatgggggcattcagtgtgagaccaaggttcatctgcactaaaaacaatagacagaaatcactaatttctgcaggaaaacagcattcattttacaatcacagaacaattttacatatgtaagtgtgtacaaaagaaatgagactagtcctcaaaaaccacaatgtactaaatttgagcctaggtgatataaatagccctgtagtcatgaaagaaaattactctctatatgaaaaccacttagaaatacacagtcccaaagagattcaccagagaattttacaacccatttaaagataaattaacagcaagtttacatcttccttgccagaaaatagaaactaaaataaaaccagaaatcaagccaagcaaaatggcatgtacatggagtctcaggtaggtactcaaggttgaaatgctaggattacttacactcacaggctttggtccaacctggacaatataccatgaatgtctatcttaaaaattagtgaatgagagagagagagagagagagagagagagagagagagagagagagagaggaagaagaagaagaaggagggggaggaggagaatgaggaggaagaggaggaggaaaggagggaagggaagggaagggaagggaagggaagggaagggaagggaagggaagggaagggaagggaagggaagggaagggaagggaagggaagggaagggaagggaagggaagggaagggaagggaaggaaggttggtttgacagttagttcacctgttaagatcactgactcttttccagaggacctgggttcaattcccaactctcacatagcagcttaaaatggtgtggaaccctagtatcaaggatattacaccttcatttaggtacacatgcaagcaaaacaccaatgttcatgaacagaaacaaatgaacttcttataaatataaataagtattaaatttataaaaaagaaaaattattaaaaacagacttataaaaaataagaggaaatatttatgacttctgtctaggcaaacacttgttaccaaaagcacaacccatataatggagttatttggtgaatttgattaaatcaaagcttaaaacttctacttctctaccctctaaacaggatgaaagtgaaattaaaggctggaagataatattttcaatacatatatatcttccaaaggaatagcacctaaaatatataaagacctctaaaattcaacagtggattgaaacatgtcacttaggaaatggttaagattagtgactgaagagaatatacaaatggcaaataagcacaagagaagatgttcagcagcatagactattagggaaatgcacaatgaaatgcctttccatatcttacagagtgcctaagctaaggagtaatgttaacaccaagtgctctcaaagacatgagaaaaatgatcattcacacattactgatgagagctgttacccttcctgaaaagagcacagtagcatcttatgtttatttgtaggacacagaaactaaaaatagctcaaatatctaccaataagtggatggtttagtaaacagtgatccatctgccctgtgacatagtgttcagtaatgaaagtaaacaaattattaatatatacgatagctgaaagtctccagggaattgcagtaactgcaaaatgagcctgcatctaagtttatctcttgcatattcaatttatgtaatattctgaaaatgccaaaattgtagtaatgatggtgagcaattagtggtctccagaggttagaagatggacaatgtaggaagagacgggctataagagaagcaaggggaacctgtgagaaaaaaaaaaaacttaaaattgaagtagctgtaatcaccgaataaaatttacacatacaagtaagttcacacaattctgaataacatcaggggggtttatcaatggtgatttcctggccatgggatgggactttagagattgaaaacattgtcttcagaaggaaataggtacaggatatatgtgtatttatactctcaaaacaacaacaaaaataatgctttgccaagataacagaaattgattaactgggtaacactgcaacagagatactgaagcgtgaagaaaaatagggaaagcttagtgaagtgacaggtgagttcttaaggggagtaatgatccttaaatgcccacttcaacactcttgactttctttaccttgtgtgctctttatacattctgaaaaatgcagcttgcaagtctcagcttttatttctgtgacacaaaaccatatgattagaatatgtgacagagaaccatgtggttagaccatgtgtatatgagtcattgttttcacatgcaagaaaatggtccatgcatggaaaatggttgaaaggaattgttaaccaagcatgcgtttttcaggctgtggatacagttggggttggaatgtttggaggaactgcaaaagtgactacatctggaaccatcccagcaagggtctctgtgttacaaaaagttgaaaacagagtgcctgccaagctgtcatcaacttgcatagctatcctgtgggaggaaccagactgtcatggctctcctatcactggatataacattgaatatgaagataaaaaaattgtgactgtcaaaagaataaccgagtatgttctgaaagatctacaacctaatactacatacaggttagtcactcatatcttattttgggtaaataaagagactgttgagaattttgagcacagacacatttgtgtatttaatacacacagatgtcccttgaaaagagttcttaattggtgaaatttgatagcagtaagagccaatgtctgcttttcatcaataattctcagtagtaggtatgtcttggaaatctgtcttgtgatcaggatgagcatcattctaatatagatagagtgggttggcttatatgaagaaaataatttcatttattgaatattaattcatacatcttacttttaccaatagcatcagaattcaagctatcaatcattatggactaagcccttttagcccatcaataagatgcaaaaccaaaccactaccaccagagcctccacagcttaattgtgtggtctatggacaccagagtctcagactcaaatggggcactgtctcaagcaaaaaaacacttgcctactttatcaattacaacttactaatggaagatcgatctggcaggaaactacttttaccatttaaaatctactgcagtaaaaagcaatttaaattgttgtatcttgtcaggcatgttctctctctgtccctttgtctttctgtctctgtctctttctgactttctctctgtgtgtctgtctttctttctctgtctctctgtttctctctgtctctctctctctgtctctgtctctgtctctgtctctctctctctctctctctctcacacacacacacacactcaaccaccttgatttctattggccttttgtttggtttggtttggtttggtttggtttggtttggtttggtttggtttggtttggtttggtttggtttggtttaccttactggcttaatttgccttcctgggcttaactgatgattatattgtctccttaatctttatcttctttctctcagattttctgtcttttaccgtgggccggatgtgacttacaaagtacaaatgttgagtgagtatacagaatacaagtttaaaatccaggcatgtaatgaagctggggaaggaccagagtctgacatctacactttcactactacaaagtccccacccactgcactgaaaggtaaatggtatacaaagacactaaccatattactggtgcttccatggaacatgaattgaattgagcagtaatcagaaaattctggagtaagacaggagacctggctcagaaagacagatgccatgtgtactatctcatgaaaactcttgcttctaaattttgttccaggggagccaatgcccacttctgacctccactggtaccaggcatgaatgtggtgcagacataccatatatgcaggcaaagtatctacacacataaaataaacaattttaaaattacatcttaaaataaaattagcagtagtaatttttaaaattcgtaaataggaaaattccacaaacaatatagtacttaattagagatttaaagggcaatgtaagattcattaagatttcaggcccgatagaggtggttcatgtctttaatcccagaactctggagggagaggcaggtggctgagttcaaagccagcctggtctacaaattcaggactgccagggctacacagagaaaccatatcttggaaaccataaaaaatggtttaataaaactcccacagtcagtattattcaaatgtcttagagatctccacttattccaaccctaccaattttaagagtgagacatggagcagaagagatatctctgaggtcaatagtaattgttattgtttttaaattttttcttttttatatattttttattatatactttatttacatttcaaatgttatcccctttcctagtttcccctctgaacctcccctatgccctcctccctccctctgctcctcaacccacccactcgcattcccagtcttggcattcccctatactgtgtcatagaacattcacaggacctaggacctctcttcccattgatgaccaactaagctatcctctgctacatatacaactagaggcaaaagttccaccctatgttttctttgattggtggtttagttccaaggagctctgggggtattggtaagttcatattgatgttcctcctatgggacttcagaccccttcagctccttcgctactttagctccttcattggggaccttgtgctctatccaatgaatgattgtaagtatccacttctatatttgccaggcactggtagagaccctcaggagacagctatgtcaggctcctgtcagcaggctcttgttggcatctgctacagtgtctgggtatggtggctgtttatgggatagaacccaaagtggggcagtctctggatggtcgtaacttcagtcactgctatgaactttgtctctgtaactccttccatgggtattttgttcccctttctaagaaggattctgagcttctgggctaatatccaaatatgagtgagtgcatatcatgcattcctttgtgattgggttacctcactcaagaagaaatcctccagatccatcgatttgtctaaaattttcataaattcattgttaatagctgagtagtactccgttgtgtaaatgtaccacattttctgtatccattcctctgttgagggacatctgggttctttccagcttctggctgttataaataaggctgctatgaacatagtgggcatgtgtccttattacattgttgagcatcttcttcgtatatgcccaggagtggtattgctggatcttcctgtagaagtatgtccaattttctaaggaattgccaaactgatttccagagtggttgtaccatcttgcagtcccacgatcagtcgaggagtcttccattttctccacatccacaccaccatctactgtcacctgagtttttaatcttaaacattctgactggtttaagggggaatctcagggctttgatttgtatttccctgatgattaaggatgttgaacttttttttaaggtgcttctcggccatttggtattcctcagttgaaaattctttgtttagctctgtaccccataggtttatttggttttctgtagtccaccttcttgagttctttatatatatataggatattagccccctatcagatttaggattagtaaagatcctttcccaatctgttggttgcctttttgacttattaacagtgtcctttgccttaaagaagctttgcaattttatgaggtcccatttgtcaattcttgaccttacagaacaagccattggtgttatgttcaggaatctttcccctgtgcccatatcttcaagggtcttacccactttctcctctatatatttcagtgtctctggttttctgtggagttccttggtccactaggactaaaactttgtacaaagagataagaatggatcaattggcattcttctacatgataactgccagttgttccagcatcatttgttgaaaatactgggtttttttcccccactggatagttttagctccttggttaaagatcaagtgaccataggtttgtgggttcatttctgggttttcaattctattcctttgatctacctgtctgttgctgtactagtaccatgcagttcttatcacaattgctccatagtacagcgtgaggtcaggcatggtgattccaccagaggttcttttattgttgagaatactttttgctatcctaggttttttgttattccagatgaatttgcaaattaccctttctaactcggtgaagaattgagttggaattttgatggggattggagtgaatctgtagattgcttttggcagtatagccattttgactatattaatcctgccaatccatgagcatgggagatctttccatcttctgagatcttcttcaatttctttcttcagagacttgaagttcttatcatacagatctttcacttccttatttagagtcacaccaaggtactttatattacttgtgactactgtgaagggtgttgtttccctaatttctttctcaacctgtttatcctttgtgtagagaaaggtcactgatttgtttcagttaattttatatccagctacttcactgaagttgtttatcagctgtattagttctctggtgaatttttggggtcacttacatatactatcatatcatctgcaaatagtgatattttgactttttcctttccagtttgtattcctttgatctccttttgttgtctaattgctctggctaggacttcaagtactatattgaatatgtagagagaaagtgggcagccatatctagtccctgactttagtgagattgcttccagtttctctccagttagtttgatgttggctactggtttgctgtatattgctttttttatgtttatgtatgggccttgaattcctgatctttccaagactttaacatgaaggggtgttggaattttctaatgttttcacagcatctaatgagatgatcatgtggtctttgtatctaagtttgtttatgtagtgaattacattgatggatttctgtatattgaactatccttgcatccctgggatgaagcctacttgatcatgatggatgattgttttgatgtgttcttggattcagtttgcaagaattttattgagtatttttgtatcgatattcataagggaaattggtctgaagttctcttttttgttgggtttttgtgtggtttatgtatcagagtaattgtggcttcatagaaagaattgggaagagtatcttctgtttgtattttgtggaatagtttgaggagtattggaattaggtcccctttgaaggtctgatagaactctgcactaaacccatctgatcctggcctttttttttttttttttggttgggagacaattgatgactgcttctatttccttagggtatatgggactgtttaaatctttaatctgatcctgatttaactttggtaccttgtatctgtccagaaaattgtccatttcatccaggttttccagttttgttgagtataggtttttttttttttttgtaggatctggtgattctttggatttcctcagattctcttgttatatttcccttttcatttctgattttgttaattaggatactgtccctgtgccctctagttactctatctaggggtatatctatcttgttgattttctcaaagaaccaggccctggtttgtttggttctttgtatagttcttttttatttcacttggttgatttcagccctgagtttgattaattcctgctgtctattcctctttaatgaatctacttccttttgttctagagctttgaggtgtgccttcaagctactagtgtatgcttgctccagcttctttttgaaggcactcagagctatgagttttcctcttaggactgctttaattgtgtcccataacttaggttatgttgtagattcattttcattaaactctaaaaaggctggaatttctttatttcttcctagactgagttatcattaggtagattgttgttcagcttccacatgtatgtgggctttctattatttatgttgttattgaagatcagccttagtccatggtgatctgatagggagcattggattatttcaatatttttgtatctgctaaggcctgtttggtgaccgattatatggttaaatttggagaatatttgatgaggttctgagaagaaggtatagccttttgttttaggatgaaatgttctataaatacctgttaaatccatttgtttcataatttctgttagtttcactgtgtctctgtttactttctgtttctaggacatgtctattgatgaaaatggggtgttgaagtctcccacttttattgtgtgaggtgtaatatatactttgaatattagcatttttctttaataaatgtgggtgcccttgcatttattaaatgcatagatgttcagaatggagacttaatcttggtaaattttagctttgatgagtaagaagtgtccctccttatcttttttgcaaactttaagttgaaagtcaattttactcaattttagaatggctactccagcttgtgtcttgggaccatttgcttggaaaattgttttccagccttttactctaaggtagtatctgtgtttgtccctgaggtgggtttcctgtatgcagcaaaatgttgggtattgtttatgtaaccagtctgttagtctatgtctttttattgaggaactgagtccattgatattaatacatattctgaaaaagtcgttgttgcttcctgttatttttgtttctagagctggaattctgatcatgtggctatcttctttaggtttgttaaaagattactttcttgctttttctcaagcttagtttccctctgtgttgaagttttccctttattatcctgtgtggatttgtggatagatattctgtaaatttggttttgtcatggaataccttgtttttttccatctatggtaattgagagtttttctgtgtggagtagcctgggctggcatttgtgttcttagggtccgcataacatctgtccaggatcttctagctttaatagtctctggagagaagtcaggtctaattctaataggtctgcctttatatgttacgtgatcttttccccttactgcttttaatagtctttctttgttttgtgcatttggtgttttgattattatgtaaggggagtgtgatggtttgtatattcttggaccagagagtggcaccatttggaggtatggccttgttggaataggtgtgacctggttggagtaggagtgtcactgtcagtgtgggcttaagactctcaccccagttccctggaagtcagtcttccactagcagcctttggatgaagttttaaaactctctgctctgcctgcaccatgcctgcctggatactgccatgttcccaccttgatgataatgaactgcacctctgaacctgtaagccagccccaattaaatgttgtttttataagatttgccttggtcatggtgtctgttcacagcagtaaatccctaactaagacagggagaaatttcttttctggcccaaactatttggagttctgtagacttcttgtatattcatgggaaactctttgggttgggaaagttttcttctataattttgttgaagatatttgctggcccactgagttgggaatattcactctcttctatacctattattcttaggtttggtcttctcattgtgttctggatttcctggatgatttgggttaggatcatttcgcattttgcattttctttgattgttgtgtccatcttttctatggaatcttctgcacctgagattctttcttctatcttttgtattgtgttggttttgcttgcatcagtggctcctgtcttctttcctacgttttctatttccagagtggtctccctttgtgatttctttattgcttctacttccatttttagatcctggatggttttgttcaattctttcacctgattggatatgttctcctgtatttctttaaaggagttatttatttcctacttaaagtcctccatcatcaccatgaaaagtaactttagatccatatcttgcttctctggtgtgatggtgtttccaggacttgccatggtgggagagtttggttctgttgacgccaagtaaccttggtgtctgttgcttctgttcttatgcttgcctcctggcatctgattatcttaagtgtttcttgccctaagtatatgtgattagagcctgtccttcctgtaatcctggttgattctgacctcctcagagtccagttttatctgtgatcctgtcattccgggctcctgtgaacctgagattctgggtgtgtcagagttcttggtagtcaagcttcctctgagaccctgagatccttatgtgacaaacctcctgggatcctggaatcctaagatcctgaacatcttacagtgcctggaagtggtacctccactggggaccttggggctgtctgctgtgttcgaaatcaaggtagaccagcactgaccagaaggaaccaagcatctggtagtgtgtgtttcctgtgtccttgctcctgctggaacaggcacctcatgatcgttttggaacagatgttgtatttaattcaccagtgatcctaagatcctgggcatgctagggtacctgcagcttggagagtcctcaggagaccgtccacccagttcgtgcccaaggtggccctggactcataagtgctgttttttacgtatggttatgtatttctcatattagtactacatgttcttgtaatgattgtgtgcttgcataagtcttttcaatgtatttgaaatctaaagatttcaaactgtttagaccttctaaactgtcacttttttccccagcacctaaagtatatccactgaataacaactgttgtgagatcaaatggaagtctttggagccaattgaaggtgatcccattgtttactgtcttcaacactggaaaaaaaaaggctaatcaggtatatgctctcaaatttagtcttcaccattttgccaggcatggtaatagtacatatctgtagcctcagcacatgtggggtaaaggcaggaggatacaggtactttttagctaaacaccaactttgaaggtagagaccttgctttaaaaaaaaaaacatgccaggttgtggtggagcatgcctttgatcccagtacttgaaggcagaaacaggtggacctttgatttgagggcagcctggttgaaggggagagtagttataggatagtgaggactaaataaataaaattatatttttatgtccagctgagggttaccctttgggcagggagtaagttattgttaaaggtatgtaaagtaactaaatcttatgccaaatttccatctcatccttaccatttatgtatctaatctttatttggaaacaactagcttatccatttaattaaatcattaccatttaaacgtatagttttttttgatactcactagccacgacccatgattcaaatccacaatgcaattaaactttaaccgttgtagggtatgctatgctttatttaacataattatctaatcagtactgaattcctttacttttgttttgaacaagtacacaaaatatattttcctttctcttgttgtaaaaacctgtccaatgcattattaataagaaagaaaatcataattttcatctcatcctttttccttagatttacaaaggaccgaacacttccttttccttttccaactatcatgcaaattcacgctatcacttcaaggtctgtgaaggatgccgatatgaaacctccaatggtcttcaagagctatgggggccctatagtcccattgctcttttctcaacttataagcaacattctgagcatggcaaaggcaatgaaagtaaaggaaaaggcaaacacaatgggaaagtgggaaagtacaggatagggttcacacttattgctgttttgtgtgctgttgctattcagtacttcctgttcatatag

SEQ ID NO: 247 - DNA, 507 bp, mus musculus
atggcaccgaaagcaaggaaagaagatcttacccctccaaagtccaaggccaagaagacagtcctgaaggccttaaaagctaagaagacaatcctgaagaccttgaaagctaagaagacagtcctgaaaggcatccacagccacaaaaacaagatcagcatggcaagtcacccaccttctggtggcccaagaccctttgactccagaggcagcccaaatacccttgaaagagtgcacccaggagaataaagcttgaccactataccatcatcaaattccccggcgaccacttagtcagccatgaagaagatagaggacaacaggtttgtgttcactgtggatgtcaaggcaaaaaagcagtagatcaaacaggtggtaaagtcactcaatggtattggtgtggccaaagtcaataccctgataaggccttacagagagaaggcatatgttctattggctcctgattatgatactctagatgttgccatcaagattgggatcacctaa

SEQ ID NO: 248 - DNA, 4839 bp, mus musculus
aagggcaatcggaccctttccggtgagggaacctctctccagacatgatcaagagaaactggcgagggactgacatgatctagcttaccttgggtcaccgaacggatttggtttgtttgttctttctctaccccaagaaaaagtcgctagctactgcaaggttttgttttcaaacaaggaacagcatgccaaaagaaagtgctgcgcctacctgatgagcaagggaataatattcttctagaaaacttcttgtagtagtatcaagtctccccttgattctgataaacattgcgcgcgaagtttacactttaaggaggaggccgtttcccccttctgaaaaggtcaacaagctctttcttctcaattcctgtaggataagttggaacgctgttttgaaattctgccaaaacgtttttaaagttcttaactattcattgaaatttggatagaaatgatagtttggtttggtttgtctttgaagtgatattctctgacttgctgtcactatgtatctatccaaggctcccctggaattccatgtcaatcttcctgcctcagcttccctagtgctcatgtggcaggcatgtgtcgccactccggttgacaaaaagtcttttttccactaccttgagactacaattgttttcatgtataactttaactcttagcacagcgctgatttgatcaaaggatttgtataataattgacagtttgaggaaactggttcacttccccaatttctcttagcatcccgttctcaggatgttactttgaacagaattcatagaaacaaaacatgatgggaaaacaagtactatttgaattgtgtacattatttgctttgaaatactcaaatttgaaggttcacattaatgtatggctatagtgggagtttggttttcagactcagggagctcggtgattaaaccacattgggcatagaattaaatttaattcaattcataaacttaacatatccttagcaattcattctgccaatttcttttattgagtaattaataacaacataagagtaaaatgctatggttatctttggtataatcagtatctgaaagaagtagataaaagaaatataaaacctcaggacaaaattgtgaggtgcttactgaaatagtaatttttatagttcaagataatataattaacagctaacctttaccaagtcattactacatattttgcctgctgtaactcatttaatccttaacagtgacctaggagacagtttatatttttctctaccatactaatattaaaaattactactagccaggtgtggtggcacacgcctttaatcccagcactagggaggcagaggcaggcagatttctgagttcaaggccagcctggtctacagagtgagttccaggacagccagagctacacagagaaaccctgtctctaaaaaacaaaaactaaaacaaaacaaaacaaaaaaaccacctgctatatgacttcaaagcacttacatgctattgtttttcttatatgtaaatgataataaataatattcactgtgtttgctaacacacattttttgtagaactcatgtgagaatatatctctgttgtattcaaaaggcatgtgacataattatcccagcgatcactaaaactgtaaatttggatgcaattaagagagaaaactccacacatttatggaaatttaaggtaagaaattacttgtacagaattaattttatttgtatttattcatttattgtgtatgtgcaggggcagagtcacctggcctccaggtaaataattatgttaactggaatttgaaatgataagggattaggagtaaagaaaatgcagattaacctcctgtggtctgatctacctataatcccaacactagggtggctgaggcagaagtgtctttagttcaaaactaaactgggatacatagctaattcaaagctggcctgagagataaggggaactggaaagagcacgacattagtttcaggcgcacaatacccaatgattctagaatcctctactgacaaagcaaactgacacaaggaaaaatacttaaagcccaaatccatttccacaaaaccagtcactaagggtaaattttggagatgataattaaggaagtgatgaactagcaggaattttctgtactaagtttgtaagaagaaagttttttaaatgtctgtgttcccacaaaaaaatattcattctttagaactaatgctaacgaatcaaacactttgaagtaatttagaagacagaatcaccagtctgaatctctgcctgaccacatttgtatccccccccccgcgcccccaccccgtgtgtgtgtgtgtgtgtgtgtgtgtgtgtgtgtgtgtgtacatgtggaggtcagaagacagcatttgagagttgcttttctccctccattatgtgggtcccaggacagaatccagattgtcagcttggcagcaagtacctttacccactgagccatgttgctgtctttctttaacttttttcaaaatttagattagtaaaggaagcaaattttcatctattataggaaaaaaaatggacttaagtagaaaaataagaaatgttgctaggcattgtggtatgttcttataatcctagcactggaaaattcagggcagaaaaattaagagttctgtggcatctttgcttacacagtgattttgagaccaacctgcctacatgaaaatatcacaagaaagaagggaaagaagaataagatatttagcaagtggcttggtgggtaaaaatgcttgccaccaaaccagcaacctgaggtcagtccccagaacctacctggtgaaggagagaactgactctctggagttgttctctgacctccacactcttgccctggcatgcacttcccacccccacacaaacacacttcataaatgtaaaaaatgttaataaaaatgtttacttggtagctgcattagcttcctggggctaccataacaacttctaatccagagggcttaagaaagcagtgggttggttttttacacatgaaagctagaaatgtaaaatcagccactggcagagtttgtgctccctctaaatgctctgtaaaagaatcctttttcccttttctagcttctgctggatccttagcattctttggtttgttgacagcatacttccattatcttcctccatgtttagataacctttgtacatgtggggccctgtttcaaatcttagcatattgtgtatatacatgattctagggacccacccagggtctcccacattttgggcaagcacactaccacttaatgtgttttgttatgaggacaggagtcattaaattttaggtctaccttacatctagaatgatctcatcttaatggcataattatatctacaaagaccttatttccaagtaaggtgatattcactggtattgtggttagaacatgaacatatttctgaggggtacaattcactgaactatcctttactttattatcatctttatttttatttttgtttgtttgtttgttttgttttttcaagacagggtttctcggtgtagccctggctgtcctggaactcactctgtagaccaggctggcctcgaactcagaaatctacctgcctctgcctcccaagtgtgcctctgcctcccaagggttgggattaaaggcatgtgccaccactgcctcgctcatctttatttttaaataaatcttttttggagggagggggtttcaagacagggtttttctatatagcctggttatcctggaactcactctgtagaccgggctagcctcaaactcagaaatccacctgtctctgcctcctaagtactgggattaaaggcatgtgccaccactacctggctaaataaatcttatttgccattattatatgcatgtattgatgtgtgtgcatgatgtgtgtacacgtgactttcagaggtcaactttgtggaattggttctctccttccccttttatgtgggttccaggaattgaacatattatccttttaaaagtcatatttcaggacgattaagagtatatacagcaaaacttgacagcctgagttggatcctcagatccacagagtaggagagaactgactcctgtaaagttggcctctgacttcaacacatgtgcaatggtattgtgctggtaggagtacatatacaaaggaaataaactgtcaacataattaaaatcacattgcatgaaccaaggatatggctcagttggtaaacttcttggttagaatggaagataatttctcaaatttaaaagccatctaaagagacaatcctaaatttgaacaaggaaagcagaatattaatattaatattgatctaaagcagtggttctccacctgtgggttatgacccctttggaaagggtcacatatcagatatcctatgcatcaggtatttacattagaacctgtaacagtagcaaaattatcgttatgtagcagcaaaataatgttatggttgggagtcaccacaacatcaggcagcatattaaaggtcacagcattaggaaggttgacaactaatagagattatgaactcctgaaactaaacaaaagtagtaatgaaaacaaatgagaaaaaagtggaagggcactctcagcagaaaaataggcagcattattaaattcaacaccatatacacatacatataatgaaagtgttaggaagaagagtgagaggaaatagtttgaagatacattgtaacaatgttggaagcctttgtttaaaagtaaacatccacacaggaagctcagtgagctacaaatataaacatttagtagtgcccactaacctattgaaaatcg

SEQ ID NO: 249 - DNA, 4839 bp, mus musculus; identical to SEQ ID NO: 248

SEQ ID NO: 250 - DNA, 812 bp, mus musculus
ctgtacacacccatccctaagagagattctccgcggttcccagcctgagtcccagatccaggcctacacatatggcctgtggagaagctgaagccagtgcccatagcaagaatgaaccatggcatctttttctctgggtattcctacctagtgtgtcacaaggcccagaagaggcctcccatctgcacctgaggataggccagcagtcatcctgaaaggagcagggggcctgtgctctgctggctgagaacctcaacaccatgctgggagagcagactgtgcagcgtcctgtgcagcgccctgagggtcaagagaataaatctgacctcttcatgaattacttcccatgaggcctcaagtaccgggaaggtggcgtggagttggcatttcaccagacaacctcgagcgccaccccagcagccatcaggaagctctaccaggttaagggtaagaacatctgtgtgaccgagagggctctgagctgggacagcttcaacactggggactgcttcatcctggacctgggtctgaacatctttgcctggtgtggtagaaagtcggatatcctggagcgcaacaaggcgagggacctggcactggccatcagggacagcgaatggcagggcaaggcccaggtggaaatcattactgatggagaggagccagctgagatgattctaggccccaagcctgctccaaaggagggtaaccctgaggaagacattacagctgaccagaccaaggctcaggcggcagccgcgtataaggtctctgatgccactgaacagatggatatgaccaaggtggctgac

SEQ ID NO: 251 - DNA, 812 bp, mus musculus; identical to SEQ ID NO: 250

SEQ ID NO: 252 - DNA, 32 bp, mus musculus
ccgcctccttccgcccccgcggcgcctcgcgc

SEQ ID NO: 253 - DNA, 25548 bp, mus musculus
gcactcggactccaccggcggcgcagccttggctgcgagtccgcggggtctcctagcacgaacccagcgcgggctccacggtcggcgtggcgcgcgcgtgcgcgcgctccccctttggccccctaccctgcagcaagggtagcgtgacgtaatgcaacctcagcatgtaggagcgctataaagcgggacgaggcggcgcgcctcgcagacgcagagtagctcgtgattggctcgggctgcggaacctcggaatcccgaacgaacgccaggaccttccaggtccacggctgccgccccccgcggcagttgagagcgcggcctccgactgcctggcggcggggaaggcggtggcggttgcagccccgcggaggcggtgacaggtaaggggactcctgagcagcaactcggaagccgcggctctgccaggctcagcgtgtttctgggaggggagaggctcccacccagcgtctcggggagggcgaagggaacaatggaagtggcgtctagtccccgagcttcacctctgcctccggagccctggcttcctcctcctccgccggcggaggccagggaaaggttggcaagtgagggtccccctcctcagtcagccctctgctcccttcgctcggagcccccccggggaagccagagccgtcgttgtggccgtcggtggtttagggtgacaggaaaatggcggaaaacaaaacggtggagagtgcggcgtccccttggcattttctctcggcgaccccccagcccccaccccctccatgttcctctcgcccgcgccccacgtcgttgcagccgctcgcgcgcggcggggcggcggttgacggagccttcggcggcacgcccgagggctagcaggctctgccgctcaagtggccccggggccgggcagaggacgggagcggggctccggtgccgtcagagccgggctgtgtgtgtgttggggggtgccgtgtgcggccaccgtcgcctcagccccatcaccaccattttgcctggtggccggctcccacgtacggcggggccgccggagcgaggggcggtgagccggtcggccgggcgccgtggggcgggggcagcgccggtgaccgctgcgccgcgggtgagcggggtgggcgccgcgggggacgcctcctaggctgggtctcggcgctccgctgagaacgctcgccggctcgccggctctcttgttcttgttcgctggaacatcagtctgctgggcgacagcggagagggcacgtgtgtgcgttctgctggaaatgattgaaacttggcacggtcttgggaaagggagacttctgcgggaagagtgcagcgtccaaagctgcaatattgctacttgccagggctcctttgtctatctccgcaaatactactttcccattctcttgcccagcagccttagcatcatttctcttctatccctcgccccgttgacagcacggagaagctagctccccagcgagctgtttcgaagagacatgggagagtagaatttgatttttgtgttttctgcttcccgtgcattgatagaagggtgtttacttgaagtgtacttgcttggtttatcccggttcgatacgcatctgtggtactgttgagaaggctgagaaccttagctagctattggttattaaataccatactgctgttcccttacattatttgttattgatcttattgaaacttgctatatgtgaaaaagtattccactttatttctttgctattcgaacagtgtggtacttcccataatacttcccttgtatgttgtaatctttacactattgagtgctaaggcagatttttctgtgaggatttggcaaagataaaccttgctcttgttctttactttccaaaataaggtgtttttaaaaacccaaattaaagaagatttgggcttagtcaagcagttgaaggctgaatgtaataatattttgtattgtagtagttattttgcgggatgtctagtggcatccctttggctgctttttagataaacacaggcttgagcatgtgagctttttgaaatctcaccttacaagttgaaaagtaaagaaaaacattcttaagttgtgtaagagactggttaaaaatgtcttgaagtatctaatttctatttccataataggtaaagaccgttttcccaaagaaaatgaattgttttgaaggaaaaaaataagaaattttgcaaaaattactttataatccttaagaaaatcttcatttcttcaatctacttgtaaaaggtgattaagaaattactttttcttttcttatgtaattacataaaaagttaaaccatagagtgccatttaaatctgttgtattagttatctgataaaggaagcaaatgatcaaattgtagtccacatagtgtattgtaagtgtgaaaataaatccttatggtatttttatttaaatatatggatatataggtaatttatggtgaactccattggccttttgtcctcgtcttggataagagcaaaccagaaagcatactaatttgaaagaaaggcaaaatacagctaagaagtctcctccaataattttgctctcacacaatttacctaattattttggtacttagacataattatccacttatagagcatatttttgtgtccaaagtatactgctcaaatgtttaataaagagaactcggagattgttcagcctgttgggtagctgttgctttacagcatggggcaaaagcttagccatacccttgtgcttaagaacttagtttttgtttttgtgtcattgttctaaatttttcattaagggcatacctttgtgtgatatgggtcaatataacaaacacttctgagtaacaataagataaatacctttataaatacacatcttttctattgtttggttagaatcttttgttgctagggcaatgcacatctgatatgcaattataagtaatatattgagtgacaacctctggctttctgttgcatattgcttggttgccctgatataggaaatgaaaggggttcatcaactatttaaaaatttccatgagaatagcattattttagtaacattactgaaaatatcagtgtactgttctaaatatttgtatgtgattgatcttatctttaccatatttaggaagcagtcatgtttcatgagtcctcaaaactgtgagacaagagaatgtagtagagtgaggccagaagtccctactggttcaaagaactccggggaaacttgtgatagaacattttgcattataagtagagccccaggaaccagaggtgaatacaatatctgcagagctccgctgcagggctgatctggttctggaagaaatggatcagagctactggatgaaattcactaatgctagacacctgagtcctctagtaatgtatacatatcacaactattaatctgtcatcatctttttctttattaagtatattttaactggaccccagacttgaaattttgttcttttgcttgtttattagtcatattcctcatatggctcattaccataactgtgccttttttttctcttatcttggctttacttccacctaccccttttatgtatggctctcacataaagcatctaagcagttttgaatgtttcttttcttctgtaatgagctttgcatacctggttgaaaggcatattttctattgtatttttctcaaaacaactaacttgaaataaatgcatgtaaacgtttttcaaaccatttgttttacagatacatgtgaatgagctttgctaaggatggagtcaggtggtggaagtcttggattgcacacttcagatgctagaatggctcataccatgattatgcaggattttggtaaagcattttctttgttgtactttcttattgcaaaataagaacatattaaaaataaaccaaggaattataattacaatgaatttttaactcggaaaataaactgtacggcttattttcttaacggcatatataaacaacctatttaaggttatatactttgtgaaaatgttgaaataaagactttgaatataaaagtagtattttagtagaagtgaaaaactatgcataagggcttaattgtatcatgtgatagtatacgttagttttcagatgtagaaaatgttaaatcatactaagttacattgttcacaaaactaaaaagttgtgctctgtcaatacaaaaatttaggattagaaaatgataaaagtgaatcgtatacttagaaatcatattcagatatcatttcctcaaggttattaccaatagaatacacttctttttaaaaagaatttctgttcttatttatgtatgtatgtgtgtgtgtatgtatctgtgtctgtctgtctgtatgcatgtatgtatgtctgtgtcacacttgtgtagctatccaaacagtccataagcagtcattgaatctcttggggccagggttatggatttctgtgaactgtctgacatgggtgcttagaactgaactcaggtcctccattcttatcgactgagcaatttctccagcccacttttttatttttcacctaataaaagattccttacttttatgctcatttttagtagccttaagagactaaacatttgatgaatatattaagactacgttaatagttttttttttaagaagataaactaaattttgggaagcttggtgtgagttttagaggagatagaggtatccaaattaaaagaggcagggatgggatattaagaattgaagacaagataggaataaatgaaaatagaaatgataaattggtgtaagaaggacacaggttgatgtggtgaagctgaaatcaatgatgggggactagaactagtaatacttggatcaattaagaaaatgatgctactgttctcagtgtggtataatatgccatttgctgcactgttttaaggttcacagtaataagaattagaggaagcatattctcgtcttgacagtgatgttgttggctgtagtactaataaaatgttatattgaagaggttgagctaacatttaaggtcctcttctatgattaacatttgtcagattaatacagttgggtacctttaaggttgaacttagtaaggattgagatgatttttcaggtgttatatgaaggagttgtggatttattctcctaaaagatgagtgagttttgttgtttgtgaatggtttagaaatgctttggggtgggttagaagactacaggattgtgataattaatctttgttggtgacgtgccaggtttgagaggagttttagaggttatcaaagcacacgcttgtgtatatctgttagtgtgtttttacagaggattgggtgggatgaaagatccagcttacacatgagcatcaccatccaacacggggccttaggacatgcaataaaataggaagaatggagaatgcctgctaccatgggcatagtttccttctgcttccttttctccatgaggttagctgctttgctctgcttcctgctccctgccatggcattcagcctcacatgtcaggcacagagcaatggaaacaggctgaaatctctgagactgtgagctaaaattaatcctttaaattcttctatcatgtttaaatcacaggaatgagaaagggtgacaggaagaattacaggattaagacaatttttgttggttttttttttaaattcttggctggagagttgatagggtttagactgttagagccagttaggtttctacgtaggttttagaatagacagacacttgaattttaatatagtaaaggttttattttaaatgtcaaatttgagacctcctcaatacattgaggtttccctttatgtaatattttatttccttttacttgctacatattgcaacacacacacacacacacacacacacacacacacacacacatatgtgtgtgtatatttctttttcttttttaaagcatttttattagatattttcttcatttacatttcaaatgctatccccaaagccccctaattccctcccctgccttgctccccaacccacccactccctcttcctggccctggcgttcccctgtactggggcatatgatctttgtgagaccaagggcctctcctaccactgatggccgactaggccatcctctgctacatatgcagctagagtcaccacagctctagggggtatttcttttcattgagatataattcagttgccatactattcactccttttaaagtttgtttttaaggaagttattttaatttacgtgtgtgtgtgtgtatacgtgtgccacatttatgctgatatatgtgaaagccagaaaagagggtgttagatcccttggagctgaagttacaggtagaaaaaaagccacctaaagtagattctgaaactgaactcagattctatggaagagcagcaggcattctaaaccactgagtcatctctccagaccctattttaaagtttataattccagattttggtacaattagataattatgcagtcatattttacaaaaacatcttataataaaagttataatttaaaaaagtatgaaataaagtctcatatatattattagttattaacccatctttttttcaaccagtccttaataaccagtaattcaatttatagattcacctattctaaacaattcttataagtacaatcatgtaatatatggcttttcatgcatagcttttactttaacacagtttcatggtttataatcatattttgtttactaccctattggtaaatatttgagttgttgaaatatttcagtgttttagatcaattttgtgtttgacttaaaactttttttttaggcttattccctttgaggcatgtgtcagtatgccaaggcatacttgaaactatcagagcttgcgggtcattttcatatatttacatgtgatttagctatataatgttttagatagctatgtaatgtctataaatacatataatatgttatggaaaattcattttctgtatctactgttgtttaaggaaggaataagaagatgagaaagtttgagaactactaattttggttggcattgtcatagttatttgaagttttcttttaaagtgaattaatggagtaaataaatctctttatgtcagtaaaaagtagagaggtactttttgttgttgttagatgcctattcaagactgaattacttagttgtgtttttgaaatgattttttttttaggatccattttgtgatttcttaaatcgaggtatataaatcagtgcaaactgaatttttatactgtgataagattgtttttcttaattatagtgaaatcaagaattgctaatagagcaaagtttactcttggatttggtttgtgctggtgctttcctaaaatatgctaggtttccatctgtcctcagtaaatagatttttaaatctttgaagttataaattatagaagtttgggtacacagccatgtaaatagactgtgttataaggtctccaaattctgtaaggttcccaattgatacaatgggattaatattttatagaaaattagaagaactaatttagaggttattagatcaatttctttagaaggatggttgagatttaaagtttttaaattttatgtctcatacaatttttgctgatgtttgagtaaagtgattgtacttgcagtcagtggcactgagttttgcagttgtttgggattttagtgttgcaaagcagtgttggtttgaaacttaaatagcaaaatggctttagatagtggtccaagaaaacagtgttaagaaggacattttttgctatcactctagtggagtgccagataacatttgaacaaatacttttcataaaatggaaaatacttgaagtcaggatttcgtctttgttgctacgtttatctcattggctcacatttgaaagatgaatgtttatcatttgtaattttctaacagtaagataaattctttatgccattaggtgttgcttaataaatttttaaaaatatttaaatacgtttttaataatatttaatacgttttatgtgataggttttttaaattcttcacaaaatattattatactaatactgtatttgcttaattttatgaagtctctcttttaaaacttatctagggtaagaaacgaaactttatgctcctaggtgagtagaagaagaagaaggaaaaaaaaaaaccctacagctccgagtcaaagaatgaatacagctaacttctctaaaatgtagtttctgggggctagcgagatggtatagcaggtgaagtacttgcctaacaacagcctgacttcaattgctggaattcacataaaggctgaaggaaacaacaaactccaaaaagttatcctctggggtttccccaattttatatacacaacaataatacatacatttttaaaggaaaatatgttttcttcatatagaaaatggaggagacactcacacttattttgaggattaaatgaggattaaatattaaatataatatgtgtatatgtatatatgtgctccctcacatacacagcataaggttgcttgttcattattagtgcataataaatattactcatatctgaataaatgacattttaaaggaattacagctcatatacaactgaatttgttttggaatttaataaagtaaaacagtttaactgataaaaataaaaattatggatttttttaagtctgattaatttgataatattctgctgtactcgttagttcttggtctaggttctttaagatgatttgtctcagctttaagaaatattctcagggtaaaaaagaatattgatggttcattttgctttaggtttgattgattttgacctactctaggctaggtgaacttggaatagtttcttttattttcttagaatcagctgggccaggttaatctgagcagaaggcaacactagcattattctatccttctgtcagaacccactagctgatcagaaatcaaactcatctccaaccagaccctgaaataattgtgatttcttgattatcaagccattgatttgtgaaaatattttttatgaaataataatcttagcatctacatatagagaattccatcattaggaatttaataggcttaatatttaattttcttgctaaagctaccatttccagtctggataaatgcaaaatctgaaaccctactctgtgtctatatcttaattttctggagtaataaatgacaaagtaatttaaaaaattatctttaatccttttttgcagtccagtcattatccccctaccattccgccctcaaatagttcctcaacccattcctactcccctgcctccaagacgatgtccccacccaaccccactccacgctgccaggcctccccactccctggggcttcacatcttttgagggttaggtgcctctttgaggccagacctggcagtaatctgctgtatatgtgttgagggtctcatatcagctggtgtatgctgcctggttggtggctgagtgtccgagagatctcgagggtccaggttagttgagactgctggtcttcctatggggttgccctcctcctcagcttcttccagactttccccaatccaaccacagggatcccagacttcagtccattggctgggtgtaagtatctgtgtctgtcccactcagctgcttgttgggccgctctgagggcagtcatgctaggcttctgtctgcaaggacttcatagcctcagtaatagtgtcaggccttggagcctccccttcagctggatcccaatttgggcctgtcactggatctcctttcctttgggctcttctccatttttgttcctgcagttctttagacaggaacaattctgggccagagtttttgactgtgggatggcaaccccatccctccacctgtctttttactggagatggactctataagcgccccccccccaacacactgtaagacatttcatttaaggtccctttctttgagtcctgagagtctcttatctcccaggtccctggtacatcttagaagcccccccccccaactccgaggttgcttgtttccattcattctgctggtccttggggcttcactcctgttgcccccaatacctgatcatgttccccctttccccttcctctcccctctaccacccaggtccctccctctttctaccccccaggtgatacatatcctctttgtctattaattttgtagggttatagctatttcttttattttttgagattataatataattacattatttgtcgtccctttcctctcttcaaaccctgtcatgaatccttccttgctgtctttcaaattcatgacctcttttttattgatatatatttctaaatattttcatgcatgtatattcctaaatataacctgctaagtctctgtaatattacttgttatatatattttcaggactgtttggtattggataagcaattggtgtgctcttttctgaggaagactatttctcacccatgctgtgaatattccttagtttgcctgtagctccttgtgtaaggggtgaggccttgtgctattttgccatgtctattgttatgttcttttgatgtaatttacaattttggtaaaaatttaagagtgatttaagagagatttagaatagcagaaagggacattgggtgtgctggcatgtgcctgtaattccagaactcctgaggcaaagtcaggccaatcatgaattcaaggtcaaccttgactacttagctgctttgaagccagcctaaactgcatgaggccctgtctcaaaagtcagtataatgataatgatcccaggatctcggctgaaaagtcagctgtaatttcagtcttagctttttatcattgccaataaaagctggttttcatctttaactaacttcctgatgaattggttataaattgcactgtgtatctcgtttatagtatgtttatattccttcagatattactttataagaaagtgatcattaggtcaaaaaggctgtgtgctgggtcatttcatgtagataatacattttaagtagaccaacaaactcaattcattagggtggcagaatttaaaattcctcaataagggaatttatactctttacagtatttacaaagcaagtggtacttggtgcttactctgcttctcaagagaaaaatcaaccttttctccctctttcaaacttactaatacttaaccttagctaaagcacagtccaatatgagttaagattgttttttcctaaatcaggtgttggaaggttctaaggttaagtgctatagcagttcttttaagttaaagaacttatgggacttctgtagttatataatcttctatatttgttgtatagtgtattaacttataacaatatcctgttgcttctattttttcaaaaattatagtcatagaaaatgggaaaaattagtattcattccctccaatgctactattatatttaacattagtacaataccaagcccagaatattaaagttttagataattctgtactttaaaagtatatacctcatccattttctatcatttggacatatatttgtgcgtgaattttaatttttattattattttactttaaaaaattattttatttatttacattccagccattgtctcccctcccggttcctcctcccacagttcctcatcccattcctcttccccgttacctgcatgagggtgctcccccttcactccccacctggcctccctcattcctggtatttcaagtctctctaggattagacacatcttttcccactaaggccagacaaggcagtcttttgctacatatgttccaggggcctccaattccatttatgctcctggttggtggctgagtctctgagagctccgtagggtctggattagtgaagactgctagtcttcctaaccccttcagcttcttcaatccttcccccagttcaaccgcaggggtccctgacttcagtccaatggttgggtatgagtctgcttctgtctcagttagctgctggtagggcctctcagaggacagccttgctaggcttctctctgtatgcacaaaatagcatcagtaatagtgtcaggcatggtgtcccccactccccatgaaatggatccaaagttgggccagtcactggaccacctatagtcagtcttttctccatttttgtccctgtattttttgttttgttttgttttttgtttttttgtttttttgttttttgtttttttttttttttttttttgagacagggtttctcggtatagccctggctgtcctggaactcactctgtagaccaggctggcctctaactcagaaatccgcctgcctctgcttcctgagtgctgggattgaaggcatgcgccaccacgcctggttctgcagttcttttagacaggaataattctgttaaaagttttgactgtgggttagtaaccctctctctccacttgaagctctgcctctctactggaggtagactcttccctctgcccactgctggggattttgtttaaagtttcccctattgagttctgagagtctctcgcctgcctcccaggtctctggtactttctagaggatccctccacttctcacccccaggggctgcatatttccatgcattcccctgtccctctgagcttctcttctccacccccacccccagatccaatcctgttcttgttttcccttcttcccttcccacccatgtccctctctctctccctctacctccttttactttgttgccccttctaagcaggatttcacatgggccttcctgcttgttaaacttcttatagtctgtgggttataccctaggtattacgaactttttggctactatccacttatcagtaagcacatactatgcatgtcctttgagtctgaattacctcactcaggatgatattttctagttccatccatttgcctgtaaaattcatgatgtccttgtttttaatagcggaatagtattccattgtatacctgaatgacattttctgtatccattcttcctttgagggatgcctgcgttgtttccagtttttggctattacaaataaggctgctatgaacacagtggtgcacatgtccttgtggtgtggtggggcatttttggggtatatgctcaggagcagtacagctgggtcttcaggtagaactatttccaattttctgaggaacctccagattgatttccagagtggttgtaccagtttgcaatcccaccagcagtgggggagtgttcctctttctccacaacctcgccagcatgtattgccacttgagtatttgatcttagccattttgatgggtataaggtggaatctcaaggttgtttggattttcttttcactgatgcctaaggagtttgaacacttccacttcgttaagtgcttctcatccattggagaatattctattgtgaattctctgtttagctttgtactgcatttttaaaattggattatttgggtttttggagattaacttcttgagttctttgccaatttgtcctattgcctggttttggccttacagaagcttttcagtttcatgaggtcccatttatcaattgttgatcttagagcttgagccattggtgttttgtttaggaagtttccccctgtgccaatgagtttgaggttcccactttcttttctattagatttacactgtatctgtttttatgttgaagtccttgttctacttggacttgattgagctttgtgcaagataataaatatggatctattttcattcttctacataaagaccaccaattaaaccagcataatttgtcccactgtatgttttgtcatcttcattaaagatcaagtgttcataggtatgtgggtttatgtttgggtctttgattctattccattgatcgagctgtctgtctctaaaccaataccatgtggtcttcatctctattgctctgtagtacagcttaaggtcagggattgtgattcccccagaagatcttatattgttgagaatcattttggctatcctgtacttttgtttttccatttaaagttttccatgtctgtgaagaattgtgttgaaattttgatggggattgcattgaacctgtagattgcttttggtaagatgcccacttatttgtgcatcaattttaattttttatttgttttttttttttggctttttacactgacctctagcccagttccaagtcagttatcaacaatgcttctaaatgtttaatcaagatgtctagtacatatttaaactattttatgcaagtacatatcaattaaacataatattttattaataaaataactttacctttttttgaataattgtttgtattgtagtggctggaatggctggtactgcacatatcgatggagaccatattgtagtttcagttcctgaagctgtattagtttctgatgttgtcacagatgatgggataactctcgatcatggccttgcagctgaagttgtccatgggcctgatattattacagagactgatgtggtaacagaaggggtgattgttcctgaagctgtgcttgaagccgatgttgccattgaagaagatttggaagaagatgatggagatcatatcttaacttctgagcttattacagaaaccgttagggtacctgagcaggtttttgtggctgatcttgtttctggtcctgatggacatttggaacatgtggtccaagattgtgtttcaggtgtggactctcccacaatggtgtcagaagaagttcttgtaactaattcagatacagaaactgtgattcaagcaggtggtggtgttcctggttctactgttaccataaaaacggaagaagatgatgatgatgatgtcaagagcacttccgaagactacttaatgatatcttgtaagtgaaacataaaatcaattgcttgagatattaatttctataatatctaaaggcattccgggatcaaaggtagattcaatagaagtaatagaaaaaagtctttttgaaaataatttcaaagctgtggtattgagatgctttttgggtttgcctatacttttaatacactctgaaattgcacaccagtagaagtcaattaaagtcttagaataaaagtatatatttgaaaggctcaacagaaacatcgactaatacaacattttaatgataaattatgatatttcagaataagtagtaaattatgttatcagtgctttttaaaaacaataggtactggtattgtcaataagcatttacataagaacttaagcataatgtggttaggtataggttatatgaatttttaaaatgtttcagttaaagcataaacttagtatgtgtcctaccattctttccagattcatgttcgatttttattgaatgattatgtgtaatatatgcaaaactatttgatgcatttacttcagactgctttgaggtctttacagtattccatttgaaagaagagtgtagaaatattttactatcattttgggtgatagatttggtacacaaactatcaaagataataagtctcatgattttgatgtttacaaaaggagggagtccttctgctagagcacttgccttgaatgcaaccaccctccccacacacatgaatgcacatgcacacatgcacataggcctgtgcaaaacgagtggaaatgttcttcataaattttgaaggaatcattctacaaatagaaaagattagatgaaggcttttaacatttccaaaagatgtgctttttcctttgaaaagtaaaaataaaatgctgggaagggaataaccatgtagagagtctgtatatgtgtgcccgtgtacttgtaaaatgactttatgatatatttgagttagtgattttaaagcttaaagagtacaaacgagatttaagttttaaatataattctgaactctactactgttacctttctttttatatgcacttttgttttttaaatttaattttatttttttatagtccagtcaataccttccacagttcctcaccccattcctccttgctcctgtctccaaaaggatgcccctccactcactgggaccttaaatctctccaggattaggcacttcactcactgaagccagactaggcagttctctgctatatatctgtcaagggtgctggggggaggggctaaagtatgctgcctggttggtggctcattgtctgagaaatctcaggggtcccatttaattgagactgctggtcttccagtggggtaggccgcctcctcctcagcttcttctagactttccccaattcaaccacagggttcccagacttcagtccattggttgggtgttatctgcttctgtcccagttagctgcttgttgggcctctctgagggcagccatgctaagcttctgtctgcaaggacatcatagcatcagtaataagtgtcaggcctcggagccttctcttgagatggatccctattgggcctgtcactggagctcctttcctttgggctcttctacatttttgttcctgcaattctttcagacaggaacaattctgggtcagagttttgactgtggaatggcaaacccatccctcacttgatgccctgtcttcctactggaggtgggctctacaagttccctctccccactgtaaagcatttcatctaaggtccctccctttgagtacttagagcctctcatctcccaggtctctgatacattctgaagcccaccccccttatctcctgaggttgcctgctttcattctttctgttggcccttaggacttcactcttatttactccctgtcctcaatacctgatcatgttccccttttcgtctctttatccctcttcccaaccaggtaccttcttccctttgccctccatgattcctttcttctccctctgaattgggattgaggcatcctcacttggcccttttggattgttaaccttcttgagttctgttgattgtatcctgggcattctgtactttttttttttttggttaatatccacttattagtgagtacatgtcatgcatgtccttttggatctgtgttacctcactcaggatgatattttctagttccatccatttgcctataagattcatgatgtccttgttcttaatagctgaatagtattccatggtgtaaatgaaccacattttctgtattcattcctcctttgtgggacatctgggttgtacccaggttctggctatcacagataaggttgctatgaatgtagtagagcatgtgtccctgtgacatggtggggcatcttctgggtgtatgcccaggagcggtgtagctggggcttcacataaatctatttccatttttcttttctttctatttttttgtatttcttttctttttttttctttttaaatattttgtattaggtattttcctcatttacatttccaatgctatcccaaaagtcccccataccctccccccaactcccctacccacccactcccactctttcgccctggcattcccctgtactggggcatataaagtttgcaataccaatgggcctttctttccagtgatggccgactaggccatcttctgatacatatgcagctagagacaaaagctccggggggtactggttagttcatattgttgttccacctatagagttgcagttccctttagctccttgggtactttctctagctcctccgttgggggctctgtaatccatccaatagctgactgtgagcatccacttctgtgtttgctaggccccagcatagtctcacaagagacagctatatcagggtcctttcagcaaaatcttgctagtgtatgcaatggtgtcagcgtttggaagctgactatgggatggatccccggatatggcagtctctagatgatccatccctttgtctcagctccaaactttgttcctgtaactccttccatgggtgttttgttcccaattctaagaaggggcaaagtgtccacactttggtcttcgttcttcttgagtttcatgtgtttcgcaaattgtattcttacgtattctaagattctgggctaatatccacttatcagtgagaacatatcatttgagttcctttgtgattgggttacctcactcaggatgatgccctccaggtccatctgtttgcctaggaatttcataaattcattcttttttaatagccaagtaaaactccattgtgttaaatgtaccacattttttgtatcaattcctctgttgaggggcatctgggttctttccagcttctggctattataaataagcctgctatgaacctagtggaacatgtgtctttcttaccagttggaacatcttctggatatatgcccaggagaggtattgtgggatcctctggtagtactatgtccaattttctgaggaaccaccagactgatttccagagtggttgtataagcttgcaatcccaccagcaatcgacgagtgttcctctttctctacatcctcgccagcatctgctgtcacctgaggttttgatcttagccattctgactggtgtgaggtggaatctcagggtcattttgatttgcatatacctgatgactaaggactttgaacatttctttaggtgcttcttggccatttgagatttctatgttgtgaattttctgtttagctctataccccattttttcattgggttgtttggtttctttggaggttagcttcttacattctttatatattttgaatattagacttctatcagatgtggggttaatgaaagtttattttttcccaatctgtacattgtggatttgtcctaatgactctgtcctttgccttacagaaactttccagtttcatgaggtactttttaccaattcttaatctaatagagcctgagccattgatgttctgttcaggaaatccctgcctcccatcatgtcaatgagttcaagtctctttcccactttttcttctattagtttcagtgtatctggttttatgttgaggtccttgatccacttggacttgagctttgtataaggtgacaaataaaggtctatttttcattcttctacatacagacagcctgttagaccagcaccatttattgaagatgctttctttttttcattgtatatttttggcttctttgtcaaagatcaagtgaccaaccataagtgtgtggttttatttctgggtcttcaattctattctattgatgtcttttgaggcagattttcacatactgcaagctggctttaaagttgttagggacccaagattacccttgaacatctggtcctatgaactcttgcttctgtggctagagcattaagattgtaggtatatgccatcaagcccagcctgtagatactatgccagtaaatatttacattttccttaagagaatggggtatacttctaaaagtgatagagaatgtaattatgatcaaggtacattatatacatatatggacatgttgtccatatatggacatgttgtgaaatttattactgtgtacaattagtatatactaataaaattgttatatatacaaataaacaaaaaatacattttcttatattattcatgaacattttgattttcatacctataccctcaagtgaagggattctaggtatgtgcttctaagtctagttgagatttttttttcagaaaaataattgcagatacatcatagaaaacatctaaggtctgactactcagaatttccccacattttgacagtttttaaaaatatatttatttatttacactccatattttattcccccctgtctaccctctgactgtttcacatcccatacctcctccccaccccccaccctacctgatccctaaactccctggggcctccagtctcttgagggttaggtgcatcatctctgaatgaacatagacccggcagtcctccgctgtatgtgtgttggcggcctcatatcaggtggtgtatgctgtctggttggtggtccagtgtctgagagatctcaggggtctagattaattgagactgcttgttctcctacagggtcaccctcctcctcagcttcttctagcctttccctaattcaacaacaggggtcagttgcttctgccctttggttgggtgcaaatatctgcatctgactctttcagctgcttgttgggtcttcctagccattttttatagttatacttacatacttacatttgaactatttattctttttgtttgtttgtttgtttttgtttttcgaggtttctctgtgtagccctggctgtcctggaactcagaaatccgctgcctctgcctcccaagtgctgggattaaaggtgtgagccactactgcccagcttctagttactcttaatattttttctcttcttttaaatcttcatttgattaccttttggtgtccagtggccattgagtctttcaataattataaaataaattgccatgaaaaaaaattcattttaaccaggatgtcctttactttttggcctcaaagtagactttccaaaatatttaagggctgaagttgaagagtttttttcaaattctagcttcctgttagggtacttttagatcttgttaggataggctttagagttaaagaattgcttttctctgtatctaaattcaatccatattcaagctaaagcttacaccttctttatcctaccacatggctaacattgtccacttgtgctgagtagcattgaaatgaatatacagtaactgtgtcttatgtactggttgaactctgttttaagtctatttaagacattcatgggtggttgtttcctttttgaaaagcttcactgggatgagcaatctccttcataatgatccactataatgtaacaaagactttttacttacgaaagtgaattcatataggaaaataccattcaaatctctcaaattttaacaataaaagaaaatgtttacatctttgcatcattaaaaatataagtttaccaagacattacttatatacaacaaaattcactcatctaaagatttaaattgtttgttcatatatcaacatttgaattatcaccacttcaaacaatttaaaatttaattatgccaaaattgaacctgataagctcttgaagttaatccctgctttattcattcttaggcaacaataactatggcatataaattttgctgatttcatttatatatttcatgtgaatggaatcatgtagtatatgaccattcctttctgtcttctttgtgtttctcaaaggtcatccatatcatagtattgatcatgtgtggcattgatgttattaccaaaagatattctattatacatgtatactaattttgttcacccattcatcagttgatgtatatttttctagtttctacttcttaactagtatgactaagtataataggaaaagtgtggagaagtttttctgggtgtaaattttttacttccttggctatgtacctgagcatgatataccattgaaatttaagtatgatttttgtttactcatttttctgcattataaaagagattttttgttaattgtctaatcacaataatatattaagttatataatacccacagcataattttactgatgtaccataaacaggagcaaactcaaaagcctatgtggctttaaaaaggaggtcattaatttaggagggtgtggggtttacatgtgaggcataagaggcatgaaggaaattatgtaattacattttaattaaattttcaaaattagtattatactgtatattttactcagattgtgccagtgatctacaaaaaacattgaaaacatccagccttttcagtgttgccaaacagtgtaacttacattgtctttaatgctaatggattttttatgggtgttatattgctcacttaaaggtggatcaagaatcaatacagtgcggtatgccttaagatacgcaaaaaattaagtttgaatattaagtatttactttttaatctctattaagaacagttgttgaaagtctagtgttaatcctgtagtcaaggttctttcctataatctcagtactagagagggaaggtaggaagtttgcaagctctaggcctgcttgggctacttagctctatgtcctcaaaataggaagaaaaatattttagaatttattaagtcatttggtttcctagtaaaactttgttaatgttatagtttctgtaactaataatattaaataaatattggtaaagctaaactcttcaaagtacatactagttttaaaaaatacctattatttattagatgaaaatacagaacaaattcagttgttccatacatttaaaaattgctcattctgagatgcttaatctaagtggaaaacagtggatacattaaacttaaagtatgaaattttttttaaagtagaagtaaaattagaaaataaatgctaacagaaaaagcagtgaggacaaatcaagtataatttcaatatttaaagctaaaattgtggtacatagtttagaattacccccaaaatctgttttattacatgaactttagatttcaattataattttaaatgagtgtgatctagatggaaatatatctacttaacctatttacatgtaataacagattatttattaagtgagagtattttattgtcaacttataatgattccaaactccaaaatttgtaattttggaccttttgaaagttttttttataaatactgttttaaaaatcaatgaatgaacaacttatttttccttaatattttactagtttgttttagtatttctatgatctctttattttatttgatatatatatatatatgtgtgtgtgtgtgtgtgtgtgtgtgtatgaaaaacaattaaacaatatcacatattttattatcttaaatgcatgtgaaacaaatacctaactagatagcttaatgattcagtgaatataaaaacatcatatacaaaaaagtgaagatatattatttgaagtcaccacttatatttatattaaagttgtattctctgcagttttaagaatcatattaataacacagaggcagtatatatgaactgcagtgaatagatattcataaactgtgaaaatcacaagtcacattcaagaaataaatggccacataaatacatttgctatattgctacactaaatttcagtgctttttatacagaaacatggtttgggtaatgttaattttataaataacattttaatgtaattttgatcctgttataacttgagtattattttgatcttgagtattatttttccatgaaacataccatttttagtgactgcaaataggtcactgagggaatatagtaggtaggtgtttaaaacattttgtcatttatgcttaacactcattaaatgtcagtagtccttttactgaaatagtttcctttatattttgcagtggatgatgtgggagagaagttagagcatatggggaacacgccattgaaaatcgctagcgatggttcacaagaagatgttaaagaagatgcatttggttcagaagtgataaaagtatatatctttaaagcagaggctgaagatgatgttgaaataggtacaaaacaattttaattccatgatagaattcttatctttcatggggattattctaaaattctcaaaagacaaaaaatattcataggcttcttaagtgtatttttaaaactgtatatgaatatctacatataaagtgggaatgggaaaaatgtcactcagatttttttcagatatgaaactattatggcagaaaattttcaaacaaatgaaaataatttgaattagagaaaaaattatgatgggtgtgtaagagcattgaagacagaggaagatattttgtattttaaacctacttctagcacttaactgagaaaaatcctcaataacttttatgttcttctacttccttgtgtcctcatctgtatgatggccataatggcaatggtacaataaggtttttatgagaaatgaatgggtaaatatgtatgaaatttttgtagtgcttgtcatataaatatggtatagctgttaactgaaatgaatgatgaatgtctaaggtataatttacatgcatattttaatggcactttgaagtttgttagaatatttatataccctgtatatccttattaattcggggatttattccatgatatattttgagtttatatgtgtttttaaattttaaggtgggacagaaattgtcacagagagtgaatacagcagtggccattctgtagctggagtgcttgaccagagccgaatgcagcgagagaaaatggtttacatggcagtgaaagattcttcccaggaacaggatgatatcagtaagataaagggcactgtagtgacttacaagaaacactaacacaactttaaatgcaattgatagcaaccatagatgcactgaatatcagctacgttaaaagcaataagcctgttcttgcaaatatttaaaagtatgggtccttttagacattcctgaaccaatatattattactcagataagaatacatgaacaatacatctcaagtcatatgttacaaagcgatgaagagtttatagttttgatgtaatgaagttcaaaatacatagaaattgaatcatatattaaatatatattatagacatgtgtagtgcacataaattcacaaggcatacagacacataggcataaatttagaaatatttatatctgttaagttttatttcattttaataattaatctctgaggtagaaagtattattccttttttataagacaagtaaatcctcagggaaaataagttgcccaagacaacactaaaacttgagtacttgtctaacactactgccagtgttttgtctacatgacagtaagcacttttggcctctttggatttagcagtgaaagggctaactggttgatctcctgtcactgagaagttgggtgggtaagtatttatacaagccgttctgctaggatgttaatttattatgctgttcatgggtaattggggtaaagggcttcctgggactcaggatcacagggtgaaatattctattcataggctttcttttgtcattcttcatgctttttgtttattttttcaagacattttatttttttcctacattgtcttcatctcacttttcagtcttgtctgaggttgtatttgtttccttgccatgctgacaaaatgctattttatcacacaagagcaagaccctccttttcatagaattttctcgatagtgctatgttctatttatgctgcactataacaactactccttatgtatttctctaacaaccacagagagctgaattctacctccatgtcacagctgaaactatcaaaacacttagtgctagggaacaaaagcgtttatttaagttatgcttatttcatctgaaatcttaaaatttttaactcactcattaaatgaggcatgataggctatgggaaactgaggtacaggtttatctaatgccataatttgataggaacatggaaaacttagactagcatctgtggttat

SEQ ID NO: 254 - DNA, 475 bp, mus musculus
aaccccacaaaatcatgcattatcaagagattcaaaccttcgtgttcattttaagaacacctaggaaactgttcaggccatcaagggtatgcatatgcacaaagccacgaagtatctgaactatgtcactttaaagaagctacgtatgccatgacagcagtataatggtggagttggtaggtacgccaaggctaaacaatgggactagacacaaggaaggtagccaaaaatgaatgctgaatttttgctgcacatgcttaaaaatgcagagagtaatgctgaacttaagggtttaggtgaagattctctagtcattgaacacatccaggagaacaagacacctaagacgcaccatcaaaactacagagttcatggccgaattaacccatacatgagctccctctgctacactgagatgatcctcactgagaaggaacagatcattccaaagccagatgatgagattgcacattaa

SEQ ID NO: 255 - DNA, 26 bp, mus musculus
ccccccccccccgggccccgcttctc

SEQ ID NO: 256 - DNA, 22 bp, mus musculus
gatgcctcacctggagcacctc

SEQ ID NO: 257 - DNA, 199 bp, mus musculus
caaacatctgggggcccacagaggggcatcctgggctacgctgaggaccagactgtctcgtgcaacttcaatagcaacttcctctcttccacctactctcaatgacaactttgtcaagctcatttcctggtatgacaatgaatacggctacagcaacagggtggtggacctcatggcctacatggcctccaaggagtaa

SEQ ID NO: 258 - DNA, 199 bp, mus musculus; identical to SEQ ID NO: 257

SEQ ID NO: 259 - DNA, 59215 bp, mus musculus
agcgggacggtgaacggagaagggttggcggagaaaccacccgtctctcctctcggggccccaaaaaggcggcctgcggcgaccgcgcgctgtgactgtccaacgcacgctccgcccataggcgaccctggcgcgacgcgtgggagaaaacgttacagtctctttttttcctttttccttttttttttttgtcaattgtgggacaagagcaacgacacaataacgtcatttgaatgcagtctcctgtgtgccgcgcctttgctgtcacccaaagcccaacattgaaacacatgtagtccttaaatcctttgctggtgttcttggcttttgtccctgcccttgcagtagccgccctatcctgcctgggttttcatctttccaactacagcctctttctcccaaaatccacatgttttgtctgttttctaatcttggcttctgtttgaaacgaactgcaagcctttaaacatgtctgtgggttccctccacctccatagattcggaagcaattggtctttcgtgatgtctgggcttcgaaagtttttttgtgtgcgtttatttttgttttttgtttagtaacctagctattctcacgcacaagtcacggaaaaattaactgttaaaagcgtctatttttgtgaccctacctaaacatcgttttgcagcttcatctctcgcaggtgtaacagatgctcatgctgatcgtaaggttagacaattctctttgttctccacttgtacaattgcagtgctcttgattcttggtctcactgtgttgtcggggctggcattttttagctcttgagctcaaagtaattgggatcacaagctcctccactacctcatccatttttcagattgataaatcatgtatttatggggtacagtgttaaattgcatatgtttatggggtacagtgcatgaatacactcccgaatgaacaaatcggactcattgactttgatcacctctcatactttattctttgtggtgacagctagaatataccaccacctcctgccacaacattgccttttgcaggactaaggattgaatccaaccaaatccttgcctatagtaggcaaacattctgcctttatatccccagctattttttattgagttgggttctccttaaatgacataggctcacctgggacttgctatgtaaattagaatgataacttgtgatcccctccctcagtctcctaagtatttgggattattggtgtgcacctcatgtccaactaaaattcactcttatctgtaggagatgttattctatatctgggatattaactaacatcgctatgtaacatattgctgcctaactgaaacattgtatcttttgagcaacatttcccttttctctgccctcagcatctgataaaaattatttactgttgctttagtgaattggacttgttaagattccacttgaagtgagaagagatactggctttgtgtgcctgtcttatttgacaatatgtaatgtcctcttgatccatacatgttgttgcaggtgacatttcattgtgtatgatatataatagacatgtctacagtctcacagtataactcagactgactgtaagctaaatcccccctgcctcactcctgaatgctaggacactgtacatgatgagacacacacattttttttgtgggtgtgttgaagataaaccacaggacctcgatagagctatgcctatcattctctgccactcagctacatcttttctatccatttgatttctctccatgataaacacaggttatttctgtatcttggttattatggataatgctgtatttgtccagtgtagtgctgtaattgaaacactttggaattagaggcaggaagaccaggagctaaagatgctctcaacgccctaatgagttcaaagccagtgtagagtatatgagaacctgcctcaaaaataaaaaagcattagcatggtggtgatggtacacacctttaatcccagcactcaggagacagaggcaggcagatctctttgagttcaaagccagcctggtctacagaatgagttccaggacagctaaagctacagagagaaaccctgtctcaaaaattaaaaatagggctggtgagatggctcagtgggtaagagcacccgactgctctttcgaaggtccagagttcaaatcccagcaaccacatggtggctcacaaccatccctaacgagatctgactccctcttctggagtgtctgaagacagctacagtgtacttacatataataaataaataaaaaaaaaaaaagtaaaaaaaaaaaaaaaaaaaaaaaaaagaaattaaacttgctgtttaaaaaaaaaaaaaaaaaaaaattaaaaataaaaaaagtgagagttgtgcagatatgtggcatagtaatttcattcccttttaatgtatacccagaaaatttaattactgactcagtaatctctttagtgattttaggtccttcatgctgttttccaaagtgcctgtggagattttgaattctccccaacagtatacaagggttctttttgctcaccatcttcatcatttgtatactttttattcatgtccattctagaagactgtattagtcagggttctctagagtcagaacttacagaatgtctctatgtactaagggaatttattgtagtgattaatagtctgcagtacaactaacccaacaatgggcaactgtgaatgggacgttcaagaatctagtagttgctcattcccatgagactaggtatttcagctggccttctctataagctggaatcctgaagaagtaggttccaacagatgtgctggaaagtaaggtcaagcaggcaaaggagggagagagagccttccgccattgtccttacataggcctccagcagaaggtgtggcccagatttaaggagtgtactaccacacctggttttgaaacttgctctctcaggcaggccttgaactcagagatctgcttaccgcagtctcctaggattaaaggcgtatactaccttgcctgagcctaaatttttcatggctactatgccttaaattctggatcaaaggtgtgtgttgtcccatgtcaagatctgggttagaagcctgtgtcttctagcctcaagatctggatcatgccgggcagtggtggcgcacgcctttaatctcagcactctggaggcagaggcaggtatatttctgagttcgaggtcagcctggtctacaaagtgagtgccaggacagccagagctacacagagaaaccctgtctccaaaaacaaaaaaaacaaagaaagaaagaaagaaagaaagaaagaaaggaaggaaggaaaaagggaaaaaaacccatctggatcacaggtgtgctctctatttctggattgtagttcattccagatatagtcaagttgacaaccaggaatacccatcacactgatataaggtcatttcttgtctttttaattttcatgaggaacagacaataaattcgtgtcagctcgaatcagaccattccttttccagttttgacttttcttattgaaaggtttttctctcttttgaaaacaatattgatggtcaggcagtggtggcgcatgcctttaatcccagtacttgggaggcagaggcaggagaatttctgagtttagggccagcctggtctacagagtgagttccaggacagccagggctacacagagaaaccccatcttgaaaaaccaaaaaagaaaaaaaaaagaaagaaagaaagaaaaaaagaaggaaagaaaacattattgacttctgctaagacattctggttgttacatacaaaagatggttgtataagatgatccatagagtcttctctaatactttacagttctgtatgttactaggattgcaattgtgttttcttgtataaacagccacaaaccttacctttttgtattttactagatagtaaggttctacctagagagagtcttgccaatatgtgggtagaaggaaactatcagggtgagatgtgtagataagcagagcactgtgagttcagggccagcctggtctacatagggatttctaggctaattagggatacacagtgaggtcttatctcaaaaattcctaggcttagaacattaatttttttctagctatactaaaattaaatatcctataaatgaatggttgctaatgagcaaacaaaaaagaagaaaaagacaggcacttttgaaggaaaggaagtccccatttagaatcttaattattagccaggtgtgcaggcttttaatcccagtattcattcagaaggcagaggcgggcagagctctgagttagaggccagcccggtctatacaaagaaaccctgtttcaaaaaaaagtctaattattcttccttagggaatggatttttcccttgcctcatttctttgttaatgagcagcccacctgtggttctgtttcaatttatttcctctgaattgaaacattcaattctggagagaggtaaaagactcagaaagctaaggatgtacaagaaacacatgaaatttacaagactctggaagctcccgaaagattacagggtctctcttcaagaagagtccaaacaaatctcagcacagtaaacagcagagccatcatcagcatcttagctgatggccaagttccagtgccctcaagtctcacaaataggcagagtctcagagccgctatgcaaaatgaattgaaccacaggtgaggacccaaagtgtttcctttgttttggtggttttagtttcacttttggtttggtttgcgttttgttttgtttgttttgagataggttttcctatagctcaggctgggctcaaactccatatgttgagtagagtgcatgaccttcaagtctatttgatcattctcctacttcccagtccaggcctgcaccagcataccaagtatttctttttctgaattgctgtggatgggatccagggctttgtagttgctaggcaagcactccaccacctgagctacatccccagcaattccaggccttaattcttctcaatcacaatgaaatgaggctgtcttggtgcacagatgaggaagtagctcaggcgagaagcacctgctcaagctcctgcttttgtcatggtcccctggagattagcccagctgaaaggctgtgtgtgccatcctgccttccaacggatcacaaagtagttaggatccagccatgccactcagaactttctgctttcatgggagagcatgaggacagggtcccattgctaatgtcaagtgctaccagacacagataaacaaggtgttttgtgatactacagttgctggatctaggaaacaaaacatgttaaatgctgcacacacacaaccttactctttacacccgctaggaactgaaatgtgcctttcttaggtacctagtttattgctgtctccaaggccgcataggctttttatcctaagccagtgtagtgctttaaatagatatggctccatagactcatgtgtttgaatacttggccataggaagtgtcactgtctgagactttgtttgaggaagtgtgacactgtgaggattgcctttgaggtctcctgtgctcaagtgtggcacacagtctccttttggggcctgtagatcaagatgtagaactctcagctccttctccagcaccatgtctgcttgcatcctgccatgtttcccaccatgaagataacagactaaacctctgaaactgtaagccagccccaattaaatgcttgcccttatagagttgccttggtcatggtgtctgttcacagcagtaaaaccctaagacagtagcaaccactgtcttcctttacccaatatcctgcatctccactcagatggccttgaactcataatgatccccttgcctcagcctcctgggattacacagagacagaggcagttggatctttgaattttaggccagcctggtatacagatggagttccagaacagccagagctacacagagaaactctgtctcagaaaaccacaattaaacaaacaaacaaacaaataaatagaaaggcatactagattagttaaatataaatactagtttgatttgcttcagccttttcatctttgaactcaaaactattgtaaggattctttgggctggaggtttagtggggaggtgctaggagaaaactatgggatgctagccaatcaaagaagtttagtcttcctaggtcatttgtatgtaaattaaatcgcttgaatacttgtcagagattgtggaccttcaggtgaaaggaaatgtgttcctaattgcacatactttgctacagtagttgtcaacaaagttgcttcctttcttcagtaactttgtcaatgaaaggcaatgctataatactctaagatagaaatcaacaagggctggaggcaagagagatgactcagtagttagttaaaagagggcttgctgcttttctaaaggacaagagttcaattcccagcatgtgtgcgtgtagtggctcacagctgcttgtatatcttcagctctagggcatccaatgcactctttttggcacatgcaggcgggtgtgggggtgggggtggagggaggcagcaacaaaggaaagtcacattttttttaaagggaaaaaagcccggaagcttgccagtgccccactgttgtgacatgttgtgttcctacccccccagtactttttctgtccttgtgaataaattgtgttttaccccaggagaggattctacttgcttctcttccgctggtgcctccagagttgctctgtcacatcattaaggcctagagaaaatgactagcttcttcttgatttttttctttgttactttgtttcactgttgttaagacctaaaactcattaagtcaaccaggctgcctccagcttacagagatcttcctgtctcagccttctgagtgttgagactgaaggtgtgtaccaccacactcagcaaattcacaagtttgtaaaaccagcactggtagggaaagttgaaagattcccttttgacctctatcatgtgtgtgcctgcccttcccacctctagcatgaatcggtccaaactgtaaagatgaactagaaactggaatcaaagcctgggacttcctttctgattttatttagctgcccccaactatacttataaatatgtctgtccattctatatctgttctgagcatcagcaaaacttaaaaaaacattttttaaggggctggagagatggctcagtggttaagagcaccgactgctcttctaaaggtcctgagtttgaatcccagcacccacatggtggctcacaaccatccgtaatgagatctgacgccctcttctggtgcatctgaagacagctacagtgtacttaaatataataataaataaatctttttttttaaaatttttaaaaaatacaactattacagcaaaaaaaatcttgctaatatttttccacttgaaaaatgttgacttttctttccaataatggtgatacttgtctataactgcagctaaatatttttgaagatacctcatcttagtctgggcatggagctcagtttgtacctaacatgcacaaaacccatcttcaatccctatcatttgggcatggtagtagatacctgtaatctcaatacttgggaaatggagatgggaggataagaagttgtaagccatcttcaagtatctgtatgtttaaggctagactggaccttgtctcaggaaaataaaataagaccttatctcaagaaattaaggcacggtacatgcacacatttaatcccagaacaggcagctctctgcaagttagagaccaccctgctctaaatacagttccaggccaaccaggcttacatagtaagaccttatctcaatttaaaaacaaaaagaaaagagattacattttgctcaactcttcactgcccaaatcacttttgctcttattcacaggcccaaggagacttttcagcacagcctctgaagcagtggcattggcagcatctcctctgctctctgggaaccagttggcaacctctggaagcatttttcattgtcaggtatgggggtgtgggggtggtagaagcaagtggcactgggaagctcctatagtgcataggacagtcctcctacaacagcgacgttttggtcagtggtgctgaggacaagaaacctcttcacaattgaaaagcagacactttgtcctctgggggaagattacaggaagacatcttgctagatataatgagaaggtcattgcctggcactgttacccagcagaagactaatattccaggttgttgctccgtagacccaggtatctcaaaggttatatgatgtccatagagcacagggtgactgggtcacagcctgatgtggccagatttcatctactcacaacaggagaaatttctccgttttgccaggtaaggattaaattgttgagatcttcaaaactgtagccaggcaatggtacatgccgttaagcccagcactggggaggaagaagcaatcggatctttgtaagttctaagatagtttggtctacctagtgaattctaggccagccagggctgcacagtgagacactgtaaagcaactttgataatacgtgtggccatagttttaatattgtcctttgcagctttagttgcttcttaggtctaacaatacgcctgactgccgtttgtgatttgtctcaaatgtagagaagcaacttagcccagtgctgttggaatgcacttttaatcctagcacttgaaagacaaaggcaggtagatctctgtgagttggaggccagcctggtctatctatacagtgagttccagaacagccagggctacacagagaaaccctgtctcgggagagaaaaaaagcaactactgaaactgtatttaccatctattcaacttccttaagtatagacatttatgataggccagcgagcttaccaattagcttcctgggtgattgtacttatcaacaagtactctatagggaagaaggacttcttggaaaactaggttgtccgggcagtggtggtgcacgcctttaatcccagcacttggaaggcagaggcaggtggatttctgagttcgaggccagcctggtctacaaagtgagtgccaggacaggtagggctacaacagagaaaccctgtctcaaacaacaacaacaacaaaaaacaaaaaacaaaaaaagactttatagtccccccaccccccaccccacacctggccaaaaatagattagggaagacagcctgtttgagtttagtttagattcacttgactccatttcaaagttcactacaaagcttactctgtaacaaacatgttacatttgtctatgttgcagtgttcaaatgtgttatcttaactcacaaatgctactgttcagtcattgttacataagttaacagtttctcttacaaggaaaagaacacaaaagcttgactccaggccagctgcctgcatggccttccattgactggatttcagtagggcagttctggatttcgcaaaagaatgttctgggggataaattacatggctcttggccaaaagggactaagaaagtaaatcagctcagagtgagaaagtatgaatttgcccagccgttcattaagctggaaggatacacagataaagccaactgattagtaacagaaaatgacctctctcccaagggatcactacagctaaaaagagccagcacctttgggtgactgctgctcccaggctgactgatatctttccgtgtaaagcctatgggagtagttccgaagaaactgctcggtagttaagagctcttggctgctcttacagaggactgaagtgtagtccacagcaccctggtgagggggctcacaactacctgttacttcagctccaggggatacaacaacctcttctggcctccatggcacacacatggtatacagaaatgcagacagcatgatgggacggggataatgcttaggctgccagatgaagggaaagaaaggacgactatgacatttaggagaatgttgggaagccagtaccgtttaaacgagtcacttttgtgctaggctcaaagcaaggctgcggacagagggctcaggtcaggtctgcactgcccagtgcagctatgggattccctgagctctacaaggaatatatgtgaactcttgagtctggtattcccaattaaaaccacatttccaagctcttggttctctacaggttttaaagaagatggaatgaatcaaaagagaaactccaaattccaaactaaataaagtttagagagaagcatattccagaagaaaatagaaattataacctgagttttatagttgctttggtgggggttgggatttgagacggttctcactctgtggtccaggtagaactgaacttttaattgtgtgacccaggctgctcttgcatttgtattacttctgcatctgctccctaagtcctgagattacacatataaaccccatactggtcttgtaaacttgaaatttgtttcgctatttatgaaggctaaataaattatttcctctgaatgttgtcataagatttttttgttttgtttttattttttttcgagacagggtttctctggatagccctggctgtcctggaactcactttgtagaccagactggccttgaactaagaaatctgcctgcctctgcctcccgagtgctgggattaaatgcgtgcaacaccacgccaggctgtcaaaagattattaaaggtgtgttctataccaagatgtctaagtacaagagaatgaaactgtaccttgaatcctgacattgggtccaacctttaattagcccttagaatctccacctaactgcagaaaagttagacaaaattgccttatatttggcaaaaggtgccaatctgtcctgctgaatgtgtgtaaaagccagttagtgactctttatggatgttgcattccataatctgacactgtgggtcatgatttaaggtcacagcattaaatctttacgagagagcatgtttacagatagaacaaacaataaatagattgaagagactattcacatcctgttttgatgagtcacggaactgagctttagcccatctgtccctggtatgtagttgtaacagctcatttatagacttgcccagtcctaggctgacctcagccaaataccggagtgtgtcttagtctgtaacactgtgggctctgacttcagaaaagcaaaaataagtgaagcccagcctgaagaaaacactactttattttttaatgaaaatttttgagacacagacttgtaaagtcaggctggccttgaatttgctgtgtagctggtgatgatctttaattggtcctcctgctattgtctctggaatgctgaggttgcaggcatgcgtgaccaggaccagcttttttcattctccgtcattgtgtcagttaggagggatttgggtcccaagtctagaaagtatggctgccagtgcacagggctttgcttttcttagataccaaggtgtccgaagccctgggctatcgggaatttgcttcagcgtctctcctgtacccgagtcctctgctccataagcttatgatcacaagatccgtacacttggcataaaaagaaaggggagcaggagatgtatcttttaatttatagaacaactttcccagttctccaacaggtttctactggttgtctccagtcagcagaaaacactcaagggaggctgggaaatgagggccaaggatcagtgaaaacaggaacaaaacttggcttagcctacaagtacatgagtgcgcgtggtactgtttggttaatcaggtctattcagtaggacatggggcagcaaaataagagaaattgttgcagggggcctaccagaaatgacccttcaagacacagtttatagccaattgaaagtctattccagccagctgggactacactcagatttttagggacccaagtgtagccctgagcatatatactaagggtcttttaaacgccaaaaagaaaaagaaaaaaagaaaaaagaaacagaaacagaaaagaagggctggggatatagcacagtggtagagcacttgcctagcatgcttgaggtcctgggttcgatctcagcactgcaaaacaagaaagaaaagaaaggaaaggaaaggaaaagaaaagagaaaagaaaaccacatactgctctctctctctcaatagctggaggggaggtttatacatgcaagcaatttaacagaagctataagccaagataagctgttagctagaggggaaggtttacacaaacaggcattttaacaaaagctatgataaactgttagctggaggagaaggtttgcatcttgagttttggtttctagaatagggttggataatttatggtgcaattctacatcatagagttcaaattctagttaaacctgaaatgaccccagcaagaatacaagatggaggaactgtcttgtcctgtcacaaaatcaaacccattctgttgtgggaacgtcaagatcctggttctatttacttttccaaactataaatcacacaggccgttgcaactctgtttactaatatatcctttaataccctcttttttgttttgttttgttttgttttgttttgttttgttttttgttttgtttggtttttggtttttcaagacagggtttatctgtgtagccctggctgtcctggaactcactttgtagaccaggatggcctccaactcagaaatccgcctgcctctgcctctgcctctgcctctttaatatcctctctattggaccaaattaagtccccacttttcttgcatttgttcatggctagctcagctgtactaaatccccctaccctgctgtcttttctttagtgtgcaaatttgccatggtatgcatgatgccagaggacagatttggggagtcatttgtctccttccatcatgtgttttgagggatcataccaggtcatcgggcacctttatctgctaagccatctcagcagccttttgttgttcattgcaactatgcttaaacaatatcccttcaaggagatattccctagtatccacaaatgggtttgatctgtgacctccaaggcacattactgtctaaagtggcagcagcttgaggactttacataggctctctagtcttcagaacactgtcttaaggtgctttgtgtgagattatgtcatgtgcatggtgtattgcacttttgtgtgtgcaggtgctcatgtgtgtgcatgcccagtggtatagctattgtcctcattgtgaggctgctgagacaaaaatcttagaaagtttctgttgttcaagatcacacagctgatgacaagctctgcccgatgccaaaatctattcactcaacactgtgcttgcgagtgggtgaattaagggtggaacagtacctttcctctttttttttttttttaaagattttatttatttattttatatatgtgatgagtacattgtaactgtcttcagacacaccagaagagggcatgggatctcattacagatggttgtgagccactatgtggttgctgggatttgaactcaggacctctggaagagcagtcagtgctcttaaccgctgagccatttctccagcctagtacctttcctcttactagcctctcctctcctactttattcagcctttgccttggaattctcaaaatgcttatgaataaacaaatagtctagcctcgcctaggagacgagcttctgggcatgtctgagggatgtctagatttagttccttgaggcgggaagatcctccttgcatgggtgcagcactgctgcatggggtggggtccctcccgtatgaagcgaaagagcaaagaagcttagcaccactctgcttcccccactgcagctgtagctgcagcatgacctgctgtcatgcctttcccaccaagacagactgtgcctcaaactgtgagccaaaaataacccacccttcctatgactcttttattcccgcttctaagtgagattcaaatatcctcccttgggccttccttcttgttctttgggtctgtggtatgttgtgtgtgtatcctgtattttatggctaatatccacttataagtgagtacataccatccatgtccttctggctctgggttacctcactcaggatgatattctcaagttctatccatttccctgcaaaactcatgtctgaatagtattccattgtataagtgtacccattgtataagtgtaccacattttctttatccattcttcagttgagagacatctaggttgtttccagtttctggctattacaaataaagctgctttgaacatagttgaataagtatctttttgggatgttggaacatcttttgggtatatgcccaggaatggtatagctgagtcttgaagtagaactaactattcccagttttctgagaaactaccaaattgatttccaaagtggttgtacaagtttatactccaaccagaaatgaagaagtgtttcccttgctccacatcattgttagcatgtactatgtcttgaattcttgatcttaggcattctaatgggtgtaagatggaacctcaaagttgttttgatttgcatttccttgatgactaagggctttgagcattttttaagtgcttctcagccattcgagattcctctgttgagaattctctgtttagctcagtaccccattttttaaattgagttatttgtgttgttgatgtctgtcttaattaggcttttactgctgtgaacagacaccatgaccaaggcaactcttataaggacatttatttggagctggcttaaagattcagtccattatcattgaggtgggagcatggcagcattcaggcaagcatggttcaggaggctctgagagttctacatcttcatgtgaaatcacaaaagcttctaaatcttcactaggagaagattggcttccaagcagctagaacaagggtcttgaagcccatagccacacttccttcaacaaagccatacctcctaacagtaccacctcatggaccaagcatacttagaccaccacagtgtctaacttcttaagttctttgtaaattttggattttagccctctgcagatgtagagttggtgaagatcctttcccaatctgtaggctgatattttatactactgacagtgttctttgccttacagagctttgcagtttcatgaggtcccatttatcaattgttgattttagaacctgagccataatacattcaagggtatttctcactttttcttctgtaacatttagtgtactgagttttatgttgaggtgcttgatctacttggacttaagttttgtgcagggtgatgaatttacatctatttgcattcttctacatgcaggcatccagttagaccagcatcatttgttgaagatgctgtctctttttttcaattatatgcttttggcttctttagttgaaaaaaaccaagtgtccatacgtgtgtgagttcatttctgggtctccaattctattccattgatctacctgcctgtctctgtaacaataccatgcagggttttttttgtttgttgtttggtttggttttggttttggtttggttttttggtttttggtttgttttttgttttgttttggtttggtttttttttttggttttttgagacagggtttctctgtatagccctggctgtcctggaactcactttgtagaccaggctggcctcgaactcagaaatccgcctgcctctgcctcctgagtgctgggattaaaggcatgcatcaccaccgcccagctaccatgcagtttttatcactattgctctgtaatgcagcttgaggtcagggatggtgattcctcacaaagttcttttattgttcagaattgtttttcctatcttggggtttttgtttttccatagaggttgaaaatctctataaagaattgagttggaattttggtggggattgcattgactctgtagattgcttttggcaagatggccatgtttactatattactcctgccgatccatgagcatgggagatctttccatcttctgagatcttctttgatttctttcttcagagacttgaagttcttgtcatacagatctttctcttggttagagtcataccaaggtattttatattttttgtggcttttgtaaagggtgtttccctaatttcattctcagccatttgtttatcatttgtataaagaagggctactgatttctttgagttaattttgtacccagccactttgctgaaggtgtttatcagctgtaggagttctctgggagaacttttggggtcacttatgtatactgtcatatcatccacaagtattgatacctaacttctttttttccagtttgtatccccctgatcttcttttagtgggcagccttgtcttgttcctgattttagtggaattgcttcaaatttctctccatttagtttgatgttggctattggcttgctgtatattgctttgattgtgtataggtatgtgccctgtatccctgattctttactactagtaacatgaagaaggagtgttagattttgtcataggctttttcagcatctgagagaagcatgtgatttttttcttttgagtttgtttatatggtggattatgctaattgttttttatatattgaatcatccctgaacccctggcatgaagcctacttgatcatgatagatgatggttttgatatatccctggattcagtttgcaaggattttattgagtttttttgcatcaatgtttttatgagaaattggtctgaagttctctttctttgtttttctatcgtcttatttatttacacttcaaatattatctgcattaccagtcccccctccatgagactgcaactctgtccacctcccttttgcctctaagagggtgctcccctaccccctccccctctagcatcccacttctctggggcatcaagcctacaaagaacctagcacattcctcccactgaagccagataacgcagtcctctgctacatatgtagtgagtgctacatgccagcccatgcatgctctttggttagtgacttagtccttaagagttgcttttaggcatccaggttagttgacaatgttggtcttcctatggggttgccatgcccttcagctccttcaatccttcccctaactcttccatagggatccccaggctcagtcctgtggttggctttaagcatatgcctctgtctcagtcagctgctagtagagtcacaggacaaccatgccaggctcctatctacaagcacaacatggtatcaacaatagtgttggggtttgatgtctatgcatggaatggatcccaagttgaggtgatctctggatggcctttccttgagtctctgctccatttttgtccctgcatttcctttagacaggaacaattctgggtcaaattttttgaggtgggtgagtggccccatccctcaactggggggcacgcctatctactggaggtggtctcttcaggttccatttccccactgatgagtagtttgactaaggtcatccccttgggtcttggagtctttgtttgttttaggaatctgggtaactgtgacctcatagaatgagtttggcagtgtgttccttctgtttctattttgtggaatactttgtgaaatagtttgagtggtattagctcttctttggaaaatctcttagaattttcacaaaaaccatgtgacccttttggttgggagacttttaacagctgcttctattttcttaggggttatgggactctttagatagttcacctgatcttgacttaactttggtaaatagtatctgtctagaaaatcagccatttcattaagattttccaattttgtggaatacaggcctttgaagtaagacttaatggttctttgaatttcctcagtgtatgttgttatgtctcccttttcatttctggttttgtttatttggatattgtcttttggttagttaggctaaggtttttctatcttactgagttttctcaaagaacctgctcttggtttcattctttgtattgttttctttgtttctgattgatttggccctgattttgattatttcctgtcttctactcctctttggtgtgcttgcttccttatttatttattttttttagatctatctatttgagcgcacagcacggttgctgtcctcagacacacctgaagagggcactggatcctattacagatggttgtgagccaccatgtagttgttgagaattgaactcagggcctctggaagagcagtcagtgctcttaacctctgagccatctctccagcccatgctttttttttttttttttttttctctagagcttccaggtgtacttttcaattgctggtaagagaactctcttctggaggcatttagtgctgtgaacactcctcttagtgctgctttctttcattgtgtccgatagatttggggtgaatactaggaagtctttaatttctttatttcttccctgacccagagatcattgagagagttgttcaatttccatgagtgtgtagcctttctggtatttcttgtgtctttgaagtccagcttgcttgcttgcttgcttgcttgcttgctttcttttggttttttgtttttgtttttcgagacagggtttctctgtatagccctggctatcctggagctcactttgtagaccaggctggcctcgaactcagaaatctgcctgcctctgcctgtactgggattaaaggcgtgcaccactacgccctgctgaagtccagctttaataaacaatgctctgataagatacaaggagttgtttcagttttcctgtatctgttgaggcttgctttgtgactgactatgtagtcaattttggagaaggatccaagaggtgctgagaagaagttttttttttgttttgtgtttgggtgaaatattccgtagatgtctgataagtccatttgattcataatatctgttaatatcattatgtctgtgtttaggtttgtctggatgacgtgtccattggtgagagtagggtgttgaagtctcccactattaatgtctggggtttgatgtgcaatttaagcttttacaaatgtgggtactcttgtatatggggcctaggtgcttagaactgaaatatcatcttgttagatttttttcctttgatgagtatgaagtgtctttccctgtctctttcgactaattttggttgaaagtctattttattagatattagaatggctactcaagcttgcttcttgggtctgttttcttgaaaaacttttttctagccctttactctggggtaatgtctatttttatggctgaggtgtgttttttatatgcagcagaataatggatcctgttttcacatgctttctgttagcttgtgtcttttttagtgaggaattgagtccattggtgttgaaaggtattaatgaccagtgtggtggtttgaatatgtttggcccagggaatagcactatggtggtatagtattgttggagtagttgcatcactgtagaggtgagctttaagcccctcattctagttgcctggaagccagtcttttagcagccttcagatgaagatgtagaactctcatctcctcctgcaccatgcctgcctggacgctgccatactcccaccttgatgatactgaactaaacctctgaacctgtaagccagccccaattaaatgttgtcctttataagagttgccttggtcatgatgtctcttcacagctgtaaaaccctaacttatacaaccagtgattttatttcctgttattttgatgttggtggtggtggtgtgtgtgtatgtgtgtgtgtgagtgtgagtgcgtgtgcacacacacagacacacacatacatgtgcaagcatactttccttgttcttgctaatgtggaattacttatttcctgtgttgtcttggatgtagttattctccttgggttggagttttccttctagtattttttgtaaggctggatttgtggatagatattgctttaatttgaatttatcttgaaatatcttgttttctccatgtatggtgattgagagttttgttggatatagtagtataggttggcacctgtggtttttttttttttttttttttagaggttgcaagatacctgtccaggacgttctagcttctagagtctctgttgagaagtcaggtataattctgataggtctgcctttgtatgttacttggccattttcccttgccacttttaatattctttgttctgtagattttgtatttgattattatgtggtgggaggatattcttttctattccagtctaattggtgttctatacgcttcatgtatttttataggcatatctttttttaccttgacaaagttttcttatatgattttgttgaatattttctgggctgtggagctaggactcttcacctttttctattcctattattcatagttaggtcttctcatggtattctggatttcctggatgatttgtgttaggaattttttaactttaacattttctttgggtgaagtatcaattcctactattgtatcttctatgcctgcgattctctctcccatctcctgtattctcttgctgatgcttgggtctgtttttcctgttctcttccctaggattccagctccagggtttcctcagtttatgtttcctttattgcttctatttccactttcaggtcttgcacagttttattcatttccgtcacctgtttaattgtcttttcctgtatgtctttaaggaattcatttgtttcctctttaaagacctctgtctgtttgattgtattttcctgtgtttctttaaaggatgtgtccatttcctctttaaagacctctatctttacaagattggatttacagtcattttcttgtgcttctgttatgttaagatatccagagctagttgtagtggggtagctgtgttctgaaggtgtcatatttccctggattttgacaattgtgttctttcaagagctaaaggtcaactggatggctttggtccctggaggctcttgtagtagctattgggtggcagtggttgatctggatggtcctggtgtgacaggcctctggtgggtatccctgggctgtatggttgtgaaactgcaggtctatatggttccagttccacaggtttgtatggttcaggagctgtagatccaataaaggtgggcagatagttattgggaaaatgacagtccctttggtctagcaggctgctcagagcagtttggcgtgcccagaggactatgtgagcaaggaaggtgggaggaggggagagaagctttcctgtatggttcaggctctgcaggtctgatgaaggtgggaagagaggtggcaggagaatggaggtccccctgggatagcagcttgctcagggcagctctgcttgctcctgaggactaagtgagcagggaagatgggtgtgggaagagaagctttcctgtatggttcaggagtcactggcctgatgaaggtggcaggagaatggaagtccccagagggctcagcaagctgaaggaagggaagcttacttgtatggttcaggagtcacaggtctgatgaaggtgggggtaatggtggcaggagaatgttatatgctgttatttttttaaattatgttatcattattgttgggtagcaggggcatacctgtagagatgaggtcaaagggcaacttttaggaattggttctttcctccttcctgtgtatgggttgtagggctggaactcaggtcaccaggtttatgcataaagcatcagtatccattgagccatctaacaggacccaagatgctgttattttgtctgtgaattcttgttccatagagggaagtcagtgttttatcaatgagagattcaaagtatgtttctgttagctgaattaatccgcagaatagatatttcaatgccaaaatagaagggttatttttttttcctggcttcttcaactcactatctagccaaggatgaccttgtaattgtggtcctcctgactaccttttaagtggctggaccatttacaggcatgtaccactatgcccagtccatgcaatgctaggaacagagaacctagagcttcatgcatgcgaggcaagcactgaaccaactgaggcatatccccagctcccaaatgtaagttgttttacatccatattacatatgtaacgatgctacataaaagtggggcctcaaagagaggcccattggacttgcaaactttatatgccccagtacaggggaacaccagggccaaaaagggggagtgggtgggcaggggagtgggggtgggtggatatgggggacttttggtatagcattggaaatgtaaatgagctaaatacctaataaaaaatggaaaaaaagggctggtgagatggctcagtgggtaagagcacccgactgctcttccgaaggtccagagttcaaatcccagcaaccacatggtggctcacaaccacccgtaacaagatctgactccctcttctggagtgtctgaagacagctacaatgtacttacatataataaataaataaatctttaaaaaaaaatggaaaaaaaagtggggcctcctttaaaagcagacagtgttatgtataaagctttagggtaatcttccctaagaagtcagtattgaaaatctccaaaacttcccattataatatatactgccataccacttgctcatcccaagctgtaagtccatattagaagttcacccagccagttaactcccacttcagaacaagttatgccatttatcagtttgtggcctcacagttcctagttgccccaccccaccccatttcttgggcttgatttgtaatattggaattgtaagcagttactaggtctcacaatgtcaagcttggtcaggtgagggtgctggaaacagtacaaaacccgacaacatcaggaacttgtctttctagtttagcttgtttccttttcctgacatctatggtccaagtggtgtgtagaagatctagaacccaccattcagcagttgccagcatctcggcagttaacatccttgttagcaatcaggatattcggtggcagcagctcaccgccaacagctcactagcactatggcaagcagctcccttgtctctatccttgcccagctttaccttgctgctttcccactgtctagccagctacaaactatgttgtcaaacagtgtgaaagttagcctgaatggggcaggacagtgcccatgtgttggcctaccttggacccatcccttcaactctagagatagctacttcttgcaatgctattcttccattctctctcccttttttttaattaggtattttcttcatttacatttccagtgctatcccaaaagtcccccataccctgccccccactcccctacccacccatcccacttcttggccctggcattcccctgtactgaggcatataaagtttgcaagaccaatgggcctctctttccactgatggccgactaggccatcttctgatacatatgcagctagagacacgagctccggggggtactggttagttcataatgttgttctacttatagggttgcagatatccctttagctccttgggtactttctctagctcctccattgggggccctgtgatccattcaatagctgactgtgagcatccacttctgtgtttgctaggccgcggcacagtctcacaagagacagctatatcagggtcctttcagcaaaatcttgctattgtatccaatggtgtcagcgtttggaggctgattatgggacggatccccaggtatagcagtctctagatggtccatcatttcgtctcagctccaaactttgtctctttaactccttccatgggtgttttgttcccaattctaagaaggtgcaaagtgtccacactttggtctttgttcttcttgagtttcatgtgtttcacaaattgtatcttatatcttgggtattctaagtttctgggctaatattcacttatcagtgagtacatatcatgtgagttcttttgtgattgggttacctcactcaggatgatgccctccaggtccatccatttgcctaggaatttcataaattcattctttttaatagctgagtagtactccattgtgtaaatgtaccacattttctgtatccattcctctgttgaggggcatctgggttctttccagcttctggctattataaataaggctgctatgaacatagtggagcatgtgtccttcttaccggttggaacatcttctggatatatgcccaggagagtattgcgggatcctccggtagtactatgtccaattttctgaggaaccgccagactgatttccagagtggttgtacaagcttgcaatcccaccaacaatggagaagtgttcctctttctccacatcctcgccagcatctgctgtcacctgaatttttgatcttggccattctgactggtgtgaggtggaatctcagggttgttttaatttgcatttccctgatgattaaggatgctgaacatttttttcaggtgcttctcagcccttctgtattcctcaggtgagaattctttgtttagctctgagccccattttttaatggggttatttgattttctggagtccacattcttgagttctttatatatatatactggatattagttccctatctgatttaggatagggaaagatcctttcccaatctgttggtggcctttttgccttattgacggtgtcttttgccttgcagaaactttggagtttcattaggtcccatttgtcaattctcgatcttacagcacaagccattgctgttctgttcaggaatttttcccctgtgcccatatcttcgaggcttttccccactttctcctctataagtttcagtgtctctggttttatgtggagttccttgatccacttagatttggccttagtacaaggtgataggaatggatcaattcacattcttctacatgataaccgccagttgtgccagcaccatttgttgaaaatggtgtctttttttccactggatggttttagctcccttgtcaaagatcaagtgaccataggtgtgtgggttcatttctgggtcttcaattctattccattggtctacttgtctgtccttgtaccagtaccatgcagtttttatcacaattgctctgtagtaaagctttgggtcaggcatggtgattccaccagaggttcttttatccttgagaagaatttttgctatcctaggttttttgttattccagatgaacttgcagattgccctttctaattccttgaagaattgagttggaattttgatggggattgcattgaatctgtagattgcttttggcaagatagccatttttactatattgatcctgccaatccatgagcatgggagatctttccatcttctgagatcttctttaatttctttcttcagagacttgaagttcttatcatgcagatctttcacttccttagttagagtcacgccaaggtattttatattatttgtgactattgagaagagtgttgtttatctaatttcgttctcagcctgtttatcctttgtgtacagaaaggccattgacttgtttgagttaattttctatccaactacttcattgaagctgtttatcaggtttaggagttcttttctggtccagtctatttggagttctgtaggcttcttgtatgttcatgggcatctctttctttaggtttgggaagttttcttctataattttgttgaagatatttgctggccctttaagttgaaaaatcttcattctcatctactccagtaggtttggtcttctcattgtgtcctggatttcctggatgttttgtgttaggatctttttgcattttgcattttctttgattgtgccgatgttctctatggaatcttctgcacctgagagttctctcttccatctcttgtattctgttgctaatgctggcatctatggttccagatttctttcctagggtttctatctccagtgttgcctcactttgggttttctttattgtgtctacttccctttttaggtctagtatagttttgttcatttccatcatctgtttggatgtgctttcctgtttttctttaaggacttctacctgtttggttgtgttttcctgtttttctttaaggacttgtaactctttagcagtgttctcctgtatttctttaagtgagttattaaagtccttcttgatgtcctctaccatcatcatgagatatacttttaaatccaggtctaggttttcaggtgtgttggggtgcccaggactgggcgaagtgggagtgctgcattctgatgatggtgagtggtcttggtttctgttagtaagattcttacatttgcctttcgccatctggtaatctctggagttagttgttatagttgtctctggttagaacttgttccttccgtgattctgttagcctctatcagcacactagctctctcctgagtttcaatggtcagagcactctctgcaggcaagctctcctcttgcagggaaggtacacagatgtctggcgtttggacctgcctcctggcagaagatgaaggcccaaaacagggcctgtcccagaagctgttagcttctgtagtccatactctcacctgtgcagactagtctcaaagggatctgggaaccaagatggcttccccaggtgctcagggaaagccctcccgggcggggaggacacttctcttctggcagggaaggtgccaggatgtctggagcccgaaatgggttctgcctaatgcaccttgggtgtgtcctccgactcctcgcccaggtgacccagtgctggcaccaaccggaaggaacttgtgaccctggtcaggctgggttttctgcttccctaatgctgtcttaggtcctgtgcaattggaatggaacagaagttgtgttccactcactggtggtcctaagatcgagtggagagtcctctagggaccttgcggaggtgtccactgactccgtgcccaagatgacctggtgctgacaccgactggaagggcccattcttttcagtcttctgtcagtcatcctttgtgagtggatgtgtctggggggatgctcgtgtgttcatgtgtgcatataaatcagaaagcacatttggaagccagaagtcttctaacttttgttattattttaacaaggtttctcatagggcaggctagcccatctagccagtaggtgcatggggtcaaccttttgtctcatcctcatagggattacaagaaaatggcatcaccaatagctttgtccagaggttctggggatctgaactcgggtccttacactctcaggcaaatggcttactgagccatccccctagccctctatcccttcagttatcatctttatttagtaattctttacacaaactgtgttcaaattactggtatggtttctgtttccttactgcaccctaattgatacacatgacaaaactaaatgcaaagaatccaggttggattaaattcccacttgaaaaatgacatcccaccactatcaaacataaatatttctttttctttttctttctttttttggtttttttttttttttggttttttgagacagggtttctctgtgtgtcctccacatgctccaccactgcctggctaaacataaatatttcaaaaactgtcaaaaaccataaagacaccaccaccacccccaacaaaaagcatgtgctggcgaaatcgttccatggataaagatgcctgcttccaaacctaacacacacacacacacacacacactattataaaaatactttttttgttttgttttgtttttcgagacagggtttctctgcagccctggctgtcctggaactcactttgtagaccaggctggcctcgaacacagaaatctgcctgcctctgcctcccgagtgctgggattaaaggtgtgcacccccacgcccggctaaaaatacttttaaaaagaactaggactagaaagatagctcagtgttaagggtacttactagctcttacagagaagatcatgttgggatctaagcacccatgccaagctgctcacaaccacctaaaacttcagctccattgtgacagacaccttcttctggcctctatgggcaccagcatacatgtgcatttacccacatagttgagtggcatttgtcgggactccatagagagagaagcactaaaaaccctctggtggcgtactgcagtttcttgctgctttcacagactctggctgattggcagagtgatgtcagttgagacaaatgcacatgctgaggcaagacaggtgctaaggcaggatctgtgggggacacgtcatgtttggaggagtctgcctcagtctttcacctgtgtccacttgaggaaaacactccttcacatgtttgccccagcaaaaccccatccaacacaactgactttccaaagaacccttaagtttccacttcagctaagccattaagatcaggtgttgcagggctggagagatggttagtgagatggctggagacagtcagtggttaagagcactgactgctcttctgaaggtccagcaaccgcatggtggctcacaaccatctgtaatgatatctgacaccctcttttggtgcatctgaagacagcttagatacaataataagtaaatctttaggctggaatgagcagggccgactggagcgagcaaccttcattcccagcaacctcatgatggctcacaaccatctgtacagccacactgtactcatatacataaaataagtaaatcttttaaaaaaataagtcagttgatatattgcaaagcaaattagatatagctaaaaagaagtcaattcactaaaatcgattaaggcagttttcctgaatgctgtgacaggaataacaccaaattgaaacatataaacaagtttgagacttagaagataaaatatataaacctaagaaaagccaggtatagtggcacacgcctttaatcccagcactcaggagacagaggcaggtggatctctgagctcaaggccagtctggtctacagagtgagtgccagggctacacagagaaaccctgtctcaaaacccacaaattaataatagtagtagcagcagcagcaatagtaataatgttaagagaactgtttatagtgtgtccccttgtatttaagaaaggaaaagaaagtggggtatggtttttgggtgcctgaaatctcagtacttgtgacacaattggaagcaaagattgtatctcaaataaaaattaaaaaaaaaatctgtgtgtttatatttattatatttccatagcaaatcaaaatgacatacaaataatgaaattaagagcagtcatttgtttgtatgtgtgtggaggtgataggcaggaatgagattgggactttaattgtatgcattttatattggtttcacttatcaaagtggtgcattaggctggcctctctttgaagcagaagccaggatgggattggccactgaggactgattagggagatgtctgtgagagagaaaggggaggagccttcagacaatgcagttctggtgcctggggaaggcaggttgttccacagattcttaacactgcagagcagttctggaaaaggtttgtcaggctgatgaagcagccccaggccccaaatacccatcagaagaaagatacatcctgcagaaatagatgtacattgatatacatgccgtacttagtcactggctgcttgctaccagcagcctttgtgagggactatgtatgtctgcactgatgccttggagattcagaatacagcaggctgaggccatctgttacttatgttccttggagcaagagattggagtggcatattttcatagctgccacatcatgagacgaaattttgtattgaaagggacgaaggcattttcagacaaaggctaaatgagcttatcactcacgtgtcttctacatcaaataaatttcattttacatctaaccgtcactttggacttgcctggtatgacattttatagatgtagcatggcttcctgtattacctaaggacctcttaaggatttgcttcaaagagaaatggtttcagaaggacactgtagggtggaagcagcagtggaaagcaaataagctaggaaacatttgggaaagaaatcaatgaatgcaggagccagcagctgactcagcagcctgatgtactgagtctaatctccagaacccacagggtagaagagaacctagtccagcaagttggccgctgtcatagtcagtgctctattgctgtgaagagacaccttgaccatggcaactcttataaaggaaagcatttaataggggcttgcttacagtttcagaggcgtagttcatagtccacaatatagggagtattgcagcacacaaggggacctggtagctgagagttctacatctagaatccatggcagtaggaagagagagacactgggtctggcttaagatttgaaactccaaagcccacccccagtgatgcacttcctccaacaagaccatgcatactctcaagtaatgccactccctagttatcaagccttcaaatctatgtctattatgtcaggaccttccctattcaaaccaccagtctctgacttctactctgcatatgtacacaaacacaccaccaaataaaataaatgtaattttaaaaatcaacaaatatgcagataaatctattgacattatttattaaaaatatctaaatgtgatgttgattacctgtaagtagagaagtaaaccaaatttccatgatgcatacctgtgattgcaggactggggagaataaggcaggtggattttgaacttgagactaacctgggctaagtagggagagactctctcaaaagataaatacaacagtgattgattggagtacattaaaaatgaaatgaaaatactaatatgtaaaattggaagaggaattggaggtatgttaaggtttatgtatttgtcttgaggattgaaaaacacaacttcagatttcaaacaagttacatgaaaaattaggagaaatgtctgtaggtctggggagatagctcagtaaaatgcatgagtacttgaatttgatccccataacccatgtaaaaatgccagacatggtggcacactctcagtgctggggaggccaagacagaaggacccctccggctgactagccagccaggctaccctacgtggcaaaccagtccagtgagaaatcctatcttaaaaaacaagatgggtggccatcgtaaggatgatggctaaggttgatctcaggtacccccacacacttgtacacacatatacataaaatgaaattactcaggatgtaaatactttctacctttcatggaaaaaaaaaaaggatgactcaaagggaggagccagaaggcctaagggcaaaactgggagtcgtgaggcttttttttttttttaccagtctcaacacttaaaggagttactcagctgggttttaaaactgctttagcctagtgcctcttaggtgggtaggatatgtgttagacggggtctcaaataaccaggctgtcctggaactcaggatcttcctgcctccacctccccagtctgtgcaccatgtgcatgcctggagccctcagagaccagaagagagcattggatactatagagggaaaataagttgtagagtcattatatcttaggtgaacatcagaatgaagttgttgttttctagaagttcttcgacctttaagaaattgttgtagaaaatagtgatgagggctggtgagatggctcagtgggtaagagcacccgactgctcttccgaaggtccagagttcaaatcccagcaaccacatggtggctcacaaccatccataacgagatctgatcccctcttctggagtgtctgaagacagctacagtgtacttacatataataaataaataaatctttaaaaaaaaacaaagaaaatagtgatggttttctctggtttccagagttgttttcctgcgggcgctttacaacctttgcatgctttagtcagaagacggtcctggcacacctggaacatcctgcataactgagtgctgcaaacagtgcacagtaaggacagagactgtgaggtgctccttcaagaactatagatttgatatgagaaacttattttacccccaaagcaactttgtgagataatcaatgactatgcttctatacagtagtttgaggttcagtccatcagaggctggacctccctgctgccttcaaggccacatttcatcctggagtgacctgctttctttgatcatcccatgtaactcagaactggagttacagatggttgtgagatgccatgtgggttctgggaattgaacccaggttttctggaagagccatttctctagcccttttttggatttttgcccctgttgttgtttttagcctttgagggtggtggagtctcacttaacccatactgccctcaaatttgtggaaaccctctgcctctgcttcccaagttcagagattgccagtgtgagcctctatgcaccaccatgagcctattttgatttggttggtttgcatgtgtgtgtgcatgtttacagggttgaacagaaagtaaagtcgggtttgaaacagaagaaagacatgctgccaattacttgaagccatgtgcaaggatcacagtaccctttagaagctaagcatgacccctggtggcagccagcaagcaactcaggatttcaaaactaaaattgcatggaactgaattctgccaacctaaatgggtgtggaagtagaggtaccaggttttctggaagagccatctctctatcccctttcgaatttttttttcctggtcattgtttttagacttttttttttttttttgagacagtctcacttagcccagattgtctctgaggctacctcgtaccaactagattagagctgaggtttaccagcaaatagatttcagccttgtacaatctgaagcagagaaatcgtctgagcctgtctggacttgtgacctagaaagaaatcattgttgttttacttgctaagtctgtggtgattctttgacagcatagaaaatcatatattatctcctcaaaatatgttcaccacagttggtatagttcagttaagatgaagtcacactggaatagggtggctgctatctctttaaaccgttttagttaatatgcatgagaggagagagagagagagagagagagagagagagagagagagagagagatcactcacagcacagcacacatgtggaggtctgaagacaacctgaagaagttggttttctccttctaacatgtgggtcctggtgattaaacccaggtcatcaggcttggcaacaggtacctttacctggctgctgagccatcatctctccagcccatgtctttataagggaaagaaggagatttagacaacagagacacacaggaggaaggaggccctgttctcaggtgacagtgagctgcggggtatgcacagaatgccacagaatgcaggagttgcctggagcctcaagaggccaggaaagatgtttttccctagggtccctcagaaagccgggcataatagcacacatctgcaatcccagaattgaggaatctgatacagaggtatcaggaggtgtgtgttacataataagttcaaggccaacctgaactatataatgagaccatgtctgtacctgtagttagctaatcactttgtactcccattccagagcacccgcatacccgctcaagagctatctggattctcgaatgaaacacacacacacacacacacacacacacacacacacacacaccagttatttttaatatgccttgactagcttaaatggctgggcatttctaatcctttccactgctagcaaacactaccctccagtactcctgagttaatatcttttaaaatctatatttcatctctgctatcccaaacacaataggggaagtggcccatgtggttattttccttaattcttacatattggtgggcctttaggtctggtctttctttttctttcatggcaatctctctcttcttcctctcttccagttcctagcctaggcaaatctaaaagttccacctctctctctctctttctgctcagccattggcctttggctctttattgatcgatcaaaaaccaattggggccggacgtggtggctcatgcctttaatcccagcactcgggaggcagaggcaggcggatttctgagttcgaggccagcctggtctacaaagtgagttccaggacagccagagctatacagagaaaccctgtctcaaaaaaacaaaaacaaaaacaaaacaaaaaaacctccagtgtttggacaggcagattcccaattaattcacaacattagaatcaatccccaacacatgtcccttccctataaattaaaaaaaaaagccaaccttgagagattgggaagagagggaagaaggggagcttgtattgataccttaattttgtatttctagcttctagggtttcaagagtgtgtatttgtgtatttgtttctatgtgtacaggtatgtgtgtatgtcaggtattacattcctaaagaaccatccaccttggggtttttgtttttaattgtttacatttatttatttgcttatgtacttacttactgggggcataggtgtgccccagtgtatatatggagatcagaggacaagttggaggagttagtttttttccttccatcaagtggaacctgcgattaaattcaggtagggaaacctttatcagatgagccatctcttctcactgacacctgggactcactgtttcgtatagtgtctggcaaatgaacccagggctttgtctctgccttcccaacactggaattacaaccatgagccaccatgcccgctttttatgtgttttgttttgttatgatagggtttcaccatgtagcccagctggcctggaacttgatatataaaccagactggctcaagatctctgcctcttgagtgctaggtttaaaggtgtggccacacctagattttaaaatgtggattctgaggattatattcaggaccttaaactttgcaagataagcagtttactgaatgcttcccgctcttcccagggacaccagcatccatagctcacaattacctggaactctagtgccaggggatccagcatcctcttccttgggcactggcacacttgttgcatatgtttacagagacacacaggctgctggtttgaatgagaattatcccccataggctcagatgtttgaacacctggttcccaatgatggtgttgtttgggaggtttaggaggtgtggtcttattggaagaagtatgtcacaggaagaagacttagaaaatttaaagaccctgtctcaaaacaagaaaaagaaagccttaaaacccaagtaacataaacacataaattattatatatagaaataaaatcttgaaaaacaagagtgttctatattttcctttatctattgatgaccaggtgctcctaatgatttaacttattttttttttttgagacaaggtctcactatgtggtcctggctgtcctgtaactgagagaccaggtggcctcaccctcacagagatccacctgcttgatatggggctgggcttgacattcctgtcttctctgtatgagtagagtgtgctcttaaccactgagcaattcctccaaccctctaccatcttagtaaccattctattgctgtgaagagacaccatgactaaggcagctttaaggaagcatttaattggagctggcttacagtttcagagggttagtcctttatcatcatggcagtagacaggtatgctgctgagagatctacatctttatcttcaagccaagatactgggactgacataggcttttggaatgtcaaagcctacccccagggacacacttcctccaacaaggtcacacctcctaatcctttcaaacagtgccacttctcggtaactaagcattcaaatctatgagcctatgggggctgttcaaactatcataccttttttttttaacataaatttagtgtgggagactgagggtgtgcatgctacagcaatcatatgagtgtcagaggacaacttcaagaagctgtttcttgccttccactatgtgggtcacagtgattttacccactgagccatctcactggtcctctattttttgttttttttttttggttttgttttttttttttttttggtttttcgagacagggtttctctgtgtagtcctggctgtcctggaactcactctgtagaccaggctggcctcaaactcagaaatccgcctgcctctgcctcccaagtgctgggattaaaggcatgcgccaccagtgctcggctggtcctctattttaatatttattcccactcagcatgttatctctaagctttcccttttctgttcaaagtctgatttgttttgagacagggctcactttgtagccttgactggcctccagttcactatgtagattacactgatctcaaattcacagaaattcacctacttctgcctcctaagtgctaggattaatggaatgcccaactcaaagcatgatcttaaatatatgtttaaaaactgaatacagttgagtgtggtggcccacatctttaattcaagcaatgagaggcagaggcaggtagatctcttgagtttcaggctagcctagtctacagagcaagtttcaggacagccagggctatacagggaaacccagtcttgaaaaacaaacaaaagaaattaatacaatggaggatttctatcctgtcttggtgcatgttggtagccttttgtcccctccatatgtgctcacagggtacaggttaaaagctccaaagagaaagatggtttgggtcccctttcatttgcttaactttgttttctctttgtacatgtgctcctatgaatagattcttgttaacccttcacttctctgcatgtgtgttttcttttttttattagataatttctttatttacatttcaaatgttatccccttttctggtttcccctctgaaaatcccctatcccttcccccttccccctgctcaccaacacccacatactcctgcttcctggccctggcattcccttatactgaggcatcgagccttcacaggaccaaggacctctcctcccattgatgacagactaggccatcctctgctacatatgcagctacagccatgagtcccaccatgtgttttctttgattggtggtttagtccctgggagctctggaggtactggttagttcatattgttgttcttcctatgggactgcaaaccccttcagctccttgggtcctttctctagctccttcattggggaccctgtgctccgtccaatgaatggctgtgagcatccacctctgtatttgtcaggcactggcagagcctcgcatatgtattttcttatacactgtaaatgtatggcaacataaccagtgcccttggtcttatttccccgtgaaagtacaagactttattcctctggactgcctgatcagtgtggatcccatgatcatgaaggagaatggagatttctcttttgaactctgctggtcagagataaagctatgcctttccattgttcaatgctgcatatttaatacacaacaaaattttaagccatagcagctttttaagattttaatttgtcactattgtattacagagcaaatagcaaataaccattttatgaggggaaaagggaagcaggaaatggacatgtggcttttggcctttgttctgttgcactttccattgtcaagtaagtctaatgtttctatgatttagaagataggaatgcattttcaaacttcatggctggaatttgtctcctgttgttgtaaactatcctaaaatatggtggcttattttcttggtaccaaatcaggctctttttgttcgaggagtgctgaaccagttagagaaataatgagtttgcaaaagacaaagaacacatctgtaaggttgccaagtaaacatgggagacccaagcctcaaatcttcctcggatttgaggatggttacagggcaaagaaacagggtggttggaggaggtatgaagagggcgattggcagggaaggcatgagtagcctgcacacatgtactcagtctctttggcttttcatagaatgtgtgctcagaaaatagcagtgctaccatagtctaaggatggagttttcagcctcccgatggcagggggtcacccatcagatacctgttcagacccaaaagaagagtccacgggttttcatgggaaaaacaataactgaagaaaaaaaaaaaagagataaagccagccttcaaatctccaaagagtagcctaggcaaccattatcatcacgactcacatgtcagagatgttgtctacagctgtgtgagcagcaacattttcaaagacaactgaaagcaagtacctaaggaagcataggggctcagaatcaggtataaaatgtagaagagattgctgagtcccaaggagactaggcaggctgcgtttattggcttgcaaagatcaaagctagatcctgttctcccactcagacttacagacccaggtcttcttttgatgtctctcatgtccttgaaaaaaatgcttcagaactatgaaaggtatttcagttgtgaatccttttagtagatgctggaggcccaccaagcaagggtcctcttttattccaagggacctggactggtccctttccctagttatcctggatgtgtttctcctttattgtcactgtcctgttcagtctagattagttagcagttctgttcagtgtagagctctatcctaaagcatgctttggctgaacgactgcaggttggtggagccatcttatgatttccatgaaccattgccactggtctgttagaaccctacaatcttggctcctgctcttatttggctttccatgctttctgtcagtatgcatttgctgctgtcacaaattggacatgtcacaaaatgcgccatggctgccctgagtatcttaatgcatagctctcaatgcttgtccctgttagcttgtatttagttttgttctctctctctctctctctctctctctctctctctctctctctgtgtgtgtgtgtgtgtgttgttgttgttgttttttgaaatattctatctagtattgttgtggggtagtggaggatgtatgccacagtgcatacagtacatggatggagctcagagaacaacttcgtggagtcagctcgctcctttgacctttatgtgcaccctggaggttgagctctggttgtcaggcttgtatagaaagcgcctttacccactgacatctttaccactaacacagacgtgtgtgtctctgtgtgtgtgtgtgtgtgtgtgtgtgtgtgtgtgtgtgtgtgtgtgttgctggagatggcctctagggctctgtacttgttttttgtttgttttttaatttttttgaaacccttgtgtcgagggctgactttcaataggtcgcagcgagggaattgctctgctacatgtgaaccccaccccaccctgtacttgttaatcaggtattatatcattgagcttcaccccagcttctcttagtctttttaaatttgagacagggtttcactgtgtaaccctgactggccaggctgatcttgagctgatcttcaactcagagatctacttgtctctgcttcccaactgctgggattccaatgtatgtgccactactccagtcttctatatttgtactgcagagggataaaacagcatctagttttattgtacagataaatcctactataaaagaaagctagtgccaggcagtggtggtgcatgcctttaatcccagcacttgggaggcagaggcaggcaaatttctgagtttgaggccagcctggtctacagagtgagttccaggacagccagggctacacagaaaaaccctgtctcaaaaaaaaaaaaaaagctagcagggtggaggagatgcctcagtgagtaaaggtgcttgctgctaagcctgaggacccaaggtgtagcaccagcctgggacacacatggtggaaggagagaaccaatttctgaaagctcttcttcatacctgtgctatggtcatgacccatgaatgcacagtggagaagtaaataaacaaatcataaacattttaaagaaaatggaaatccctctgagtaggggcagggaagaaagctacagttgaacaacttgaatgttaaaatgggaaaccaaagagatgtcagctgaatcaactttggggagtatgacaggggtgtgggggtgggtgggtccgtgtcctttttgttgagctgcattggtgcaccaggcaaaagaagctattcagaatgagcagggcttgagcaaacaaaagaaaggaattcttacctctactacttgaactggctcatttaacttttacaattctgtatttttgcttgggagcctagcttttaatggctgggccatcatttcagccccattctttttttttttttttaaagatttatttattatttatttttatatgtaagtacactgtatctgtcttcagacacaccaggagagggtgtcagatattattaaggatggttgtaagccaccatgtggttgctgggatttgaactcaggaccttcagaagagctgtcagtgctcttaactgctgagccatctctccagacccctcagccccattctttacaattttgatgaaaattaaattatattacaatacctgggatcatactttattcaggaatgggagagaaaggagattaagaggcagataggaactgatgttctggttttaagatagcaaaaactaaatccttcagatgaagatgctggaggttcaggacaacatgggataatgacacctgttaactgtaatacactgttttaggagggagaacttaaaagtctatttactcacaaaatagacaaaagtaaatgtttcctcatacctgatgtcttagttagggttttactgctgtgaatagacgccatgaccacgcagcaggtcttataaaaaacagcatttaattggggctgacttacaggttcagaggttcagtccattaccatcaaggtgggagcatggcagcatccaggcaggcatggtacagaaggagctgagagttctacatcttcatctgaaggctgctagtggaagactgacttccaggcaactagggtgagagtattaagcccacacccacagtgacacacctactccaaccaggtcacacctattccaacaaggccacacctacaaatggtgccactccatggtccaagaatatacaaaccatgagacctgaatacaaagatactctaagagttaatacactgggctgagatgatagctcagtgggtcaaagtgcttgccgcacaagcctgctgtgcaagcgtgatgactaaaatttggagctccggaacccaaatgcaagctgggcacagtggaggtatatctgcagtcccagtgtacctgtgccaagatggatgggagaaagagatatcccagaaatgcaagggccagatagcttgccaacactcaacagtgtcttgacctgacctcatatatgaacacacatacacacactgctgttttaaaagttaataaaggggctggagaaatagctcagtggttaagagcactagttgctcttccacaggatctgagttcaagtctcagcctcaacatggtaactaacaactgtttgtaaccccaatacataatattcttacactttattcagagcatcagaaaaattatattagtcagggtcttgtaaaggcaaaccccacaaagctacgtccttccagcctttgtccaatcagagccaatcatacatcctgacttccttcctatgtaactccttgcctatgtgtgatcaaccatatatcctgtgcagttgggcaaccaagcttgtacatgaacaacagcccccaacattccagaaagttctcttccttgggcaagtggggcttataggtcagcggcggtttttgttttatggatctcttaataatataacgttagtcctcacattagaccacaggcaacatatagatcaattgtagcttttaaaacttgttttttacattttagttcattagattgtttatatactgtggatataagtcctgtttttagtcaagaaaacttacatttatgtgtgtggtgttgagataggttattcttctgtagttcagactgatctgaactcctggaaattctcttgtctcagtctctcaaattctggaattacagttatgtgctgctccacctgattgtgtgtgtgtgtacacgtgtgtgtgcaggagctgtttgtgtttcttttgagacaaatgtttgtgtagccctctctgttctggaagtcaccgactcactaacaaggcagcctttgactcacagaaacccacctggctctgcctcccaagttcccaagtacaggaattaaagttgtgtgccgtcatgtccagtatactattgctgctatcctgcctaagaaatgtttctctatccttgaaactggtaatttttttctacagtcacagtcagctattggatagagcacagggctcccaatggaggagctagagaaagtatccaaggagctaaagggatctgcaaccctataggtggaacaacattatgaactaaccagtacccgggagctcttgtctttagctgcatatgtgtcaaaagatggcctagtcggccatcactgcaaagagaggcccattggacagcaaactttatatgccccagtacaggggaatgccagggccaaaaagggggagtgggtgggtaggggagtgggggggtatgggggacttttgggatagcattctaaatgtaattgaggaaaatacataataataaaaaatatttttaaaaaaactttaaaaaaaaacagtgtcatttgaaaggattttgtttttctttaagatgaggtctcactctgtagtcctgctggcctggaactcagagatcaggctcacagagatcctcctgcctctgcctccaggattacaggaatgcttctttgactagcccaagatgttttaaatatgatggaatttaagttgtcaatcctattagcaaaaaccccacaacctattaattttttttgcttctattttgatagagctgttggcgccatttctaggtaattgcctcactcagagcacatacatttttttctcatttttccttatgaaagtatatagttattatatttaggtcctaaatattttgcttccatttttattagtattgtgagggatgaacccaaatatttttttgccaaaataatattttgaaagattatcttctctccactaatttatcttctatttttgtaaagaacaatcatgtgttcacatatgtataggtctatttctagcctctaatctattatatctatctaatggtataatttgacatcaatcttatattgtctttatagtaagtgtttgaaatcaggtagctttaatcatttttggttttgcttttgtttgtttgtttgttttccaaagctattttggctatttcaagtccttcacacttctgtttaagattcagaatggccttgtcaatttctattgaaaagcttgctgggatttttattgagattgcattattatagacattaagggtggttagaatggctatgtgggtaatagtgcttgctggcatgcctggtgacttgagtttaacccctgggaattaatcacatcctggaaggagaggactgacttctgagaggaatccagaccccacacatgccactatatgcactgtatgcactatggcgtgcacatcaactcacattctcccccacctctctctctctctctctctctctctctctctctctctctctctctcacacacacacacacacacacacacacacacacacacagataggggagagaaataattacataagtgcttaattttaaatttaaatgtatccctcaaaagcaaaaagagtaacaacaaaaaagacaaatgtgccatgtttaaaaattaataatatataaggcctttgaaatgggtcagcaggtcaaggcacttgctaccaagcctcataacctgatttagtccccatatcttacatggcggacagagagaatccagtccagaaagttgtcctatgacttacacatatatgccatagacctcaatttcacacacacagaggcacaaaacacacatatgtacacaccaaataaattaataaatgtaatttttaaagatttagttattattataaataagtacactgaagctgatttcagacaccagaagaggacgtcagatctcattacacatggttgtgagctaccatgcggttgctaggatttgaactcaggaccttcagaagagcagttagtgttcttacccgctgtgccatctcgccagcccaataaatgtaattttaaatgtctaaatagtatataggggctgaagaggtggctcagcagctaagagcattggctacttaaatggctcccatttatctcagtgatgctctgtaggttttagtatccagcttatatttagtgaaactgattttaagacccataatatggccgattttggcaaatgttctctattttgctattgttggatggagtgttttataattatctaagggtcaaatgtattgattatgttgttgaagtgttcaatggctttgctgattttctgtcaacttactctatttaattaaggcgagggggtgaaaacaatgaattacaatcattcgtttctcctcccagttctcaaagacatttttttaaaagactacacagctggaaaggataatcttgaactccaaatccacctacctcaacttcccaattctgaagttaggtaaatgcattaccacaaagtctctgaatattctctgaacttcttctctgtttattttgaagttctgttcttctttggtgtatagatgttttagatcaagttctaactaattcactcctttatcagtaagaaatgactttagggccaggcagtggtggcgcacgcctttaatcccagtacttgggaggcagaggcaggtggatttctgagttcgaggccagcctggtctacagagtgagttccaggacagctggggctacacagaaaaaccctgtctcgaaaaagaaaaagaaaaaaaagaaagaaagaaattactttaattccacatggtatagcactctctaatctataggtataaatatacatatttagaagccatgtcaacatgcacatcatatgtatttagcaaaactcagcagtagtttacctgctaaagcctctaagttccccagccatagatttctaccatctgtcaattccagcctttggaacaggcctcagattccatcagaaagccagtgattacccctagtcatgtcactgtgtctttttttctttttcaaatttatttattgttgttgggtgttttttgtttggttgggtttgggggtttgttttttgtttggttttgttttgttttgtttttaagatagtatttcttgagctggagagatggctcagtggttaagagcactgactgctcttccgaaggtcctcagttcaattcccagcaactacatggtggcttacaaccatctgtaatgagatctgacgccctcttctggggagtctgaagacaactacagtgtacttacattaaataaataaatcttcaaaaaaacaagaaaccaaaaacagggtttctctgtttaacagtcctggctgtcctggaacttgctaaaagtataaatcagttttcatcatcaggttctggtaacactttttgccttcgttaccataagcagcttagtaacacactgcaaatcataagatcatttccacatttggcttcgccttagccagcttacatttgaaaagtgaatgctgtcaccacagtccgagtcacctttagcaatccctgcagaaaatgcaggcatgacgtctgcttacatgactttgtaatgcttttgaaatttcttgatgactctgatacacatggatctcagtgacagttacattgtcttctattaactttacaagtctatttcatcactggagcaccatcagctgttataccagaagtgtcgacaaagggcaacaaaaaccactttaacttttattgctttgtatttatttcttgatttagttgtgtcttttaatgacactaaagaagtcatgtctgtccaggcagtggtggcacatgcctttaatcccagcactcaggaggcagaggcaggcagatttctgagttccaggacagcctggtctacagagtgaaggacagccagggctacacagagaaaccctgtctcaaaaaaccaaaaaaaaaaaaaaaaaagaagaagaagaagaagaagaagaagaagaagaagaagaagaagaagaagaagttgtcagttgtcttagttacttttctattgctgggaaaagataccatgactaaggcaacttattaaagaaagcatttaactgggggcttgcttacagtttcagagggctagtccataaatatcatggcagggatcatgcagcaggcatggttctagagttgtagttgagagcttagatcttgatccacaagcagccgaatgaggggtggggagcaggtcttagcatcggcttttaaacctcaaggcttagggctagagggatggctcaaaggctatgagcagtttggctgctcttccagaagacctgggttcaattcccagtgctcacaactgtctgtaacttcagctgcagaggatctgacaccctcatataaacatacatgcagacataatgtcaacacacataaaataaagaaataatcattttaaaaacctcaaagctcccctcccagtgacacacctccttcaacaagcccatatctcctaatcccccaaacagttccatcaacttgggaccaagcattcaaatatatgagcttttggggccattctcattcaaaccattgcagaagccatttttaacacatttatactttatttatggcacagggtgggggaaaacacacacatgggtgagccacagtgacatcagagtaactttatataaatactttctgagttgggcagagatggtccatgcctttagtcccagtactcccaggaggcagagacagacagatctctgtcagtttgaggctagcctggtctacctagtgagttccatgacagacaaggatacataaagaaactgtgtctcaaaaaacaaaacaaaacagtttttccttgagcaagtgttttcccaattctgctttttttgtcctaaaataacttatttatttttattttatgtatgttggtgtttgagggggtcagattccctggaactggagttgcagacatttgtgagctgccatgtggctgctgggaattgaactcaggacctgtagaccagcagccagtgctcttaaccactgagccatctctccagcctcctctttgtccttgagatacaatccttgatcacatggagttcagcatttttaaaaacatataatgccctttccagtcctactctttgacaatttgcacaaattcactgcagatctggctgctttttgttgaacagttttcctatctccggcttttttccttaggggagtggttatttttccttttgagatgcagtagaagctgtgcttcctcactcctgagactgtgcaatagtgagcaccctgccagcagagtgaaatcattgtccgtggggaaagcctagaaggccccatggagctcggtgtgaagatgtactctgttagattttctgtcacatttccccttctttatgcctttgacttcaagtgctgattcccaaaggagctttctgaagaccacatagcacttcccaagggccacctcctggcccttgtgctagaactggctgctgggaacatcaccaccttctggtaaacctttctggagcctggtctgataccatgtagcaaaactgaccttatcaactgcgcactctcgtgcacacacacacacacacacacacatgcacacacacacacgcagtattcttggggactgtagtgacacacttggtgatattctgatttctggtgcccagatctgctatagcccacagtcaagtgtttctatttgtgtttctggttgactagacccttttcatctccactgctaccctgtttgtctcagtctggacaaattattctctcagtcaggttgtgtaattctatgttttgaccccaatcctccactgtagttagtgttggggaaaaacaactacctgaaagcaacactcagttgacccctgccagaactgaatggttactgttttgtgctattctgtcttcttttataaacttttaatgtctactaagttggggaggggcgtggatatacatgcccttgttccaccaaatgtgtgtggaggtcagaggacaacttgtgagagtcagtttcctttcaaccatttggattctaggaattgaattcaggttgtcagacatgatgcaagcatccttacctgccaagccatcttgccagcccttctgttctgttttgtctgtttcgggctggccttgaactttctatgtagtctgggctggtctcaaagtgatcattctctacttcagtctctcaaatcttaggattgcaggcatataccaatacacctagcctatgagattcccaccccctccccacccaccgccctatggactatagatgtttttgttattctaatggtttatactttatatatgtttatcttataagtatttcaaggacattaaagactaagaaagccatatttagacagaacttcatgacggggagtatgtagtagggcaaaccactccacgtcatggcaggtcagaaagcaaagagaggaaaaggacaggaacaagaaagacaggttacatggttgtggggctgaggtgcagctcaatggcagagtgcttgtctggcacctgcaaggtcctggcttccatccctgataataacaattcttccatgtcacatcccttacgaccccctacttctgattagtccccacctcctatgttcagtacctcctaatagtgccaccatcatttgatgactccatgaagagatgactccaatgaacaggcaagagtcctcaggatcccatcctgagaagcccatgctctggcagccaaggccctaaagcataagcctgtggatagcatgtcctattaaaccgtaacagtaaactagccagttacatggccatctaaacagactaagccactcatctatacttaggggcaatttctatgtttttcctttatatagattgacgtttctttctgcccaaagacctttgtttaacatttctttcagtgatggctagctggtcatgattgattgattgattaattaattaatttgttcattccttccttcctttttatttttaattttgtaatatatttaagtggtttatttgttattgttttatgtgcattagtgttttgcctgcatgtatgtctgtgtgaggttgtcagatcccctggaactggagttacagacagctgtgagctgccatgtgagtgctggaaattgaacccaggtcttctggaagatcagcatctttacccctgagccgtgtttaccacataaaccacaacctcactattgttttgattgactggtccttgactaagaatggtgagcatttttttcattgtctgtctgtatgtatgtatgtctttctttcttcatatttcttttgataactgaccatatattgactggattatttgttctgagttagtactcaaaatcagtaagtttttacctctttatatatcctggatttggtctgctgtcatataaagagtggaaaaaatattctcgcattcttttatttttttaagtaatgattttttatgtgtgagagtgttttactttcatatatgtctgatgcccacagatgccagaagatgctagatgtcctgaacctagagttacagacagttgtgagccaccatgggatgctctttccagctgttggaagccagctctgcactgtcaggccatgtctccagccctctttcaacagttatttgtttgctagtttgtttcttactacattttatgtatttgctttgtgtgtatttgtgcatgtgtgtagatcctgtgactgtcagaggataacttgaaagattcaattttctctttctgccatatggatcttggggatgggactcaggttgtcagggtggacaacagattacctcacctaatgaccatcaagttagccccaacatgggacatgtttctattttatttatttatttatttatttatttatttgattatttatttatttatttttggtttttcgagacagggtttctctctgtagccctggctgccctggaactcactttgtagaccaggctggcctcaaactcagaaatccgcctgcctctgcctcccaagtgctgggattaaaggcgtgtgtcaccacacctggctctcttctgtttctaatgacctttgtaccactgttagaaaggatctctcttctttcatgcaaaggtcttatgagcagccttctcttcagggtacaatacttcataccacttagaggagaaagccacctgcctggacagcaacagcaaagcaggctagggagatcaaacagagcatggacttataccctgaaggagagaagctggggactcagccggccttcattttgctgctcagaccttatctagctcacattgtgacagggagatgcccacaggctataaggctcattgcctgcactcttgcacaatgaggactcggtcttcaccgcagatgtggagtttcttatcactcccccagctccctagtgctggagcttctcccctgctcctcccaatcccgtgactgcctgtgcctctcttggacaccctgactgggtactttaatttacaaactgaaagaagaaggttctatttcagttcatgtgcatgtagtccaccttggggaagccatgacatcagaacgctgaggaagttggtcacactgtatccacagtcacagtcaaggagcagagagtggaagctgacttcctcctcccccccttcttccttttttatggttattcttgttgtttgtttttgttgttgagacagggtttctctctgtagccctggctgtcctggaactcactctatagaccaggctggcctcgaactcagacatctacttgtctctgcctccagagtgctgggattaaaggcgtgcaccacccctgccggattggtttgctccttttttatcgacttcaggccccaagcctgtggaataacactgacaccacctacctatatttggagaggatcttccacctccattaatctactctagataatccctgagagcatgcccagcggcctgagccctaggtgattctagatcctgtcaaactcacagtattagtcaccacacaaggtattcccaggctcgacttgggactgactggtctttgttttcaggttccaagagaagctcagtctcaggatagtgaggagctatgtgatggaattctcagttgcatcaaattcacagcatcaaatccctattttagatttcaggtttgcgagcaatgggtttctcttggagctccatgtttgcaggcaaggttatcccctactcttagctgggtgtatggtgttggccttgataactgttttccttgaggctatctgctctctccagatttaggctgtgctgtgtggccttgagttctcaggaaagtggggcttgggttgagggcatcttcctgcttcttcctgaatttctttcattgcttgctctgggaagctccctttggtctctttgactggagatgttctctctcaaccggggcaacctgatctttgttctctcgactcctgctatatgcagagccgttcagaggaaatttctaacctgccattttatcttggaagtatcattttttcttttttttttaaagatttatttctttattatatgtaattatactgtagctgtcttcagacacaccagaagagggagtcatatctcgttacaggtggttgtgagccaccatgtggttgctgggatttgaactcaggaccttcggaagagcagtcagtgctcttaaccactgagtcatctcaccagccaccccgttttttcttttttgcttaccttttctttctttctttcttttttttttttagactgggttttactatgtagcctccaactcagagaccagcctgcctctgcctctgcctctctgcctctctgcctctctgcctctctgcctctctgcctctctgcctctgcctctctgcctctgcctattaaggcacctgccctacttcaagccattttctttcttttagaaagaaagaaccttttttaacctttcatgactctgcacgtttatgtatgcatatgggcacatgtgtgcacatacatgtggatctcagaggtccatatcacatgtcttcctccatccctctccaccatggtttttgagacagagttccacattgaacatggagttcactgagtgagtaagactgtgtggccattgaggcccatgggtcttcctatctctgcttccctaatgctaggattacaggcatgtgctctcacatttggggcagggggaggaacattgtcacctgttaggatttctgtgaagacagggaagcagccaccagcctggcctcggctctttttgctgtctcgccaatattctgggagccatcttaggtctaatgctgtatgtggcattagctcaggactcttcaaggagtcacaggagcctgtggcaccccactctccatcccactctttccttcacatcacccccatgtgcacacatatgaaaatatagaaatcagaagataagttacagggatggcttctctccttataccatgtgagtttctgagatcaaactcagacaatcaggcttggcagcaagtgcctttgctccctgagccatactggcagcccaaatcatctcctttttaaacgtcactttgtcaatcatattttacagaatctcagccccaccaagaacagaattataacacagaacacagagatgccccaagaacaaaaacagtgggaaccagagagctggccccgaactcttcctaatgccataccttgcagtgcagaacggttacacctctagaacattccatgcacacagcagacacccaccacctactgtgtgcccagcaaagtgatggactctggtgaggaagacatggtttcagaaggaacagtatgtaagtatttgagaagaaaggacacacaaagtaccctaattggagattttttttggatacctggtagttgaatctgtcatctgaatgagtgtaggcaaaaagcacacatttgttgacttaccaaagaggcgccttgattctctaagaagctgtgtggtttggaatattaaccactacacagttgtacccaagcctcccagaactgagcaaaattgggttcttcattaaaaacaaatgacattgtatatgtaacccacaaaaagctgacctgtgcaatgaccccatctgtactactttcagacaaacattagttgaccattcaaaacaattttaaatgtaatttgagattatatttaactacaacatttctccttccctttccttcctctaatccatcccatatagtcctccacactctacttcaaattcatgacctcattttcactaattgcatatatgtacatacacatatattcctaactataacctgttctgctcatatatttcttgtatgcatgttttcagggcactctacagccaatcggtgtgttttcttccctggagaaaggctcctgtcagcttatttgtttaggtattttattggattcttaaaactaccaccttttcgatccttattacaccctaattccttccaactccccaaaactaggtaagagagagaaggttagagggaaagggggcgtaggcctctttagactggttagggatgtcaggtggctaggggcaaatccaatcttcatagtcaggatatctagcaatccagcagtgcagcaatagcaacccagcaagcacagcagcagaaaccagcagcagcaatcaccacaggccctttggtctcccacttataccctctccagagtccccagaattaaactatctgcagttggcaaaaatcattccctgctagtgcaccaggcaaatcataatcacctgttgtgaagcagcctcttatcgtacagctgagattaaaacaaaaacatagtcacttaacataactgggttttaaagaaagccagcctctctctataccctcctctcccattccctgctttactgagttgcctatcatgctctgtatggggttgaggcctcatgggcttttccttttccagttcaaggtgttcatagtgtcatctttttttttttttttttttttttttgggtttttgagacagggtttctctgtatagccctggctgtcctggaactcactctgtagaccaggctggcctcgaactcagaaatccgcctgcctctgcctcccgagtgctgggattaaaggcgtgtgccgccatctttgttcagctcacattgcacaatcatgttaatgagactttatgagtgcagcttctggtattactaggagacatactcatacagcaaacttgatgatccctgctggcccttataatttttctgcctcttctttttcagtgtttcctgagccttatatgtttggagtgtttgctataaactgggactgggctccacaactctatggactggttgtaagtttccataggtggtctcctctgttgtaacaagaagtttccttgacctgtgggtcattttaataacataaaattaatttgtctgtctttctttttgggctggagccttatacagacttagtgcatgttctaccactgagctgtgccccagagagaagattgctgttgttgtttctgttgttttgagacaaggcctcatgtctccaaggctgaccttgaacttagtacatacctcgatggtcttctttatcaactctgctatacttggaattaactaaaacccaaaaatggaggtgcatacctatgagggacttttgcttaatttgaaatgggaagatccacttctaatcaagatatttaaggtgggaaattccacctttaggctatgccttctgctggcagcctatatgaacatagacatagaagaaggaagcttgctttttgcctgcttcctctcactcttgctggcaaatccattccttcactagcattagagccttcttctttggaattctgacatatactcaagaccagctgacatatccacccttgtgcactgaacaacttctagattcttggaccttttggtagtagacagtcgttattgcactagctggaccatagagccagtaagccattctaatatatcccctttctatatagagagatttattctgtaagttctgttactctagagaactaatataatacctaaggataaccctgaactcctgaccctcctgcctcaaccccctgagtgttaggtttacaggcctgttctgaacaagctataggcatcactgggcagatggtcctgggtgatataaaaacaggcagctgagtgtgacctggaagcaaggcagtaagcagccttcctgctcactgctttagctcctgccctgtcttcctttcatgatggactgtaatgtataaaatgaaatgaaccttttccttcccaagttgctttcggttgtggtgcttcttacagcaacagaaggcaaactagaacagaaattggtaccagagagttgcatgtttcagtgatgggcctcaccatgtagcatttaacccttaaactcctttgtgagagggagatagacggttttggagctttgggctagaaaatccattgaatgttcattgcttaatgagctgttgtgggaacttgaaagaatactaagataaatgtagaagatgagaggctggagagatggctcagaggttaagagcactggctgcttttccagaggtcctgagttcaattctcagcaaccacatggtggctcacaaccatctgtaatgggatctgacaccctcttctggtgtgtctgaagacaggtacagtgcactcatgtaaataaaaataaatgaatcttttttaaaaagtagcagatagaagcctggtttatgaaatttcagggagaagcaaacctaccagtgctattcaagggatgttgctgagacaggagatgctagttagctggggttgaaaagccgctgtgattaataagagaccagcatcactgatttgaaatctcctcctcctcttcctcctccttgtcttcctcctcctcctcctcctctccctcctcctccttttcctccttcctctcttccttttcctccttctcctcctcttcctttaatgtaatttggcatgatagtgctaatttaaggattgctgtgtttagttaagtaattgtccttagagagttaattcatgacatagaatagctactcactaagtgctagctattattattaagtgccaaacaagtagtagagataagaaatactacaggcacctttggagaaggtggtcacttaagacagtaccttgggaagctgtcagggtttgaataaaccagtgtcaagaaggaaaaagaaagccagctgtgctctgtgagttacaagccagctagggccacacagagaaacactgtcttgaaaacaaaacaaacaaaaagtcatggcagggctggggcaatggttcatttagtaaagtgcctgtcatacaagcatgagaacatgcgttctatccctagaagctgtgtcacattgccagactggaggcggcagaggctgtgtcttatggaacaaggttggggtctgcaagatgccttggtagatactttcccacaagtctggtgacctgagctcaagctctaaaacctacatgttggaaggagaggatgaactcctcaagttgtcctttgttctccatacttggcactgtggcatgcaagtaccatccccaaatagttaaatcaacacgggggcggggtggctcatgaagaacggcccaaggctgaccttgggtctccacatgcacacacgtacatgcgctcactcacacctgcaccacacagcactcagccagccacagacaagagggcatgccaaaacactagtttgtttgaatttctactttttttgtaaagctccagatgccttttcaaagcatcgttatataaagtgtaatttgctctcttcatttcagtttgtagcaaccttgaacatgaatagcatgctttaattatgcatatgagagaaaaatattttgagtcagattgcatgctatttgtctttaatgctcctcactagtttctctagcgctcataggtttctttgtatatagctgctatttggatcttaatttgaccctgactcttagttattttcatgcattatcagaatgctttttaaaattaaatatttcgcatgtttcctattcagtgtccaagggctgtttattactgcagttcgttgttcagacaaatgtaccacatgccgtattcatcatgtttcactcaattctccaggggctctgaaccatctcatggtcattaagtgaatctgtcgcctgggaaccaaatgactgggaagagaaaggccatccataggtaggagtgggtaagggaggtagtgggttttcctgggcactggctcccttaccatctcaggcctcactcagactttctctctctgctctgacccttctgccttactagggacatattcccttagccttatacatacacaaccaataaataaatgtgaattaacaggtttttttaaagaaaaataaaatgataggggccggagagacggttcagtggttaagagatcttgctgttctttcaaagggccacagttcggttcccagcacccatggctgcacaactcccaaccacctgtaactccagctccagggtcctgatgccctcttctggtttgcacacatgtggtatacactcacacacatatacgtgtaaataaatattaagatacaataaatcttaacagaaataaatacaaatgatacttatgacagaattccagaaaagatgaagactgatgaaaattctgaggttttccctacttgcaagctgacaaggcatcggcccaccacaactactaagtgctagcagacagagcctccaagtttctactggagtctctctgggagataggacatggctaacctgcatgcctcacattcagtgttggtgacacagtctctatctctcattaaccagggctggtgctgaagcattgcttctacagcgtttccagcccattgaccactccaccacattcagttatcagaaccagtctcagccaagaggtggattgtgatggtgcctgccttcaatcccagcacttggcaggcagatctctatgaggagtttaagaccagcctgggctgcatactgagaccctgtctcaaaacaaacaaaagtggacttggctttggtttccagcttccctttcttcaaacttcctcaaggccactgtctccctcttctccaggagaaaatggatcttcatctccttgtatcttgctctccttttatacccatgctgactaaatttttcgccagcttgacataaactagagttatctgagaggatgtgttccaggtccccagacctctagcataactcatagaagtacaatacaggtcatagaatccagcatgtagaaagcaccactagccaaaacaataaccaaaagctaatccatcgaagtccttaaatgtactgaccttgcttattgccttctatagttctgcttctggctaactgttcttgttaactgaactatgtcaacaagatcatggtttttgtgcttctaaaagctcaccctaagaaaggctcagtgctaccctgggaccctgaacacccaatatacttgctggacagataataaagaccttttattggctt

SEQ ID NO: 260 - DNA, 59215 bp, mus musculus; identical to SEQ ID NO: 259

SEQ ID NO: 261 - DNA, 80 bp, mus musculus
aactgaagcttctttctaaagacttgagcttgtgtcatgttgatacataaaaccagcctgtacagcagttcccaccaggt

SEQ ID NO: 262 - DNA, 1257 bp, mus musculus
cggcccggcggccccaggggcggtggcagcccagcaggcgtctcgcggggcctctttgcttccacactcgtctcagaggacccaaaaggaaggatgtcgtcggggcttaaggccgagctggagttcctagcgtccatcttcgaccaggaccacgagcggctgcgcatcgtgagctggcagctggatgagctgcagtgtcagttcctggtgccgccggcgcccgcgggcagcccgccctcgccgccgctcaccctgcactgctccatcaccgagtcctacccatcttcgccgccgatatggttcgtggactctgacgatccagatctcacatcgatcctggaacgactggaagattcgaagcccaacagttcgcttcgtcagcagctcaagtggctgatctgtgaactctgcagcttatataacctgcctgagcacctggatatggagatgctggaccagccggtccccatggctcagaaggcgaccatcgaagaggtgccttcagaagatgaaggtgaagatgcagctgacggggtggaagacttggaccattatgagctgaaagaaggaggaggaggaggaggaggaggaggaggagaagaagaagaagaagaagaggctagtagcgagaaaaagtcagaggatgaagggcttgagaaagagcatttggcaatattagagaatatcaagaagagccaaaggcaagagcatttgaatggtaccgtgtctggctcggtgcatgcttcaaacagacttatgaaagaactcagagatatatacagatcgcagagctacaaatcggggacttattccgtggaactgataaacgacagcttatatgactggcacgttaaactgaggaaggttgaccccgatagtcccttgtacggtgaccttcagctcttgaatgaaaaagaaggcattgactatattttgcttaacttctctttcaaagataactttccgtttgatcctccatttgttcgcgtcgagttgcctattctctctggagggtatgttttgggtggaggggcgttgtgtatggaactgctcaccaaacagggctggagcagcgcctactccattgaatcagtcatcatgcagatcaatgccaccttagtcaaaggcaaggccagggtgcgctttggagcagataagaatcaatataatctagaaacagcccaacagtcctatgactccgtcgtgcagatgcatgagaaaaagggctggttcactcctccaaaggaagatgggtaa

SEQ ID NO: 263 - DNA, 1257 bp, mus musculus; identical to SEQ ID NO: 262

SEQ ID NO: 264 - DNA, 555 bp, mus musculus
gaccgcggtgattgcagctgcttaggggcagggcttgccccagcgctgagtggtggcaccggcgtggtttgcgtcggggttgcctgggcttggggagacccggtggcctgggagcggcgcttggcgggcaaccctctctgtccgtggacgcgggacattcttagcgctccgaggggtgtttgcccttgaggagacttggggtttctgggcggcaggtgacagggccagagaaagatggaggagctcggggcggcggcgtcgggagccggaggcggcggcggtggcggcgaggaacacggcgggggccggagcaacaagcgaggcgcggggaaccgggccgccaacgaagaggagacgagaaacaaacccaaactggtaagtcttcccgcaagccccgctggtctcggagacccgagatccccggatcgtcctgcccaggaacacgcctgggagccggccctcccctcccggcagcagccgtgatctcgccgcacaactcagggaacggagacggcgtgggggcggaagagcaccccttctccactttatccggcc

SEQ ID NO: 265 - DNA, 555 bp, mus musculus; identical to SEQ ID NO: 264

SEQ ID NO: 266 - DNA, 292789 bp, mus musculus
gaccgcggtgattgcagctgcttaggggcagggcttgccccagcgctgagtggtggcaccggcgtggtttgcgtcggggttgcctgggcttggggagacccggtggcctgggagcggcgcttggcgggcaaccctctctgtccgtggacgcgggacattcttagcgctccgaggggtgtttgcccttgaggagacttggggtttctgggcggcaggtgacagggccagagaaagatggaggagctcggggcggcggcgtcgggagccggaggcggcggcggtggcggcgaggaacacggcgggggccggagcaacaagcgaggcgcggggaaccgggccgccaacgaagaggagacgagaaacaaacccaaactggtaagtcttcccgcaagccccgctggtctcggagacccgagatccccggatcgtcctgcccaggaacacgcctgggagccggccctcccctcccggcagcagccgtgatctcgccgcacaactcagggaacggagacggcgtgggggcggaagagcaccccttctccactttatccggccttctctctcgggtcagcttgcggaggagaaaggccccaccccaacttggggacaccctgcgtcgcgtcctagagtactggggtagggctgtttgtctaacttgtgggcgcgaaccttctttgcgggattccatttccctcccacctcttgtcagttgctgtttggtcccttaacacttggggtcccgggcaggggagcctccctcctctccgtttcgagcgcatcggagcccactcatagctaaggaaatcaagacaagcaccacataggttcctagctccttcgactttgccagaaatcggagaaagaggcgcctgcgtgcgtttgttccccccaccccccatgtgctcacccaagaaacatttctttggaagtctgggacttggggggagcgtgggaggagttggaggctgggtaaccccgccaaccccccccccccccctgcatcccagcacagcatttccacttggttgagaatgctcagaagcagttatgttccccatacttgtctcacagtcctgacagtgtggtccagtagtagctcatttcctgctgaggccagaaatcgatggggcctggtattgggttgggaaatactggggtttcttcaactcatcagttaaaagggttcctcttttggtaaactttctaatttcagtggcatgaggagaaaggagtttcctgcagagattcagcaggcaaacttttgagcctctcctgagccttttgaacagtagaatcctactccacatcccaagtacaagtccatgtcgctcgtctacatttcagttgtaaacaacaacttgattatagtagaagagagggtgagactgtgacatgcaactcaaaccatttcctgtggcatctggccacttggtctggacttgcacttctcttctggctccggtttactttcctattatggaccgtccatacgggaaaacagggctcaaatattaggacatatgaaatcttccattatgtgcgaacggacttgggctaaagtaatctttcaactttaaaatctcatcaaaacctgagacaaatctagaaatcacttccctaatgtgtcctattaccccaagcacttacaaataaagaaactgagtcacagttcttttgacttgtctgcaatatttatcacagtgatgagggctcacaccatcctggattcaagaaaaacagttctgagtttattgttcgagttgaatgtatttcaatttgtttcttttctttttgagatagggtatctctatgaagtcctggctgttcaggaccatgctatgtagaccaggctgaccttgaactcacaaagagcctcctccgtgggtctcctgagtgcacgagtcactgcctcagccaagcagtcaaaagttttgataatgtgactttgaaatgtactagtttgtggtaagagagtgagcctacttctgttttccctctccccttacttagcccagtataaactgtagtaaaaagtttaaaaataaaagttaaggaatagtttccataaatagttttatacatttagcaagaatctcccaattttcaatatagtaaaggaaaagcatttatctctagtagtaataacatttactctttggctattcgtcctatttcatcttttatgttttagttgatttgacaaggtaactaggtgattatgagatagtatcactttcagttcctagctaactaacttcactgttctgtagttatcccagcttgatacaacaaatcaagtactggaacccagagcgcaataccaacatgagtttctttttttctactcatctataacttttgagctttatgtgatttcctgaagccaatgtgtcacagctaataaaaacaggaattgaatatgactcattttaatgcaaagagtttgatcaaataacaagttttggtaaacttgggattcttaaagttttgaaagtatgataagaccttttagaagatttatttatttatttatttatttatttatttatttatttatttgatgtatgtgagtacactgtcactgtcttcagacacaccagaaggtggcattgtatcccattacagatgattgtgacccaccatatggttgctgggaattgaactcaggacctctggaagagcagtctcttaaccactgagccatctctccagcccccttagactaaattttaaaaatattaatgctatgtattatgcttcactgtgataattccaaattttgaatgtgtgtaaaggagttgtatgtgattataaaacagccttatggcaatataagttatttgtctgggttattgtattattaggggctcaaaactccttaaataaaaaaaaggggtatatgtttatttttctggcttttcttccttttgttagtttcttagaagtatccatgacttgcagaaagaaaaaagaatcattgcagttcaaaagacagcaaaggaaaagacagctggagaattgagggaaactccttaaaacaattagttcaatcactgtagtctaagggtttcttaaactataagactggtgcaactgtgttcatttatttgcttatggatttggaaaaatggggattgaggttgtatttttgtaggtaaaatttttgtaggctagttatagtcccgcatttttgatgcctaacagtgaaaacttttttcagattgacctatcagaactttaatgatttctgtttaaggttgtgtgagtctaagtgtaataaaactcacttcagtttttcagatatgtatcctcataatgaaacccccacatctccacccacccacccatccacccatccatccatccatccatccatccatccatccatccatccatccatccattaagggaagcagttcattcattgactcagtacattttgaataatatatggtagtagagtttctgattttatataactttctggttaggcccagactgtagcatgctattaaacagcatgactcttatattaattagtaatttgatgccaaccgtgtattataatttgttaaactgaataggagataaagtgccctagagaagtgttaggaagatgctctgtcttaaagctcatatgcttaaaggaatgatttaaccattaagagagtccagtgttagaactagagagatagttcagctgataaagtgctttcatgcaaacttgaggatctgagtttgatgccagcaatctggtatagagtctatgctggttgcacacatttataatcacagggatgtaggtaggaaaagacaggcagatccctggggagatacaggccaaccagcctaatttaaccaaaggggtccccgattcctttgaaagtgataaaaaaaaaaagaagaaactcctttttgatgaatgaccccaagattgacttctggcttctataaatataatgcatattacatgagtacatacacacactataatgtatatattacatgcaaacaccccctcccgccacacacacacacacacacacacacacacgcacgcacgagtgcaatagacaagtgaggctacacaagagaacaagagcaacaggggacattgttaaagtgaagctaatatctctatcttctattgcaagatggtggatatagagtagtttgacaatatttgatgttttaatttttttctatataatttctgaagctgtttctttttttgtttgtttgttttttgtttttgtttttgtttttgttttttgtttttttttgagacagggtttctctgtatagccctggctatcctggaactcactctgtagaccaggctggcctcgaactcagaaatccgcctgcctctgtctcccgagtgctgggattaaaggcgtgcaccaccacgtcccgcccaagctgtttcttttttatgccagtaaaattaagttaataattataataacacatggatcttatggttattatatagctgaataattggccatttatttacaatgagatgatttttgttttgattttagctattaaattctgaccctaatggttttatgtatacactgtgtttgccaagtacttactctaatgttcaatttcagtgaaatgaagatgctcatagtcaggccagacataatggtgcatacctgtattctcagcactcttgaagtaggaacatctcatatttgaggctagcctggcctatagttagattttgactcaaaacaaaacaagacaaaacaaaacaaaaacaaaaacaaaaaacccaaatgtctcctagtttagtgaagcagaaaagtgagttaattttatcagtgttacaaaaatgccacagaggggaatttaagtcgaattggattttgatttttatggtttttttttttgaggcagattttctttagcctttgctgtactagaagtcactctgtagaccaagctggcctcacactctaagatcttcctgtttctgcctcctgagtgctggaatttaaggtgcatgcttccactgaccagctaaattggatttttttaagtgtctttctttctttctttctttctttctttctttctttctttctttctttctttctttctttctttctctctctctctctctctctctctctctctctctctctctctctctttctttctttctttttctttcgtttcatgtgtatggtatttaccagtaggtatgtctgtgcactgtttgtatgcctggtgcctatggaggccaaaggagagcttctaatcccttgtaactcaagttaatagacatttgtgatctactgttttggtgctgagagtcaaatctgcattctctgaaagagcagtcaatgctcttacctgctgaaccctctgtccagcgctaaagttgattcttgggtgaggtaaagaaaggcttatagtagaagatctgtgcaccaaggcttgaatagtgttttatttgaagtagaggagggaatgacattctagatcaaaatggcaacatatacaaagctaggtaggggtagaatatgctgataatgaatgtttaactagatactaattaatggctgaaacagaaagcagcaaaaacaaattttaatggatctggccataaagggatgggctgtaggtcatagtagatctttgtgtgtcatgttggaacattgactttttcccagaaagtcagcagaagttgttggagagattaaaaagagggagttacctgattaaacaagtctttcagtgacaatttaagaacaatggagaatttcctgtaaagggatgttggaatgaagggaggaaggccagccaggagtagcagagtgaagtggaatttgccatttagagtcctggatttcagttgctgctcatgtagttcagatatccgaatttctttatccctgtaattcccattttccaactctgctcttggtattctcaccaaattggaagcatcttttttattttcctttaatgaatctcatagctttcatagcccagctcctacctccgtgctgtcttccttccagtggttctcaactttcctaatcctcagaccctttaatacagttccccacattgtggtgaaccccaaacaaagaattattttcgttactacttcatatctataattttcctactgttaggaagcataatataaatatctgatatgtatgataatctgatttttgacccctgtgaaagagttagttgacaccaaaggggtcgtgggacccacaggttagaactgttgctttaaaccttcatttgttgtttcagcttactgaggatttctctgtcatctgaacatttagctgtcctgaatttcaatgttctgtactgatcttgctttacaaagattttaaagtacttccgggcatggctcttttatgtttattcttataaaccagccaatgataaatagctagggatttttgtctctaaaggtcaggtatattgggagttgaattgttgaagagacttagaagaaacaagcaaacaaacacatagttctttctttttttttgagatgtggtttcatttattccaggctggccttgaactccatattaagttcagggtgatactaaacttcttatccttctacttctacttcaaatgctgagattacatgcttgtatgctgtgtctggtttatgtggtcctgaggactgaacctaggacttcatatgttccaagcaggcactctactaactaggcaacatccccaaacccaaattattattgtttacatgttatatattttgttagtatgcacatgtgcttattatcagatgaactttcctgtccattcttatatgttttttggttttcttgagacccatgtctgattttaaattcactatgagtctggtcaataccagatgctgtctccttccatattccacatacagagattgtggcttgagcctatatgcctggttcccctgtctgttctctgagctagaagttcaaacaatgtcttcaagggtcatgagaaactcccctcctccccttgtttgtttagatccttctgatgtcagagccagaactcccatgcagagagagagtactgtcacaagtgagccaagtaacagattgctgtcattactaggaggcttcagattaatctcaaaacaatatgcactgttgagtcaaaagctctgcattccagtgtcctttctgtcttttatttgcttgtgatctctgatgaatattaatatgagaaaattgagcactttgattaatttctgccactcagagatatggcttccttcccaaaatgcttgtttgattttgagacatggtcttacaacactgttgtccaggtgatcttttaactcctgacctcaggtgatcctcctgttacaggtacttcagtagctagaactacaaaaacatactatcagacaagatggctcagataaaatacagtaaagattaataacacatttaggaaattgtataatgttacagaaatatacattactgttagctcattctatcatctgaatcaaatgtgatcatggaattagggcatagtttcatgatagagtgcttgcctagaattaatgatgacctgaggtcagtccccatttttaggaaaaaaaatgtgtttatgattgttgaatttcatgtctgttttgcaatttgaaatccttattgtacaaaatactgtaatcaggtgtgtgttgatggattccttgttctcattcccaattccctttgtttttgaagcattacacattttgtcagtccttttactaatgagcttttcatctgagtgattgtagatgtgagcttaacttttgtttacgcttttgtactactatttaattttagattcatttattttatgtgtaagaatgctttttgcttgcatgcatgtgtagccacatgtatgtgtgtgcctgaaatttgtacaggtcagaagagagtatcaaatcctctggaactggagtttcttaatggttttgaagtcaccatgtgggttctgggaaacaaaccaaggaccttgcaagagcagtaagcgcttttaaccactgtgccatctttccagcccacactctaaatttttaaagaacatgtctaccattttctttgaattgatccatttcaggcattacattttttattaaaaaaatgttagtaggtatgtatgaccttctgtcttgtcaggaagctcagtgatgttgtacaaataaggaaactgagtcattcaggagttatgggggctgacttagaaataagtttaaaagctatcacctctattgtagaagttatctatagcactgagtcattatgcttcagggactcttaaaagtaaaaagttattcaatctctcatttcttttgttccttttgaacaatttataattataatcctcttagatttcactgtaagtactaagaactttgccagtagcaacatgtcaaagtgagatcttactcatttcaaacctgatctcaaacaatactgtaaaaaccaagatgctctgaaaatagtatgataatatatgttaaatttatatgaatcagcatatctgattaatatattactgggtagctttagcacccaaatggttagtattgaagacccaggtttcccttactccaagttccttctgcaagacttgtggtatgtattacattatttttttctgaagacagagaaaagaccaaggtgatgcttaagtaacataaaagcattgctgtaatcttgcagcctaacttggcttcatatgggaaatactcattgtggaagaaagctcacgattggcccatgtaaaggttgatgtatgttttcacgtggttgtttattgtgaaactcatgaatacagggaaatgcattctctctgatttgaaacttattacctgaacatgctgaatctgatttactatcaaatgatatacttagaccctagttttattaaatagaaccttaattgaatctggatatgtttgtgtgtggtggcctggggaggaagatactggtaccttccttgtggaagaatgtagaaaacacaatttttaactcattttccctccttgtgttggtgttttccatctattatcctttgtaagactggatttatagaaagatattgtgtaaatttggtttatcatggtttctccgtctatggtaattaagagttttgctagctatagtagcctgggctggcatttgtgttctcttagtgtctgtatgacatctgtccaggatcttctggctttcatagtctctggtgaaagtctggtgtaattctgataggcctgcctttatatgttacatgaccttttttccttactgcttttaatattttttctttgtttagtgcatttggtgttttgattattatgtgttgggaggaatttcttttctggtcaagtctatttggagttcggtaggcttcttgtatgtttatggacatctctttaggttagggaagttttcttcctataattttgttgaagatatttgctggccctttaagttgggtatctttactctcttctatacctattatccttaggtttggtcttctcattgtgtcctggatttcctggatgttttgggttaggctctttttgcattttgcattttctttgcctgttttgtcaatgttttctatggtatcttctgcacctgagagtctctcttctgtctattgtattctgttggtgatgcttgcatctatgactcctgatctctttcctaggatttcaatctctagggttgtctccctttgtgatttctttattatttctatttccattgttagatcctggatggttttgtttagttccttcacctgtatgcttgtatttttttaaagatttatttatttattatatttacatatataagtaagtacactgtagctgtcctcagatactccagaagagggcatcagatttcattacggatggttgtgagccaccatgtggttgctgggatttgaactcaggaccttcagaatagcagtcggcgctcttaaccactgagccatcttaccagccctctttttttttttaatattttttttattacgtattttcctcaattacatttagaatgctatcccaaaagtcccccataccctccccccccccacttccctacccacccattcccattttttggccctggcattcccctgtactggggcatataaagtttgcctgaccaatgggcctctctttccagtgatggctgactaggccatcttttgatacatatgcagctagagtcaagagctccggggtactggttagttcacaatgttgttgcacctacagggttgcagatctctttagctccttggatactttctctagctcctccattgggggccctgtgctccatccaatagctgactgtgagcatccacttctgtgtttgctaggccccggcctagtctcacaagagacagctatatcagggtccttgcagcaaacgcttgctagtatatgcaatggtgtcatcgtttcgaggctaattatgggatggatccctggatatggcagtctctacatggtccatccttttgtctcagctccaaactttgtctctgtaactccttccatgggtgattgtttccaattctaagaaggggcaaagtgtccacactttggtctttgttcttcttcagtttcatgtgttttgcaaattgtatcttatatcttgggtatactaagtttctgggctaatatccacttatcagtgagtacatatcatttgagttcttttgtgattatgttacctcactcaggattatgccctccaggtccaatcatgtgcctaggaatttcataaattcattctttttaatagctgagtagtactccattgtgtaaatgtaccacattttttgtatccattcctctgttgaggggcatctggattctttccagcttctggctattataaataaggctgctgtgaacatagtggagcatgtgtccttattaccagttgggacatcttctgggtatatgaccaggagaggtattgcgggatcctccagtagtactatgtccaattttcaaaggaaccgccagactgatttccagagtggttgtacaagcttgcaatcccaccaacaatggaggagtgttcctctttctccacatccttgccagcatctgctgtcacatgaatttttgatcttagccattctgactggtgtgagattttcctgtaattctttaagagatttttgtgtttcctcttcaagggcttctagctgtttacctgtgtttttctatatttctttaagggagttatttatatccttaaagccctctatcaccatcctgagaagtgattttagatctgaatcttgcttttctggtgtgatggtgtatccaggacttgctatagtgggaaaattgggttctgatgatgccaagtaaccttggtttctgttgcttatattcttatgcttgcctcctgccatctgattatctctagagctacttgcccttgctaaatctgactgaggcctgtcctttctgtgatcctggttgtgtcagaattcctcagagttcagctgactctgtgatcctgtgatcctgtgatcctgtgatcctgggatcatgggatcctgtggtcctgggcatgttagagtgcctgggagtggagactcttctgggtgttgtgggaatggctgcagagtttgcacccaaggtctgctcatggcacaggctgagaccggaaggtaacagtgccactggttgattgaagttcctgggtgcctgggtccccctgatcccagttactccagatgttggggcagatgttatgtcctcctcatctctgatcctattgtcctggacatgttagagtgcttgcaagtggatcttcctctgggtgatgtgggactaactgctgagtttgtgctgaggtcggctcagggctctggcctagacaggaaagagttcttaacttcttgaatgagcagttgctgacccagtcaagtgggtgatttttctctaaacacataaatgagtgataattgttggggctccatagacagctagcattttctccatttattctgcttaagggaagaaaagatatggatgcgttgttttatgtgctttgaaattaatcactggtaaaatctgaactgtttaatagcacatcaagctacctggggctattgaggaagattctatacgtagatagtaagatattttgcagttatatctcgacctttaataacatgtattgtataatagaacagtgtcattatgtgggttgggtcctatacaagggtatcagactatagagatcacaccatttgccaaagtatgcagataacaaggctctatctttctggagtatttttgtacttcacacaaatgtcttatataggttaggtgatgcatttcattttttatatctggcactagttttggaaagcagagaggttgaatgtctcatttagaatacttgtttttttaattataaattaattttagttatacaaacctttatgttcctatgtgctcctgagtatgttggatctctggagatggagaataggcatttgtaaggttccagatgtggtgctagaaaccaaacttgggtattctggcagaccagtaagttctcttaactgctgaaccatctctctggttcaggtatatttctctctggaataggtatatttcatttgtcattcattttgaacaagaatgtgacatatatgtatgtaatgccctatacctgactacatttggttttgaattctaaaatcccatatgtgaatggccatgtcattgagggtctagattgaaggattaactaaggcactgctctttctttagttctccaagtgattttcttgaaattatttttttttaacaagctttgcatagtcacggatcatatggataagactgtactttttcgaagtttgtactataacttgaatgtattttcatttacatcacccatgatacaaggcgagaacaaacagaatgttaagatgggtttggcagagacatggcttcttataatatgctctgcagtctggtatcttccattatgaaatcaatgttttccagaagagtcaatgtgtatataacacacttgtgagtgaatataacctttcttgggttaacctcacagattgtttgtcattgtcactgcagtaacttacacccaccccccccccctttggtgaatagctaatggtctttaaatgggagaacaaatttactgtgccaaaaaagggcctggattttctccatgttgtgctttgtctggttctgatttttcatgtatttgttttgctaaagcagtgtgtacctatgttctgtgatctctaaattcttacatctttgcagtatagcctatccttgctctatcagactgttttcagatgctcttgtgaattgccctgagatccaagccctccatttttatataaagtgagttgtcccgaaactacatcctaaattttttaagtagccgtgtctctatatcaaatgaaatgaggtttcagttataactgaaagtagggattgtacagggctataagtccaattttccacactcgtccttccagtttggttccagctaattatggatcaaggtatgctattgaattacactgtagatcctggcttttaacttcttcctttccttgaaagaatcagttgtcacttgaatgtttctaatgctgaaggtcacattcctggtcatgtttattagttgtttgttgaagactttcaatgtagaaaaattgtcattaaatgttaaatcagttgttgaatttgtcagatatttatgtaatggtatttcccattcaaacttaccaccaaccatgttttcaggaaatagtagaaactgaattttttatcttaatacactggtatgagttttcaaggatcgatgagttaactaggatatgtatgccattctattacttagaagagcttgttttgggatatttgagatttcctagaagtgaactaacatgaaaatgtatttatgggcacatcatttctttatctttctagctgtcagtttattctgtataacaaaggggtagaaatagatgatatacatatgcttcattctccttccacccattaagggtcaatgattagttagagctataatgagtctgccttaacacgaatgcgtgccatctatatttcagttagattaaaagtggaaattatgaaaaataaaaataatttttaggctgaatattaaaaacaggataccctagctgactttatagttttgttttatttctggattattttggtccagtgaatactacagcaaaactgttttatccatatttttccctctagagagtgttcatcattcataggtcattctaggcattgagtcatttctgtgtttcaataaacaaatactcaggctacctagtgataattcagtgatactcaatgttgtgagtctggttgcttttctgggttttttgcatgcgtttgtgaagaatcatacaaaaaaggctggggaaatgatgtgtcagttaggaatactgaaccttgtcaaggactgtcctgacatccagggtcctcttactgcctctttgaccacttgcactcatatatgtgcacatagtaccccatgcatataattaaaaatacatatttaagaatcatacaaagtgtggggttttatactgactactcactgttcccatttcacagataattgcaggttacctgagacttctaagtaagagaccaagaatactgtcattggaagaatagcagtatgtcagtacaatactcaggttcaccctaatcttaagttctacagggtagacttgggtaatgggtggaggtagttagttgtgctacagcagaggaacactgagcttgagggatctgccactttaatagtgactagcacagagtctggtctttgctaagattgggagctgttgccttagtctggaaatcacttgttacaaacaaaatcctaggaaatagcctgaaaaaatccagcatcaactttcagtcttgacatatccagcagtaatgtacaaggatgctctcggatcgatggtggattgtctccctctgaatattaacacattttatcctgacagactttagtttgttgataacaagaaagactcagagcagctaagtaacttccttggcattacggaacaatgtgattatgaaaatctttgttttaacccaccattttgtatattgcctaagagcctaaacattgggcttgctctaaattaaccagaagaactagtagtcctgtggataggtgatgttttggacctagcctacatttgcaccatgcttatgtatcatttagaagacagagttcaggggctgtttgtttcaatgtaactgaaatatcccaagttaaaattctttgaattgctgccatgaagtagtgggaaaggtatgtgaccatttgcaaaagtgccatgggcacaaaagggatgtggctgtggattttagggctacatgaacacagttcttaaaaatagcagtcttggtagtttgacctttattccacagtttctggctcacctcaaggcttgctgtgctttaccactctcattaatgctgatgcatcctgtttctttctccccatttgcacatttgtgccttctaacacaatacatggcaagtgctgttgtattcttcgctctcccctcctttcccctcccttccccattctctgtttgtttgtgaacttttgtgtgaggcaaaactgctttggaaaactaatgctgcctcctgttacacaagcacacgatatgcattgtttcttattagggaagtgccaagaaccacctaccttgtcctgctgtttcccctgtctgctttgcctaaagattggctgctataaaagtgtagcatagtcagccaagtgcaatcttttttaaattagtctgctgaaagtgttgtgacaaactattttagcactggtgtgtgcctactactagagaccttaactgtgggctgaaatggcaaataacatgagagtgcatcatgtagtttgggttctacttgcctcagttttaagcatcatccctcccaagagagaaagagtgcctttaattttaaaaactataataggtaaattataccttgagtagttcactctatgcctggagcctgcagtcaagctatttcacacttatgatcactattaaaaaattaatgagacataatatttatgcatttttatgggaaccctatggtaatttgacacttactcactaatgttaatgaggtaaaatttccatgctggttcttttcctagaactttttagcatacttaaaagagaaggatcgacaggataagtgggcttgtaattaaacggatacaatattttattaaagtcctatttttccgtccttcaaaatcctataagttacttttcttttgcaatgacaaaggtaccttatagactaaagagtttatttgggctttcggttccaagagagtaaggtccatcatggcagggaagcatggctacaagcagtatacattatagtctgaagcatgaatctgggagctcacatcttccaatgcaagcagaaagcagagagagcaaacgggaagtggcttagagttttcactttctaagatcatctccagtgacttcttccttccagaaaacctctggaaactccctaaacagtgccaccaaatgttcaaatgcaagagatggagatgggggcacaattcaacccaccatgttagttactgatattctttttattttggcttcattaaatccaaataactctgttaagcgtaagtatttgtgaaatggcaaaaggttcctctatctctaaaagtcttttcttcccccaacccccttttagaccagcggttctcagtgtgcggcagttttaattcccaggaaacatttaataatttctggagacatttttagagtttagagttaggagaaagtgcaactagtttatagtatagatgatgatttaatatcctacaatttgtaggacatgccccctacacaaagaagtactcaacccaaactgtcaaggttgagatagactggataggctggaagaccttggtttagatcttctgactttttctctatttagagtggaaaactcccattgatactcagacattctcctccttccattgtattctctgccctgtattgacacaggagattatccctgttttcaagaaacatcatttatgtcattggctgtcacaactcgtatttttatctttttcttttctgctgataaaaacctgcaggactgggctggcttatgaactgtatttcttatcacttaacatatttctgacaactaaggaaaatgtgtgctctcttcctaatgagtttaaaaggtaattttcattttgcttattccttgagatattgctacctcttgatcctgctcatatttagctccttatccatgtggctcttatttatttacttgagatgtgagcttgccatgtagctcaggcttgccttgaatttacagtcttcctgcttcagctccttgagtgctggtaatattcgtgtgtgccaccacacacctagtgatctgtgtgtatgttgtactttgtgacatagacttctggtaccttctgcatctccatttgttaacttctgaagtcctagtctttcctctcatttcacagatttcttccagtttatcgtctctacataccaattcaggcaacagttatttctcctcaaataccacagcatgtagccgatgccaaacttctctactgactttgacatgtcagtaggagacaaccttggtaagctgaggggtgtctccagactgtggtttggtttgactaaacatagtttaaaaagcaaatactttatgggagtattcattttaatattcttttttgcaagaaaaatgaaaatcaactgtcccctcatgtggtaactatcaagtttgcctctgcaggttgaggtttatccttgcctcacggatcaccagacttgtttctttattattagctactgactgaccttatgatttctgttccaattgaatcaaggttaactttcctatttggccaatgaaagtcatcgactacattgtattcaactcaccagcaccaaggaagggtactttgtatttgaggataatgttaagcacctaattccttttctgtttttacctttgtttaattgaagccatgcgctgcagtatcccacttatttactttaacctttcctgctacacttttattctttccttgtgaattctaaatagtttccatccatttctttatgtaactgttaaactatttttacctgcttaaagatgacatgatgagacttccttcaccttcaacctacaatttcatttttgcagcatgcacagccacgctaacttgtgctttttataaatgtatgttacaatgtgtaaacatttgtgtatgtcctctccttgctacatatctggtatcatgctgagggcataagtacagttacaagcaggtgtcactctcaagaagctcgtagcctattgagaaggaagggataggtgactataaagtcataagtacaataataggtatgagcagagtgctgtttagagtgccacatactgtgcttgatagagacagagaagcctcttcagatgataagtttaatctggttcctagaggatgaagaatagcggggtcaggtttgttgggcattgtccctatgtaggtatgcatggtgagctagtcagttgggagaattctacctttgaaattcttcatgttcaaaaattaaccacatgtaataaatgttttagagaagcccaccacagtaataagcaagccttattaggcccaagataagcaattcctgcctgctatgtacacagagttggagaatatggtgttacaaacatatggtgcaggatagagtggtaagtacagatgcaggggtaaaggtgtttgggaacacagatcaacttcactacaaatggaagatagggataaaaagcttcttgaaaaggacagagattgtttttaacgaatggtgatagagtgagaatagtatgtgtatcatagtcagtgttggattatatataggaaggcattaaagactggatggcttacacgtaacaggattgatatatagttctggaggcttgaaatcaaggatcaagatgtcatcctggctaggttctgttgagggtcctttcgtggttactcactgctgctttcttgtggtagcttcacatggtcaagagcttagtaatctctcatctaatctgtaatatctttgagaggctccaggtacttcttaataccattatatcagaggaagatattttaatctgtgaatcttctggaaacactttcaacatacaaggcaacattacaagggagctaagaattagggcctgtttgaggaaatatgaggggttctaggagtcccaggtatgtgtatgagagtagctgatatcaagatgggtagattgtggctcaaccacagtgaccatcagatgcttactctgtttctgctccttcctgtgaactgggaagagtgaacaagggagttggggttgtagagcttacaatgtgattggagctgattggcgcttgtaatcagaccttactctagagttttggtaattggaaataccacgaagtctgaactcttgttaaaactacgtggtaattgccttgtttgcagtgtaaatatacagcatccattaattttgataccctttggaatgctttaatttgacagatttgaacctgtgaaattaaatacgtactgtaaatagcatgcatgagctttgatgacttagttttgtagcaagttaattggccctttctcccaccctactcttctgtagctctgttcctctcaagtttgtgttctaagtcaagctcttgttatttctcccctacaaacagatcctggcttaaaggtcatataacttacattacaggattcttgctgtcaaaccaaacatgtaatgtcttggctggattgcagccttagaatctctgaaatattccaagggaagctgtaagatttgtgacatgtgtaatgggtaaagatagcctcactaaagtacttccattttcatgtgtctaccacctaccacaaagtaagttaacttagaaacaatcatggaaaagtaatctttgcactgtcttgaaacaaaatcctgaactaaaggtagtttactttaacaggttggcttttttattaacagacattgacagtgtagttttattactacagcttttaagacagggtagctagcaattctatactcacatgagtttgaaataagtgccacatgaataaaattggttcaggattgtatatagctgggttatcaaacagtgttaatatgtgttatgactagttcttatataaacctgcttgtaacatatgagttgcactgattatagttacagtggttattagttacgttgttttgaacataaaacctaatcctgtgtgtgtatgtgtgtgtgtatatatatgtatacatatatatgtggttttgtgatttatctattgtttccttgaaagaaaacttttttaaaaatgggataaatgattgttttgtgttttagtttgaccgaacattcatagtcttttgtatttgagtttggatatattatccatgatgtgtcttactgaaaatgagtgatgatgtttatttgaaatgctttgtagctttcagaacaggctatcatatataatgaaaaaatatttcaagttctttgccttataaaattattttaaaaaggcacaggtctttgatacaggagtcatcttgtgcttaacaactttctcatgtgagatttgtgattcttgctacatctcttctgagtttctaggcatgaagagaattactataaatgaagaggacagaaacttcctgagttataaatacataaaacacatagccatatgaaggcccttgcagagggtctcccctgctgtgttgatccaaaaatactgcctgtcctgttcttcccctcttcttactgatgttgccttgggaattggaagcccaatcatgagtcactgtagtttctcttttgtttctttttcagtgacacccatatgcggtgccatgaataatatgcttctcaagaatgtgtctaacaggctggactgtgtgacttcattaccacagaattagggctgacaggcaggagcttttcctatgctaatagcttctcctcctgtttgactttccaggatgggacacgtcttcccatagctattattcatttatatatatattatatatatattacactgttcagtttcaaaatactatttttagtgcaagtatttgttttgaagaaattgacaatattgtctatagaataaaagtgtgagtcagtatttggtaagggccttatgaatgtctgggatatagacacaggaaagattaataatttgggacaaaatatgctaggaactgagttactagtattttcttcctgttactgttcctgtgtgtgtgtgtatgtgtgtgtgtgtgtgtgtgtgtgtgtgagagagagagagagagagagagagagagagagagagagagagagagagagagaagacatacatgcaacacttgccaaggggaaaatactcatttggaacttaaaacaaaacacttaggccttcaggaatccatggattttagtgtgtgtagtttcagaagtttcacatatattgaattaaataaaagtttaaggcataggtctgtttcattttaagaaaatatgtactagcaggataaaatgagttagtaaacaaagttgatttttagaatactgccataaatttcaatgctaattattgctactctgttgttcttaaatatctagtacattgaaaaaaaacatttttaaaaataatcgtaactgggttcatatattgttgatgtgtttatgaataaaaagtgctgttctgagttgaaacaagtttaatactaaattgtacttccttaggctcacaatgaatgagaacaatgaaaggactttaaatgcattacaaatatagtgtttatttctcctactgtcctcacttcttttaatcaaattcccctttatccagaattgttaacattggtatttgaaccatattgcttcaatatcaccaggaaagctagctaaaaagattgtaaatgtagacaaataaggaacccaatgaatctgaattgtgtattgtatgtttcataacccttaaggattgggagttcacatacgaaccaactttttaggttctctttagtcatcaaagtatgtttacagtaatgcttttttgctttttattcatgcttttctcatgggttgccataatccactgtatttcaaagagatatgagaatgggccatgtactcgagggtataacccagccccaccataccaccacatcctgcatgtcagctcaggtgacttaactgatatttatttttctacccctgacccacattacacatgctcagaatctttatgctttcaaatcttcagcttcaggatccagatattttgaaaagtgaggagcaatgactgtcaagaggtgagctacgtggttggaaggtaagagatgttagagtaggaaagaaatgagcctctgatgctaggtgctgaaacttgtgatggtgaaaagaaaggaggatttagaaacttagtgattgactagtggtgggacctggatgagacactgaagaacaggtgccatattcagcacaactccagggacagctgactaaggcagtaatgccgacaaatacaaagacatacaggaaagtctgggccaggtggtttgggctctttgatggagacactacaacgcagtagaagctcagcatgtttattacatgtagtagaagacagatgaggagttattgcatacagctgaacaaaacggtggggttattacatgacggttgggtttatggtatgcaactaaatcaaggaggcacgtttagctaatatctgtaggagcagtttgactgtagctgtgagtagcttttagactgtaagtacctgaagggagaaagctatggtggatactttctgtccataccgtcaacatctacatatggactagaggaagactttgctattcttctgggccttaccccagaggtgagacaggctttgccattcctatgggtctgaagctatgagctgttgacctgggcatgcctatgctaacatataccctctcagcatttccctccctccctccctccctccctccctccctccctccttcacacagggctacttctgttccctacaaaccagcatggtgggatgcaggaaggtgagtctgctcgaagacaccagactggtgggtgactctgaggcatcactgctaggtactgagatgtagcttgctctggaggaaagacactctcctctgtttgcgaagttgattcctggatggagtatgtgagagtctcctggggaatatgtataaattgaaaaagtatgctcaaaagactataactgtcctttcttaatgcaagcaggttaaaaaaaaattatctactcaattgtagctggcaagaatagacataaaacagtgtgtcctcaaccttaatctaagtagggcagagatgcgtacagaacccctagaggatgcaagatttgtctccaaaggggttacagattagcaaagattgacacattgcagtaggacatcataatgacatagtgatttaataacaacagcatctttctcgcaaatctgaactttatcttctctttccctttatcttttctgcatttcaaattcagctctgtgtgcattctttaatctgcagactctgggagcatgctgtattgtaagaagtatttgccagacccccttttttttgtttccgtttttatctataagaaattgtttctttgggaacatgttctgaatggaggttactttcccagggtagcgcccccttttcgggtcccacttaatctacattgcagatgagctgctttattaatagtatcagcctgagctgtgggagcagacatgtgccatatggtataggaacaaagaagaaagtcccatcctttctgttaggttctgggccgaccgtaagctatattttgaaattatttcatttatcttccggcctcccttcagagcccctttccacttcatggtgctacctattcagaacctcccctcttgttgtgactcccacctcaatagcttgctactttttcactttccccaattacctaccattgattcttttcaaattctcaatccttgctcagtagtggaactcttaattacaagaaaggacttgattattttaaaatcaccttggtgggcgccgattggctgcctgggaaactaggcagcagagaacacaaagaagggaaccgaggcaggtggcgaaacagaatgttttgggtaagcaatgattcttaccctaaactattctgatttaaggatttcctccggactttttttttttttcctaaattgttcttacttttccttcctatttccttactcttcccccttcctttctttttctccctttgcctctcttccttcatttcaagacagtttctcaagtaactcaggctatacttgcactacttgtgtacagaaatgacctcgagctcatgaaccttccatctctacatcccctgtaagtgctagacttacaggtgtacagcgctctacctagttttaggtggtgctgtgtattaagcttagggcatcaggtaagctaactgagaactctatgaacgagagactacatcctaaggccagttatatttcattttgaacccctgccatctttcgggagtgggactttgcctcaaatactaaacaggtgttcttttactgagctgcttcccccaccctcccccagcacgtgtttctgtttttcagtccttgtccttgattcttgaggcagcccatctcattcagagtttctttgttttcctgattgctctcttaaaaggcagcacaaaagcttttggagttgagaggagacaaatggcaaggggcacatttacagtacttacataagtctggtattaactatatggcctttggaataaaagaaatattcattaatggtttaatgcaagcattggttaataaaagttatttcatagttcttacctacaatattttcatgtgacatataagctaagacagtggtaattgaggcaaatggtgactatctttaaaagcactgattgactgttctttaccaattactctgttttgcgtgttgagttgtatgcttatcaaagagcagcatgtacattgtacttacttccatatgtgtgtgtgtatgtgtgtgtgccaagtgtagttgctattgtggttacatgacttaataaaacatggaaattgatgagatgtgcgagtgagaagaaatctattaaaattcagaagtcttttgtaggaattgatatggcagctatgaagattgctactgaaataagcatgagggaggtaactaaaagcctaggaaaaaacccagtgtactttaaaaggagtcatagggctttactggtgtctgtaggctctctaatatggaatattaaacagcagatgggaggatgtgtttttgtgaaaaggctgctttgaactccagctgatgagccaaaaaggctttagctctgcattaaaaaattgataaatgaatatatatttcagtgttgtcaattataataacatgttaaagatagttttttacttgtagtaatttttcattttaaccaccttctaaaaattaattgcctatggtaccttattttgtctatataatctgtatatagtaaaacaccatttttcatgcagagaattgaaattttagtgagcacttctttttaatcatttctaggcataataagggctgacctacctttgaataaaactttgtcaaatgaccatagtagtcagattttaattctttataaattactaatcataaattattactttattacatcattctttctatggcagatgaggaccttattcaatatggaaattttatcttgtagaaattataaagtagggaattactttaatatgtaatggtgaatttctgtgattaaatatttttaaagaacttgtctaaggcttctgtttgaaacatatgtgactcctctttgtaagtgagaaggattctctgactacactttgatattcttctttggtcttccttctttgtctttgtagtagggtttttgttggggaaattgctgagtacattcataagtgttctggtagggaattctggaactatttctgtataataactatttgttaagagaaacagcatctggttatgtagcttaggttggcctagaactacgtttgcctatttcagcctctggactgcttggattttagatctgtggcagccagagttccccacacatgttctgtgtagtaatcataaattttacccactgtccttttgtgtcctttgaatgatgaatgatcatgtgtcatcacatggttagaatttgggcgtgtaagggtcagccatttcagaaatttcctgtgattgctgctttattgttctatttataagtttttctggtgttcagattctagattacctttgaaggtcaataaataaattgctatttttttgttccttaatttgcatggaatagcttagctgttgaggactaatgctagtgaatctttggatctcatatgtagcatcatcccaccctaaatctactatcaccatagactgagatgagaaccatttaataggtggggtattagttttagaatttgtgtgtttggttgttatattgatgatgcaaagaacttgaatgcatgggtattattatgttaactgcacattaaatcacatggatgacatatcagagagagcacacgaggtgagaatgaatctcattttcttctttcttgcttaaataaataactcttgtttaaggtagccatgatgacacatacttatcatttcagtgtttgggaagctgaatcagcagttcaagaccagtttggtctacaggatagatcctgtcttaaaataacaaaacaaaacaaagtccccaaacaactctccacctaccttttaaaagcataactatggtctgaagagatggctcagcagttaagagcactggctgttcttctagaggactcaggttcaattctaagtacctacaccatagctcataaccttatctctatttccagggtatgcaacaccctcttgtggtatataaacatacatgcaggaaagatatccatatgcataaaacagaaaataaaacaattacaacatctatatttatctagatagtttttaggtggaataatccactcgaatgccatgacatttgctagcattttctgttcatgaatctattccaggttgattttttttaatagaaaataaacctgtgataaaataaggcaaaatggaacacctagcacttaaaaaaaatggattgcaacatctttaacaatctaaagcgatagtctggttagatattgaattattaggatactgaactctgttaaatatcttggtgatttacaaagagactcgtttgggttctaattgctatgcctttgccatcttacttcactcctttgtgttcaatggctgtcatcttctgtataatcagtaacccttctaatatgtaaatgttagctagcggtgacctttccaaagtcttctgacactttttccctagtagtttcctttgtatctacaaatattacgctatatgccactatgtcttcctttatttatttgacatattagcttttgacttccttctctgatagaagaggattaatctcccacagcatgcttccttcctcttcttatcattacaatacacttatcactatgtttaatttcttcgttagtgatctttgtttgtgtaatgtgaaatttatttgagacaatgaagataaatgtgagtctacctacttaaaaaaaaaaaaacttcaccctttccactctatagtcttccgtatttacaaaaaaggaaaaaaaagggaggagtcctgagtttgcagtggttccccatctcctcatgtggcagatttagccttcaaatggtccagctaccccatatgagaatggtgtgggatttgtgtgtgtggtgtctatttctgtgtgtacatatatacagggtcacacaggcaattttgcatgcagtgcaaagattagtatgcatttctgactttctgcatgtgagaagaaaatataatggagacctagagtaatttaaaggctgacctagtccatactctgtgtacattttctccagttttaaaagtgttcccttaccttgacaggggctcattctcagcatttacaatcactggtttttgtagcagtgtctaactgaactcttacctcaaggattgtgtttattttttaaaaagacactttcgtttttagacagcaattttaggtccataacaaaatcaagcaggaagtcaaagagtgaacatatatagaacactggttttatatgcctgcacctatatgcttggatttgcatagttgctagggattcaaacttagttcttcctctttgcacaacacgcatgttactcactgagctatttactccgaccctccttcttcaagggtcatgaatggttagatagttagttgtcaagttctctgtattaagtcactacactaaaaatgtgctttcgtacagtacatgggaaaatatgtataattaaatatataattaaaaaatttgaaaatcaggatgtgctttctgataatcatttgatctgtctgtctgtctttctgtctgtcatgtattttgaacagggcctcactatgtaaaagtagttgatctggaactccttagattagtatatcttcaactcacagagatccacttgcctcagcttcccaattactgtgattaaagatatatctccacatacctggatgattattttttttttttttcgagacagggtttctctgtgtagccctggctgtcctggaactcactttgtagaccaggctggcctcgaactcagaaatccgcctgcctctgcctccagagtgctgggattaaaggcgtgcgccaccaccgcctggcctggatgattaattttaacacgtagaaaaatataggccacatagtatttgttcagaccattcatttttgtgtaacacagtagcctcacagtccatagtgaaccttagaagaaagactttcaatttaaggtaaatattaacttacgatgcaagccatgtagttaacagttaaatctcactgcttttgtttgtttgttgggaggtggggtttggtttcaccatatgataaaacaccatggccaatgcaaacttatgaaaagaacatttaattttaaagtttatagtttcaggtgttaaaagtccatgatggcaaaaaaaaaggtgtggtggcaggaacagctaagagctcacatctttgatgtggaagttagaggcagagagagtgaactgggtatggcaggaatcttttgagacttcagagccctcccctagtggcacacctcctccaacaagcctataccttcacaaacaagccagtccttcacaaacagttccactaactgggaaccacatatttaaatatgtaagcctatgggggcattctcattcaaaccctggcaccagataactttcgctggtttagaatttgctattttggccaaagtagcttcaaattcatagtaatttgcccatccctgcttccagtgttgaaatgaaaggtgtgcactacttccccttgttaaaatttattctttaaatacagtttttgaagatttctttatttaatgcatatgaaattttgcctacttatatgtatgtatgtgtgaaacatgggtgcctagtgcctttggaggttaaaagagtatattgggtctcttgagactggaaatatagatcattgtgagctcccatgtggatgctgagaaccagtactcttaaccactgaaccatttctccagtccttaaactttactctgtatggatagactagacatattcatccacgtcagtattctctaaacagtgaaggtttgtcttgtgtcagcattggcatagtaatcatagttgagaggaagtaagaaacacaaaaaatggaatgcaatgctttaccttgcccttgctgctgcttcaagcttcagagtcctagaggtaagtatttgcaataaattgtacaagtaattaaggacaagtatcttcatatctgaatactgatttataaagattgggatttgggggactatgctatgcagctatccagtgagtacttctatatagctcaaggtaggaatgttataatagaacatagtttacaaataacatgaaaataaggtgtctcttcttctttgactttgtctctcttttgtttgttttgttcttctgatattgctccaaaacaaaagattcaactgaaagggtttatctacttggagctctcttcatttacagtaggtcacctatacaattctatcattttgttagggcataaactatatatttatgttttgttaaacaataacaacaaaataaataaataaatttagagtataaaataataaacacatattattgcaaatacgttcaataagtacccctttaatgagtaagtctgaatatatatgtatatgtgtatatatgtatatatgtataagcatatatacatatatatgctttcatatgcaatatgagaaaccacttccatcccattggagaattttataatttttaaagggaacaggtgatttgatttgtatattctagtgcattaaaagctaaaccttgtaaatggaaattgttggttttttttttgtttgttttcgttcattagataacatgcacaatggacatacaataaaccaaaaatatttaactggaacatactgctgatctacatatgcccccatccccaaagatgctatgtcctggtttttcaacaacctgtttgatggaactaattgaactggttgatgtaacattttttaccattctcttctaagttctcttatgcttacttgaggcagccatgctaaaatcttaccaagaccttctaaccttcttgcatagactccaggtataacctttggggttcagctgccaattgtcagttcagcgatgtgcagacaggtcatctggcagtgcttctttattttgctcagtagatacttggaggttatgttctttatcaaacttgaggtttttcatctaatctgtttgtgcatgtatctttttccacctttcaaaatatttttttcttccaaattgttctcccttgggtcatatgattgtatctattcctttgtatttgttgattgcaacagaattccttctgtgttagcatagttagtttctttaagcacatggaacatatttcaaggctaccagtaaactactgaagccacagacagtggtaacacacacacacacacacacacacacacacacacacagagagagagagagagagagagagagagagagaggggtacacagacagacacagacagatacagacatactcatacacacataatgtttttcaccaacatatatgactgtgacaaagcttgacttgcatattaatttcagtaggggctggagagatggcctaggggttaagaccactttgatttccagtatgtacgtggctgttccatcatctggaactctatttccagacatccaacacccttttgtggtctacagaggcattaggcatatacatggtacacagacatacatgcaggcaaaacactcatacacattagaaaaaccactgcaaattaaatacaatatgatgaaatattaataaaggatttataacagagtcctgaaatataagctttgtgactatattctttcttgaaagggtcaagacaaatactgacattttgaagctgcagttgagtagaaactctggaagcaaatttgcagataggggtgggattactgcatagcacaaaaacaagatgttagtgcccacaagaactttcttgtttatcctttttaataagcatgtttggctgtgtcccctaatgcttgagatgttttcataattgatcattttaaaaactcatcagaaactgggtaagtcttgcagacatatgtcagtttgcttagattatcgcttgacattctcattggtcatgctgcttctacaagactactagccagaagaaaatccaaagcactgttcagtaagaggaaatggtgtgttggatggatcacatcaacatgaattttggcataaagcttcctgttagtttgacaggttttactcctgactgttgtacttcctgaaaacttgcagtgaacaggaactcccttctttgcaagcctgagaatttgcagttacaaatagctatttctgaagtaatcctttcagatttgtttcgttttaatattttccctgttgaaactcaatgatgatgaaattgtggacactggaagacttttgaatattttaagttatacaaatggcttcacttaggtatgggtcccagaaagaagagctaggattgttttattagcatctgaaagaaagatatcaggacagtatgtgaaagtctgcatggggtgactgcatctggtactctctggtgctaatgttcaagctgtcttgaggggcgaggggaggatcttttagaggaagaatatggaccaccaaaatgtgatgagaagctggttgtaggatttggaccagtagccaaagaaaagctagaaaggtgtggaaggaaaattagacatttgatttataactcaggaaaaaagtgggcaggctgagcagtgaagatgtataagcaaatgtgtaggtggtgggaatcttcagagtgagacagggagatggaggtacagagagagagagagagagagagagagagagagagagagagagagagagacatacagaggggggagagagatagggagagagagagagagagagagagagagactgagagaagagaaaggtagggaggagtagggaacagagcatcaaagtagccttaggatttgagctagtatccaaagagatacatggaaaagaaaaattatacccttcctattagctcagaaaagtaaacaggtttagcagggagggtctgcaagtgttgctatgcatgtagtgatgtcaaaggtgtgtgtatgagtacataccccactaatctcatagttatttgttcaggggagagctttccttaccagatgataggccgagttggattaactcttatgtgaagtaattatagtgcctttgaaatattattttttagccagtaaaaatgtctcaaaaaaccaaaaaaccaaaaaacgccccaaacccaaagcaactcctcctccaaagaatgtcagtgctagacctctctgtctctctctgtgtctgtctctctgtctgtctcactgtttctctgtctctgtctctctcttcctctctttcttcccaccttccgccaccggaactcatttagtagagcaggctgtcctcttgatctgctgcctgcttcaaacaaaccaacaaaccaacaaacaaggaaaatgtagcattcaagataaagagacaaaaaccgtgtacaatgtagccgtgccttactggtttcccgttaactccctcatcaaagcctagatacccattctgtcttccagtttttgcattttaaatcttcaggaaggggcagctgtgataagtctttttcttaatattgctgtgcaaatagggatgtggctatgcaggacccacaggagattttgaggcagtggtctgttcttactggcctccatgcctgctacttcctgtctagttatccaagaacagtttgtggtttcacccctaattccactaagcaagaccattaaatttatggttatatgtcctcgatgaagttctgatgggagtttctatttaataaagttaggcttccttgttaactatctccagagtttatgttgaaattgtcaaatccttgagagatgaagttaatatagtttactttgtatgtcactggtactaaatttaggcagataacaaccaaaactgggaagatttttaatttttattttgagatttattgcatctaatgtaattttcttgtcatggaatttaaataaatacaataaatatttttaatgcaaatccaaactaaaaatccatcttccttacagatatcattagcatttatttcatgacattttctttctctattttaaagggaaagaattttctgaaacgctagtaggcatgctgtcacttcttagtactttgtagtttactgtagccttctctggtgctgacaaatgaacacctggaaaggtcggtgttggaaaataaaactgcagcccttttacacaagcttggttcataggaagcaatctgaaagtcatgttacctttgtgctctatagcgcttgcttgagttctgaaagtagctatgtagatggtagggtgggaacttgcattattttccaggcaagttaactagtaactatagtccggtgccaaggtgtttcactctgtgcagtcacgagttgcaacataccctcacagtgtggtgtttgctattcattttgtgatagtatgtttttgactggcatgatgatgctgcgtacaggccaggaaatgttacacaaagtagcttggttgaacctctgggggcctatgtttacattagaggctgtgcctacattacaggtttattgtgggaattaaattaaaactctaagaacagtgcctggtatgcagtacttagtggctcttaattagtaatacaatcctgaatatctctttaggttctgcttttctccccgcccccccccccatttctgtgaacaaattaaaaaaaaaatcaatagcattccctgctagttggattctcattcattcattcagtccgtctctacactttctctaaaatccatctccctttatctccttgtctctcttcctttgcttctccctttttctttcacctcccatatatttatgtggcttgttgcattgaaagtggagcaataaggtaaactaggcaatgtttacatactggcttgcagtacaacatttacaacaattgataaagaacctgaaatcggcattatatacttttgaggaatatatcatgtaagcagcatagtgcttgctaatcaatatacaggatcgttttttgaccaatttatagtgtgtattccaaagcataaaactaagttcctatactgtagtctctactttgtagttagaaataatggtggtggtggtggtggtagtggtaataatagtagtatactttgataagtattgtaaccaaagtgtgaaccaaggtattgggagtaacaaagggtatgttttctgtgttactgcttctttaaagcattctgtagttcacaaaaacactggttcttgacagctactggtgattgacaccatgcttcttaaatgtttagtttataaaatggctacttcaaaatttcagttacatgtcccaaatgggtcttgcctacagatttgtgtctacacatagtcttatttctacatttcatatgaaaagaagtgtctaacttagtatattctattatggaattaaagagagaagagcacattctaatattttgctaagataaataaatgctcactatttaaagctcaagtaggcatgtgcttctatatagtgtatgaaatttgagatcttacaagttcagtggttatctgaaaaaatatccattcagaggcctttcaacttggtaggtcaaatttatacttaagctcttgaagtagttcactctatgtactgttgagacagttcttatgaaggcatttagatgccaggatattttctttaaaagaaggggttcattgacccctgtttcttattttagacactcaaggacctagagcaagaatgtgttttctcccattcattctctcatcatttgcactgaaatgagtggccagttggtttttttttcttcttcttctgtcttcttgtggactactgctagtgcagcctgcactagcagtacatacttgcctgtaggaaagaaaaacctttttacaacctgagtctgattgtttttcactggaagtgttctaaaggagatcatagttgccctcctacattcatacttacaaagaaaataaatttgcggtgcattacagggtgtatatctgtgtgtgtctgtgtgtgcacacatgtgcatactaaatctagttgggaatttaaccatcatttcagaacgttggttttgtaggaaaatatagcgatagaactagctgtacgtgctacgacatacatctcaggactataaagagcccatgcatattgaaggttatgcttattaaattagatagtttatatagaataagtacaatattattagaaaatggaattgtattgttgagaaatcaatttagttattttgtaaatttctttgctacccttgtcctcctggcatagtaatgtggggctaaactcaagataacatagcaagagtaattctgtaaatgttgaagaacatttgtattttcatttcagtacactgactgtaatttattctgtctcttatatgacacttaagttcaatcttctaatgtctaattggacaaattgttatcaatccaaattactcaatgttgaagaaaataggaatgcctacagaagctattaaaataagtttagaacttctcaaatttatcccggagaagttagactttctcttgcatcaagaaggctacacacacacacacacacacagagtactattagcatgtttaatgtggctgaagcactaggtgcaaatatatgatatgcgtccctgtgaaagaatttgtttttcctgattggaatcttttcttgacgtcagtaaagtcaaataattataaacagattaatagttccttcatattttttgactttatataaactataatcaatatattgatgaacgaacaccagtgttgttctaaagaaaagcagtatgtttacagcctgagaagctttgcattaaagcatttatgtgattcacaatattaaaaatatttgagtcatttgctttgtcctgtaaatgtgaagtgttaccactttagttctccttttttttttccttcagagaaaggggcatgtaggcctttgccttttattttgtaatgatacaatggctagactacatatcctttgaaatatacatctattttgaaagtatagtttctggtttattagctgttgttatctttccataagcaaagctattgagatgtatgaagagttcattttgaccagcacgagtttagaagacatttagggcctgtgtgagtaaacattaagtcagttgttgctttgtgtaatataagaaaatatccacaattaatactctctgctaatttgttatgatggcaattgaaaacatgggagtataagtgacagttttgttcttctctgtttactattttgacagtttctcttgagagctcagaagttaatgccttaagcaaattaaaactgagttaaaacatgaaaataaatagagagctaaagtccaaatgtttgaagaatgcttttaccagggatatcactactgagcaaagaatatggcacccgtcctgagaaaaaatcaaatttaaacatttttatacatgctgttaatactaagttcttccacagcagttttgggaagacctctcaatatcgaattattttcacctaccatatcatcatatttgtctcaaggtttttagtttaaaatacttgtgaatgttcagttgtaaggctggttttataagattaaaaaaaaatcttctgtgggtctgagaaagccgcctgcctttccctgaactgatcagaactgaggggatgtacttttcgttgggaagccatggctttgagctgcacctttcaacctgcccgcgtttcccaagagctaaaaactgaactagacaaacaaacttttagatttgactcattcctgaattttggattgctaggaaattcaggaatagaagcagaaagtattggtaatgacattaacttaaattgttggttgaattttatgtattttgttataaaattaagtttaataataacgtattcaaaattcaggtataattttcagttttaggcaatttatactcttaaagctttaaaggagtgaatcatcttgttttgtcacattaattttgtagctgcatcagaaaactaaatgctgtggttatttataaaagctgcttgaagtagatgcatgataagtcattgtaaggtgaagtatctactagtagtaatcacagcaatttagaggttatttgtgtgttgtaaagatagtaatcacaacagcatatatttaaattactctacttaatacaaacaacaatcatatgtctgggtacattgcttcaataacaagggtaattttaaacaaaattacatatactaacagctttctctattccaattgctatcacctaatctgagctcttatcataacaatcagatctctctttctgtcactcctctttttcccagtcccagttccatcaatcattacaaatctgaatgcttattctacgttagactctgggtaaaatctccaaggaagttgtgggaacaaagagtcttgagacctaggcctgaatctgcgtgtggactgtatatccctgaaaatccagaattggggagagtgagctggggtggggggagaatgttgagagttttgaggccagcctgagctgcacaggaagactatctgaaaacaatgacaataaacaacactaaaaggtgctgagagagaaccagatggggtagagttctatatatagacagaaaggtggaggagagatcgttagtcctgatcacattgaatttccaagatagcaaggaaggcaaatatcaaataattgtgatctgataattacaaaggggggaggtcagaaaccacgggtcacttactacaagagaacagtaatgttagaaaagatgaatggtgatgaggaaggaagaaatgtgagtggaataagcactcaagtccagtgaagagtgcaaggataggccaaaactgacaaccactaaccagaaatgtcatagtgctgtttactgtctaccaacgactttggaaggagatagaagtttcagagcatgagatcttaattttatggcctaaatgttaattaaaaatgctaaggccaaatggaataataatcccctccatagcattcttatggagatttaaatgaggcaacatagtctttgagcacagtgctaacaaacgcacagtagagggttgctgatacatacatagaaaagaccacagcctattgttgcaagcttttcccgagcttttggttcctccttcagtcagtaatacgtatgcagccacaacccttttctgaaattctaaaacctatgaaatctgaaaatggcctttcttagttagggtttcgattgctgcatcaaaacaccacgaccgaaaagcaagttgtgtgtttggggggagggcttatttgaattatgcttccatatttccaatcatgaccacaggaagtcagtcagaaactcaaacagggtagaagcttggaggcaggagttgatgcagagacaatgcagtggtgctgcttactggcttgttcctcatggcttgctcagcctgctttcttatagaacccagaaccaccagcccagggatggcaccacccaaaatgggctggacctaccccattgatcagtataagaaaatgccttacagaagatgaacctagttttactgaaacttgatttaccaaggatgattgagactcatgagaggcctccacttttttgaattgagacagagtattgggcagggcggggggtgggggggaggactgagaggacaggagggaggggaaactgtggttaggatgtaattaaattaattagttaagtaattattaaaaataaataaagtggctggatgatttttaaaaaaagaaggaaataccttacagctggatctcatgggggcatttcctcaactgaggctctttcctctctgatgactcttgcttgtgtcaaattgacacacaaaaccagctggtgcatatagccttttataaatcggcaataaaacctacaggataaataaagtctgtgtgcaaactttatttatcctgcttagtggaacatcagtgtctcattgctcattgttttcagatagtcttcctgtgcagctcaggctggcctcaaaactctcaacattgctaaacttgaatgcaacgcagtgtgctactttgggttttcctgtatgttttgttatttgtagtacacatagccatatttctcaaacttgaactatttggagtttcaaaacatatctgccttcaaaagttccagaaatgattgtggattcaatgctatccaaattaattagaacagacaaacaaacaagcaagcaagcaaacaacattataacctccatgtccttctgtgaattaggaagcccttaggacccccagaggttggcaaatgttgtataggttaccccttatggttttcatgattaactctcacctgaccacagagtacatcttgaaaatgtaatgtccttccttttgaacgttttgtttcaaaggccactgctcccaacttgcctgaagcatagagtaatgtctcctttgtcttacttccttccccctttttttttttctccctgggtattcctgtccagaaattagtgtgtattcttatcctgatttttcaacccagttcaacacaatagttcaactgtttcttcccagaattctttttttgtacttaaatgaatttattaaatgaaatatttgaagaggtattgtgtgccagtagttgttaaagtgttagtgattagaagccagtgaaatctctaatatgaggggacctgttttctagtaagaagaatacaacatttaactagtgctcacaaacttacagatagcggggtaatgccgtgataatagtggacagtgtggtagaggaggagaagctgcagatcttagagcttagtatttaattattgacttgcttttatatggttagattgcacatgccttaagggaaaagcatgtcttatgcttctagataccacaaactgccggctgtttaataatgggtacgttcttagtgtttgcttgactcatgcattcattcatcctttgattaaccgagaaagtagaattttatttattaaacatcaatcttcatttggctaactcgtcaacccaagtgtatttaatgcactaattacttcattgaaacattgaaatacatgtatttatgtaaggctagcttctctattcctatcttttcttttaattcatagtccaagaagaaaaaaaaaattgaagtccaggtcttcatatctcagttggtttagtacatagtaaacaaatgtgatttctgtacctgtaggagaagcgcttactacaacaactttattatccctgcgattttgcttaattcagatacaatgtggcttttacaatttattcttaggaacttttgttgaataccaaagtggtgagcatacatttcctgaacatattctgaggtgggtcatgcctatcaaacagaagagactgttggattcccatactatagttgccttttctgacattcaagtttatggtggtacagttcatttttttattgttaggataggcttaaaaaactaatttaatgtagtaacagtcttttgcttcatgaagaaaacagaagtcccggactttgatgttatatttgatctcttatatataaatattttattctttttatatcgaaagaacagcttgagaagaagatcccagaaggaacgtggttttctttctttctttcttttttttcttttttgtcagaacaatagcagaaagaattttgatttgtaatagcaaaaagtctggtggcttaaagtttgatgcttcaacttggcagtatttctgaggaggtgtggttactgttaataaaaatataaatgtattttcctacttaagtgaagaaatggatagttaaaggtgttaaacagcaaagtaaggcagaaattggagcttaaggtcagtatggtcatctcatcttttagggttttgggctttgaaagcaggactatatttctttaagtttgtagtgtctagcatgttgccagttcatctagcatctattcataaatattaattgtgatggaggacagtattgcctaaaatgatgtgttcctgttagaaaatgactcttatgttagaaaggagatgaaagagtgactgaggataattttaaatccaggtagtaaacatttccatgatgttgaaagctaatatttgttctgtcatcctagaagcaattctctacattgagcttgcttctaaaaatcagattatagataattttcttggtgaaataaatagaacagggaactactaaactcaaaatctctatgaaggattccaaggactgcttagaatgttgatttttattactaggtattcaaataatctggaattatttcgattggtcttactagctttgaaagttcagagtatatgatcttacaagttggaaggcagaaccagttccttgtatgacggcctccaatctgaataggtattaggcagatgtgccatatagaggagtttaggcctgccttgtgtctcttgactcccttgctccctttcctcaagatatttctaacttgaaatgtgtgtggaagctatactagggtactttctcttgagaacccaggcagtaccctcacttccccaattttttgtgattgtttgttcaatcctctgatctctaaactagaacttacatggtagatgcaaatgtttgttatattgatatgaatgcatctttctgtatctcattgttctggcttttattttattttattttattttttttttttgtgagcaagatacttaaagctgggtgaataattgaccatgcattttttgttgtaatggccaacttattgatcttcattaaaagagaattgtctaatacagtgattgtggtttttgagttgacgatgagacttttgaattatatctaatttagtttttcaatttctgtggtactagactagttgcacaatgtttataaagcactgtattaccatgtaacgttagccatgagagagttgactctttacatcttgctccttttgttaatttctgcctgattgagaaaattaaaacttaattttcttgccataatgacctttagctttgcgatcagaacttcaacattagagtttatagtaactcagccatttctcttattcttaaggggttgagactctagagcaatacttttataattatataacgctatataattctacactattatatttaatatagctgatcatagatgaagtttaataaacactgattgcttgagtaatgcatagtttgattgcttcttcagagttgcgcttaatgaaaatatatggtcactatacttattgatgtaatatgccaccattgtaatgaccattatcattatatttgcataataaaaacttaacaaaatgactttaatcagtgcttttaattcaaggctgtgattccaattttgggggttatttttgtcttagccttttaaatgttctttcaagtccatgtatagctctctagtttgtgtgaaggaataagatccatgtttgctttttttgtggtttgaggaaacatatgtacatctatatatattaaattcataaatgatttgagaacttttctgggaagaacatatggatatgaaatgatagtttatctattcattttaaaatactgtttttctgtgctgagggcctaactcatggtctctcatacatgtctagtgaatgctctaccactgtgctataattcagtcctgaaagtaaactttgatacagttattttcaaatgtgttttaaagatcagttcataggaacatgtttgacttagtcttgccccaaagcagctctttacatttttttgaacttctttactgtttggtgtctttgttactatgatggggtgctcctgtatattgagttttcactgccactcattggttttctattgatgattacttaattgtgacttaaactacaatattagtgcatttttagtatacaatggctaaaagaaaatcacagtttctgaagctcagtttctttgtccctgctaaagatttaacttttcagcccaccatagtcctttctttcaatttgaaagaaaggttttcagtgtcactatgtttatgaaatatagtatttgtgaaattgaaatatttttaaaaattctttttgctttgcatgtgtacgtatgtgtgtgtctgcatgagtgtctgacgcatgtgtacaggcgtctgtagtgtgagaaaaggtgttgactgttctgaagttacagggagctatgagccacccgaccgatttgggtgctggctactacattggggtcttctccaagaacagtatgtgctcttacccactgagcaacctctcttgctcctgagagcaaatatggtaatgagagaaatgtattagaaaacagctgcattatagtaaatgttcacatttatatagaatgtatgtttctgtgctggaatgaaatttataaatcaaaaattcaagagtgaagtgtttttctttatggctctctatcataagtaattggaataattttttatgtgactataatttgctttgtgccctgggggtactctatcattcttgaaaataactgttagaggaaaaaaaatctttgagagtaaaatagagtacagtcattatccagttttcagagtttcacatttgatttgccaatagtcaaattttaaattttagagacgttctagaaatagaaatacatctactaaaatgaatatctcaggtcaagggatctgcaaaactaccaacaggacatcataggacatacactaagtaatattttgctttaagtagtacaaggaccaagagggaaaagtgaaaggtggcctggggccaagtcatacagagcctgaatacctttgggttattagtctttgcaggaccaggatgaagtaaatatttatgaaagggagtatgagagtcattcataatcattattgcgctttagtgtaccaagcgttgttttagacatcagaagcactgcccacaatcagtcagaaaagactatctatccctctacagctcatattatagtgtgttgaaaaagataggaaacagttgagggtgtagctgaatggcagagtgattgcttaacatgtactgagccctgggttatatctccagcactagagagtaaaaagcaaaaggtaacataatgaataacattagtttaaagattgttatattaaatattatttggagaaagacaaacaagggaatgtgtggattaggcctatgttattactagaattaccagagtaggcctcactgacaaaaaaaaaaatcattggtaggaggatgaaggggcaagttgtacagataacagaaatgaacaatgcaggtagggggaagagcgaattcgtgtgtgattgctttcttttcttgggagcactgaggtggttagtgcgaatggagctagttgaatgaaggagaagcagtgaaagatgaggtcagggattatctagtgattgtaatgaccttgagttgcattggatgggaaaatagtcattgcaggtttgagctggggagtgacatgactttggttttcacagtataccattgtctgcccttttcaaaactcactgtaagagaacaaaaatagaatgagggagacaaggtaggaggttactaagaaaatctaggtaagagctggtggtggttttaattaggtttggtgtgtgtgtgcttgcctgtgtatgtgtatgagtgtgtgtttgtgtgtgtatgtgtgtgtgttactgaacagtctgttgctaggctattggaaatgaagagtgacttaatgtagaagtcttcagcatagaaaatggaatacaggggtaccattagcataaatgatactctcttatttgtaacataagatgtttgcttatattatcttaaatttcacccaactctaaatgtccatattatgtggcctagtgtgaaccaaagaatgttaattcaaagtagagaaatgtgagaagattttagactcttcctgtaaaacaaagtgaaaagatagctagcatttctatttttttttcattttgttttttttcctttttttatttaaaatttttttattaggtattttcctcatttacatttccaatgctatcccaaaagtcctgcatacccttccccccactcctctacccacccactcccacttcttggccctggcgttcccctgtactgaggcatataaagtttgcaggaccaatgggcctctctttccactgatggccagctaggccatgttctgatacatatgcaggtagagacacgagctccaggggatactgcttagttcatattgttgttccacctatagggtcgcagatccctttagctcctaggatactttctctagctcctccattgggggccctgtgatccatccaatagctgactgtgagcatccacttctgtgtttgctaggccccggcatagtctcacaagagacagctatatcagggtcctttcagcaaaatcttgctagtgtattcaatggtgtctgcatttggtggctgattatgggatggatacccggatatggtagtctctagatggtccatccttttgtctcagctccaaactttgtctctgtaactccttccatgggtgttttcttcccaattcaaagaagggacaaagtgtccacactttggtcttcattcttcttgagtttcatgtgttttgtattttgtatcttgggtattctaagtttctgggctaatatccacttatcagtgagtacatatcatgtgagttcttttgtgattgggttacctcactcaggatgatgccctccaggtccatccatttgcctaggaatttcataaattcattctttttaatagctgagtagtactgcattgtgtaaatgtaccacattttctatattcattcctctgttgaggggcatctgggttctttccagcttctggctattataaataaggctgctatgaacatagcggagcatgtgtcattcttaccagttggaacatcttctggatatatgcccagaagaggtattgcgggatcctccggtagtattatgtccaattttctaaggaaccaccagactgatttccagagtggttgtacaagcttgcaatcccaccaaaaatggaggagtgttcctctttctccacttcctcgccagcatctgctgtcacctgaatttttgatcttagccattctgactggtgtgagatggaatctcagggctgttttgatttgcatttccctgatgattaaggatgctgaacattttttcaggtgcttctcagccattcagtattcctcaggtgagaattctttgtttagctctgagccccattttttaatggggttatctgattttctggagtccaccttcttcagttctttatatatattagatattattcccctatctgatttaggataggtaaagatcctttcccagtctgttggtggcctttttgtcttattgacagtatcctttgccttacagaagctttgcaattttatgaggtcccatttgtcaattcttgatcttacagcacaagccattgctgttctattcaggaatttttcccctgtgcccatatcttcgaggcttttccccactttctcctttataagtttcactgtctctggttttatgtgaagttccttaatccacttagatttgaccttagtacaaggaaataggaatggatcaattcgcattcttctacatgataactgccagttgtgccagcatcatttgttgaaaatgctgtcttttttccactggatggttttagctcccttgtcgaagatcaaatgaccataggtgtgtgggttcatttctgggtcttcaattctattccactggtctacttgtctgtcactataccagtaccatgaagtttttataacaattgctctgtagtacagctgtaggtcaggcatggtgattccaacagacattcttttatccttgagaagagtttttgctatcctaggttttttgttattccagatgaatttgcagattgctctttctaattcgttgaagaattgagttggaattttgatggggattgcattgaatctgtagattgcttttggcaagatagccattttttactatattgatcctgccaatccatgagcatgggagatctttccatcttctgagattttctttaattctttcttcagagacttgaagtttttatcatacagatctttcacttccttagttagagtcatgccaaggtattttatgttatttgtgactattgagaagggtgttggttccctaatttctttctcagcctgtttattctttgtgtagtgaaaggccgttgtcttgtttgagttaattttatatacagctacttcattgaagctgtttatcaggcttaggagttctctggtggaatttttagggtctcttatatagactatcatatcatctgcaaaaagtgatattttgacttcttcctttccaatttgtatcctcttgatctccttttgttgtcaaatttctctggctaggactcatttctattttttttgggggggggcttgttttcactgattaaattgtcaacatgtgttcaattgagatacagtgttgaagtatttctgacatacgtgtgtcttaatataggaacttgactgaagcaaatatttttcttctaatttctattctggatttggaaatgtagatgtttccaatcataactgtataaccccaaaggaatggaaggaaaggaaagcagaagttgcttgaagagttatgtagtctatcgaaaaaacccagctgggcaggctcatgtcagatgttagcaggctcatttcaggtctgtaattgtgctttgcaggaaatcccatctatcatcactgttcctgaagcttttctataactcaccagaaaactcaagagaaaagaaatggagaaaagtgtctatggtgaattgatttttttttttccgagacaaggtttctctgtgtagccctggctgtcctggaactcattttgtagagcaggctggcctcgaactcagaaatctgcctgcctctgcctttcaagtgccaggattaaaggcgtataccaccacttttttttttttttaaagattgctttagtttttatttaaatgaccccccttttaatcttttgtgcttttgtgtgatgttcatattttgtgtgtgtgtgtatgtgtgtgtatgtatgtatgtgtgtgtggtgtgcacttgcatgccacagcacgtttgtggatgagtggaggtcagagcacaactttgggtatttcttggtcctcacttccttatttagtttgaaccagggtctctttgttgttcctttctgcattgacaggtaacccattagctttcatgggttctcttgtcacagcctctcatcttgttggagtagtgggattatagatgcacaacactgcacctggcttaaggtgggttatatagtttcaaacttagcttttcatgtttattcagtgagcactttccttactaagccaccttctaaactcctctcccctcttccccaaggaaataaagatttattgagttttatgatgatttagtacaggagaagaagtttcgattcctaagggagttgaagctttcaaaatacaaaaatgatccatacatgcactagtgcatttgccatgtttgttctaggttaggatggttttcaatagcacagagtggatagtagtaattgaaggcaagtttctgagattgcgagaccaagcagtttttttttattagatattttctttatttacatttcaaatgttatcctttttcctagtttcccctcccaaaatcccctatcccctccctgtccacctgctccccaagccacacactccctctacctggtcctggcagtcccctatactggggcttagagccttcacaggaataagggcctctactcccattgatgaccgactaggccatcctctgctacatatacagctagagccacaagtaccactgtgtgttttttttttttttttttttgattggtggtatagttccaagaagctctggggggggggggtaactggttagttcatattgatgttccttctatggagcttcagtccccttcagctccctgggtatttctctggctccttcactggggaacttgtgtcccgtccaatggatgactgtgagcatccactactgtatttactaggtactggcagagcctcataggaggcagctatatcaggctcctgtcagcaggctcttgttggcatctgcctaatgtctgggtttggtggttgtttatggggtagatccccaagtagggcagtctctggatggtcattccttcaggctctgctccgaactttgagaccaagcagttttgacttatggaaaactcccaatgcaattgtctgtagtgaaagatgtgtattttacttagtaaaaattcatgccaatatttatggctatgttagatacacttcatttggcttcttctgtaagaaacagaatgtgaaacaagtctgaagggactgcacatgagatggtgaccgtgcaagagtatattatctgtgccatcctagtttgcttgagtgtactctgatgccatttattgtgcatttctagaaacataacatcatcatgaagagatgtgtggctgtacttaaaacagtgaaatcttgactttatactgattgcatgctactgtaagattctgaattatcttctgaatcctgaattttattgaattgttagatttgttacgttttaacattttactcattaagtaatatttgctatatgtgaaatagttactctgttttattttaatttcataatcgtttaggcactattcatttcagaaccttttgaaagactgcgagggaacagaagtttgcttactgctttgtagtattttaatactattgtggtgctatctaatatacaaatgaaagtttgatcttaatgtccatatttaaagtcaaatagctaaccctcccccttactaaaccttcatttgaagtttcttttctttttttatttattttttacttttaaggcaatttttattagatattttcttcatttacatttcaaatgctatccccaaagcgtcctatatcctacccctgccctgctccccaacccacccactcctgcttcctggccctggcattccagtttgcttactgctttgtagtattttaatactgttgtggtgctatctaatatacatatgaaagtttgatcttagtgtccatatttaaaatcaaatagctaatcctctccccaaccaaaccttcattttaaatttctaccatattttttaaaaattttgtaatgggtgtgttatttgtatgttgagttttattttttgacaattttcatttgataaaagatgagaatcattgaatttctttaattattgttgtcttggttgacttatgagtttcttttttctgactgttattttcttttgtttgtttccttttggttttaatagaacattcaaataaaaactttggcagatgatgtggtaaggtggtgtgagcagcatgttatttcattgcttgtgcatgttatgtttttatttaaaaagtggacattaaagcatatatatgcaacacataaagtgactgcatgtttagaaaatagagcagaataggatctttgccaatagagcaattcacccctttagaaaatagagcagaataggatctttgccaatagagcaattcaccccttttcacatatgtatgtaagcaatcgtagctaggcacagtggtacatacctgtaattctcacatttcagagactgaggaaggaggattgcttctggtaatggaggaggtcagcctggtatatacaaagagttctaggttacccagggctatttagtgccctgccccacctcaataaaaagaaactgcctcaaaattacccaaataattgggtcagattccagctatgtttttttttaaatcattgtaatatataacaaccaatattttgatgaatacatgtagactataaaaacatggctgttttctctattgatagataaatatattgtgagtatattaaattctgatattagaagaatttgtctacaaatcaaatatgtactattgaatttaaaagcttatatttttgagctcagactaccatagtaattcttgttggaagttataagctaagattttttttaatatgaacttacctatctacaaaaaatgttaaatcatattactgttttaaggaaatgaaggtatgtaacttaacttcattttcttaccaaaatatagctgaagtacaaagccattttttgcattagaatgaaaggtgtagaaagctcaagtctgtatgttaccaatgctgatactcagtataaatgctttcactgtataagtactttaagtggtgtataatgaatggagaaaagatatattaatttaatggccaactacatatttaaatgctttcatgtccaccaaatctttttcttttttcaccatatctttgagtaaaatttgactcagtttatttgggattactgattgtttttttctttcttttttttttttgagatgtgagaagcaattatctaaaccaacttaagtttcctcaaagagttacacaacatttaataatacagttgaaataattttaaagaaatacttgtaatatgaacgctgagatcagaaccagggactcatgtatttaagggagtcacctgttgtgtgaattgagggaattggtttggatggcatttcatttttcttcccagctctaaaatattgtggtttctataatctctctgtaagcaaccatgtactcaaataatttctgtaatcccaagtaagctgcttaaaactgctttcttcaaagtacacgtgttaaaaaaaaaaagcacccattatttcaatcaataaaataaagactatgttctcttagggggtaaacaaacataaactgtaataatgtctggaatgctttcatattcttaaggttatttaaaaggatggtggtaacatggcagtgtacattcattgtcatcatagctaacatgtgtgtttgcttattgtgacctgatgatattgcatgtgcttcctaacagacacctgaataaaactgagttgtctccagttttatgaatattactaatgtttgatgtcaaatatttggtggtttttaaatcagatggtccattgacaagcagctaaagtccttgactcacttggtatgaaagagcaagctcattgttagagattgtacatggtatcaatagtttaaagaaaatacctgtaaagtagtgagtttgtcagataatatttaaagggggaagaaaatatttctgtttatatgttcaacaaatggaatgagtgctttagctttgttttacttcctactggtgccactgatttggaaagaaagagttgaggaatatggtaataacagtaattagaatcaacgcccaccaagtgtatttggcttttacaattacctacaatataagaagaggaaatagtgagagagaagggtatcttcctttcctgactgattctgagttagtgattttccagtttggatttaaactcactgtgtctgtcttcagactccatggtattaggcaactgctaaaatgacagttattcatatatacttgtcacagtttttacagtgtgcagaagaaaaaacattaccctaaaattccctttgagtttgctagcagttgttccgtttccactctccctttccatagcactgaagttggcaccaaagcctcattcttcctaaaacaaccaccacaagattttgatccaaagtgtctctttacttacttcctgtgtaaagaaagaaatgacaagtgactaaattttacttttgaggaatgttttctcacccctagacttctgaagctgaagaactactcaaaggttgcaaaatagtccagtctctaactggtgcttgctgcttacaataacattttgtcaagagacaataataatatatattatactaaatgccattttgatgctttcattcttcttgttcatgaatcctgattcttttcttagggctttatttttgttttgttttgttttctttctctgtttctagcgtgaccgaattacaagtttcagaaaatctgccaccaagagagaaaagcctgttattcaacattctattgattatcaaactgcagtggttgagattcccccagctctgatagtacatgatgaccgatctttgattttgtctgaaaaggaagttctggacctctttgagaaaatgatggtgagtttgacctctaatttcattgtcattttaaactacatgtgtccagaataacgctgcatcttaaataggaatgtctgtggggaagttttatgccatataaacaacagacataaccttgttgagataacaatagcatttccacgaatatttgagattgtttgtttatttatttgctagaatgtctgtcctaatcatagtgcctaaaattagggacagatttatttctctttgttctctagtattttgtagtttgtgacataacaaatcaattttcaattaactaatttgcatgcttgctggtccaaagcaaagtgagcctaagtcttcaaggcctgttgagtacatgaaagatagttgggaagatacagtttaaaacaaacaacaatatgctaattggaaccaaggaattaaacctaacccttaccctaacactatcccttagcaacagtcatacaacttgcattctgtagtgtacttcttatgtttctttttgtgtactctaaagtacttctaaaataataagtgtaatacttggatttctcaacattttttttaatctagaaaagggacaaatgagacattgggtaatctcacattggttagcttcaccagatctcttttagagacctcaaaacatgatttgttaatttaacgtattaatcttatgtatgaacatacattttatataaagaattcaataacatttgttgcatcccttctttaccaaacatgtcctaatctatcttgcattataaatgttattcattataagtgttattccattgtcctgtcttaattaataatgatgataatagtaacaaacccagaaacattccttgagagtattttgttaataacattttctgtctttctcatttttctctctttcactgagcagttatgttcagttaactggacttttttgcttcttgttaacatgggtgatttttttttattcatgttcagattcttctatttgtgtacacaagtagtttccattcctttttatctccttagactccaccccccctcccccattttttccactataaagcagttgtgctgtctggtgtcaaaacaatttctcccagagatagctagcagctagtcctattgagtcaattcttcaacataggttccttctttccaggagactctacattgtaacaaattgacaataacaactacctatttttgtagttgggggcgggataatagggaaataattgccaaaggatttcaatactttgtgtagctatggggcataagttaacagagatctattttataaagtagtaactataattaataatatattgtattgacaatgtgaagatttaataaaaagtattctctgcataacattatttgaaatagtacataatgatgaactagacttagtcatctacaatgacttcttttttagaacattatgttgtatacaggaaatacagttgaaaaatttacttataaatggaaagtgaacataagtgaatatattcagtgagtacatatctttatagtgagtatgttataaactttctcccatttttttatcagataaatcctgaccattgttcaattgccaacatttcttatcagtttactaccttgttttactatcttaagcactgataacagcaaaacagttatactgatatacgtatgaataccatttacaaatgagcatatattactttaaaataatagtataatcttaacagcaacagcctttattagaaacatggtgtattagagtaaagagtttgaggtggagcatttcttaccttatctttagctgccattatagaacctcaccaaagccaacagtcttataatagaaagctggtaagtatcatcattagagttgatggtggaaaaagaactgaacttttagatatgaaatttcttgggcacaagtcccttccgctcgactcaagacccgggctaccttgccagcagagtcttgcccaacacccgcaagggcccacacgggactccccacgggatcctaagacctctggtgagtggaacacagcgcctgccccaatccaatcacgtggaacctgagactgcggtacatagggaagcaggctaccagggcttgatctggggcacaaaccccttccactccactcgagccccgggctaccttgccagcagagtcgcctgacacccgcaagggcccacacaggattccacacgagaccctaagacctctagtgagtggaacacaacttctgccaggagtctggttcgaacaccagatatctgggtacctgccctgcaagaagagagcttgcctgcagagaatactctgcccactgaaactaaggagagtgctaccctccaggtctgcttatagaggctaacagagtcacctgaagaacaaactcttaacagtgacaactaaaacagctagcttcagagattaccagatggcgaaaggcaaacgtaagaatcctactaacagaaatcaagaccactcaccatcatcagaacgcagcactcccaccccacctagtcctgggcaccccaacacaaccgaaaatctagacccagatttaaaaacatttctcatgatgatgatagaggacatcaagaaggacttacataagtcacttaaagaattacaggagagcactgctaaagagttacaggcccttacagaaaagcaggaaaacacagccaaacaggtagaaatcattaaagaaaaacaggaaaacacatccaaacaggtgatggaaatgaacaaaaccatattagaactaaaaggggaagtagacacaataaagaaaacccaaagcgaggcaacgctggagatagaaaccctaggaaagagatctggaaccatagatgcgagcatcagcaacagaatacaagaaatggaagagagaatctcaggtgcaaaagattccatagagaacatcgacacaacagtcaaagaaaatacaaaatgcaaaaggatcctaactcaaaacatccaggtaatgcaggacacaatgagaagaccaaacctacggataataggaattgatgagaatgaagattttcaacttaaagggccagctaatatcttcaacaaaataatagaagaaaacttcccaaacataaaaaaagagatgcccatgatcatacaagaagcctacagaactccaaatagactggaccagaaaagaaattcctcccgacacataataatcagaacaacaaatgcactaaataaagatagaatattaaaagcagtaagggagaaaggtcaagtaacatataaaggaaggcctatcagaattacaccagacttttcaccagagactatgaaagccagaagagcctggacagatgttatacagacactaagagaacacaaatgccagcccaggctactatacctggccaaactctcaattaccatagatggagaaaccaaagtattccacgacaaaaacaaattcacacaatatctttccacgaatccagcccttcaaaggataataacagaaaagaagcaatacaaggacggaaatcacgccctagaacaaccaagaaagtaatcattcaacaaaccaaaaagaagacagccacaagaacagaatgccaactctaacaacaaaaataaaaggaagcaacaattacttttctttaatatctcttaatatcaatggactcaattccccaataaaaagacatagactaacaaactggctacacaaacaggacccaacattctgctgcttacaggaaacccatctcagggaaaaagacagacactacttcagagtgaaaggctggaaaacaattttccaagcaaatggactgaagaaacaagctggagtagccattttaatatcggataaaatcgacttccaacccaaagttatcaaaaaagacaaggagggacacttcatactcatcaaaggtaaaatcctccaagaggaactctcaattctgaatatctacgcaccaaatgcaagggcagccacattcattagagacactttagtaaagctcaaagcatacattgcacctcacacaataatagtgggagacttcaacacaccactttcttcaaaggacagatcgtggaaacagaaactaaacagggacacagtgaaactaacagaagttatgaaacaaatgaacctgacagatatctacagaacattttatcctaaaacaaaaggatatacattcttctcagcacctcacgggaccttctccaaaattgaccatataattggtcacaaaacaggcctcaacagatacaaaaatattgaaattgtcccatgtatcctatcagaccaccatggcctaagactgatcttcaataacaacataaataatggaaagccaacattcacgtggaaactgaataacactcttctcaatgataccttggtcaaggaaggaataaagaaagaaattaaagactttttagagtttaatgaaaatgaagccacaacgtacccaaacctatgggacacaatgaaagcatttctaagagggaaactcatagctctgagtgcctccaagaagaaacgggagacagcacatactagcagcttgacaacacatctaaaagccctagaaaaaaaggaagcaaattcacccaagaggagtagacggcaggaaataatcaaactcaggggtgaaatcaaccaagtggaaacaagaagaactattcaaagaattaaccaaacgaggagttggttctttgagaaaatcaacaagatagataaacccttagctagactcactaaagggcacagggacaaaatcctaattaacaaaatcagaaatgaaaagggagacataacaacagatcctgaagaaatccaaaacaccatcagatccttctacaaaaggttatactcaacaaaactggaaaacctgaacgaaatggacaaattactggacagatagcaggtaccaaagttaaaacaggatcaggttaatgaaccaaacagtcctaatcccctaaagaaatagaagcagttattaatagtctcccagccaaaaaaagcccaggaccagatgggtttagtgcagagttctatcagaccttcaaagaagatctaattccagttctgcacaaactatttcacaaaatagaagtagaaggtactctacccaactcattttatgaagccactattactctgatacctaaaccacagaaagacccaacaaagatagagaacttcagaccaatttctcttatgaatatcgatgcaaaaatcctcaataaaattctcgctaaccgaatccaagaacacataaaagcaatcatccatcctgaccaagtaggttttattccagggatgcagggatggtttaatatacgaaaatccatcaatgtaatccattatataaacaaactcaaagacaaaaaccacacgatcatctcgttagatgcagaaaaagcatttgacaagatccaacacccattcatgataaaagttctggaaagatcaggaattcaaggcccatacctaaacatgataaaagcaatctacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattctaccagagaactcctaaacctgataaacagcttcggtgaagtagctggatataaaataaactcaaacaagtcaatggcctttctctatacaaagaataaacaggctgagaaagaaattagggaaacaacacccttctcaatagtcacaaataatataaaatatcttggcgtgactctaactaaggaagtgaaagatctgtatgataaaaacttcaaatctctgaagaaagaaattaaggaagatctcagaagatggaaagatctcccatgctcatggattggcaggatcaacattgtaaaaatggctatcttgccaaaagcaatctacagattcaatgcaatccccatcaaaattccaactcaattcttcaacgaattggaaggagcaatttgcaaatttgtctggaataacaaaaaacctaggatagcaaaaagtcttctcaaggataaaagaacttctggcggaatcaccatgccagacctaaagctttactacagagcaattgtgataaaaactgcatggtactggtatagagacagacaagtagaccaatggaatagaattgaagacccagaaatgaacccacacacctatggtcacttgatctttgacaagggagctaaaaccatccagtggaagaaagacagcattttcaacaattggtgctggcacaactggttgttatcgtgtagaagaatgcgaatcgatccatacttatctccttgtacaaaggtcaaatctaagtggatcaaggaacttcacataaaaccagagacactgaaacttatagaggagaaagtggggaaaagtgtgccttgaagatatgggcacaggggaaaaattcctgaacagaacagcaatggcttgtgctgtaagatcgagaactgacaaatgggacctaatgaaactccaaagtttctgcaaggcaaaagacaccgtcaataagacaaaaagaccaccaacagattgggaaaggatctttacctatcctaaatcagataggggactaatatccaacatatataaagaactcaagaaggtggacttcagaaaatcaaataaccccattaaaaaatggggctcagaactgaacaaagaattctcacctgaggaataccgaatggcagagaagcacctgaaaaaatgttcaacatccttaatcatcagggaaatgcaaatcaaaacaaccctgagattctacctcacatcagtcagaatggctaagatcaaaaattcaggtgacagcagatgctggcgtggatgtggagaaagaggaacactcctccattgttggtgggagtgcaggcttgtacaaccactctggaaatcagtctggcggttcctcagaaaactggacatagtactaccaaaggatccagcagtacctctcctgggcatatatccagaagatgccccaactggtaagaaggacacatgctccactatgttcatagcagccttatttataatagccagaagctggaaagaacctagatgcccctcaacagaggaatggatacagaaaatgtggtacatctacacaatggagtactactcagctattaaaaagaatgaatttatgaaattcctagccaaatggatggacctggagggcatcatcctgagtgaggtaacacattcacaaagaaactcacacaatatgtgctcactgataagtggatattagccccaaacctaggatacccaagatataagatataatttgctaaacacatgaaactcaagaagaatgaagactgaagtgtggacactatgcccctccttagatttgggaacaaaacacccatggaaggagttacagagacaaagtttggagctgagatgaaaggatggaccatgtagagactgccatatccagggatccaccccataatcagcatccaaacgctgacaccattgcatacactagcaagattttattgaaaggacccagatgtagctgtctcttgtgagactatgccggggcctagcaaacacagaagtggatgctcacagtcagctaatggatggatcacagggctcccaatggaggagctagagaaagtagacaaggagctaaagggatctgcaaccctataggtggaacaacattatgaactaaccagtaccccggagctcttgactctagctgcatatgtatcaaaagatggcctagtcggccatcactggaaagagaggcccattggacttgcaaactttatatgccccagtacaggggaacaccagggccaaaaacgggcagtgggtgggcaggggagtgggggtgggtggatatgggggacttttggtatagcattggaaatgtaaatgagctaaatacctaataaaaaatgaaaaaaaaaatttctttgttttcttcactccttgtaggtaccctccttataaataatgtaaaacattttcttgtgctatttgatgactcataagatgctcttagagtctcttgatgttacctatattctgctgtttctgttaaccagtatttgcagttcttagaattaccatacaactctgtatcctgtttagactaatggtgtgtttggattttaggatgaaatactccaagtgtaaaatgattttctaccattgtatcaaatagcacctttcacacacttcctttgcaataggtgcttaacagcaaatggattacattataatttccaatacaatggattattaaacagttttgagaaatagcatgttttcataaaacttacagtgaaaagcaacaacagaaatttctgatcaaatttattctgtctcattatgataatcgatattcttcctgcttgtggatcaaccataccaacagcatttcttactatagaagccattagaagtctaagtttaaaattacaagagaaaaagatgttttataagcattagctattttattattaatcatttactaatgaacccccaatataacagttgatttattttgaaatgaatgaaaactcctaagtgggagggaagttaattaaaagaactaggtggtgcggtagtgcataccctttgtagtaggaggccatgctaggtagatctctgtgaatatgaggccagcctgggctatataggaagttaaaggccagccagcaggactacatcctgtataaaaacagtggctcacctttactttagattatgagtgttttcttgactttcacatttactttgttcatcaataaatcccttcttatattataaacatttggatatttgacatagcaagcatagactttctaaatattagttccactgacattgctgaccgatttaaaggtctcacatatgaaattcttaggtgattattttatagaacacatactctttacaaaacactattttaaaactatatagatatgctttgcatctttggcataatttaataatgccttagttatatataataagtgcttagttattgattttgtattccacctgttagaattcccacaggtcattctaaagcttttactcttgttcttccccccccttttcttcattaatttacacagaagagtggcctctgggcaccaggtgctctactgtaacctaagtatattgtattcccttgactgctattaaaggacttttttctcactcagcaccaggtttttagacgttggttagcttggctgagaacctttgagtgctctaagcataagtaagtttaattaagttaccatgaaatacattattcgtaaactaggccttcacatctataaaaagccaaggagtagttgtcagaaatgattagattctaagaaattgtttaggaagtccaattcctactgcttacatttaaattttctacatcctcaacccatattttagaccatgctcaataccaggatttttttttttttgcagataatacattttattttcctgtgaagactcatacagaaaacatgtaaaggagtatcaacatgtactcacgaaacagatgaaaaattagcctgggtctggatgcattagaaaaattgccattattttatcataaaagtcttacaggggagcagcaaggaagataggcatggaagtaggagaaattaaagagctaggtttgcaaattcacttccctgggagacaggttcatagcctgcttgcttctgttttaggtctgcatgtagaaatgtcttgaaaatagtgcttttattttaaaaggctttgttgcatttattgtgagtacagcttagctattattaattgatctgtgctgtgtgctagatagtgtgctatgggctacaggtttagaggtaaatgtagcaccttgcctcaaagagaagagagttcagccagggagaccactagaggtaagcaaagctatcctatttctaggattgctgtggatcagctgctttagtggggatgtaattccctgaacctctcatgggtgctcatgaaagaagcagatgaagatgtaatatgtgaaaagccagtgtctacttttgaattattggcctcgtttttttttttttttctggcagtccatactcataatttgagtaattcagcaaagtctagggcggggggggggggcagtcagagagagagagagacagagagacagagacagacagatacagcaacaatgggacagaaacagagagacaaacacaggcagacacagagacacaggcagtcagagagagagagagagagagacagagagagagagacagagagagggggaagaagggtgggacgaatacttaaaagaaaatcccaaccatcaagaagttatattctgagagggtgacatatagaaacataaggtggcattatgaaaagaacaaatagcaaaaagaagtttcgagtcatgctttgatagctatctccagtatgctagctagtttgttcttccagaaaacataaacatatcaaaggtactattccccacggaaggacttcactttgtatggcttgcaagctaaaaatgttgctttatgttgtattttctattttttattattgatatatgtgtgtgtgtgtttatgtgtgtgtgtgtgtgtgagatgtgtatgaatgcagataggaatgcatacatgtagcagtgtgtatgtagcgatcaggtgacaatacacaagagttggttttctctgtccatctactatgggttctttggggtccatggcagtttgccaggttttgtgggacaagtgcatttccctgggaagccacctcactggtcacatgttttattatttaaatggttaaagagaagattaattatgtgaattccattgtctacaaatgatattttattgaatgtagctatgtctatttattattattatttattttttctttaggctgcttatctgtaagttcatattatatttgatatttgacttgatatatcatagccaaaacgaagagctgacaaagaagctgaaacccacggctggagagatggctcagtggttaaggtcacagggtactactcttctgggggatctggcttcagtttctagtacctacatgatggtttataaccatctgtaacacttgactcaggggaactggcatcctgttctgatgtctgaaggcaacaggcataggggtggtacacatatatatactctggcaaaacactcacatgcataaaatacagtaaaaacaaagaaacaaagaaacaaacaaaaaacccaaaacataaagcaaggttcaccaggagaagtaaattctcttcccttttgatgatagccagttgtccaagtactatggcgtattacattttgatgtttttacattagtggtttaaaaaagcactttaaggagggagtctttaatcaatgctattagagacatggactcttttcatcttctcttctatatcattgatatatagctcctcatcctcatggatgtctacttcagacaatatctagcactcagaagaaaaaaaattaacaggagttcaagcagaacactgatatgaaagttgagtcagccaatatgtgtcattccacatggggttttttgaaacaaaattacattctaataagatacctttttttccttaattaaaagggaaatgtctaaaccatgctgaattttagctgttttaaagttctttatttttcaataaccagacgtgtttgtagggagaaatacattctttcttcttaaaatgtatttgcaactattcatacaagtattgattatatgtttacaattctttcccacccctaactttccctatctacattagtccttttgttcccaaagattagggagaaaatattttcatatttggttcctaccccatttgaaaattgtgtaactacattaatgtttttgcttttcatatatttttgagatagtctcactctatagcccagattaattgggaactcatcatgtacctgagggtggccttgaacttgtgattctccttctgcagcttctagagtgcaaggtttataggtgtgagatatcgcctaaggtgtgaaccttggtttaaaatacttcctgcaatgctgtttgagtttctcacatgtaaatttgttcaggaatctttcctatttgtggtattttcagaaagcatcttattaactacagcttttattgtggcgatatgtttctcctgttaaattgttctattagtgactcaaagaaaaatggcttatatatattatatctgtattgaaacaatcttaataatactataagccatttcattaaacagctattccatccatctatatagtgatcctcccacagttcagtcattttcctaacacttgcttatgcacatttttcacaatggtttctgtgtgtcttctgatagggtttgctgacaaggaaggcattttctttatttacatttttgcatgtattccttcagctgcttttataaagtgtttcctagctgctgtggggctttttattaaaagtggtattaaaggaaaaccaaaagaggctcataaacatgtgtcattaagtttataaactatcaccaaggtacaggattgagaccatgtgattgtgattattgttgagaatgttgaagacattacaatggcttcctgctctggctcctaggatttatatggcctgctaatttgaggtggatatttactaccattgtctaattttctaaagtataatatgcacataaagtgagggtcatcatcatgattcatttgtaactatatttcacgtgatttctttaattattttcatcttatggagacagcgtattagatttagatttttgttattattactatgtgataatggaagaaagagccagaaattatgaacagatataacaggcatctattttctcgttctcttgtgctcacattattgaaattatctttttatcctcaatctgttgtctttataggaatcgtttggagttgtgtttccattttttagggtatatttggttaaaactagataaataatcagaaaatatactaacattaactgtagcgtgttgcaggacacttaaggtgagtaaatattcattgtgaacattgcactactcccttaagcaacttcatgcatcattcaatctatgggtccaaggaggaatctagtgcatattcttggttacgtattagtaaatcttatttttttaatcctttgaatgattccaatttgtcaacctcagtgggacttttatatagtctttgcactctagaaacatcagttgaagattgtgctcacaattaacaattatgagacagcgaaagtactagttacattttcttatattaaaatacacggggctggtgagatggctcagtgggtaagagcacccgactgctcttccgaaggtccagagttcaaatcccagcaaccacatggtggctcacaaccatctgtaacgagatctgattccctcttctggagtgtctgaagacagctacaatgtacttacatataataaataaataaatctttaaaaaaaaaaaaatacacgatcttgggtgaaggcctctgattggatcttgatacaaagatataatgaggaaattgtgtgcccaatttactaatactcacttaatattttgcctttgcttttagtttcattctatattcagaaatattatctttccactttatcgttctgactttgtttttctatctgagctcctatatgttatattgaatgttttgtttaatttgttgaaagaagctaaaattatggaatagacaataaagttctgggtataattaaataagcataaaaattcactaattttaaaaacataaagcaccaaaaataattatatccattgttggttttggtgtattttaaacactacagtcctattaattcatttttcttaaaggtgaatatctccttagcctaggattttggaggtagaggaaggcaagggcaccagaatgaatgacagagtcaatgaaataaccttctcatctgagtctagttttacatagttcctcattaacaactttactggcatactgtttgaggttatatatataaatcagtgttatagcatgtatcgaatgtgtatgaggctctgggttcaagcagacacacacacacacacacacacacacacacacacacacacacaaatcaaacatttcatgaaggaaaggaatgtttctggagagagataactgtatgaaatgtgaaaacaggaaagagatgatgtttataactatggcttaattgaaaactattgtaagtttggtcagttatttagacttcagcatcattttttttctactacattcttcatataatgtggatacattaaacaaatatgaaatatgcttaaaacttgttttgtattttttccatagtaagaactctgtgtttagaagtagtttcatattcaattatgttgcttagagttaatattgagttacgagtattgctctatttagttttattattgtattatgaagctgaagttaatgatttggaagtatcagctgtataattagtagtatgtttttatttctataggaataaaatgagtcattatagactcttctattcatatgaatgctactcattcctaactaatgaaagcagccattttataagtggaaaaaagctaaagattctgcggcaactttcagtatttaaagcaaagttcccaaattttgtttttctagtagcaagaaaggagactcaaaaaaatattcagtaagtatttactgtattccagggatggggatctttcttttttgcgattgcagagatcaattcctgcttttagttgtcttagagcagtgtttttgaacctctgagttgtgacccttatgggggttgtatatcagatatcctgcctatgagatatttacattatgattcataacaaaagcaaaattgcagttaagaagtacaatgaaataatcttatagttgggggtcaccacaatgtgaggaagtgtattaaacttttgtagcagtaggaaggttgtgaaccacttccttagagtttgagagagataggttttttttactatatattttctttatttagatttcaaatgttatcccctttccaaatttccccgctgaagaccccctatctcctcccctctccctctactccccagcccacacactccctcttcctagccctggcagtcccctatactggagcatagaaccttcacaggaccaagggccagatcagataggtctatgacaaagtattgatatacgtaatatggaagaacaggatggtttctgtttaatagtgggggcactgcgggaaaacttgtagcaggcttagtaggtgagcattgttttaaagtgtaaggaatggacagaagcggattgagtgggaggcagcacatcactgagtaagaagtggaagctggaacagcatcatgtaaaacatagtggggagtatgaaatgacatattacatgtaagagccaccacatcataaaatccaaggtcaagggagtagatgtatgctatttcaagatgaacgtgaagtctcagaatgattgagagtgggagagatagattctaagtgatgttacctgaacataaattgcagctggggtgtatattttggccagagagaattcagacttcaaaacatatatgcttggttcttaaggtaattttcttcaatccagctaccattctcttcactttgacagttgaaatgcttcagaatctcaccattttgagcataggaatacctgttctggatttttaaacatatattaagtattaagagatattagtttgctcttcaatcaagaaggttgctgcaataggctccagatggctttataggaattgcttgcagacctacatagtgaaatatagtccgattaaagagctgttgccactccagaaccaattggtctttctaagttaaaaaaaaaaaagtggctgctgccatcggttccttatcttatctatgtcatctctgttgtcccccatatcaacaagatggatggcatattcaagacatatttcttcacatagttcatttctgagtttgtaccttttattaatgcctttcattggtaaaggccaagccacaggtttgtactgaaattatatgtaaaggatataaacaaatgcagtttttataaactcaattttatgtgaaactgaaaatgtggatgcattaaactgtagagggcatgcctaagtgacattggacagccaaaaatgacagttgccaacaggaatcttttaactgctcttcggatgttagatttttctcctttttcatctctctctcttgctctctctctctgtacatatatacatacacatacacacacgcatacacacacacacacacacacacacacacacacacactcagctatattacctcttttttctttgtaatatatagcaactttctgagactttttctttggtgaatacacacacatatagacgtggatatgttatatatatcctattaaatttgtgtgttatttgttttcatgggtaacagtagtacttggaagcatgggctaaagagcgtgcgtgcgcgcgtgtgtgtatgtgtgtgtgtgtcgagataaacgctttgcaaggtctctataatatctgttataaactaccagtgttctgtagcctagcttaaaaaattttctttcttcttagtgtttagctaaatagaaatgtaagctatgagtatgtgtggaatacatactaaatgatggtatgtcaagtgtgaaataatgaactatctaaaaaatttgttgataaatattaattgcattaatcccttatgaagcaattaagcagtaatccatccatcctcacattctttctaacaggaagatatgaaccttaatgaagaaaagaaagctcctttgcgaaagaaggattttagcatcaagcgtgagatggttgtccagtatatttctgctacttccaaatctgtaagtaaagatacttcccaggcaccaatagaatgaacttagctgtttgcttgaaagtttaaaaaacctcagctttttacattcttgcctcagtgcaattatatttcatatatatataaaatctatctcagtactgaacaattcattagacatgagagatccattattgtaaacaagagaccaatatggaaatctcttaacagaattcaatgaatttgagggcagaggttttctgctcttattaaaagttggcagtgatgtgtgctgtccttctgtttactatacaccctgctacatgaaaatttcagagttgaagggagaaaatgcaaacagcatagctacttttaagtttacattgaagtatctaatttttggaatttttttcatatttggctttgttttgaatgtaaactgttagctgacttatatttggtgtggtaaagttcactttattgtaaaggaaaatatacaccaggaactttaattaaatctgtataaatttaaaacctaaatgcatgatttattattgaaagactttattgtctacaagaaaaacttagtgctttaatagagttaattcactcatttttgttatccttctaaggtttttgaaaagtagtcttcaggtttgattttttttttttggtagaaaaaaatacacttttgatgtggcaaaatatatattttgtatttctgaaaagaattttcaatggcagatttcatgaagtcactgtatgtatctgtatagatacatgttttatacatatttatgcacaatttacatgtagatatttgagtttattttcatttgtacacatgcatttaaaacaaagtattttcactataaaccattgaccactgaagaaaatgttctttactgtagaagtatagcctgagattatttgattatctcattcatactttttagcactgtaattccagtagcaaccgctgaattctgcaattgcactgattctatattgtactttaggccagctaaatctgaatgctgaactatttaaacataatgcatcgcagctctgccagagcagacttaacagcatgttttttaatttggttctggtatccaaaggcagaaatatgtttccagtgataagtgaaatttgccatgagcatccttttcaatagaattaggtgatgcatagggtttttactttgaaattctgatgaatctcttctcgtttttgcactcaagttattgttcccagcaaaaagctttaggaaatgtaggacacatattttcagtgttgttttttaaatgcctaacggcaagtatactggcaaatctatataactagatgtgaggacaaagtggagataatatatgtctaatcatgtggtgctttaatgatgggatttgttagcatctctggcttatttgttgatattgtttgggtaagtgggactgactataatgaagattataggatgttctcattccttgaccttcagataattacatattatctatgcacagcatattttaatttatgttcatactgtgttctcttcaagtgatgagagaaatgtacagttttaaatcttatgcttattttcatattgaaatggaagaaagttaggctgaggcagtagcatagcactgagtgcacctgcctaacccattagagctttgtctctaccactggagacagattaggagatagagagaaaggcggaggaagggaagaggatagctcagagcttattttaactgcttcattcaaatgggagaaatggagtattataagacataaaattttccatttcaagtagccacaaaattagttctactgtttcaatgcccttttttttggtctcatttgacatacttgttagctcttcttcctttacaaaaattccaagactgtagatttttccaatctttttttttgtttctatgagccaaatattttgatggaagacaactgactgacaggcatgttttgaagctttctcaccttggagaaacagtaattagtactgtgttctatcattaaaactatgaaaattgtttacttaatttccttttaaagataagagggctgccattcactgagcaacaatattcaatacgaagcaatgcttttaccttttcatcatgacagtcaattttgcaccaattatcactgaatgtgtggctgttggcccgtgtggagcttaggtttctgccctgctatctgacttacattaggtgttaaatatgctttgtctgccctatacatttttactttttcattatgtattgatatactcattaaaggtgtttcctcatttaatgcaaataggatggtacctgtcacattataaaaaggttttgtctttataaaaagccagtgttcccatctgaaaagtaaaaccagtgttaaagtggaaaaatgttccgtgccacatgtaagatataggaggattatagctaaattttagtgtaaagctatgttttcccctctaactaactgctcttgttcttttatatgggatttaaacaatgaaaaagtgagctgtgagaaagagtcatcttgctaggaaagggcattaagagatgatgatgcaacacacagctatgtgtcagaacctgtttctaaaacaagcaagtctgactttgcatcattaattatgttacaattagtgttggtcaggaggatattaaggaaaccacaagttgatgttgtaaaactattgtttgattctccacacatacttagtataatgtccaataatagacagctatatgagtattaaaggaatagcagattgagtaactccatgttgagtgaacttttaatatgtatgtggagagcctagtctgtgtttattgctctgaaaggcaaatgcttgtcattgtaggaggggtgagggtagacctgacctatgggagctggcatgcatagattatttagtttcaaataacaaagaagattttatagtttcaaggtgcaatgaagaaatgaacagcttttgtgagtattgttaaagctgtcctactaaattattacctagcacactatgctggtgatatagagaaaaacttgcatatacctattagcatatgcaggcactcatgagaaaaagttactcacctcacattaggcagccacatttcctcatccttatgataatatgcagaaagcagtttacttctaattttatgataattttaacgagtacttttgaaattgagattttagaacatgactgattacaattttcacaacatgtgaggcattgagcagtttcagaaaaatctcaatactatagaataaagtggttatatcgactatatctacaggtttgtagacttaataaatataggaagtagttgaaagttgtagtacacatgtcaatatatatgcatttatagtgactgttgttggtttttttttaaaccattattagataatttttcatcaggtccttttcatccatgggatggatgtggtaaaagatgtgaccaaattattttctccatgcttctcttgactaatgaatctcatgtatttctgtatgtgctttagctaaatgaaatctttttcaatccaaataaatcattaaaaggtcttcaatggtccacattttagttgtttcatggactatgaacctgtcttaattgttaacacagactctcattctttttttttggtcccatatctatgataaagaaacaagggacaaatataaccgctgtcttctttggtgggaggaaataatttatgtcaatagcgtatctttcatttcagaggactgttgtagtaccaaagaagacttttattcatctaaataattgctgcttataaacagggtgttaattttttttaaagaatttgcttctcttttttgaagagtctgaaatcatttggattgctaaatcatttctctttttggattcttatgaaatcatttacttggaagctgccattatatttttgtatcttgtgatatctcactaagccaggatacttaatgggctttcagttaaaattgatgtttgttttaaaacactagctgaaaaatttaacacatcttgatgataattactgttatcaaatgaatattattcaatggtggattagttgttttttgtacactgctcaatatttgatcagataactgatttgacttatctttagattttaacatagattatgtttatgttgagtttcctgttgtttccttaaacagaatactgcctcagaaattgtcttatctctcgaaattctgaaccgttttctttgtattatgtgcatttttatggataaagtatattgtttgtcttcacatcatatagaaaactaatttcatacttggaacagtagagtgattgtaatgcatgaaaagccaaatcataattgtttccccttagtctttagactatagattttgaaatgtggcacacattaatatttgtattttgttttagtctcaagatctcaaacattaaatgtgttagtataataagttagtcactaatttattaaacactttccttttgcaaaagcttctgattactaatattattgctactttttctcacaccaccacccttcttcgttgaccactgtatgcagatagttggaagtaaagttctggtaagtacaagacatgttgtgcagtgaacttttgttttggggatttgtgactgttgcatgtaatatttagggtttggtgtttcatttgctgtatattgctgtatattcttacaaattattaaggtaaatattgagatcaagtaattaaaatttagctatgttaagtggtttcttatagttttggagcatgtttaagaagtttgtttttctgtcgcccataccttgggaattatgttaggtatcttgggtagaattgtgtgtcacatgtctgtttctcaggatggggccagggtcctaaagcattggtcttctggttgtacaaatttttgttattatgtcttactttgatatatatatcacactgatgaaagaaactgaggcaatgacctggttttgttggatggtaggtaatgcctctgattttgggggagcttcagatatatgtatttaagttgaaatcattatcttaacttatactttaaggttctttttgttgctatgatttagagattttatacttagggtattacatttttaatacacccctgtagcaagccagacatcacctgcattgtaattcaaagctacttgtaattactttcactccttgagtatgtatcatttatttggagaatagaattagaaacatctttaaagtcacagagaaatgaagtatttagcatagagaatgtgtttaatatttgctttgcttttgaaagttctcttctttttttcttcctttccttcctctcagtggaagatgttgcacatgtttgcaagaacatgttacttccttgcacccaattggctcccaatttccctttataatctcacctgggcttccttaaaatacgatatgcatatatatatatatatatatatatatatacacacacacacatatacacacacacacacacacacacacacacacacacacacacatatatatatatatatatatgtgtgtgtgtgtgtgtgtgatgacacatgtgtacaggtcagaggacatcttgcacaagttacttttctctttccatcatgaggttttaacttaggttgttgggactcctggaggccagcacctttacccaccaagccatctctctgaccttattcttcctttaagaaggcatcttcaggtgtgttcctgtctttatctgtacacttggcagtgcctaaagaaactttcctttaatccttctaaatcaagcatattatacattttaattagagtattcttttcttctttggtagcctagcaagtacctaagtatcaatcttggttaaccttcatgttgctggtgaacttgtcccagataagtgcttctatcccatagcatcctttctttaacattttagaagaaatcttttacatgcctccttttgccaatcaatatagcttctgctctcaagaaactaggtctaaaggggatgaagacagatgacaacagagaggtatatagaacagagagaggaccaaaagaggctatattgtcagcgttgcaaagtgagagaccagcaactgtgtgtggtttctacagtgttttgaatggtaatgttttttcataagtgctaagtctagatccagagtacatcttgtttcatggtcattttctgatctttcatctgtttctcacatttgagctgtcagcttctgctacaaagaagagtaaacttaaggaatcccttctacaggaaataaggaaggtttaatttagaggtaggtgggatgctttatggaattttttttgtttatattctattttgcagcttaagagagagatgaacaaacaatgtataaaatcaccccagttatacaacagctacagaagggcttattgtgtcatgggcacattaatcttcaaatggtgggaggaatatttttacggataaaataagcaggtagaaatttcgtagaggtgctgtagacagtcgaattttcaaataactaatttatgtattgtggttacttagagattgtagcattagttaaaaaaatgagggctggaagagccagtgaaattggaaacatggaatatataatgaagtaggtctgcctggccttttcccttttgtttctgtaacgctgattgcaagctgaaataatagcatttgagattctgctgctgatttctttttttttccccccacgatcagtactgcttttcaattttcatatttacaagctttactttacaaagcaaatctgaaagctgcctgttattgggcatagctacaacttcatccccaggttatatggattctggctttgtgacttttctgctggtatttactgcacagcttttgtgtaaagcctttcttaattctgataccctaaaccaccttctattttcaccttactaggattcctgtagctctttctcttacatatgtatttctttcctatttggtaatttctgtgaccaaattcctaagagctttttaaaaaatgtcattccaagtttacattatagtaatttcaacacttgaacagtaacctctatcattgtttggttctatctttctgtgtccacaggacagatctataatttctagaagtcacataagcaaatgggtttagtttgagactacataggacctgtgtgatctttatttatagatcatatatgaagctcagatttcccattgtgagatgaaaataccaagttcaggatagttttagtggactatttatatttgatatttttaaaatacaaataaacatttcatttatatgtctcatttattttttcattcaatatagtatcttttaaacatgatttgaaaaacataaagcataatgactacagtgtaaactgaaattaagaccataattttttttctttttgttcagtatacaaaatgtagattcaaagatagaactacaattatttctgggtcacaattcctgagaaagattttgctgaacgttagaagaattctttgcttctgttttggaagctgtgtgctacttgttttggattattgctgggctttgaacaaaaagtaaaacaacaacagaaacctccaatgtgtcaagttaacattgacacatttattttaaagagacattaaaatagttaaggattttgtatagattctttctatgaagtgaaaaatgacaaaatgtcttctattacctatctgaaagtatcaaaggatttagagtcaggcagagggagaactgaatgatggctgtgtgtgtgtgtgtgtgtgtgtgtgtgtgtgtgtttgtgtctgtgtaggttctcaataattgtgtgtgtgtgtgtgtgtaggttctaaataagtgtggtagaacattgtgaaccaaaatagtttttattgtttagtaacacattgcataaaacagatttagaaacagttaaaatgattgatttgatttcattgcaagccaggaatagcttatccacaaatataaaagttagctttctcatatagggaataggaacaattgacgtgattatacacgatacattaaaaaatagaaatgtaatgactagaccttacaaggttaaacataaggcaattaaatataataaacaattcagtgcctagggtagcaacagaaacattagaagtgtttgttttacctatgaaaagactagaattcaaatggctctcttagggccaaacatggttttacaggcccagaatatggaaggcagaggcaagcaaatctctttgagttcatggccagctagaattatgtaatgaggccctttagcagaaaaaagtgtaaatttgtgcattcattcgttgtaactgggtagttagagacatggtcctatgcaggtagccaaggctgtgcttgcactccctatctttctgcaatgaccacaagcgctgctattaaaagcataccccatcacacctaactgctttttttttttaatgcaaaatttctaggtatctgttatgtcccaggtgctatgcttggtttttttcaccagagcctctgtccataatgcatgacttcgcatagtaatctagatacatattcagtgataatgaaataaaatagatgaaagttgaaaaacgagtttttccctttttaggctaaaattggggggagagaactaatctcattctgattctgtcttcccttttcaaatatcagtgttctaacttaaaaaagaagggaaggaaacaaaagccttgaagtattcatatagagctttgccttcaggctccatttaaggaactggcaggtcattctttctggtgagtcaactgtttccaacctttcttggcagggcctgtagaaaaccagtgctcagaaccaccatttaaatgtacagatcttaatttccagacctccttgtagtgctaggatgataaactatacaggtagtcctcatggagctaacattttagttggggaaacagacagtaagacacatatcaaatattatgacaggtcttggcaagtgctatggaggaaaacagtttaaaaaaaaaaagagcaagatgagaaagcagactaatccgcagtgtgctgttttaaacaggcaagctctgtgagcaagggatgtttggacagagaactcagggaaaatggagagagccgtgtaggtgtctgggaatgagctttgcagccacagacactgtcaagtgcaaaggccttgaggcagcaatctgtatggagtgttggaagaatagcatggaggacactgtgggtagcatgagatgaacaaaggacagaaagggccatttaataaccaatgccaatagctagttacagtgacagaaatatatattaagcatagttagcagttccaaggcttggaaaggtatgctgtggtcattttaggagagctgaatgaaggacatgccagttgaatagttactgggggaccctgaatatttttcaggcttagaataccagaatcagaggtttctcctgtggagtgctcatatagcattagattttggagagattagactaaggaagagagatcaagggaggtggtttctacagtggtctcaaatgaatttgaactggggtgtgtggttattaggaactaaatggaagatatagatgagagaacaaggaagaccggatgtgtactgtatcagccccagtaaaggaataaaaagggcaaaagagatgtgtacttaaataatgacagaaatttcaagcatggctggctaaaatgaccctagcattcatataaaagtcaagagccagaccaagtttggagtccgagatgatgagttcagttagacacgtaaatcaaggagaaatgactaagatcacaaaagcagaagtaaagtctgaccatgcgaggacacttctttagttttatagcattcacagtttgatttttagaatgtagttcactgttgcagattactgcttttactatttaaaatatcctctctgtacctcgctgatgagaagagctcacatgtcatttgaatatctttaactagcttataagctgaagcccagacatctttactaagtcagcaggctttgtgtatatctcaatgactgagtgggttggcatcgagaacagtaattcatattgcatagtctggagtgttgtttttcagataggcaatcttaaatgtttaaacagtcccattttttaacctttgtaaatgatcacagtctatagaacagactcatcatagtgaaggctcaatagaggtgttacttttatccctaatcaggatgtgagaaccacctttactaattgagtggtccacagggtttttattccaaagtagagcccagtgggtttctaggatcaggatgataaagaaagtaatgccaaggagacaaaagtaaccataggaacttgaggccaagcctgcatcacacggtgaaaccctgtcaagagaatgagatggccagtttcaaaatgagcccaaatgttcttgctgtgcacctgaatgtaaaccatctattactagtagtatccagaaaattacactaagcatggcagtatgtttttatgtcttgttattctatcattaaattgcattttattagtttattaacagtatagtaactcaatgattacttcatgctaatattatactcatgtcaaaccaattatttgaatatatcctgtaatgaaagattaaatcttagttttccatttttccactttctataattaggtaggccagaagggggagacaaaacattgaatattggagcttgaaatagtcacttcatgatgataaaacattgctttctcgtaccccaagttgattgtggttttctaacgagtagacattttagaatatttgctactgtaaaagatttagttttgatggtggaaacaatcttattaaaaaaatctaaattcaatcagaataaaaataatcaatgccattatttttaactataaagtagaaaaactcatttgttaataagatgaaaagaagacccgggtctattgaatggtggcatatattaagaggtcttttaaagaactgcacaaacactattaaaatactcattttactcttccctaattttacattcattagggaaacaaccagctactttctcattttctaatgttttaacagtatgcaagctggcttgtgcattaggcttgttttagataaggatgtagagggtctgggaacctggctcagtggcaaagcatttggctagcatttggttataaaaacaaaacaacaaaacctaaatatcaagccaaggatctcatcatttattttgaaagatcttatttaaatctatattccattttagaatagcttctaacctattcctatcatggagaagcggctgcattctaggcaatgcaggacctctctgcacctgctgttctgggggcccagagcaggaggaacccttgcgttttgggagttgccatattgcaaattggcaacattcatgcaggtaaacacatgacactgtgtaactttaatgggagggaaagagtgaaaaaatactgctgcattagggttccaaaatatacactagaaacaattccatttctaactttggcctataatattttgaagccagtttttctatgcttaaagagataaaccattgttcctttgagttttatatcatccatgttcacctttcctatgcactcttgccttttataattaattccaattaaacattagctttgtttaattaataatatttaattaaaatgcttataagctctcagagggcaaggaccatgtcttagtataccttagacattttcaaataccctaggctgtaacagcgttaaataattaggatccctctgttgaatcactacattcttataacttcactgaagttgaactgcatatgaactgaaattggaagtctgctagttattttataatgcttctcaaaaacagtccttattcttctgagatgcagtccaacatcataaaatcttttttttcttagaataaaaataaaagttttaagtatgtttcttctttattacttttctacattgacaacactttctcattatcaccgatgagcacttttagagcacttgaaggtttcgtggttgttcaggtttttctatttcaagttttcctgctagagctgtcatttttcactggttctcttccttccttccttccttccttccttccttccttccttccttccttccttccttccttccttcctctctctttcttctcttttcttttattggtagaggcacagtctatatattggggcctcagaattgttacgaattcctttataacccaccctgtctcaatgtatttttctcattttactcagagtgtaggtgtgtctatgcaaataccctccttcctcagattagataggggtgaagaatactgagaagggtccaccctccacctcaccttttcctcattatctaacattctcccaaaatagctgttcatcacatcagttagaagcaacctgattgttccctttgaagtttgctctgattgtgtttgctcacagcatgttgtatacagtgaatcatacttacaggaaacctagtatacaatatgaatgcctaatgcagaaattataacagttgaacaaaaggatgcctaattttttaatttctgttacagcctagagtatataaatatgtcaaatgtagactatgacctggcccctgtcttttgagagcttatatgacatttatttaaacattactaattaaagttaatgtttaactgaaaaaattataggccttggacttgaagacctactgtttggatcagggatctactttttatgcatgagtgacttgggataaaaggctaacctttctttagcccatatctctataagtaattttttatattgatagagttatgaaacatttgtaaactgtcaaacaagctatgcatttaagccattacagtaataaccagttaaggagataattcctatggtagttcctaatacatatttcaaaggaaatgtgttgagccacaagtatggctgataatgcatttatacattcatttcattacttaatgtcttctttagaagccaattatgcttttatcctctgcaaaatcacacatttttgacattgctccttggctaaagattgtatttactgtcagtactttatgaaaaggcataagcaactgtgggtgttatccttaattttgtatccaaatatgaaaagatccatatttaagctgttcatccatggcatcatttgtttgctgactttgaactcttttgcttatacatactttataaattaggggtttgataactttctaaaactcaatcatagaaactgagcagtgagaaagattctaacagagtaatttcagattgttggtagtacttaagaactttttcattgtttaagaagaaacataagtataaatagatctacattaccctccccccgtctctctctctctctctctctctctctctctctctctttctttctttctttctttctttctttctttctttctttctttctttctttctttcttggtaaggtcaatgtaattgtgatgagaagaaggggaccaggaggagagggaaagagagctgaggaaatgaataaaataaaaatgaaatatactgacatatatgtaatgaaactcactacctttttgtactaacataaaagattgacttaaaaagaccagtggagtactgactagttttttgtttgtttgtcaacatagacataccttggaagaggaaatagtagtgtagaatagtagaatgccctcatcagaatgacctccaggcaagtctatagggcattttcttgattaatccttgatgtccaagggttccatccatggtgagcagtgctgtccttggtttggtggctctgggttctataagaaagtaggctgacaccaaacccagacaccattacatatgtcagcaagattttgctgaagggaccctgatatagatgtcttgtatgaggctatgccagtgcctggcaaatacagaagtggatgctcatagtcataggatggaacacagggcccccaatggaggagctagagaaagcacccaaggagctgaaggggtctgcaaccctataggtggagcaacaatatgaacgaaccagtacccccagagctcatgtctctagatgcatatgtagtagaagatggcctagttggccatcatcgggaagagaggcccctaggtcttgcaaactttatatgcctcaatagaggggaacgcaagggccaagaagtgggagtgggtgggtagaggatcagggttggggagggtacagggaactttcgggatagcatttgaaatgtaaataaagaaagtatctaataaaataaaattttaaaaaaaggaaaaagaaagtaggctgggcaagccatagggaagaagccactaagcaaaactcttccatggtctctgcatcagttattgcctccaggttcctgctctgaatgagcgtgtgcttcaataaaggactctaacctttaagagaagataatcttcttcccgaggttacttttggtgctggtgtttatcacaataacacaaagcaagcaggaataggaattaaaaataacccataatcctatataccttgcataaaggtttatatgtttatatgtttatgtgcagttgtttctttgctgcatattatgttattaaaattgcttacactaatttttgttgatgcacttttctttcagaaatgcataattgattataataccataaactgatgaagataatttggtaaattaaatatttgatagcaaagtcatattttaataaacccaggtacccttagttcccttaattacagttcctaaaaactcaacatcagaagcagttttcaccttgtgtggttgtggtaggattttatctttacaaaacttgagtatgtgaataactgtggttctttttttttttttttaatgtatctacttatgtagtttgagaaacctgatggaaaattatccatgctctctagcccattgttggattaaaataatatacattgctatcaagatgtgaagtgatacttagtgtttacttttgcaaaataactgtttatagtgttttttttcacacttacgaggcaagagtaacttagaggcatatctaaaggtatgtgattgataagtaggaccataaatgcagcaaagagttccaccaaatttggtaaaccctgcttttcattctttgtggggagggtactgttgagttactatttcaaaggaagcaaggtttccatttggaaaaattacttgtattaaacatttgactaggctgaaatagcttctaaaacagtttaatgtttttgtttttaaagtagtccaactataagatgtcatatcagattgtatgtgactacacaagtgaataatttttttgattcttaattttattttatttttattatttttattttttattatgtattttcctcaattacatttccaatgctatcccaaaagtcccccacaccctccccccacttccctacccacccattcccatttttctggccctggcgttcccctgtactggggcatataaagtttgcgtgtccaatgggcctctttccagtgatggccgactaggccatcttttgatacatacgcagctagaatcaagagctccagggaggagctagagaaagtacccaaggagctaaagggacctgcaaccctataggtggaacaccattatgaactaacaagtgaataattttcattttatttttgagttatcacatttcaggatattgattaaaatcacctaaatatttgttatatttcagcctttcatgcttaagcatgtgtcttagtcaggatttctattcctggacaaaacatcatgaccaagaagcagttggggaggaaaggatttattcggcttacacttccacattgatgttcatcatcaagaaagtcaggactggaactcaagcaggtcagaaagcaggagctgatgcagaagccatggagggatgttccttactggcttgcttcccctggcttgctcagcctgctctcttatagaaccaagactaccagcccagagatggtcccacccacaaggggcctctcccccttgatcactaattgagaaaatgccttacagctgtatctcatggaggcattttcccaactgaaactcctttctctgtgataactctgagctgtgtcaagttgacacaaaactagccagtacagcatgtatcacctaatagcaaggaacttctctgacatcagcagtgcatataatcaaactcaatgcttttttttttttaaatttacactattagggtacagctatataactagatcccatttttaaatatttttccagctattctaatatacttttaaattatagtcttagaatccagttgaagatataactttattgtttctattttcctcaacttagtctggatgcatttgggaagttttccttatcactttgacatatccaaagcagttatttggtagactatttcgcaggtttgatttgtctgtttctccatgattaaatttagtgtaaacatttttaccaaggatattacataggtgatgctgtgcctcagagcatctcatcatgaggcatgtaggtatctggctgtcccatcactggggttggcaaagtgtcccttatatttgaaattggtaaatgatgaataggatgatgtcttgagatcatgtaactaccccattccttagcaatactttgtatacttttcatatctgtggatgaaattcttgctctgaatctattattacttggtttgttacggaatgatcttttgattttgtctttacatctgtatttgtcatataacattcttctgtataaataagcattattagctttctcttcctgcctgaattaaaaaaaatgaccatatgctctcatagattgttcatttaaatttagttcattggcacaacttgataatatgtgaatgcctttcagttttttcttttttctttttttagtaaaaataacatgtaagataaagaaattaaataattgatcatgctcatgtgttagtgtacttggtccccagctagaggcattgttttttaatgttatttgtgagataggacctagctagagaaaatgccttgcttatgagggttgggtaggccttatgggttgtagcctgaggtctctacctcctgatcatagagagatgagcaagcagcttcctgctttcatcaccaaggacccagccaatttagttgcctactccaatagattgtaccgttttaatccatgagcctaaataggtatttcctccccgaagttgcttcttttaggtattttgtcaaagcagtgagaaaatagactagaagagagaggggtattataaacacaaatatatttacatttgtctttatgtatatatcagaatattaagaaacaaagggctttatagggcaaagtcacaagacatagtctctgtaagagttaactacctataggaatgacacctattgaaaaaaattgactcctagccctttcagctttgattctgaggatggatacacttatctggaaatagttccttcttttccatctatgttatgggccttatgtctgtgcaacaataaaagctacttataacttaatgattttgaaagctattgtgtgattataagaccctataatacacactggtcaagcatttgtccctagcaaccatccatctgtttttgaatgtcctagagtaacatattcagatcactcgcaattataatagtgcattgtatacagacagatttatgtttcagcctaacaccttaaaatagatgtgttggaatgcaagtgctttttttattggatattttcttcatttacatttcaaatgctatccctaaagtcccctattccccccccccccgccctgctcccctacccactcactcccacttcttggccctggctttcccgtgtactggggcatataaagtttgctagaccaaaggtcctctcttctcaatgatggccaactaggcaccttctgctacatatgcaactagagacacgagttctgggggtactgattagttcatattgttgttccacctataagggttgcagaccccttcagctcttgggtactttctctagttcctacattgggggctgtcttagtcagggtttctattcctgcacaaacatcatgaccaagaagcaagttggtgaggaaagggtttattcagcttacacttccatattgctgttcatcatcaaaggaagtcagggctagaactcaagcaggtcagaaagtaggagctgatgaagaagccatggagggatgttcgttactggcttgcttcctctggcttgctcagcctgctctcttatagaaccaagactaccagctcagagatggtcccacccacaaggtgcctttcccccttgatcactaattgagaaaaatgccttacagttggatctcatggaggcatttcctcaactgaagctcctttctctgtgataactccagctgtgtcaagttgacacaaaactagccagtacaggggccctgtgttccatcctatagatgactgtgagcatccacttctatgtttgtcaggcaccagcaaagcctcaaaggagacaactatatcagggtcctttcagcaaaatcttgctggtatatgcaatagtgtcagtgtttggtggctgattatgggatggacccctgggtggggcagtctctggatgctccatcctttcatctcagctctaaactttgtctctgcaactccttccatggatatttcattccctattctagggaggaatggaatatccacgagttggtctttcttcttgattttcttgtgttttggaagttgtattttgggcattcaagttttctgggctaatatccacttaccagtgagtgcatatcaagtgacttcttttggaggttcactcaggatgatatcctacagatacatccatttgaccaagaatttcataaattcaatgtttttaatagctgagttgtattccattgggtaaatataacacattttctgtatccactggaatgcaagtgttttatcttcctagaatttttttctaaaacatctcactttctactgaatctaggtagggaattattttgctttattgatctgctttctggcagactttaatatttgaaccagttttttttttttttgcaaataatgacatagattccataataatagatgcagaattttctcatttgaccaaagtaatagagaaatgggaagagtacatatatcattataagtaatttgttcttattaacatgataaaatccatattacaacctaacaacctcattgaatttatttgtacattgtctagtagtgggagagaaacaactccactaagctgctttttaacctccacaggagtgcctcttcctctctgtgtctgtatctctgtctgtgtctctttgtttctctctgtggctgtctgtctctgtctttgtctctttctctcttccctcactttctcccctaccgcctcgctcacaaacacatacacaaaatactcatacacaatttgctctgtgatttctctttgtagatgaatggcatgttgagtagcatgtaatctagtactgtcacctttgatatttaggaagaagttcttcatccactaaagcatgtttaaaacccatataaaagagcagtgtaattataagtacccataattaaacaaatttagtaaatttaatttcattgagtattaatattttaaaaatcatgttgtttgaaaataatgaagtagaggtaataatgcatcaaaaccaagcttaactaatcactttacaaacctccctgaaggggaattgtctatgtcaaaagaagatgtgatagacatgagtttagagaataggagatatgaaattcctgtggaataaattaataatttcaaatagagactttggaaatactagctgtaacatggctgtgacacttgtgtaaatcggcagaaccacggtcagatgactttagatgatgagtagcagtggttgagaatagacctacctcccataggttagccctcctgacatgatcagaacaacatacaaaattcagcatgggtgatggagtggcagatacttaaggcctagcagtctttacatgggaggcacaagccaaaccttagagagtttcaggttcttttgggagagagagcagaaagaataaaaaaaatgaaagaatgtatctaaaatagtatgagggtggactagatttaatagagcaagcggaggaggcaaagagaaagtccttgaatgctacaagggaagaagtgaagacttttgaaagtttgaagaaacctgagtgtttttgaagactgagttgaagagaccaattgatcgaagataccattgtacccagagggccctttttacagaaaggttctaaattctcctgttgccatcagtgaaattgtacaccattccttagtatataaaagagaaaaagttagtgagtgtggtagtcatcaagaatttggcagctgtaatgaattaaatagccccttgataatctctgaagaagttgatgtctgccttcaagtgtctacctgattaccagagagtaattaaagtgctgcagagacaggggccttaggtaattaaagactggaattagttatatctgtgtgaatagctgtgattgtaagcagattttctgagagtaaccagtggcagatacaactgataaataataccaatgtgtatgttcaatgtattttagttgcatggttatttaaccaaagaaatcgatacttagaggagatagcagtgagaaggcaccaagctgaaagccctctccctaggttgtgcgtttgcatctgatgacactgattctcttcttttacctcagtcactgtttaatgtttcttactgcatactatggttcttataaaattaagaagaattgaaaaggtgacggagaaatctggccaattttgtatatgttactgttagtaaattgtcttttcataatttccatgccaaattttggaaaatgtaataattgaagctagaatgcaaacagtagcttctgtaataaaataaatttttattatgtaccatgaggtaagccttattgcttcctttgatttatatgcaaatatttctttttcatatagtttacactgctttcagctgctattttggattttcttgctttagactgtctctattctttccatgattgccacaataaaataggcaagggagaaaaattatgggtgcttcctggctcagtttgtggatttgtttcagtggcaggaccaatcttttaggaaaccactgttgtcaatgtcatgaatttacagtaaacctgtggaatttacatatataaaacatagatgtcatgctggtgaattcaacttacaagccatggaatagaactcttgcagtgaggctattagtttcaggtaatttaaatctcagtgggaaccaagaaatggattttgaactaatatattttttgaaatcctcaaagataggagattgtaatatttctgtgtaaagaaaaaaatctgtcattttcaagacaaagaggtttaaatttaatgaagtgattaaaagtaatttcaagatttatttctcctctataaatattatttttttgttggtgtaatggaaatttgctgaaaaattaggcctgttttcaatataatgccaaataaaacgaaacacatctttaaaggtaggaagctttttgtattcaggggactgtaaaatgacatgtttttgtggctatatagcccgtcctcatcagtcttttattattatgatgatgatgatgatgatgatgatgatgatgacgatgatgatgatgacggtagcacctgctttcaaagggtatatcatactggcttttgtaccaggtaaacttttgtcttgataaattgttgtttctaattttagagctgaaaggaaatgcacgactgttttaaagtacaggtagggactgtaatcttgtggatgctgttgagtctgcctctcaggtgttgccgttttggcactttggcacacatttgttttctatcatctatgggatcaattgttaagatcatcagtcacatgctcgttggctgtgctgttgcttcacctcttttaagcttcttacacgtgtaatttggaattataatgatttatttactactgtatctcattgacggttaggattttatttgtattcttaataaattctgcattgggtttttgatactttcattgatagctgatacgtttcagcaaaactcacaccacatgcagtgaatgagcctgatatggcttacagtttgtaggaagataacatctttgttattatccaaagagacccatgtaaattgtgcgattgagattacatgtcaggaacactggtaatgcccatcatggactagttttacatctgacaattccaagaacacggattgtcgatgtgtgagggttcttttagtactgcagatccatatgtaacaggactgtatatttttttctttatcaccaaatagcccattgttaacattgtaagtatcggatgattattaagattttgtatgaagagtcagcatgaatttattgttggcatacctttccaaacctcccagtaatatctaaaggaagcattttaagagacatatcaaagtgtaaatgttattatttcatatgtattcaccacagacccacatgtatcacaggtatgagtattaactagactgtcactttgggagatttgttaaaagggcttataagagtaagagtgctgagattggatctccaaaggcagggtggtaccaaagggggcttctggtgagagggatttctaagggtggggcagagaggggaggagggagggggctgcaatcaagatataaagtgaataaataatataataacaaaaagattgaggatttagctttaagtgttacattttgttactgtaggctgatatatatatatatatatatatatatatatatatatatatatatatatatatatcaaggggaaaagccaagccctaggtatgtcctagcagaatccatggctagatagccttattgtcttccccttgagagtggtcatgtacaaaggtcttttcctccagtaatgaaaaaaaattaacaatccatgtgtgaccttcatggccatggcaggccagtagaaggtcagtacccaagggttttttgtttttagttttggtttttgtttttcaaattaacactgttctgggcttgagagatggctcagaggttaagagcactgattgcttttccggaggtcctgagttcaattcccagctaccacatagtaactcacaaccatctgtaatgagatctgatgccatcttctggtgtgtctgaggacagctacagtgtacttacatagaataaatgcatacatttttttttaaagagtgctacatagtgacttagtctagcatttagaaaaaatacagactattcaatgtggaacaggttttaatcttaaaatatttaaaacacccatagtgatactcaccttattagccagaatactggggattcactctaaatccatgttcccacactctagccaaatataagcaaaccttccatagaggatagctttaggtttattttacgaactttttaggccagcatggctttgtgtgcctactagctttgctaagaaaattaaactgtaatgtatgccattttttaaaaagtactttaaactactcatatgcgtaatctttaaacagaaagatgaacgcctctcttatttattagaggcgcctctgatgctttgatgatttaagtacctgttcattgacttgcgttattgctgaattccttagttaagcgttatgagtatactgaacatacctgacttcccactgccctagcaaacgctttcaagcctgctaaaaatatgcttgcttctactccatgtcttcttgcaaatagtcagctagacatactcttgctggtagtttttatggagtcatataatattatactgacttttattcagacttcaattttctttgttttggttgttgagtagggatattcaaatgacagaaactatgaaaacaataaaggaaagaaaaatagagtgttccagaaagtcttggcatattgttataattttataattttaaatatcacatatcctacatcctacacacacacacatccatggtgactgatagaaaaagcacctttgtttcatgtttcatgtggtttcctgtgctaacatgtttgctgattttaaaggtttctctcactttgtctttacattaatgctttgggaaagacaattatagcatttccattttccccatagacccccttcttactaccaggaactcagtcttcaaccatttatagtgttgtcagcctttcctctcccctcccaaattaaataccggaaatgaagacacttaatgtgtcttggagagttgtgggtgtcaattcaacctttcacagagttaatgttatgttttgaaaagaaaaacaaattgacaggaagatgtgacaggaacaggagaaggaagaactataaaaaatatagtagtctttagttattttgcagggagaaaagcagtactccagtcttcaatggttttgaagggcatcactctattattacaaagaatagaaattgatcttgatgaggtgccatcaaggggatattcattatattcttcagcagtgcagcctatgtgtaatccattttctaaaagtttccatcaggattgcttagctcccttccgctgtatttaatgaagtattttccaagtacagagcatacacttatggatcactttttgtagggaatgaaagaaccattgcacttggttcttcttatgcatgctcatggaaaaattgctatccttgatttactcagaacttaatatcattaaaagcatgaagagtaattatgccaagtgaatacagtaccagaaatatttggtatgatttgggacataatattcatgttttccagtaacctcacacaaatatttatgagatttattttcaaatggaataactggctaccaataagatatatattattttaaaaagtttcattttcatgaagaatggatagcttaagattttcgggggaaaagaaggaaatgtgattcaggagataaagggctccttaatcctagtgctattcctcaggggagggaagatagttttttatacttgcagagtgtctttagtctttggttatctggcagttgactttatgatctgggaggggaatgatgcctgtttcattatacaaaactctgtccctttcacagcctgtctgtcaggcaactctccaataatactttctgactttttactatgtggtttagggattgtgggaaatacacgtttttcacacatgaatccctcctatcctcattgtaagtaatcttacaagatgatcatcgttatcttcagttcaagaggttcaaatttatagaagataattaatttgtccaaggtcagctgtgcctgacagtgatctcttaactctcaattgcttcacctgtatatactccccaggcactctagtaggatagctgctaggcttactccatttactataggagcttgggatagttatttatggatgttagaatgtgcaacaaatgcaagctggctcctttttcttctaggaatttctagtagtggaagctccctgtcataaatgaagtgcaaacctattatcccttacttttaagcacagagctgtgaaataagggcttgtttgctgctatttactactctccatggttttcttgctgcgttctctccgagcaatacttgattgctcatttacagacagggagccagcttccatgatgctagaactcactgtcattgttgcttttgctatcttagtggtaataaaagctagaaagactcccccacccctcacacacactcacaaacaacagcagtgtgcaaggttttctcttgactccatccttctggccaccgtttccaaaggggtcaggaattaatacttgttttaccatagtacatgttttgattttttttgtttttgtttttggctgaaatgtattgttctgtgtagacttggtaattaaatattttggttaagctattttattgggaggatgtcccagtgcttttatttttatttgtttgtttttaacttcagctgacttacaaacagatttaaggatataatcctcttgtaaattgggaccacttggataacacataggtttggggatactttttctatcatattggatggaatattcttgataatttgaatcctttgatatgtatgaaagtgtacactgcagttagtttaacacttcagttgttataaaaacataatttcaatagtatgtaaatttaatgtaactttggagacttagtcttagtttgttcatttcaatgttaatttatttatttaagttttagctattttaaaataggcctgtgtgtgggggcctggtaatgtttttttattttggtatcattagattttgaaatgaaagtgactttaaactaggctccaaggaggtgttagttaaattattagtaatgagtttggatgctttgaaaaaaaagtatacttgtcaatgaataaacataatataatgtaatcgaatctctttataatgttgctgctacagggcccactacctgttatgcaaactaattttgctatacagtgatagtttcatcagccgtaggatttcactgaagatactaaaaactctgttcttttcagcaattgtaatccagtttagactgtatttcagcttctgttaaaggaaagcttccttgcaaacctggttttgaaactgtagaaccactgatgaatagaaagagattgattgctctcacttgtcatccatttttattttacttcccatcatgtacagaatgatggatgctcattgtgtttgcttttttctttgtatttctgtttcttcactgaaaaagtcataaattaatatacatgttacactcatcttgtagagcagtaagtgaagaacctagaacttctgtatattacctttcttatctttgtgattaaagtcctgggggggggacacttatagagaagaaggtttattttggatcacattttaagatatcccttgtaatgggatagcatagcaatgggggcatgtgtagctgcttcatttcaccaacagtcacaaagcagaaagatatgaatactagtgtctcccttgtgttttccatttgaatcagttcaagaccccagctcatgggattttgctctttatagtcaggatgaatcaatctttgtacctcacttacccaaaaatcctcttacagatgcacagagctctcctaggtgatcctaactaagtacaaccaatcaaattgccagtcagagcatcaaacattattagcatgagtttgaattttagtactgtgagcataacagtattaaggtttgtgtttggatgctaattttcattgttagttactagcatattatcattgtctttttagaataatattcatatggtatgtaatttttcaatagtctagagtatcactgggtgttgagaatttggttctctgtcttcctaaaaaataaaacaaaaacaaaccaccatcacccctaccaccaccactgccaccgccaacgctgccaacacgaccacaaccacaaaacccagcagtccatttgacataaaggaagatcctatttggcttactttaagcgaatgaaaaataggggtggaaagcatgagagttccagagtttggttgcaggtactagggaaaagaagaaaataataatagtgtttaacagaaaaataacactctgtcatatggaaaatcgagacattattagatcagataaatctgtgaattcaggagaaagaaagtaagaggttggggaagagagtgcagaagtcttctgattcctaaacagtcaggaggcaaaatcagggggatcataaattcaaggtctagggtgctctttccagtaggttttttttttttgtcttatattcttccaaaatttctagaaagctgagaaatagtcctctgtcactttgggaactcatcccatatagtctatgaatatataattatcaagttaaccattttattattgaaagacaaagatttttttgtttctatgattgtagtcataaaaattaacctttttatttgtgtaacctttatttgtgcacccatttagctcttctttcacattttagtagaaattctaagtcgattgatattcctgtttgatgacttctgatgactactacaaaatgtatagtccttgctcatagcttttactttccacctttattagagaagtagaaatgaactttgcctagggatacttcctatatgtggtaaggtgtttcatttaatcctcgcattgttttttttattcagactcctttagagatgaaggacaggaagattagatagacaaaggaacttatgattttgtggaatggaatcagaactaaattcctgatctgatactaaggccctggtttgatgctacataaggatgtctaccattcttgtgttctattgtgagactccagtaatcattgcaaaacagtgcattgctgatacagaaagcatactattaattgaaactaatttctcaggaatttattttactctaatgtcaccctgtagccaacataatcattgaacatcttgctgagagcatctctgttctttgactaggaacttcagtgttctcaattgctagccataccatatgttattttatcagctagctaagtatgtagaaagtggaaaatttagagcagaaaaaataaatcctgtttttagccctaaactaggggattataaactaagatttaaaaaaaaaaaaactgtggttgggttattttgtacattgtctgtttttttttttctttctattttttatgttcaaaacatcacagtagggactctaaaaatgtgtggtagaaatggaatctaaatgtttagccaaatgtaaattctggtttagagaaaaagatgtaatgtatgctataaatatgcataggcatatatacatatgcctctgtgtatatgtgttttctgagtcaccttggactgctataagaaaatacaatatgttttgtggtttaataatagattttttttattctagaatatgcaatgtccaaggtcatgctgctagcatatatggcttgacatgtagactgtccattttttttcaatgcatcatcacataacagtgatgagaatttttgctatctcatattattttcataaggtgattaaatttcattatggctactctactcatatgacctcatcaaaatattattatttcccaaaggcccaaccttctagtacaatcacagtggggtttgggttcaaggtttaaattttgggaagacacaaacattcaacctgtaacaggtactttcataacataactaatgtttgagtatattaaaaaaaaacatatggtggactgtaaagtattttagtgccatgttttgaaagtcctgggggaaactgttgatataagacagctggtgagttacaaacacacagaaacaatatgttgttcatatatctgtctgtcataattgatccagacttctgtaaaaaaaaaaatggcacaaatgagataacatcattgacagaaatttattgctcacagttgtggtaattaggaagcccaaagcatgaaactaacaaacttttggttttagtgagggatcaatatgcttcacagaagagcccttgttgctaaatcctacacaaggtccatttcacgtctactataagggtgccaataccattcatgagtgctctactctcttgttataacccccttcccagtggttctcgcctcttagcattttcacatggggagctaggtcttaccctatgcacagtcatccaaacaatatcagtactttagtgctgagtatagcactagacacaaatgtattcagttaatgtatgtagaatggatgaattaaaaaataaatcatgaggccatgtgttggtagcacatacttttaatcccagcccttgggaggcagaggcagaggcaggctgatttctgtgagtttgagggcagcctggactacagagctaattctacgacagtcaaggctatgcaaagaagcccagtctcaaaaaaaaaaaaaaaataaccaaaaataaaataggctttctgagtttgctgtgaacttgtaggtcaagtagaaggaagagtgagtcagtttatttgctttttaggttataagtaggtatattcattgaaaaatgattgtagcatcaaaatgcagtgtatttaataatatcgtgtttgacaagtctctttaaatatgtagatattagggttacgctcatctatggattatattgctaatgttatcactaataggcagcaaaacaggagaagtttattttttttctagtttctgaaagccataagtctggaatagctataaggcaaacatccatttttatctccttcagcttctgctaccagataattctttgttttgtggatacacaattctagtttctgcttcccaattcacattgtcttaagctcatcttttactagtcactaaagcagtgtttctcaacctttctgatgctgcaaccccgtatagtgccccatgttgtgctgaacaccccaaatcataaatttattttcattgctactttattactgtaattgtgctactgttaagaacccagatgcccctcaacagaggaatggatacagaaaatgtggtacatttacacaatggagtactactcagctattaaaaagaatgaatttatgaaattcctagccaaatggatggacctggagggcatcatcctgagtgaggtaacccaatcacaaaataactcacacgatatgtactcactgataagtggatattagcccagaaacagaatacccaagatataagatacaatttgctaaacgcatgaaactcaagaagaacgaagaccaaagtgtggaaactttgccccttcttagaattgggaacaaaacacccatggaaggagttatagagacaaagtttggagctgagacaaaaggatggaccatctagagactgccatatccagggatccatcccataatcagcctccaaacgctgacaccattgcatacactagcaagattttgctgaaaggaccctgatatagctgtctcttgtgagactatgccggggcctggcaaacacagaagtggatgctcacagtcagctattggatggatcacagggcccccaatggaggagctagagaaagtaccaaggagctgaaggggtctgcaagcctataggtggaacagtggtatgaactaaccagtactctccggagctcgtgtctctagctgcatttatatcagaagatggcctagtcagccatcagtggaaagagaggcccattagtcgtgcaaactttatatgcctcagtacaggggaacgccaggaccaagaagttggagtgggtgagtaggggagtgggtgagggagcttgtagctgacttttgggatagcattggaaatgtaaatgaaataaatacccagtttaaaaaaaaaacccaaacaaacaaacaaaaaaagaattgttatgtaaatatttgtgttttctgatggtattttgggggtttcagaccacagcttgagaactcctgctttaaaggcttggtaagtactttccactctaactaatcagagcacaaatgtctctcagccccatgcaatctgcaatagttgagcttattcttctctagtagacatttgcccattctaatagagtctcatctatgtatgtgcagattgctagtcagcattatcttaagtagactcctgtagatatctacaactgtttttctattggggattactcttctcctgtacgatgcttcataaatccaagctgccttatcctccttggtctcttatttttttctttccagctctgcagtactgcagtactctgtgagctttgtcctcatctttcactgtgaaaagtactccttcacacaccgcccggatagctgtaaggctcaatttgtttcctttctctcagggatcacagtcctctgaagaagcctgttgttcaatgtctgaaaacagttgtttcatatagtttctgtgattttctacttgtttacagatggagggcttgtctactactagctactttatcatggccagaagcagaagtgtcttatatatcttttatcattgaatatggtgtgtttgctttttactttttacttaacacactgttgatttggtgttcatttgttccttgaggatcatactttaaaaagtatcctcttcagtaactcatgaacaatacttatatagcccctatctctatgtctctctgtgtttaattcggtgagatgattgtgcaagtgtaagcagttatatcatttcctggttttgaagacacctctatgtattagagaacatttacatgctgattttgtacgtagtctgtttgaagtaaaaagatcattacacttgtgacctactttcctttttccactggattttcttcactgataactaagtgttttgatagagtataaagcaacattttgttagtttctcaaatcccttgctatcctctttgcagaacgagaatttttactccttatgtcatagtgaggaatatagaatgtgaaagtataattgtccatggctcttaactgcaattttaatttgaatagtctcacaagatgcatttcttttcttctagaaataagtatagccccctttgagttcagagctaaaattaagcactcttttaggtcgagtccccaggacacacagtttttcattctaggtagcactgtctcatctttacatttcctgtgttgtctctgtagatggttagaaaggcaatacttcatcaggttgctgccagtactcctctgtgagatggttattaaaagcacatcctttcctcgccaattcagagtgccaggctttcactgatcttatatacttgagctcttctgacacaagggagaggatagctaaacggctctcaaagctgggtttatagcctttcatataatttggcctttcagtgaactaggtaaggtagttcttcatctttctctacctctctatcattaatgtggttgattgtcagagggagctgcagtcaaacaaatgtggaaacttttgtaatttatgtatagctctaaaaaggcaaagaaatgaaggattattgcagttggtgccatccccaatacaattaatatcaaatgcatataaatcctattagagatctgtcatgggtgaaaaaggaatatgaaaaatgcgtgacctatctttattagattcagttagagagagaccatacagagctaaggagctttacgaactgcatattaatcataaccagtcttctgagataaacctatttcttgtaacttatcaaagccatgcagaagattagccattctctttggtcaaggaatgttttacatattggtatgagttttgaatatcacagctttaaaaactgattaacagatattttaatattaaatatgtatctcattaaattatatagcttagataactattatcctgtaataccccctcaatagggagatgctctttttgtcagaacctcaacatcattgttttgttgcaagaagatactctagggagttgtattggagaccatacaaaagaaccttgttatagcaagccatagttaaattgtgcagaaacacttttttcttaaatctttatttgaagcaacaattgctagatgccagcaccattttttttttgaatgtcattttcaatttctgaagtcttttatctttttgagaaggaggagaattagctcaaggggatggttaagaccatcatgttaacacactgtagtactaaagatagtggatgtagaacagctatagtctgacaaagataattaagattgtatttttaaaatgacagaagagaggaagagaatttcataagattattagacttttagataacatataagacacaacagtaatactttggattttgtattatccttggaaactaagaaatgttgattgcaggttaagtgcccaaatgtattaggtgatgctgaaaataacatcaaagtatttcttttttttttttttaagatttatttatttatttatttattatatgtaagtacactgtagctgtcttcagacaccccagaagagggtatcagatttcgttacggatggttgtgagccaccatgtggttgctgggatttgaactcgggaccttcggaagagcagtcggcgctcttaaccactgagccatctcgccagccccaaagtatttcacaatgaaagtttttattttcttagttttaatttaatttttttttgagacaaggtttctctatttagccctgactgtcctggaactcactcactctatagaccaggctggtgttacactaacagagcagacactgcctttgcctccccagtgctgggattaaagcaaagcactacagtgctctgcttgaagatgtttatagttaatgttgtactattttatagcttagtttttctatttccaaagtattaggcctatttaaaaaggtaaaaaaatatagaagtatatacagtaaaacatatcacttttcttatccttcagtataaagaaaactaattctaataattattctaaatactttaagaaatcatttactgatgaaaagttttctaagtaggtggatcactttaatgctctaacagtcgataagctcattattgcttgtaccaacagtgcttttctaagatattttttgactaagcaaacaaattaaacatagtatataatggtccttttattttaaaatcataccattagtaatcctacatattaatgtatatatggtcagatcacaaaaatttgtatagaaaaatctatataatatagtagaggaacaacaatatgaaccagtacccccagagattccagggactaaaccaccaaccaaagagtacacatggagggactcaaggctccagccgcatatgtagcagagaatggccttgtgggacatcaatgagaggaaagactcttggttctgtgaggtattgatgctccagtgtaggggaatgccagggccaggaagtgggagtgggtggattggtgagcagggggaggcggcatgggataggagggttttaggaggggaaatgaggagaggggataaaatttgaaatgtaaataaagaacatatctaaaaataacaatgaaaataacttaaaaatatagtaaactctgatttaatcagtttatcagtagtatatattagattatttctggagtgagcttttaaaaaaatgacagtacatatcatatattaccattagcgtagccatggagaacataggagactatatacattctacataacataatctctgcatgcattctgtattaatggtttatttgaatgctatttatgatctttaatttaaaatcaaaatccaaagtctttcctcaaatgtctacttcttactttttgataccacttactgcctatctggattctttggtttcttaaaattgtatcttcttaccctaatgatattgtctgattcttaaatattttgttcagaagatgaatgttctctgctgctgtaaggcattatgttaccaacttttttctatgtgcccgcatttatatctttagacttttaaccaacttttcagttttaccatgttcaggcatatcacaatatcttatcatgttaaaatatctaaaatgaaatttataatattcatagttttgtctctctttaaatcgtacatcatgtgaccagacttaattgccaaattcccagtttcaccatgtagcaaagagttctataatatgtattcataatatgcaaagaatagagtgatttctttcaactggttaagtgaaaggtaagtgaaagttttacattttatatgtctctaatcctggaaggaattgttatattctaaatatgaaatactgtgaattttaatatttgttctatagtataaatcgttttacaatctacagtttcaggttgttgggcaagttaattttggaatagtaatgtgtagcagttgattattctagatgatgaatgaccatggtttgggtctttatataagtttccaaaaataaagttataaatatatgctaaaatttaaaaatatttcatcccacataaacaagtgatcaatatcattttgaaaaagttattgctttgggtaataagaaaaaaatgtctttagacttaggcactgatgtgctctgagtctaggttaaaccttttgaggaaactacttgctttttaagactgtaattttcaaatgtggaagctaattccttaataaggagatagaaagccacaaatcctttgatatttatgggtacacaacctagagatgttgtgacatctaggtaaattacctggttataatcacaagaattaggcaaaataacatgtgtatatttggcacttactcattctaggtgtgactgtctcaaatttcctaaattaaaagttccgggtatttcaccttgagtcttaatggaggattattatactagaaaatagaaaaattactggcaaagtaaatcctaaaacatatggaagtagaacattccataactagattataggaccatgaatactgtggtataaattagtaatattttaaacaaaacaatcaccatacatcttggaaaaccatacctatatttatcctaatggtaaataaggagaatgaaacaaagaattgtctcttcaaatttcatttcctatgctttctgtgtgtgtcagttatactgatggtgactaatggagaaagtcagtacaagggcagatcctacataattggaaaagataatttcctatactctgtgttttgaaggctattctaagatctcatctaccttcctctttatataaccagaaatacctgccattattccactcaatggataataacatttgaagaaacatttctaaaaagtcactattatacctatacaatgctttgcttagaattttacagtgaagctcatattctctctcatttgatttaaacattagaaggtatgtgctcaacaagatctgggttcaggttgaagatgatgagaacatttctatttgagttgttttcgtgagcgttgaaacatggtggcaaggcactgttctgattgcctgtggcagcaatttgaagctctgatagccaaacaaatgtccaagcacagcgctttttcacagtggattgtttattgcagttgtccctcctatcactaaaggataaaaatgttaaggtgtaggttttagttttagtattcatcttttgaatagctaggacacacagtgctcctgggaataaagaataagtataaatagactaaataaataccatataggatatcccattgtcttactccctgcattattcctttttgctttgctcaaatgtgtcctactgaaattataattttaaaaattaccatcttccctcatacaacttctatcccacttaatttttgtccatagtactcttacctgtgatttttgtgtataaatatattcacataatcatatatgaatatatttatgtgcacacattggtgggtatgtgtgactatgtcttttttttatctgttctcacttaaatgcatatagaagctgctataatgagagttatagtatgattaggtgctctcaagtatacttgttattttttcctagcattattttccctagtttctaagattattaccagaaaactcaccccattcttatctctcttcattgtagtgtatcacaaaatattatgtaggtaactaccatagttcacatatatagatttctatcttgtcaaatgaactttggtgtagtagagataaaagaaaccatcttgaggaaagtgatggctttccagtgcttgctacagaagcaataagatataagttcagagccccagcactcatgaaaaacaaggcatgcttgcgcatgtttgcatcttcagggctgaaatacagagactagcagatcctcgtgcctcactggccaaccactttagttaggccacacagcagccccaggttctgccagagaatcagagaccttatccataaaaactggtggagtgtaattgaggaaatagacaccaaagttgactttgtgtctgcacatggtgcatgggtacaatgtgtgaatctgctctacttcatgtgcctgtgcatgtacttattcacatacatctctctcacacatatgtatgatcacacacacaaagtctttatagatctcaaaaaatgcatgaacagcatttaattttgatttttcatataaactaaaatcactaattatccactagagaacaattgattacttgtcccattgttaattttaaagaacacttttcttcctgacattcactattatataccattctggcttgtatggactttagtaaatgtgctactgactcatttattttcctgtaatggtggctatttaataagttttgagcaaatggacagacattcacatctattattaattacacttaagagggttgtgaattaggaataaagaatttgctgatcaaattaacaaaatgcgtctgtacttcgtggcagtacttatatccttcaaaacacataatcattattctaaacttgcagtgaaaaaagattttctattagaagtaaaatttttgttcatagttcctcattttttaaatatatctgatcggatgatttgaccctttctccaacatttacttaaaaatgtattgcagttcacataaatatggtactgcttaattgtccattaaagatgatatttaatgttctcagtgtgaatattttcctatcctagacatttttattaagtcatttattcaacaaaagaaatcctgaacaaaaaagcaatattgtaattgttttttaactactactgccaggaatttagaaatatactcgaaataatatggtttaaaatggaacttcaatagaaatccacctactagaaccatcattgtcattggattatatttttgcatggtatgtacaatgtttaaaagattctacctgaaacttagctcagcatttctatagttttcccttataatatattctatctattactattttaaattacactgtgctatgtatcttcttcttacttctttctctgcttaaaattaattttgtactcctgtacatggttcagtgttctaaggtgttcttgtaatagatattaatatggttttaggtgggctgtatacatggttaagtggttaagagcatttgaggacatggttggttttccagcacccacatggtggtttgacatccttttctgaattccgcaggcactgtattcacactgtacactaacatatatgcagacaaaatatgtaagataagtatatctttaaaaactgcttgtgtattatttcattagttgaaatataataaagaaaatgagtacaattttggacgttcaaccacaaaattgcccctatcttctgcaagaaatttgtatattgctccactaagtatttaatagagtgtctcattagtctgagttttctggatactatttttcttcctagtagtaactacaagagaatccttcttcttccaaaataaatagcttgcctatttgaaagtaggaatcaatccagtattcccacttactttggcaagcctgtaaatatcatgcccaaagacatatcatgagatctacacttttactacagttgaaagtctacaaaataatattgattgctatataggcattgcatatggcatacttacagaagcttttcacataatatgattgagtaaaatcactgaaaatgaactgctttctgctggtaccctggattctgctttctactttgatcaatttgactaggtaaaacctgttaatgtacctacagtgtttgtcagctagtttcagttaccataatattctcccatttatccctgcttcagcatataagaggattatctttttcatggctgaataatgttctattatttgtatctatttaaggaagagacgatcccttctctaccatatcatcccacttttgtaaaaaaaaaaaaattagtttactgtatatgagtaagtttattcctcggttctattctgttggtttatcccatttttctattttaatggcagtaatattgtcagaatatatttgatttacatactgattgggaaaatcaagtactgaatggaaaattttggcattctgagaagcctgttaacagtattgtaatctgttagctgaatgagctgaacagattagctgtgtgaacagaaaatttctttcacgccaagaggaactttaaaattaattacaaaaaggccttggcactagaaaaaaaaaacgttaacatggtgacaaaacagggataaagccagtttgatttatgaaagtagcttgagggccatgtgataagaatatggatcacataatcagaagccaggtgttgttgggctttttacaaatataaattgaactcaaagtgttgtctttcagatagaattgcttccaagtaggcatctcttagcattgtcattctgataatgaactagaatgaaatgctgagagtacaggctccccttagtagggaggctagttaacttcaagatccagcatttcaccttaagatatttgttttgtcttctcctttgtttgtctgtctttttgtcaatcagtagaactgttgaccttctgcataagtctccatcccagagtttcatgtcttcacatgtgtgcatgcacagtgttttgtggcagaccttacaacaggaattctgtgcagacaagaggctagatgctatactgtgaatgatgatcccgtgtgtgtccctggtatctgagccaatcatttcatatctttgaaatttcactgtctatttccactgaggatgcagtccacgacctccccagtgaatttttgacaccatggacagcagaatatttagctatattctgtgcttccaatgcatacatacatgcctatgccaaactttgctttataaattgggttcagtaagagattaacaagaatttataatgaaatagaacagctgtaccaatctaatataatacaggtggtctaaaatacacaaattgcttattggtatggtttttccatttagcattcacagagtgctgttgaacatccattaccaaaacagaaaagttcaagcctataatggggaactattatgctaaagattaaaattttagtacaaacgctacaaggaattatgaacaccgcttaatttttaatgatgaattttttcaaatttccttatggctgaaatgtaacttttcaataatatataatctaatatcaatgatctttctgtcattgtaagcctatgtgtctctatgcatggcttttgcaggctttgaaagagagaaactggatgtaactgacaattttctgtctctaatactgggtctgactttttgctcttaaaatggtgtttgcactttaaaaatcactttaaggatacattgaactctttttctgaagctttataagccatttatgtacacaagcaactctcccacacacaagactcatatcaagcaaaatctccttgtctgttttatattttttctgtcaaatacattgttttgagtgcttctaaatatcaaaagcatacaaacatcaggttgtgatttcttagtcttgattctgaaaatttctatactattttttgataacatgtagatcatagaagacagttttctgaaaataagccagtcatagtagcacgtacatttaatcttagtacctgagaggcaggcagaagaaaatggactcctgtgaattgaatccctccttggtttatatagagaccagtctacttagcactatataacgagaccctgtgtctattaacaagataaatttatagaagacggaactttggagactttatggctatagaaatctatccaattcatatgaaatgatagtctgtattataaatttatttcatctagataaaataatagtaatgtaatgacaaaatcaaaactgtagaatattggatctgattttctgaacagtgtattcttctctactgtaatttccaagtaccgtcttctttaatgttgactatgcatgtgatacctagaggaagttgaactagaaattgttccctggaattgtttgataaatgagagtgtgttaactcaagggtagttttgatgcttttgagcatacatggtaaaatttattgtcagagagataagtagctaatcatgttgacattcatgactgctgtgtttgtacctaggggaatgacttgtgttagaggaagggatcctgagagactgttctttctgcttacattagaaatcattagagataatttaaatgaacaaagcattgctggaaaattaagaaaatctttggaaaattagaaacggattcactgtatcctcccattctcttgtcagaaccactaagaggctgggagtgaaggtaaaattacacacaaaatgtaatatagtgtggaatcatttttttttaattgtgtaggagcaaaaagaaaagggtatgtgacaaaataacaacaaaagttctctccagatgagaacctatggggacttttatttttgtctttttgtgtttgctgttttttttttttaatttttctaaatctcccttactgaacatgaatttgacttaaaatgaggaaagaggaaaaaatgataaaggagttagattgtatgatctttatttcctcatcatgtttattatataacaactatgaacataataaatactccattttgtcttattttacaaaagaaactattaacttagatccatttcatccacaaaacaagaaatatattttctattttgatgtagtagagagggtgaaggaactattaatagttcttttagatataagtaatctaattatgtcacatgctctatatcatattgacctgaaggcaaaatgtgaatctattattcctttataatctcatttacagtcttattattatcatcttgtctagtcttcagtttaagatgggatatcatattagtaatttatttaaattttatatatgggatcatacttaaatctagtgaatctctattgtcaatgcaatggaaattactacttagaaatagttttgtggcattttgttttccatttattttagactgggaaactaaaagtaatgccttgtaatgggaaacatttcaaacagatgaaacttaactgagcaccagccattgaaaatagaagagcacacatgagggagattgcatgttcttaagtgatcaactgtttggaaatgaaatgctgaggtatagatagatgtgaagcgtaaaacagaaacaagtctcgtagctgggggcatcttccaatctgctctttgtgctacgaatagaagtcccattgtccaactttatggccatagtgcttcaaaatcaaacacatagatgctttgtgttgttagctttggctgatgtagtcaggaagagatgataacagcctgtggatttgtaagagagtatttgcctacagatgtttttcaggacacttttccctccggccttccccacccaactttttttttttttttttttttctcaaaagacatgtctcaggagtgattcaggaaaaatgtcagttgctttgaacttgggaggaattgattcttttaaccatatgattttatcctctgattatttatggaaaggtttaaaatgaacgtgtaccattggacaattggatgttgcatgccagctgacataattgatttgctcaggtgcctcttttaatgaaaggtatcttctagtttgccaagtcttttttgtatgtaatgtaaatattcccttcttccactagtagtaaatattctatatttttctaaaccaattatctcaaaaacttatgggttattagacatctaggttttcctcatttttttaaaatttttttcccttaagaatacagttacaagtgatatatttgtatagaaattcttagattgttttctaggcaaaatatttatactaaaaccataaaactggaaaccagagctttatcttgttatgtctgtcaatgatatacatatttattatcttaaatttatttttccattttctttggccattacataaggatgttttgtactttttatcttttaattttaatttccacctaattttaatttccacattccattacacgaatgaacctctggcacttactacttattatcttttgtagtgtgacctccatatattttctttattcttcttttctgtgtctcctggtctccttaaaactattggtccttcttactgttaccagcatcaccatttacttagttaaaagaactctgagctaccactggctatcatttcatccttttcctttcctctctttccagatagctgttctccatttccatcagctgctcactgcctcctccatgcttacctttactctcataaactcaccttgaagtgcatcttccaaagtgccttcagaatgactttcttttctcagttcgaggagtaggacctagggccttactcatgagaatgtcttttataaaggttagtgttatttataccacttaatatgtatgtaaacatccatacatatatgtatataaggtttacctttataacttttaaaatcctgttcttttttcttttgtctgtttttgagtcagggtctttctacataatcctgacttttctgaaacttactatgtagactagtctggccttgaactcataaagagccagctgagtctgcctcctaggtgctgatatgaatacacacagccaatgaaatccttttctagtattgctatgttatttatattttaataatgttttacattagaatacacagtcatgagttttatcatgtcatcttcataacttagattttatatgtattttcatatctcataattaactgaagcaaaataaatgtaaaatagggttgtttaaatggttaatgctagtgatgtggcgtcaatatgaaatgttccctttagactcatgtatttgggtgttgttgccagctaatgagctttttggaactcatcggttccttatggggttgatctttgtggatttagtatatcattggtatgatttgataggaaggaagaggtggagcccggatgaaaataggtcatttagcaatcaaccttcaggatctgcctctctcttccagttccctggaaaagttgttgagcaacttctttacatcgtattacaatattgtggtattctctgctcttgccatattcctaaaagcaatagagtcaactgactaaagactgattcatatggtacctgagccaaaataacagttccttccttaaaatgtgctcttttcttccttcccctccctttactttccttccccctctcccttccccttcctctcttcctcctttccttccctcttttttatctcaggtatttgttacagcatcaaaatactgattaacacaactacaacatgggaaaccatttaatggtaaaaattgcattattagtagaggatagaaaggtatatattgatatcagttagctaatgtcgactaactgccctttgagtcataaccagtctatgttcttccatatgaactgaacattttgtttctctcattcgctcactttgtctcagtcagttgaggagattggcttagactaagtgagacagtcaggcatatgcctgctctgacaacatattaaattgtactgcatggtttgttccaaccactttttcttaatgaaggaacagaaagtaccttgtgcacatatagagctgtatagctgaaactagagtagtgtaaggtatgggatgaattacattgggaaatgactaaatatttgaaaaagaatagctattaatgatgtatgaaacatagctattttcattaagcccatatattaaaaagcacatttgtagactaattttcttggttcaatatttgtataaaatagtgatgtattaaaacagaacattttcagggaaaaaatccctaggtaatagctaatctatattaatcaaaggatgtagtcttatagctttaataaatacctctactgtagtggctatatagtaaggttaacgagtatccatgttgttttgtgttttttttttttttgtcaattgatttgtgtttgtatgcacatgtttgtacatgagagtgcatttgtatggggtccagaagtcactttggcctattgctcttttaaagaactgtttgtttttgttttcttattgacctgtagctcactgattagattggtctgactgtcccagtctattctttcccaacaccagattacaaatagacaccaccagcttttttctgtgtgtcctggggagcaaacccaggtccttatgtttgcacagcaagcactttatggactgagctgcctcttctgatttttttttttttgagctatctattatctttgaaaacatctgactctgtcattgtagagcaaaggagaaataactaagcattttgaaagagaaaatgaagagcttatatgagatattgtagatagtaaattgacagagttaaggatgctatttgaaaggaagattattgtgtctgatatagtttattaagccataatccaagttcattgaacatgtaaagttaaaaacaaaaagaacacctcaaaagatctggaggagtaatatttaacagaaagggaaagagttgtttgcgaggaacaaaaccgtggtagactaagtaaaatgaaagacaaagcaaacattggcgtcaagtgtgctttatactttcagaattcctgcagactgtgaagcccattctttatatgatttatatctcttgctagtttgcaatttgatttaaaaatgaggaaacgttagaacagaagactacaaagaggggcatgctccatttgaaattagaatggttacagcattccaggtcaggtagcctctgaaaaactaatatttttttcatctctgcttttctcagtactttggcctcattttctcttgccagcaagatatttctttgtttggtagaaaactttgctatcaccagcaaatgaatacaggagttatgtttggatagatacaagtattcatttgatatttttcatatatggatagaagtagtggttggttggtaatggtgtgaagttttccatgctatagttttctttctctctttgaaaatcaaagtacatatttgccatgataagttacttgaaataagatatggtagaaagtttaattatctggagttaacctacaatatcatatcttagctcatatcattacattcatttataattatctcatgagtttcagaaatttttgttttagttcttataattttgatttcactgttaaatcacagagttttctaatattccactctacttcccttttgataatcagagtggttgttttgatattagtgaataaatgagtgaactagagctattttatcaaacacatatgatccgttttcctaccttttcttgtaatatttcttcccttggctcattacatgcagggctctttcttgattctcaggtctcagcttaagtgttacttcctcaaagatgcttttcccactgtaaaatggctcccacttctcatagttctctgttgaattgtcattctcatagatatttatgtttatcctttccttgcctgcttgtgtgctcttttccagaaaacttgaagccatgtatacttggtaattaaaagaattggctgtgaagtcatagctgggcacatgttctggcctcaccattactatttgtgtgcacttgggaacaatttcagcttaatccccatatggttccatttccttatctgtaaaactgtgtaagaatagagtgtatcttatagacttgtgagaattaaatgtactttaacttctgtgttagttactttttccttgctgtggcaaaatatcataaagaatcatgttaagggaagaagaatttattttgggtcacagaggaaaaagttcattatggcaaggaagtcatggcagctggggcttcatctggggatctaggagtctgcagcagctgtttgtttcctggtactaaaccaagaagcagagaaattgggtggtggtagagggttgaattatatcccttaaacacctactcccctccccctgcaacaatatttttcctcacccagtggctaactctttctaggttaagctcaacctccccaaaattctgtaacttctaaacctgcctccagctggggaacaacacccaaacacatgtcacattcaagcctttacaacatctaaactggccaagcagtatttatggtatgttagataacaaaacttcaaaagcaacaaatgagcaaacaaacaaaaaccatccagcaaattaaaataaacactcaccaaaggactactttggaaaagtctcaatgaaggaggtagatctgcatgtgcggatgtaaaatcatgtagattgtgctatcaatgaaaattgctaagtctacacttcaatgttaatctcaaaatttcatgtatctcagaggttctctggctcatgttatgcttgggcatgatcttagactccactacatagtgaaagaaagaggacactgagtgatagcttattgtgtatttaggaagtaccatccttcactaccatactcatgttgcattggccaaaatacaccagagaactatatttgatttcaaggaccaggaaagcacaatcctgtcttcttaaggaagaacagtagaaatttaggagagtatcaattcttaataataataatatcctaattgtgaataaaggtataaaatattagaaaaagtctcattgagatcaataccaaagtattgtttagtttttaaaatattttagggctggagagatggctcaacggtcaagagcacccgactgctcttccagaggtcctgagttcaattcccagcaaccacatggtggctcacaaccatctgtaatgggatctgatgccctcttctggtgtgtctgaggacagctacagtggactcatgtgcattaaataaataaataaataaaataaaataaaatattttagctggtcttattggtcttataataaggatatcctattgcatacttagagaaacccagacttatacttccagttatacctatttttaatttattttatttctatacttttttgttaaaaactaaaatacaagcagcattatactgggcctagtcaaggtcaatttaatataaccacctaccactgtgacatattgttccagtagaaggctgtcaaggtctttaacatgtataacattcattgtcttcactgttaacagtgccttcttctagaattcttcatgaaaatcccacattactttgttttacagttaaattttgtttaataaatagtttcagtataataacaataaaactatagtacagcagttttataaactagcaacagtcatttatagctagttattttgtatccttgtgcttgctattttttcatgcaaataggatataggaggtttttttaatatcaagattgccacaatcattaataataagttttattctgatgtacataggtgataaattttctagtccattatagtcttcctgggaccaccagtgcttatatagtgtgtccttactagatctgttagacaatatcggaccatgcatgaaaattttaatattttttcttggatgtgggttaattacatggtgtgtgtgtgtagcttatgttcctctgtgtgtacattatatctgtgtatatgtgtgcatgcatgtacatgtatgtttgtgtatatgagagactcagtcttgctatatagaccagttttccctatctttttgggaaccagattgggtaatgtgtgtgtgtgtgtgtgtgtgtgtgtgtgtgtgtgtgtgtgtgtgtgaattttataacaacatacaattgttttgccctgcctgccatatgttaaaatgccatggcaaatactactacagttaatcaagttgcgatgaccttagtgtatatcaaatacagatgtaatgtaactcagtcataagtgatatatagaattatttttggatgagggactagtgagtgatgcacataaatatgaatattaatattgaaaatttatatgtgtatgtgtgagtgactgagagagagagatagatagagggaggcaggtggtgagatggacaggggagttggagaggtgagatggagaggaagagaaagagggagagggtgtgatgagtatgaaaccaagagcctctcacttgctaggcaaatactctatcactgagattcattttgtctccaaatcaatgctgaagttaaaaaataaatattttgtagaagaggatagtttggcaaaatttttgggctttctagttacaaaatcttccaggtagttaattgccaagcctgtatgaggagaccactggaatatttttatatcactttgcacttggatattaatatggcatatgtagcataatatatttttgaataaatattagcgactcttcaatgaccttataaatatgctcttggcagttattctgggggtttactgggcttagaaatttttagttttcattctccttaaagagtaaagtataaaatgatttttaagtgaaaatgttagaagtgttatataacagttcttgtcaaattactttgagataaataaaaacatacagttgaatatgatctgcaaacaatgggagaagtattgattgtaggtggaagatcacatccctttaggtttatattgtttgtactgtctcatatatatacatttactttttcttgttattttatatttattttttatttgctgcatacaaactgagatgtattaagaagaattattttgaaatagctgtcatattttttcattcctcaagcttctcattattctacatttcctctttaataattagtcatataattaatatatttaaaaaattgtcacatattgctgtccccatatacatcaaaatcaacatagtgcaaaagaacatctaatgcacaagatgtaatgtaatgcacaagatataatgtaatgtaatgtaatgtaatgtaatgcacaagatattctatcttgaaaaattgtgtgtcctttattttgtgtgtacatgctctcatggatgcacatgtgttgttgcatacgtgagaggtcaatccatacctttgtggagttagttattttcttctacaatgtaaatgaggaataaaaaatacactcaaagttctctacttcaaggaaaattttacattttactttttgatctgttgagaaacaaatggggcattttacctgtacattaaaaagtactctagtgaaaggacaaacaaaagaatgtttatgaatatagcaatgagggaacagataaatccatagtaaatatactagaaattaagaaaaaaacagtaatagtgaataattattacatgcaagtttctaagtgctttcactccataaaccaatttgatgctctcaacaatgttcctctgaaacaagaaacagagtctctcttacatggctcctgagagtgactgcaaaagggcattacaaatcccacaagactattgttttgtgtggaaattcctgttttatgattttagaatttccccaatgagaacctgagttcctgtagtaattgctctttcatcatgtaatcaattctaatgttatatcagaaagatctatagaataggttctgttgttcattgaaaggtggtggagaaacacaattcccgattagcaacctagattttgtaattgttccactattgttaataatggaattttacctatggccatggtaaagaccatgaaagccagacatgaatttatgatctaagttctttctggtaggattatataatctaatgaatttagagaatttttgttcacaatagtttaaggtactcataaaatgctgttaggatatgcaatgaatttttcatgataaatgaccattctcgaagctatattgatttccatataattacataccttgttatactttagtttattaccaaaacagccccagattttgcataatttaatgaatataattaatgactaactgttctttcctctgataggctaactaatcaggctgacctagactgattctttatattcattacagaatagaaaaaaaaaagctgcaaagtattattttgcatgatagctctggttttctcatattcctatcacaggcacattattaagtttagttgaagcaatattaaaggtgtatttaacataaaatggagatattagagttgaaactgaggaaaactaaagtctatagctactctatcccttttcttgggattgtcagtcaaatgatgtcacggagaaggcgttaattaatattttaagtattttctattttacccttaattgctttatcatttaattaagtaaaatgtggatatgaaaatactaactatcaagcatgttaggtaatgaccagtttccaaatgatctttatacatatcttcatgttggaacatgtttacatttcattatttactgatttgtgtgtatagctaaaagagcagctattaaaaaacttcaaggtcaaatgaagaatcctcatggttgaaaagaaaaaaacatcaacaaaacaaaataaaacaaaaaccagtaactacttaagaattttaatacattatggattggatctgagttcaaatctccccaattcgcctaaatgaccaggtcttcctatgcataaataagaggtaaacaatcaacactttatagatagaagcaagattttctgtatttctttttcagtagctagaatagtgcctagagtagtagctagcttaaattttgattcgatgtctttagatataaagttgaattggattttggttataaaaatgtcaatgttgcttttagaaattagtgaaactcattcatacacaattttattttatttttgagcatttcataaatgcatacaacctatttatttcccctaagatctttcctgatcatcagtctgagcccaacttcaggtcttccatttttaactttgataatttattttttaaagaaattcatacatggatattgcatctatatcccttcaacccctattccaactcttcctatgtcccttctcccaaattcatgaattcttttactgttacttacacacacacacacacacacacacacacacacacacacacacacacacacacacgcgcgcgcgcacacacacacacacacatgcacacacaccctattgtattcattaatttttttcttatatatacatgattatagggctgaggacttgggaatagacaacatatgtgggagctaatccctgagggattctgatttttccctacccatgtagacaaggggtaccagtaactagtcatctagtggtggatcatgtggaattccccttgtacttgttggcatgtcaactattctcattacattgactggattcaagtactcatattgttgagagggaagttgcacctgtgaagtctcatgtcttcctgtgttctttttccttttttcctataacctattatgtccaattagtgccacccatatacacatgggtgtgcagcatccacttcagcatagttagcttacaaggaaccatgtccataaatagaactgactcctttcaaggccatctgccaatagctcacgtagaggtgtggtcttcaggccatgctgtactgttggttttgtgcaagcaaggacagctactgtgtaaattcatcagtccagtgcctctgccatatccagaagaatggtttgccaggtcttcattgaaatctaatttctcttttagtgatattccctgagtattttaggtagaaagacatacatacaggataattgtgttatttggaaaaattattgtcagtatatcaaaattgtgtcctttcttaggtttttgcacatatgatttttacattttgttttctacagtataaacacgatatatttatctactgatcccttaattctcatcaggtaccatgctactatttcacatgcttctatttaccagattccctcagtatgtgcttgccagttgaccttataatcttttaagtttcaatgtgggagattctgactgagaatttaagttagctgcctggctagttcctctgtgctgagctctgtgcttatatttgaactccagtgatgtttgtcttgaacactcttggtggtattaaatcttgatattttttgaatgtagaaatagtctttggaaatagcattttttttgccttaaatttgataaatgagtgactggattgatcaaatcctggccttaaaatataaagcaatgagatgtgtcgtaggataaactatccccagagatcatttcgtcatccaaaaaatgctcttcgaaaaatgtttcagtggtggcaagtttagatgattaaggtctctttgttcaaaagcaaactagactggttattttatactcagattttgtgatggcagtgtaaataactttcatgttgttatctaattgtatacattattttaagagatagaaatattgtagtagagtgcaaaatgacaccatttctgttactgtggaatgtctgatcatttctcagggaaaattacaaaattatttagctcacctcagtttctatagcatagcctctaaagtctcatttctttaacagggccttgtgggtgttctaaaggaatgattgaaatgaaaagaaatgagagagtcaaacagtgtaccgtaatagatgaaatggaaagtaattatgttaatgttgactcattatgaagccctaaccgtttgtacctgctcatttctgtgtggaaacctgtgcagctgagatgctgaataagaaattcttgtataaatgagcctagaggcatgtttctaatattggagctaagcctatacagaattgtaatgaatttccctaagtcagtatttaaatgtgctatcagagaaggtgcttctcttgacagaaattttggattctagtgtttatcatcaaaattttacctatgtgcctgaatcctgatagctgcgtataactctcatttgttaattagaaggaaagaaacccctcaagttgcaaagtgtattgatattatatacagtgttggattttctaaaatatgctcatgtagaaatacttcagataaattacacagaggagatatatgagacaaagttagcagggtaaagggatgtagataagtatagctttgcaaatatgtactctggtgtactttataaggaagcagctgtaaattactcacttggcaatttgaatatacatatacattttatatatatatatatatatatatatatatatatatatatatatatgtgtgtgtgtgtgtgtgtgtgtgtgtgtgtgtgtgtgtgtgtgtctattgctgaagaacatggggtttagagttgagccaacgagatttaaactgcctgtttgagtctactatggaattactgtctcctttccctaaatgcttccttccctctttcattgtacccgaatgcttctctgttcctataacctgttgctcaagcattcacctttcagctataacttaggataaaatgcttctacattttataactcaactgtcctgcctgtattctggaaataatataaaacactttaggatctctctgaccatgttaccctgccagttctggtttagttgagaaaaatgacacattgctgtttgtaattttatgagacttatttttccctatgccagggattgtcttctaaaacaattaaattattaaaacaacgagacacctaatttttgtcaagttatgttcacccttttcttgaaaatgtaattgcagtgaagaatattttaccttgggcatgaacttttcttttatcctgtcaatccaaatgcttttaagtaatgcacttaaatttcattttcccaacttgagtgttgatgcttataacattcttttgtattttgaggtaattaatatcagcttagtatttagtgtcaatcttctttgtttggatttcaatttttagatttttgcattactcccacaagcatgcaagaccttgttatacttgaacagtgaattcttatcatagaatatcatgccagaaggagggtaaaagttttatctgcagcagcatgaactgtctacaagaaatataatgtaaaccacatatgtaatttaaaaatttctagaaaccacagctaagaaataaaaataaatattcaaagttcatgttgataatacagtttatttaatcttatacctccagtacattactatttcagtatctagtcaatgtaaaattactgaaaagatgtatcacatcatttttgtactaactcttcaaaatctgatgtgtattttatatttatagcgtatttcaattccatctagctgcatttcaagtagtaggtttctgtatgtgaccaggggctactaggttcgccagtgtagacctcaagccttgatttattttctatccctggcttcctgatgaaattgtacactaagaatagttctagcacctcgtcatggaggagcgcgtgcttctctagtaaggcattatcagaaaatcataatcttacctgacttcttgactttgtccatgaggactagatcaattaaaaacattttgttttacaataagtttatttttgtggattcctttctagtcaaactttttcttcctatcattgcttgttcattttagggatgccagtttctgttgtttcatatggcgtgtaagagaatggaggtaccatttatcagtaatgatagttctgttgatgtttcttcctcaacaatttttattggctactgtggatagcatttttgtggtggcacagaggctagagggcagattttcagagctgcttcttcgcttccattgtgcactctgaggattgatgtcaggttatcagtcttgtgcatcacgcgcttttacttgctgagatatcctgcgagtccgtcctgtgtcatttcttttagaaaatgtctgctgctcctgccttagtttgcatagagtttttagagtatctgccagtgttttatgtgtacttggaatggtctttagcatggttactttgggaagtggttctgacatataagggatcctaggaggaggactttaagacatttgaaagcccctgctttacacaggattaaggaagttgtggaggaactcagaatgggttcacctcaatagattgttattacaagaaggagattgttttccccttagatctctgatttgttttgtcagtatgatgatttcttctcacatggcctcccctgagctgtcacactggatgctgacccaaggcaactacttggtctgtagctttcagttttctttgtaaacttaggcatttttacataggagtgaacctacacaaatagaatatatttgtttgaatcatttaagctacattctcttgaaagtttagctaatcaaaaccaattgcttcagattttgaacagtaatcactcatttttgtctctagactgaaaatcatccccctattgattggtaatgtgatataggtcctttgctacatgtattttagccacactcccactctctccttctaatttcatgctatgttttattctctattgttaaccttttcatgtaactgttcattaacacaaactggggaaggatttgggaaatgaatggaactggttcattccattgtagatcttatccaacttaaggtcatcacatttttttatcatctacttgtagtgtggaacaataagacatagtccttagtagcttggttgcaaaattcaccttttcactatcactgcttgccctagttttcttccctgctagcaacttcccaccacccaggcacgcagcactcaagtccagtattcctttaccagtgttcatcatttcctccttcacaaactgccttcttgccttaaatcctcttaaaggtacagtctcatccttgcttcccatatagtctcttctttccattataaccatttcttgtattctcagaacacttctgttatagatttcttgttacctgtggtaattctgtatctcttactttttttaatagcaaagttagtaggctggatacaaacaactctattgaacagatctgggccatttaaaataaatgagaattccttcaggatgcctaatttagcagtcccatatgaggaaaatgacacatattaaatgtcaactaggtgtttgcaaaaaggattttgtggagtatttgcaataatgatctataggttgtgaagtgctcccattttagagataaaattaatattggtaaagtgattgcattattcagatcacccatttagtaaatgccataaatcaaatttgaatccaggtgtgaatgatgaatgcctccttgtgtttaaaaatacacatgtaaaggaaaaaaattacctttgtggaagtggaaggcaacattgtctttgctagctggaggagatgataaactcatgacccatattaaagtagaggcacttctacttgacaaccctttcttccttccctcaagtttgtactggtattttcatttttccattttagtaaacattaaactttttagaggttatgattgttactgtactcataagagaaattgttttagtaaaagttgactatagaggtaaacttgtaaattagtaaaaaataaaccaaataatggtattacatttctctctttctctctgaaggcagcatggtaggagagagtgggctaacagcatagtttcatagagaacattggatggattgcaatggatttgtgaaagctttcactacttaccatgtcaataatatgtcgataggaaaggcttttacaaatatctgagaacatttgaaaaggaaaagaaaactagcattgaaatctcaatgcagggagtcctcatatcactttgtgagtttggttgccagagatttgtgatgtaggctggaagaggctaaatcactttgtaaaacgacaatataagcaagaaactagcatttaaatacattttttctttaactccctgagaatatacaactcttcagatatgccaaatatggaattttggtgtttttgcaataagtgctatttcattaattatattatcaagcacatttcaaaactagtaaaggatgaaattcagatctgctctatcagtaagcagataagatgtccatttataattcttggttacatatgcaaaatgaaaatgcattgaagctatttaaatcagcatcagtgtattttttccattatatatgttttacatagttaaagtggcttatttttcatgaaggaaactaccttaaatgtagaatttaaaggtgtgatagtcatgaacgttttaaattattttaatactcgtcattcatttattttcctttttgaaaacaagcaaaccatatttttgattggcctttcgttaaaaggaaagtacataaaatataaatctcatttacaaatgtggatagtacaatcttggctgttgtgagggaaaagacctgaagttctagacgtttattttgtcagtccagttcctaaccacggcactgttgggtgcttgcttgatttcacctgagtttttgagaatatgaagcgaattaataatagaaggtttttttttttgacacacagtttctctcctcccccagggaaatttcctggttactgcagtgagaatgttatttcccatcaatgtactagctctctgtaacacccccattcactgtaaacaatgaacacaacatttattacatgagccagagctcttaaaaagccagcagattttaacattctgcttagaattctgaagttataaagtgtgaaaactaatattttaagatttatcttaaaactctttggtaaggaaaacacatttcttctcagtttgtcattaatctgattttacatgtgggttggtcccacttatcctggaggcagttaatcattaaacatttttagtggcaaaaaactctccttctaaaaagatttttgtcttcctgtcatagttttatatgttttttttgagatttttaaactagaaaatactgtaaatattattggacagaattatgagtttcctccaaagtgaaatgaaagatgctttgctgccatttgtcctttataagcaggacattattaattgatgaccgtgtcttcagagatacttagttacacagcaatattctaatatatattggttccatttcacatagtcaaaacattgacaacatagttgaaataactttagtccttttagctaaacccaaggatacccattggcgggggcagggaactaaaatgaagctattaataaatttcggatatcagccagcttggttgggttttcttttgagtaatttgaaattaaatataggttcaaacactgtgtttgagccttgggcacatacatgaaacccaccggatttaagcaaaatcagtggagcctattgtgtttagcagagggtacacagctaaagacagagatttcctcctttcccaggatctatctatagccaatagtgaggagttaaagtatagggacccttgagttctcctcctcttcattcattgttaataggcctgattttgtgagagtccagtgcagataattgcagctgatgtgaattaatgagtgcaatagttgtctgaagtctagggaatggcatttcttagtccatctccagaacttccagcttttacacacttctcacctctttctcaaggttttttggtgtctctacctggtggctactggtgattcactttagtctcttcatttctaaaattggtgacaatgctttttggccctggcgttcctctgtactggggcatataaagtttgcatgaccaatgggcctctctttccagtgatggccgactaggccatcttttgatacatatgcagctagagtcaagagctccggggtactggttagttcataatgttgttccacctatagggttgcagatccctttagctccttgagtactttctctagctcctccattgggggccctgtgatccatccaatagctgactgtgagcatccacttctgtgtttgctaggccctggcatagtctcacaagagagagctatatctgggtcctttcagcaaaatcttgttagtgtatgcaatggtgtcagcatttggaggctgattatgagatgggtccccaggtatggcaatcactagatggtccatcctttcgtcacagctccaaattttgtctctgtaactccttccatgggtgttttgttcccatttctaagaaagggtaaagtgtccacactttggtcttcgttgtgtgtaaaattctttagcaaagcgccttacacatgtagttactcactgaatagtagggtgtatacatttatttttatgtatttatggtcaatcaaaggccacattttagaaataatatagaatgtctttcccttaggtaaattgtgctgttccactcccatttacctcttgaatatgctcttgtattattttagaaatacacggtttaaatatgttgtaatgctgccttttatctcaccattcatcaggttgactgattagaggacagtttgagatatgtaagaaacaccatacctttcttagtgataccctgtttttgaaaacaaaacagtaataaagacatgtagatggcttactgagcattaacatcttctcttatcatggtatagtatgaggttagtaacctatggaaagaaaacaggactgggctcttcttgcaacttctccaatagtaattttaagtaaaaatggtagttgtgatatgaagatttatcatttgattttaattgttatatcaactcatattttgtcttctcccacattaatctgggttatatgacttaggggtgtgatgcatatagatttgatagggtcttccaaacctgtattttggcgatatctaacaatgtgcacattttatagcagaaattgtaaaggatttttgctgaatcaatggatacagggattgaactctgacaatttgaggcattttgatccttttgaaagtgaattgaccatttacgtaaagccagtcaacattaagcttttaaagtaattttcatgtctgtcttgctgataattctttttacttttcgggtggggtgaaggaatatagggaatagagaaagattatgataaatgcttttaccttaggctgctttgttgaagagagtcttaaagggcagagcctcttggttgagagattcttaaatgataaatgacagtgacaagatattttttctttctcaccagagttttggggatcagggaaaatcagagagactgatatcttaaatcttaactttttaagtgctagcaaaactatcatttgttgttgcttgactatcagaaatattttctggaacattattcactcgtgtctttaacttttggataatggctttctgatttttctttttactatatattttaaaggcatgtaaaagagcttcaattgtttaaaatattatcattatttttctagtttgctcacttatagtcatttcctctgagatgcatattacatgtatagagccaagacttacttgtactattttcttttttcttcaacagtttttgaagtgatggtaataataatattattattattgtaattattttgctatcactctaatttgtccattgtctccattttctcatctgttatttgttaggagtttcagtcaactattaaaatctttgctaatgaatgatagaatttggaataactttgagttgaaagcaaaatatttcaaatattgtcagaacctagttactcgtactagttacttagaacatacaaccatccaaaagaaatataggaatataagaccatttgtattgcttgatacttaagtagcctttcagttcttgtacaaatgcagaatattaaaagaggaatagagttagggctgcagggataacttagttaatagttgctgctcttgcaagggtcccacatttgtgtttcatcacctacatcagataatttgtagccgcttgtaattctagctccaagagatctaccaccctctactggttttcaccggaactgcacatatgtactcatagccaaagaggcacatgattaaaataagtaggtcaaataaccagaaatttcttcgactattttggttatgaggactatgtgtttacactgaattatcctgaagatattaattttgcataaattatttatttatttttagaattttgagggctaagaaggtagaaatgagaaagaaaagtactctaggttgttctgttaatgactcatgtgtgtctatttttctcatgagttgaacagttttataagcaattgttacaagaaaatttaaaaatgttattatagactcaaattaactgcagtatatgcttaaagtttattagagcatttgttttatatgtggaagcattaatcaagttataatctttaatttttttccaccatcaagcttgatttttaggtatcattttatatttttgtctttttcagtgttctattactgagaagaggcatcatgaccacaataactcttataaaggaaaacatttaattggggcatgcttggtttactccatcattgtcaaggtgggaagcaaggaagcatagtagcatgcaggcagacatggtgctggagaaagatctgagatttctatatctactgtctccaacaaggccacatctcctaatccattcttatggaaaccaccacagtacttatatttagcagagccacagaggttttttttttttttctgttttaaactcctaatcatcatagtgtaatttttgttagagaatttgccatttccctttcatttattcacatatattcattttaaagatacttctaagtacaaccattaacatccatgtgttaccatgttctattttaggattttactttccagaaatagctgcaaacccttcttcagtattatgagtgtactactgctcaacccatcacgaaacatttattatttgctatttatctaagtaggtatgacacctaggctagcttaattgcagctaagaatatagtaagcatattcttgattctgtgttttgaaagctcttctgctttgtgatgtctagtgaaggataaggcaccaagcatttatgatacttcatatattctagatttaaatgtttagtgcttacttttgacaaccaagtaaagatctcggtactagctctagatttatttttgaagttgaaaaattgtgcttttaaaatgattatgagtagcttcagcttgtatagttgtgcacaagaatgaatacattacttgtgtcaccttatgtgatatatgaaaataataggtgcagtagtattgataaaattctatttatgcctatgttcttattcatttcaatccatagctaaggcttttccctgatgctagatatttcctctgcatcacaaatcagaggttctaatgacacacaaaaaataggtatagaaaccaacaaaagtacgaatggcttcattcatcttttaaccagttagaggaagtgaaggaaaatacatagaatagtgacatgcattggggaaaaaacaaaaaaacaaaaaaacaaaaaacaacaatcctcaaaccttatttgcctcgtctagcctatcttattgtgttatggattttatatggcaaacttgaaatgaaatgctattagttaaaaagacaaaggtctgaaacaagcagccagcaggcttagaatacaatcttttgtttttccttctgcctcaggtgagtgaaagggaccaaatgaatgcatcgtagcagttttcttttctttaaatatgggcttcttaactctaaaattatgaccctcatttctattttactctgcattttaaattttgaccatgtattttgattagtctttctctccactgtttaagatagctttctcagataattaaaatttttattttttcctcagcttttctctgaaatgctggtagagcatgacttatattcttacttaatcagttagtgaaactacaatgtaattaaactcatgatggaacatgttttatccaaatttgaactgatagctgaggctctaactttggcttaaattgtcaaaatattgccattgtaacgttcttcagattaagcctgggctgtattctgtaacaagacaacaagggccatgtggctttctattctataagtaaatatgttgcataatgaaaacagaataatttttgtatatttctttactgagtatgtattttgattgaatgaacagactgttctaaataagaatggttagtctttgttctcaggatgataaggagtcagatataaaaccaatattcatttgaattatcctaatgcttaaaggagacatgcagcagattagagaggcctcatttgggaggacagagaaggtttccctgaggaagtgatatttaagctgactctttaatgatgagcaaagattagataagcaaagaaagtacaaaaatatttttcagtgtgggagaattagagcttaattttttaaaactatattcaatgaatccgagaagtgagataatcagatctaaggattgaaattgtttaaacattacaagctttagaacatcacggaaatagttgaaatatggcaattttagaacttgtctgagaatcaacctaagtgaatctagatttatttaaatgatgctttgaaataatacatagatgtaaactggctgtaactcgattagaaggaaatacagtaagtagccaataagtagcatctactgtaagaacaaaatgttacaaaacaaatacagaccaaaaccaaatccattaacatatttgcgtatacagtgtagggtataattgctcataatgtgaaagatatttgggatcgtttttgatgcaccatgtctcttcataggatacctactaccactggtcctttaataaactactattgggaacgcagtgtctgatatgttgatacaaatcattcaaaattatttgtcccatatattcacctaataggcaccaaatttacatgtaagcctaggacttaaaaactttccagaatattcaaaagtagaggtaaagatattttcatttctccagtgcttatttaactgttatgacatggctttaaggtttgtggtagtattctaagtagtgtagtcttaattagttggatttatacactttagaagaattaattatttattctttctaatgttaaatgagagagaagaaaatgttgagatgcagaggaatgtataataagctttcagctagtacaaagctgcctgtacctgctcattttctcctttgctagtattcattgcatctctctggcgtgtggcaatggggtgatgccataagaaacaaagcaagagcctttgtatttgaattttcaatatttccagtgaaatgaaaggtatgcacattatcactagacaatgaactggaagcagcacgtatccttttgaatttaggatggttttgttttgtttttgtttttaaattaaggcaagattgaaaagccttgctatttcatttcggatgcatcctacatgagtataatgtgaatgcattctgagagcatatgccatagaacttgttgaaacttctgcaagttcttttacatcatttacggctgtaaattatttcatgtttacagcaaggagtgaacactccagaataataatcagctacctatttacaagaatgttcagaagttctaaatattgcttgaacaaatgatagactaggtttatcgtaatagtgaaagttccagagcaatttccagacataatatctatttgagacagttaaaagacatttaaacgttcatctccctaatagttgccatatatatatacatatatatgtatatatatatatatatgtatgtgtatatatatcaatatgaatatatattgatatatatatctgcaaactttaatgtattaaatggacaaatggacagcagaaatactaaccacacacacacgcacacaaaaataaacatatataatcaattgagtctatgtatcttagttcatatgtatatgtgctcaggaatgaccactatagactgtacaacctgtatagcaactagttcctggaagagactgatttttcttttctaatcagccaccgactaccattaatgaattttaaccaaatgaaacatgtaactgaagtatcagtggtacctcaatttctattgccctttatgattaattgaaaccaccaagataataatcttaagaaatatagttgaagataatgaagctagaatagaaattcaaaatcctgaagccatttgtgctttttacttatttttcagcagaaagtggtaattgtgagagttatgaggataaagtcaacagataactgaatacctacatgctcattgctaaagtaagaagacactaatggcatttctttgtagcaataatatgttgaagaacagtgaaaaagaccacattcataatattagcaagatataaattgatcagaataaatatataatgagatttataaaatctacatataaatttagagcattctgaaaactacaggcatagactacaattctagatgaaagatacaaaaaaactacaattctagatgaaataaatatggggaataagtatataaattttccttaaatttatccaattacaattatagcagaatagacattttaattgaattttttaatttaacaagttttatacatatgaaaaataacaacatgcaaaaatatgtaatgttgtttagagaaccatgcaacattgtaattgagaactcatctgataataagataaatcatgagaaacttttaaaagtatatatatatatatatatatatatatatatattcataaaagtaaatgaaagtaaaaactagattacttttaaatatagaaaactatatcataaaatatgcctttgtaaatgacatacaataatgcaaaaacagataagcattttagtactttctctttgtctaataattttacatggcaaatatttctgaaatttatctacttttccccattctcagtgtttaataaccttcagttccatcatcacttttctattttagcaaatgacttagtcagtgttctttttctatgaagagacaccatgaccgcagtaactattataaaggagcacatttaattaggggtggttcaaagttcagaggtttagttgattatcatcatggagagaagcatggcaacatgcaagcaggcatggtactggggaagtagccgagagttctacatctggatatacagacagcaggaagagagagaaccattggacttggcttgggtttttgaaagctcaaagccagtgacacatttcctccaacaaggttacaccttctcaaatagtgccattaatacttctcaaatagtgccatttcataatgaccaaccatttaaatacagaagccataagtcccaattttattcaaaccaccatagcccaccatgtaaattccagcaaaagccacatatttttccctttctttgggctttgttttcagtttgccttttatatttgtatgaacatgtcactcagtgacttcactttgctagaaatagtcgaaagccattagttggacgttcaagggttttcattcttgacctgtattttttcattagcatctgctttcctaccaataaactctgcctctcaaatacttatcttttatagtaatactatatattttataattctgtttttctttcataataatctttacaaagatgtatctgcattcttttctaatttttttctagtctgtgatgagtagtacttataaagagaaatattaatattaaggctaattaatggacatttttattaataattttcctgtttaaaaaatgtcatttttaatagttgtggtagtgtgtcgtgcttatgatcccgggctttgaaaaactaaggaaggaggatttctgagttgtaggtcatcatagtatagagaagaagacctgttctcaaaaaataaaaaaataaaaataagaaacccaaagccaatgaactgaacaaatatacaaatgaaaaacaaatactgttcttagcttcttcaacaagtgatgacacatgtcattattgtctttatgttcccagtgccttgtacatagatgatactttgtaaatttttgccaggcaaattaacttcacttgctgagacaaaaatataaaagcaatatgtaaggtttatttgtttccatgaaaacaagtgtattatcaaaagatggcctagtcggccatcactgcaaacagaggcccattggacttgcaaactttatatgccccagtacaggggaacgccagggccaaaaagggggagtgggtgggtaggggattgggggggtgggtatgggggacctttgggatagcattgaaaatgtaaatgaggaaaatacctaattaaaaaaaaaaagaaaacaagtgtattataaaagctcatggttaatttgaaatcactaacattatagatagaatatactatatgtccaaggtacttttcttaggactcaaagactttattctatttattatgcaaatttttggtagggataacatattatatataaatacttcagattggttctcttttttaggaccaagatttggactttatttaaactaaacaagtaattcttttctggagaaacaatattatttcacctcttactatttggttaaatctcactttctggccctataatgtgaaatcatatcagtttaaaaaaatgtatgaggtagtttatctagtgagtgtttttcaatgttttagattagctgaaaaagttgttggcacatttagcagtaatgatgcatagcattttgtttgaattgctacaaattagctcgaagatgttcatctctaagttcagtaatttctatgatatatctctcaaaaatggttctccttattgaaatctttgttgcagtaaataaatattcttctccagggagcaatagtctaccccagggaaagagggggaattgattgtcaaatagcaaataatcatacaggaaagcatatataagaaaatgtgtacatacacacacacctttacacacacatgcacagacacacagacacacacatacatacacatacacacacctgcgcacatgtgcgcacacagacacacacacacacacaccatttaagaaaaagatgccatgaatttgaatagagctggaagggtacatgggaggagttggaggaaggaaatagatagatatgtaatcataagtttaaaaaattaaaaattaaatttaagggaaaaagtccctactccatcctgaagtttaactatatctttaggaacacaatttttatcacaaactgaacaatcgatattttcacaagtaaatttgcaaattgctaaaatcagtatttttgaggatgcatactaaattcataaaacatattgtggctagtccatgatgtaaagacttagaagaataatgaaacattgaggacatagtatgtttaatataaaaggatatgcttgacagacacataacataaaagaggaaaagtagaaaatttatgtttattagatgcatgttctcattgaaaaaaactgggaaagggaataacatttgaaatgtaaataaataaaatatccaattaaaaaaagatagagagaaatgggtcttttagagatacaagccctcagccttggatatattttgattcagtgttttgtccagatattgacagttagctttgtaatttcggataagtttctggatgtaatgagctcagtttcttcatttgtaaaatgggaataattattgctttgcgtggcagtctttaagtgttagtataataagtatacatcgagtgccacacaatgcactaaagactgagctgtgtctcaagcagtgttgcatgcctgtgatctcagcacacagtatgcagagccattaggaaggagagtttgaggagatcatggactacatagtgtgaacctatttcacaaatcagagggtgagaatgcagctcagtgggactagttgtctaggaagtctaaggcattggatatgctcccaacatgttgttgataatgataataaccaagcagttattatgatccatatgtggaaaaatatatttggtatagtgtagtataatttgtgtttataccctcaaaaacaattatgtaatatgtaatgaaatttagaaaatagccacttgtataatcaaacagccctatgcaactgactgatttaaatcagctttccattattctacagtcagttaccataactgttgaccaatattaagggtcagttaatattttttttttagttctgctgatgttatatgttaatataatttgtgaatatatatgcttctaggttagtccttgctgttatattcaccgcacttggtaggcaggaactttcttgcaagttcacattttttttttcttaacacataggaccatatcctgctcctcctgcaaactcaactcattatattccttgacactgagactctgataacagatctaatattaatccaaaatatgttccaactttgaaataattcaaggaggctacaggctttgtgttttttgttagattcttgcttttttttttccttctcaaagatgcacattatataacatactcctttgagagtgctgttttaaaagtttttttgaccttaattatactggttagaaatgtcaagatagtgcattaacctactgcgctccagatggctggcttttttttttcctcttgtcttgttatatctaaagaatatgagattggcagcagagcactttaattgatgtcagatttggcagtgtaatttttttcattttatacagtgtaaacatccacttaaaatatgagatgcattgatatattcaataagtttaaactttcattcactttgtgccataatttataaagaatttatattaacaattgaagatttttaacatccatatttttatatagtagaagaaagttttttaaggatgtatatgcattttttgtgttttagattttattgattttctcttttaaaaagacacactacggctataattcatagaatgtgacctacaaaatactttttctattgttattattttgatggagtgggaccgtgtgttcgcttacattccaatccacgacagaagtgcttagatgtaagaattttgtaggcagaaactcatggttggaaatctataaaactaatgccattttatttataatgttatgctgctgtttatattggcatactttcaaatgataatatgtgcactttttatgggtgagaaattgtacttttataaaaattccctaaagattttatgcttaatactagttcagtattcttactcgattgttttctcaagttaggtagatagaggtttggagaaaatacgtttttgtgatattcattgtatatactagttgataactaaaattgcttcttatttaatagagatgaaacatttatcagagaatcttaaataacttctaaattcatcacatttatagggaataaatacaaatgtttcaatttgttaagttaattcagtttcttgaaatgaagcctaaaagacctatttctacatattcttctaatttgtatttagtaacctaaaaaaaaatctggcttcttttaaacaccagcgagaatattatgctattaatacattatttggtttcaaagatgccagtgtatttaattaacatgcaaatttagggactagttggttgtactctgaatttgttatctttttccattgtagtaacattttttaatgtgtcagctcatgtacatgaaaattaaagggcctttctttatacatcatcatattgaatatctttaaagtatagttttctgtgttttttatgtttctaaatatatgtccaactcaaagaattttgttttcaaatttatttatttaatttaaacaaaaagtttacttttattttatgtctctgtgtgtttgaatgcctgtatgtatgtataccacatgaatgcctggtatctgcagaagccagaggcatcagatccgttggaactggaattagagctggcatgtagttttaaagaagtgaactatgtctataaaaatacagcaagtgttcttaatcccaggagccatcttttagccccaccccactcccccttttgaggtaggctctcatgatataaccctggctggccaggacattactatagaggtcttgctaactttgaattcctagagacctgtctgcatttgcctcctgagtgctggcatcaaaggtgtggatatccctgcttgtcttcaaatttgttttttaacattactatataaaattatgtatatccatgttatacagtgtgatatgctgcagaatatatgattaaatgtagctaattaacaaatatattatctcacagttattctagtaagaacacacatctcagtatttttcaaagttatattcaactgtatattttcaaaggtatatttaccatagtctatcatgtcctgaacttactcctcctgtctgtgtagacatgtattatttaattaaatatctctccaatcccttatactctcaaggaacctagcctgtggtaactcacataataccctcaatttctatcatataactttatattgtatacataaattaaatcatgcagattttgtctttctttgcatgcttcatttcagtaagtatattctatttgtattcttccatgttactgaatattagagttttttgagtcattcatttgtttcagagtcatggaaaaggtcctatagtcacagggaagttgcacttcccactccagttctcccctccctattggaaactgtggataccaggagggttttgtgtcgaggtatagtcaagacaaagagggtgtaaagtgaacctcatcttttaacggtggagagtgaccttttctatgtcttgtggtgccatggtatgtgctgggctttctctgcacttattcagaatggtgctctttcttatgggtagttgttagttgattttgtaagaaggagtgaggcacaagaactcctgttctgtcaccattaatttcattgctcaggctgatgctcggtttgacaccatctcactctgtcaggtctttttaaaaaggagggcaagaagtaaatgctgactcagagtctcagggtatgctcttttcttttggtcattttgaacgttattactgctaccgaggaggaagtatgttcagtgctaagcattcaggccttatagttagacatatctgagctctaacttcagactatattgcttatttgtgcagtggccttgctccagttttccaagccctagtttccttttgtgtaagatgcagatagatgacactatacatcagaaggctgcctcctcttggggaacatggtggttttttttttgtttttttttttttctgtctttattatcccagccttccagcccacatatgtagatgaaatagcttggtttcttcaatgaatctcttttcttctaactggtacttttagcacatttgtccttgataactaaacagtcattctttaaataaataaaaaaaagccaataaaattgaaatgaaaccatttttaagtgataagtgattttgtgactccaaattgccattcatgatgtaaacagaccgaagggcagacacttttggactctctgtgcctgtagtgcaatataggatgacccagcggtgccacctgtgtttcatgtctgatctgcagttaaattttaatgagtataggcaatatgtggtaatgtcatttgctgtttattttggtacacatactttttcatactaagattatttcattaggattcagtaatgaatgtttcatttctcagcaaaaataaaatcttagaaaaataaaagtagagcctaattaggttttaggacttggttcgaaggtgatagtccaagtaatttagtttatgctcagtgttatcatgtttaaaaatgaaacagcaaagtgctaagtttttctaacatacctcagaaaccattagacaatgtccaagaattcttaacaaagctagcctgtgctctagtttcattgatgtactagcaaatctccaaacatgctgtgtttgagtttttatatttaagtgtttaatatttgaccaaaataacctagtttgccttacatggttagcacttatttgtctgtgaaattcttccatctattcttccgtctattcttagttctctcatgctctgccacctattatgacaatcttttttctgctcattacctacccgagtgtgagctgtgctatgagaacattgggtattaacttctcaatgttccaccatatctgcaaatgtactaaacattaagtggaaatattagaatataagaaggaccctgtatatacaccataacagatactttgtgttcctgttgttagttcataaagacagtgaaggcctgcattattaatgcggttatatataagtattgtggtcaactcaacttattttttaaaagagcatatttttgttctatcactcatgtagtagcctgctatgaatcacattcaaaatagctgggcctttgaaatttcacagctcaatgggcttaaaactttattttatttaactctagaattgcttttctggaatgactcttctgcagaatatgaatatataaatgtgcaaatgccctcattattagtggcacagaagacagactttaccagttagcccacattttgtacatttcctccttaactagtcaaggtttcctacagactctcgaaaaacttttagtcttttacctatgatatgcattcattgtgtttggatatagccattgtgctttaaaatataattttttattgcagttaatgttaaaatgtaaactgttgtcttttaacttagaatttgctatcacaaactatttttacattctattcagtttaatgactatatacatgtacaaacacacatgtatacactgtgatgcaattgtataatggtaattttttccagtttttaaaaattaaaaaccttaattgatattacgtggtatcttataatctttattttctatataactaaaagactttagtgtgtaagaaacatttaatgtatcaaagttgtagagctcaagactatcaaaaaacaaatatatataacattatcagaaataccataatttagtatttggctcacatatatatttgcgtgatgaattaattagttaaatttcttttaagagacatttttgtgtttgtacggaggtgggaatggtatgtgagaacttaggggaggtagaattataatcataatatagtagatgaaaaaaatttctttaatatcaataggagctatctaaatgttcaattatatatgattttttagtattaccacatacttcattattggaaccaatacctagatttgtatgtgtaggacactttgattttcttacttaaatcatgaaactggtatgggaaatggcttctcagttaggttgttaatgttgtaggatccacctatggaacaacacaagaagtctttgtagatataacgcctaatatcctaacttaaactactgtatttttaaaagctagagtaatagataagaaactcacttagctaaagtagccaaagaaacttgacattttttataaattttttattggttatattgtttatttacatttcaaatgttatcccccttcctggtttattttcagaaaacctcccatcccttccctctgcccctgcctccacgaaggtgctcctccacctacccgaccactcctacctcaccctactatccccctatgctggggcattgagtcttcacaggaccaagggcctctcctccctttgatgccctacaagacaatcctctggtacatatgcagttggagtcatgggtccctccatgtgtactctttggttggtggtttagtccctaggagctgtgggaagtctggttggttgatattgttgttcctcctatggttttgaaaaccccttcagctccttcagtcctttccctaactcctccattgttgtccctattctcagtcctaaggttggctgcaagcatccctatttgtattggtagggctctggctgatactctcaggagacatccatatctggctcctgtcagcaagcacttcttggcctcagcaatagtgagtgtctgggtttggtgactgcttatggaatggatccctaggtcatacggtctctggatggcctttcctccagtctctgctccactctctgcccctgtatttcttttagacaggagcaattctgggttaaaattttgggaagtgtgggtggccccatactacaaccaggggccatgcctaacttctgcatatggtctctacaggttctctctcccctttgttaggtatttcctttgcctcagagaagcttttcaatcttatgaggtcatatttgttgattcttgatcttagagcataagccattgatattctgttaaggaaattttctgctgtgtgcatttgttcgaagctcttccccactttctattcaagtagtttctgtctatctggctttgtgtgtaggtccttgatccacttccacgtgagctttttacaaggagataagaacatgtctctaggtgcatatgtagcagaagatggcctagtcggccatcattgggaagagaggccccttggtattgcaaactttatatgcctcagggagctccacggccaaaaagtgggagtgggtgggtaggggagcagggcaggggggaggttataggggactttcgggatagcatttgaaatgtaaatgaagaaaatatctaataaaaaattgaaacaaaacaacaaaaagaatgggtcaatttgcattcttctacatgcagaccaccagttgaatcagtagtatttcttgaaatgctggatgtttttagcttttttgtcaaaggctaaataactgtacatgtgtgtttatttctgggtcttcaattttaatccactgatctatctgcctgtctcataccaataccacggatgttttgtttgtatgttttttaatcacaatcgttctgcagtacagcttgaggccagggatgatgttttctccagaagttctcttatagttaagaatattttttgctatcctaggttttttgttattccaaatgaatttgagaattgctctttctaattctatgaagcattgagttggaaatttgatggggattgcattgaatctatagattgcttttgtcaggttggccatttttctatattagtcctgccaatctgatccatgagcatgggagatctttccatcttctgaggttgtcttcaagttctttcttcagagacttgaagtttttgtcatacagatctttcacttgcttggttagagtcacacaaaggtattttctgttacttgtgactattgtgaaaggtgtcatttccctaatttctttcttgacttgtttattctttgagtagagtaaggcaactgacttgaggtaatttgacttgcttaggtatgaaatgtagtcaatagcactctcttagtttgcttgtcttttgctaccataaaacactgaacaaaaacaccttggggagggaagagtttacttagatttcattttcttatcagaatctattatgagggtaagtcagggcaggaacatccaagaaggaattgaagccgaaagcatagagcaattctgctgtatttgtttactccagaaagtttgctcaacttgctttcccataccatctgtccagtgcaggtaccgctgcccagacagctaggtccttttacatcaatcaagaaaccatagacatgcttacagggcatgttgggagacatgtcccttacatgagcttctctctctccattgactccagttagtgtcatattgacaaaaatctaactgtactctattgcaattgatagtaattgctatctgtgtacatactgtagttgaaagacctatgtgcaatccagtgaccagagcataatacgtttacaactaagatctctgaagccttttctgaaattaaaagtaaatctgtgttacattgaaaaatgaaagaaaaaggtgtttcaagtcactaaactcagaagtggttatatctgttgcatactttggatattcccattgaacattgcttttctagttttgatattgaatttttatttctgggcaatggaggatgtggctcaatgtaccttttagttctctgtgtactgtcttagaataatacactcatagccatacagacaagtttctacattctagtgattttcaaattaaggaatagcttcaaattaggaaggctttctagtcacctagctttggaatagcatggtgttctctaactgctgactttgtctgcattgtttttaaaagatcaaatgggcacagtggtaattttcattaatctcatacagagcagctaattaaaatttcaattattatccatccattatctagttgttgcctttgttcagtattagatcaggatgttaataataagacattcgtgtattacagcccttttaagtacagtgagatttagtttaatctattgcactgttttgtttcagggttatttctttaatattatgttgtactatattgattatgctgacaatactcacacactttaacattttttttaaaatagagatttcagatttaaatacctgttgcttcagttctttattcaatactgggaaaggttgcatgggaagaatacattaattgtctgatgttctcaatatatatacattagttctgaaacctcactaattattatgcccagttaactattccctggattcttgctttttaaatatgtagtccttgctgtcctagaccttattgtgtaaaacagtctagccttgaactcagagatccaactgcctctgattcctcagggctggatgagaggtgcaccacaatgctctgctgggttctttatttctgtaaggaaaaaattaaaagaatttgtctttaagaatcattttaaccttaacatgctatcgtgattttataatgtcaaacagtaacttatgtttaagcccaccaaattgggaaaaaatattattctataacctttatcagttctttccattccttttaacatctgggtatctagataatttaacttaaactttctaatgttaatcattgtggctttctgcctacaatcataaccatttggaggtctgccatagaaggattgtcagaagttcaaggccagcctgggctacagagtgagttcagagaaagcctatgttagaaagtgagccctgccctcaagaaaaaaacacaaagtaaaagaaaagacaaaaacaaaaataatgtatttaaagaatagtagttatatagaaggttgatttctatcccagcgtccctggtctaagtgtcaataaacagcacctcagccgtgaccttatgtgtctattaaaataattctattaaagttcagttagcaaatggagttaacgtttgtttttttttttttttatctatgataggaaacatataaattcatcttttgaatatctttatattcacttatgtactttcttaataggagatatttattacccgtatgccatgcatgagtgaaatggtttataaagaatggattatacagttttgactgcaaacctcgagatgtcctggttcttaatagctgggtagtattccattatttaaatgaaccacttttctgtatccattcttctgtcatgggacatctgggttgtttccagcttctagctatcacaaataaggcccctatgaacatagtggaacacgtgcatctgtggcatggtggagcatcttttgtgtagattcccaagagtggtatagctgggtcttcaggtagatctatgcccaattttctgaggaacctccagattgatttccagagtggttgtaccagtttgcaatcccaccagcaatgaaagagtgttcctctttcttcacatcctccccaacatgtgttgtcctctgaggctttgatcttagccattcagattggtgtaaggtggaatctcagggtcatttagatctcaacattgcttagatgaggagactccattaaaacacactgtgtttgaaaatgccataatgttatttatatatatatgtctacattttattttactttcaagattcaaaggaaaaaaatgttgtctgtctaaagtggtatcttctatttattttgtagggtggcctgaaaaacagcaaacatgagttcaccctttcttcacaagaatatgttcatgaattacgatctggcatctcagatgagaaacttctcaactgcctggaatctttgagagtgtctttaaccagccatcctgtcaggtatggtttttatcattttgataggattcatacattttgcattttgtatgaatatttggtggtataatcagatatgttacttcaacatcaagatttttccatctagaagtataggattatctaacagaagagcattgtctgattttcaggttctaaatttttaaaaatatgtttatgtgtagctaatctgatctttaataatgtatgatttaaaaatgcagatattttggaatatttattttcattttgattatgtgaaataaatacagaagtaaaatattgacatttacatgttagtctatttatgtacccagataattttcattatttaatttgtaaattctatcctgtttataattgtgattatatataactgtgtatataattttatatctttaagttttatatagactacccacatattttttaattcaaaatagtaaaaactattttaccaataaaataatgaaatagaaatgattaataaactaattagtattttatacatcattaagaggcattttcttggtagcaatgaattggcaaataattcttcctttattgacagtaatgggccttaaaattagtaatatccaaaataatattttatgaagaaaaatagatttcagtataatattataatattcttggatctacatactaaattgttattgtcttaagctcagaatttccttaaaaaataggtatataatgaagctttgtaattttattcatgttccctttatatttatgcttagatccagttcctaaatcattgaaaataagttacatatcagtcatttaactgagcttaggtatagattctaatatattgtttatttatattcatactatacttggaaaagtttgaaagttataatttcgtagtacagagttaagttgtgggtttttttttttttttttttttttttttttttttttttttttttttctttttttttttttccattttttattaggtatttagctcatttacatttccaatgctataccaaaagtcccccttacccacccacccccactcccctacccacccactccccccctttggccctggcgttcccctgtaccggggcacacaaagtctgcgtgtccaatgggcctctctttccagtgatggccgactaggccatcttttgatacatatgcagctagagtcaagagctcaggggtactggttagttcataatgttgttccacctatagggttgaagatccctttagctccttgggtactttctctagctcctccattgggagccctgtgatccatccattagctgactgtgagcatccacttctgtgtttgctaggccccggcatagtctcacaagagacagctacgtctgggtcctttcagtaaaatcttgctagtgtatgcaatggtgtcagcatttggaagctgattatggggtggatccctggatatggcagtctctacatggtccatcctttcatctcagctccatactttgtttctgtaactccttccatgggtgttttgttcccacttctaaggaggggcctagtgtccacacttcagtcttcatttttcttgagtttcatgtgtttaggaaattgtatcttatatcgtgggtatcctaggttttgggctagtatccacttatcagtgagtacatattgtgtgagttcctttgtgattgtgttacctcactcaggatgatgctctccaggtccatccatttggctaggaatttcataaattcattctttttaatagctgagtagtactccattgtgtagatgtaccacattttctgtatccattcctctgttgaggggcatctgggttctttccagtttctggctattataaataaggctgctatgaacatagtggagcatgtgtccttcttaccagttggggcttcttctggatatatgcccaggagaggtattgctggatcctccggtagtactatgtccaattttctgaggaaccgccagactgatttccagagtggttgtacaagcctgcaatcccaccaacaatggaggagtgttcctctttctccacatcctcgccagcatctgctgtcacctgaatttttgatcttagccattctcactggtgtgaggtggaatctcagggttgttttgatttgcatttccctgatgattaaggatgttgaacattttttcaggtgcttctctgccattcggtattcctcaggtgagaattctttgttcagttctgagccccattttttaagggggttatttgattttctgaggtccaccttcttgagttctttatatatgttggatattagtcccctatctgatttaggataggtaaagatcctttcccagtctgttggtggtctttttgtcttatagacagtgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacatgataacaaccagttgtgccagcaacaattgttgaaaatgctgtctttcttccactggatggttttggctcccttgtcgaagatcaagtgaccataggtgtgtgggttcatttctgggtcttcaattctattccattggtccacttgtctgtctctataccagtaccatgcagtttttatcacaattgctctgtagtaaagctttaggtcaggcatggtgattccaccagaggttcttttatccttgagaagagtttttgctatcctcggttttttgttattccagatgaatttgcaaattgctccttctaattcgttgaagaattgagttggaattttaatggggattgcattgaatctgtagattgcttttggcaagatagccatttttacaatgttggtcctgccaatccatgagcatgggagatctttccatcttctgagatcttctttaatttctttcttcagggacttgaagtttttatcatacagatctttcacttccttcgttagagtcacgccgagatattttatattatttgtggctattgagaagggtgttgtttccctaatttctttctcagcctgtttattctttgtgtagagaaaggccattgacttgtttgagttaattttatatccagctacttcaccgaagctgtttatcaggtttaggagttctctgttggaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtattggccttgaattcctgatctttccagaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattaagaatttttgcatcgatgttcataagagaaattggtctgaagttctctatctttgttggatctttctgtggtttaggtatcagagtaatagtggcttcataaaatgagttgggtagaataccttctacttctatcttgtgaaaaagtttgtgcagaactggagttagatcttctttgaaggtctgatagaactctgcactaaacccgtctggtcctgggctttttttggctgggagactattaataactgcttctatttctttaggggatatgggactgtttagaaggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttcctttttttctagagcttttagatgtgttgtcaagctgctagtatgtgctctctcccgttttttcttgaaggcactcatagctatgagtttccctcttagaaatgctttcattgtgtcccaaaggtttgggtacgttgtggcttcattttcattaaactctaaaaagtctttaatttctttctttattccttccttgaccaaggtatcattgagaagagtgttgttcagtttccatgtgaatgttggctttctgttatttattttgttattgaagatcagccttagtgcatggtgatctgataggatacatgggacaatttcaatatttttgaatctgttgaggcctgatttgtgacctattatgtggtcaattttggagaaggtaccatgaggtgctgagaagaaggtatatccttttgttttaggataaaatgttctgtagatatctgtcagatccatttgtttcatcacttctgttagtttcagtgtgtccctgtttagtttctgtttccatgatctgtccattggtgaaagtggtgtgttgaagtctcccactattattgtgtgaggtgcaatgtgtgctttgagctttactaaagtttctttagtgaatgtggctgctcttgtatttggagcatagatattcagaattgagagttcctcttggaggattttacctttgatgagaatgaagtgtccctccttgtcttttttgatgactttgggttggaagtcaatcttatcagatattaggatggctactcctgcttgtttcttcataccatttgcttggaaaattgttttccagcctttcattctgaggtagtgtctatctttttctctgagatgagtttcctgtaagcagcaaaatgttgggtcttgtttgtgtagccagtttgttagtctatgtctttttattggcgagttgagaccattgatgttaagagatattaaggaaaagtaattgttgcttcctgttattttagttgttaaaggtggcattctgttcttgtggctgtcttcttttaggttattgagggattaccttctttttttttctagggcgttgttcccgttcttgtattggtttttttctgttattatcctttgaagggctggattcgtggagagataatgcgtgaatttggttttgtcgtggaatactttggtttctccctctatgataattgagagtttggctgggtatagtagcctgggctgcagtttgtgttctcttagtgtctgtataacatctgtccaggctcttctggctttcatagtctctggtgaaaaatctggtgtaattctgataggcttgcctttatatgttacttgacctttttcccttactgcttttagtattctatctttatttagtgcatttgatgttctgattattatgtgtcgggaggaatttcttttctggtccagtctatttggagttctgtaggcttcttgtatgttcatatgcatctcattctttagatttgggaagttttcttcaataattttgttgaagatgtttgctggacctttgagttgaaaatcttcattctcatccactcctattatccgtacgtttggtcttcttattgtgtcctggatttcctggatattttgagttaggatctttttgcattttccattttctttgattgttgtgccgatgttctctatggaatcttctgcacctgagattctctcttccatctcttgtattctgttgctgatgctcaaatctatggttccagatttctttcctagggtttctatctctagtgttgcctcgctttgagttttctttattgtgtctacttccctttttaggtctagtatggttttgttcatttccatcacctgtttgtatgttttttcctctttttctgtaaggacttctacctgtttgattgtgttttcctgtttttctttaaggacttgtaactctttagcagtgttctcctgtatttctttaagtgatttattaaagtccttcttgatgtcctctaccatcatcatgagatatgcttttaaatctaggtctaggttctcaggtgtgttggggttccctggactgggcgaagtgggtgtgctgggttctggtgatggtgagtggtcttggttcctgttagtaagattcctccgtttacctttcgccatctggtaatctctggagttagtagttatagttgactctgtttagagattgttcttctggtgattctgttaccgtctatcagcagacctgggagacagattctctcctctgagtttcagtgctcagagcactctctgctggcaagctctcttacagggaaggtgcgcagatatcttgtatttggacctcctcctggccgaagaagaaggcccaaaacaggacctttctcagacactgtgttgctttggcagttcccaggtggtacagactctcacctaagcagactaaattcctaagttccttggagtcccgggaccaagatggcgaccgctgctgctgtggcttaggccgcctccccagccgggtgggcacctgtcctccggtccggaaggtggccggctgtccccggcccacacagggtgctgcctcagcgcctctgtgcttctgcctgttccagaagctgtcaggttctctggcgcaccctctcacctgttcagactaatttcctaagttcggcgggtcccggaccaagatggcgaccgctgctgctgtggcttaggccgcctccccagcgctgggtgggcacctgtcctccggtccggacggtggccggctgtccccggcccacaaagggtgctgcctcagcgcctctgtgcttccgcctgttccagaagctgtcaggttctctggcgcaccctctcacctgttcagactaatttcctaagttcggcgggtcccggaccaagatggcgaccgctcaagttgtgggttttggttgtaagaatctgtcaatggctgctttcttgacatttgtaaaatggtgtgctttaacggtttttataatctcattcaaatatttgagatctttattcgtttttatttctcacagtctcactttgtagttctgactagcctggaactcacaatatccctgaggctgtccttgaatgtctggtaatcctctgccctgtcctgatcagtgctaagccaccacacccagcatgaatatgacttatgtgagaatatgacttatgtgagaagtcgattctcacccactggcacctatatcaatatcagctgcagtgcccttccatattaaaatactcagttacaaacatactgttgagcagttgaaatgaatataaactgggtatactgaattttcagctgtgggagggtgggcctgtgagatttcctgatggtcaaagttggccagggcaatggtgtgtaaaactcattaaaccaagccattaataccaaaccaaaagtaaagtcccatgaaggctactacttgggattatggatcagtggttaagagagcttgctgtttttccagaagacacctgctttcttcctagcaccaatgtggaacagctctcaaccaccagtaacaacatcttcaagggatcagactcccaattttgacctctgggatctctctctctctctctcccccctctctcacacacacacatgcacacacaaatgcacaaacaaataaaataaccacatcccattcaataatggagagattagtatatgtttttcctagtccaaatgcatctttataagatataagatagtgcttgatattatatatggaaggtgtttttatttttctagactatttattctttttatttaattttgttgaagcacggtctctctgtgtagccaaggtctctctgtgtagcatagcccagactgtcatggaactgtgtaaacctagtaggcttcaaactcagatatcttccagcctcagctctcatgagtgtatgagttaaagttgctggacatttggtacagttccctgttttgcaattctgcctagcaacaaaacgtttgtgaaagaggtatttgtgatcccacgagagtttgggagcttaaggttagcaaccgcccttcctggtagctgattggctgcacaggaagtgtgaagttccttgtgaggctgggcaccagcattctgcagtatccatcagtggtgtctacatctgtgttgtcttgggagttagtcatcgagctcctatgaagaagtcacaccaaaagacaacactcttagccacatattgtgtggagatctaaccctgtcaagtcatcaaacctccccaagtccttgagaaataatgagtaagggcaggtttgggagtgaagacagtgtctttggtggtgacggggctagtggagctagtagaagccatatgagcaatccagagctcggatgttggggtttcctgactggaatatggaggcccaacacacacagcattgtgttatgttaagccagtgctaagtgccactgaaattgacagtgtgttcaagattaggtcatttagagttccctgggtctccaacatgaggatgatcatggaggctgaaaaagcttcatagtaaattgtgtacaaaattaatgacatgacctcaacggctattgagggcaggcaggctttggctaaaaggagatccaagtaggatctgattcctatttggaatgtatgtcaaagtgcttggcatcctgcagtcctccgagggaaccagatgagtcaagatcttgagcatctgcatcctggaaaatgtgaacaagctgtccacacaccctggagattgtagatggccattcattgctgtatcaaagccgtgcaggcacagccacagaacgcccgtccacggcccaggcctgagtctgccagggtttccagggtgtctgctcttaacttcatccctgtggaggttctgcatctgattggagagtatcctcaccaggtgggaaaggctatcacctagattcgaacagagctccttggagttacagatgatgccatcacacaagtcatccggcatctgagtaggaagggacacgtatatcccagcctggatcgccagcacctacaagtttctggctgagaaaaaagaactgactgtagtttcggaggatgcttctgttctgctgttttgataattaggatgtatcgactatttcaaacaaaaaagaaaaaaaaaaaaccttaaagaacaaaaaccaaaccaaaactgaacataattttcagatgacatctgttagcaacatgctatttctacctccattgaacttgtgtgttttctgaagatatttgaagaaacagtgatggaaccaatgactgggctttgtttccaaaacaataggaatgccctagggtggatttgtaagagaaaacaaatttgtgctcaaattagaattttattttcctgtttcagtttatcttagtcatgttaagttttcctaattatagtacatgataagtgtagctttactgaaaatgagttctgattttaaatattcacttcaagttattttgagtaatttagttttattaacattgatttgtttctttaaaataagatgctactgtagattgaggcaattcagtctctttgagacatcttcatatactttttttaaacgtgtaagttcagtggttttgctccttcagctaaattacagttcactttccttgcatggtgtatggacacaagactgcatgtttgttgtactgctgtgttacctacactattggatggtctaccagatgtaaaatagggtgttttgcttcaaactaggcatattgttccactaacaagacgtgaacagagatgaactgtaatgtttttattaaacctttgcaaaatttcaagtttcctttgatttttatccctcaaatttattagaaaaagctactagtttaatgttcttaatggttatcagattttattatgaggtgtaaatttttttatttttaacaccaagcattatattttactagtagtaactcattttaatttggttatattaaatgtgagaggcttttaagccattgatcattaattcctccattacacatatagtaaaaatggtgtatttcaaattatttgcttagctaaattagaagaaagaatatagttattctaggaatagatatgtgtgcctatttgtattcagacaggtagaaaagaatctttatccttttcaatcattaaaaggggacacaaaccctataaaatccttttgctgattagccatcagtaatggttttagaataacaatcagaaaatgttggcatctcattaaaataattactaaaaaatcttgcataagaccttgtgagtcaatgcttcttcccctttaaagcaaattataaatgctttaaatttttttagtttattttattaccttttaaacaattctttattttatacatctaagcaccttgtatatgcttgatggtcttggggatcattagagagcatcttattccctggctgcagtgacagagggttgtgaaccactattgggtgctaggctctctaaggtatctcatccctttgaccctttgctgttttcttattgacaaaagtaagcggagttcagaagaattatttgtacgggcttttcattagctcttgctccagtgtgtggaaatgagaaagaagccttcccaggaactgattggaacagtagagggactcctgttgtgtggtgagcagaactgtcagcataccattgaacactgacctcctccatgggctcttaagcaactccatattccaactgacttgattgacattattattcctggggggagaaggccgttacattaatgaatgacacaggaagtatcatattcattgtgatcaagaatcatgaacagataacgaaatagttttcttatgttgtaagcataatttattattattttagcgaattagaaggaaattaggtcattctatgtactaattttatccatggtgcttagtgcctacctgagtaagttatacctgaggttggtttgcattctgtgtggtagtgggcttgtccttggggaattcccatggtgatcactacaatgattccctgtgctccttttttttttttttggcccagaaatccctttagtagatctttcatctctgacatcttggagcaatctagcagcttcatattgctggttctccctatcagatatttttgaaaaaaatatagtttttaatatagaagaaattctgcattacttctttctaaaaccattacctttcctagtgaaaatcacactggaggaaaggcaattaaggacctgctttccataggttcgtggtgctgaaagaaatgatgttgaagataaatcattacattgttataacacctaatataaatgcagaaacctggagctatggatttgctatttatgactgtagctgtaagtcactcttgtaattgttggatctgattcagttggctagtgacaggctctaatttttttcttcctagtctggtactattatctacagaaatatggctccccccaccaacactcaaccttcaccctaaagttcttttcattttggatgctaacctgatattttgtctgggaactaatgttataatatgtacccttcaataaggcagctagctaacctttctcttaaatgttgagggctctgccttcccatatgtattccttaagattcttttagttttttgtttcatgtaacattttcaaaggtaattttcaactgcccagctacaaagtgcatattatttcaattttgtttatagtggtaatggtttttccaatgttccttttccttagtggtcctgtttatgaaccaaaactgtagggataagctatatattttgagatgatatcttcaactgttagccattgtaataaagaagtctaggaacaggagggaggctgagatgataggccattagccatgttaagatagtaccagaaccttggtagtttgtcataagcctcagttaactcaggtgcagcaatttatgggaaaatcagtctttggttcaaatattggcattgactctccagtaatagattatttgtgtttactacatgttttttttgttgtccagttcagattttattagagaatctcttgtttctatttgttattattttggcaaagcctttcatacctggctaccatatctagcttctcagcaaaagtacttgtcatgctaggggcatccatcgctaatcaaattagaaatttattgtctagaaaggaagcagcagaaagtatgggccacagttaattgttctagctctacctcctgagagtgtggctttgggttctgcttctgcaaatgtggtgagctttttaggtaccaatcagcacactgacttgaaagttagtgcatggaaaatgccatcaggtataagataccattgatttatcatacacatttagtatatatgtttcttgtagcatgcaattcatacaagtcttgttattacaagttgtgaccatgtaaacaagggagcacagtactaacatggagtgtatgccagatactatacaaatgcatattttgtaataagagaagaaagaggaaacaccataccctcatattaggataaggtacatctatgaaactgtctttccttagcaataagctattgtttaaatttcattaaaagactatttttgaggttagagagatagtttaaaggttaagtacattggctgctcttctagagtacccacgtttaattatagctctcacatggtagctcccaaccatctgtgtatctccagtcctggaagatccaattccctcttctgcctttctccgataccacatgcacatggtatgtagacatacacacagaacgaacatacatccacaccaaaaataaattaaaaaccaaacattgttcctgtttaaataaatgctctcagcttacttttaaaaataaaacaaaattcatggtgaataaagcacagtaaccacaataaccacaaatgaaagaaatgcaggttattgttacttttatctgagattcataatttctgttccaagaaaaaaactgatatagaaggtagtagaaggaaacaagtctattccaggtgaagcctgagcaaatgcagatagaacctctcctttttagatctcccatcttggagaaataagacagtataaaggaattttatggccatagtatatgatagtgagacattagttggacaattcagagtgtgggcagagtccttatgttcagatagcctgtctggtttcttttgtttgtttgtttgtttgtttgtttgcttttgtttttttgttgttgttttttgtttgcttttatttaatgttttttttttaagttgttcactttacatcccactcactgccttccttctggtcaccccctcccacaatccttccccatcccccttccccttctcctctggtctggtgggaccccttcagtatcctcctcaatccaacttggcactttacgtctctgataggctaggagcttcctctcccactgagatcagacaaagcagcccagctagaaaaacatatcccaggtataggcaacagcttttgggaatagtccctgttccagttgttggaaacccacatgaagaccaagctgcacatctgctacatatgagcaggggagtctaggtccagccagtgtattggttggtgattcagtctcggaaagtctcaagggtttaggttatttgactctgtgggtcttcgtatggagttactatcccctttggggctgcaatcctttctccttgtcttccatgagattccctgagctccaactactgtttggctgtgggtgtctgtatctgtctgagtctgatgttgggtggagcctctcaaagaacaacatactcctgtccctttcttgatcttgatcagatttatatcttaaatcctaaagcagcatctacattttctcttaagaaaaccatctttcataataactggacagggtgaaaccttatggacaatgccatttgaaatggacaaattcaaaagattcaggaaaggatagccatcaaaagtaaatacaacacgatggcaaagactggaagatagtcttaaataaaagtctcctatttatcaatacatatcaatttttcttcttaatattatgaatacatttattgttatgaattacttttatatttacaggctaaatatggtttctgcctaccctttaactttagtaatatgataaatctatgtagtactaaagatatcaggtaatgttgtcccccatttagaaccaacagtaaagattttactgtttttaagttgagtgtatagacatgctataggaaatagttctttcacattctgaacagtttctacattaaagaagtctaattgtattcctttgaggtgtcagtattcactctatagtataccatagaatacactttttacttcaaccagggcaaaaccatcttaaacaaggcaactttgctctctagttccttctactttaaaaggcttagtcttcctttctgaatctaacaaataagcaaacaagccagcacaacaaacaacaaattaatctccctagtggatagaaacaaatatgtaaatgaaatcagtgaagcaacaacaaaaaggaaaccagtgtaaaagtaaaccaaggaccataataaagtatgtgaattaagttatatacatagaataaatagtacatacaaagataaatcaatttgagtacagtttattatgtagccattaaacatcccctgaaattagggatcactgggtgtcattcttttaatctcttatggcttttatagcatcactacaaactgagttgtttaaaagagtaaaaatttcatctcgcacagtcaaagaagacagtggtttcattgagcttcctccaagaccccagagaaggctctttcttgtctggtccagctcctagatttccttggtttgtggcagcctaagtccagcctttgcttctgaatccacatggtttctttatattagactacttgtctatcttttatgaggacattttaattggagttaggggctgatctgatcctgtagaaatgttactgtaatgcctattttataactagaaacatactgttttcaattaaagttctattctgaatttgttagtagataatgttcagtctaccattattatgcaaagggacattaaccttaaatttttgaaacatcaaaataaaagctcagttaattctaggaaatagcattaaatatgtcattaaaactggaaggaaaatataaaattttgttgttttagcctcctttatgaaagtgcactttgctggatttgttttttcttatttaaaaaacaaaaccaaaaaaacccttcattttatagttacaaattctgcgagctagaattttatatggttgagttagactggaatgctagccatgaaattggatttctgttccttatgttctcactaagtcagtgtccttgccatacacctcagttactccatatgcaaatgaattgaacacttccaatataaatctccctatttgatattttcctttgcttattttcacgagtctcagaattaacttactatctaggaattattttataaaggtaggtaattctttctctacatagttagaggcatttttagccattgagtatttattttgtttgctttacccaagtaaagaatgtttgcttgaatgtctgtatgtgcatagtgggtgtgcctcatgcaagtagagaccaaagagggtgtcagattcttggaactagacttatatatgattgtgatctgtaatgcggataatgagaagcaaaaaccggatactctgcaaaataagcaagcaagtgctacctgctgagccatccccccaaactccagattttttaatgtttttagacaatgttttttaatgtttttagacaatgtgatggcgtggctggcttggaactcattatgtagacagggttagccccaaactcacagagaaattcaaccatgtgccaccatgcctggcgtccattcttcagacaattttttaaatgttgaagaaagaagattctattactttcgtgaaattatgaattgaatccaatgtttaaaagaacccaggatttttcctcttatgtctgactcccattattaacagaaattatagcagtttactttgtgttcaggatctagtttctttttttaaaaaaatcatgcacacacacacacacacacacacacacacacacacacacacacagattttactataagcatttaattaatagatattttaaatatttaatggaatcaaacatttcaaagttatatattatttagttactcagatgataaaataccaagaaagtaattcaatgatattattttctgctaaaggcaattgttgaaaatgttcttttgttagctatagttagcttgccatatcacaaatcttttactgtgcattccatcatcatgtataatctataatagtttcatgttcatatgtctgcttttctaattttaattttactctcttctgcagaagggacccacttgtattcttatttgtttcataatagttgatactgtgtaaattatatacaaaaatatgtgatttgttatggatattgacccaccatcagtaacaattttgcttctcaagtagggagaaatagttttcattactctgacaatattttatccccatgcatttgtagctggaattagagtaagagaataaaaggaacatcttctacagaggagtagaatgtgttagcgtgattgaactgtattcctaagttttagacagcattgcctcttaacacgatagacttttttgtgcttatgaatgtgtgtgtgtgtgtgtgtgtgtgtgtgtgtgtgtgtgtgtgtgtgtgtgtgtgtgtatgtgtgtgtgtgtgtgtgtgtgtgtgtggttgtttttcaaggcagggtttctgtatgtagcctggggttgacctggaatttacttcgtaaaccagtctggccttaaactcagaaaaccactttccactgcctcctgagtgctgggataaaaggtcaccacctggcccaatagacttttgatagtttcattgtctcttaatggaatgcaaggtttataattctatttaatactctaaaaaaaaatccatgcacttcagcaatagaaaagcccagtgtgtcatcacatgttacattagactgtgatttagattcaatagtaagttgcttatagacttgtgtttatatgctcttcctaaagtttttaaaaggaagcaatgcctgctgggaaatgaccaatgagtttggaaaatttctccccagtcaaaccattgtaggatacatagatacttggcaatatatttcatgaagagtcaaagaaatgtgaagaaataaagcctgtcagagttgtttctcaaaacatgactagaagaacaaatcttatattgaagaatagtataaagatgtaagagctggaggatcgggggagggttgtgtgaaatattgatcatgacttggttgatgtgttcatgatcacatgttacctgatgttacctgcacaagaacagtagtagaacaagccattcaaaattgtagcaggatgggtaggtggctcaaaaggcctaactccttgctaagaagctattcacagtttatagctacaaggggatggaaagccacttttcttcattgatgtgacctgcactaggttatccatgtttcagtggattgtctcacagtcatatgcacatagccagcacaaattgcaatcagtgggatataccatttaaaacagaaaacatgaagatttgacagaaagtgttctgggggatgtcagagaagggaagtgagggatgtgatcaaaacacattgtatacatgtatgacattctagaagaataattaaacatattttaaaagcagagcatgatataattatgattgcatagaaatgtttttcatagtttttattgaaatagccttgtagcttgagggatatgttagcccatttggaaagttttcttctgatttgcttagtatttagttttctgccaaacacaaggcaaaatgtctgtgctcacttccagcttctttagtaaatgttatcacatctgtgagaagaggaaaaagaaattctttcaagtttacaaatataaagttgtctcgggcatattttttcttgataatttctttcacatagatttaaacatgttctctagcatattaattaatatacgtttaacataatcattgtaatgaaagtagctgactctcgacagcactacaaattagcaacgctattattttctcaattatgagtgttaataattatttaaatggcttgtgttaaactttttaaaagcttggcaacaacagccaacactacttagagaattaatataaaagtaggtacagatcaatactcttagaacactttacagggagttacctataaaaatgaaataattaaagcaagttttatgatgtagacatggaaacaggacttaaaaaacgtaagtaaggttctgaaggtagcattactagaatagaattactaaagcaggttttaatattgatgtcttgagtttgtttgctttaaatttctagtacatgacttattttagaataccagtattgcagaaaataaaatgctgcagtcattgcgactatgctaacttatatgacttctcttcaaatcttggctaactttatcatttagtatcaaacatgtgcagattaatttgacaaaactaccttaaatattaatagactttaaatttttaatcatgaactattaggttaaaatgcaatttttgcttaggcacactcagcatatgttataatcgaaggaaaacagatctttgtgtcctatattagttttaaaaagaattaggcacactcaatgctgatgaagtttttgaagtattgttttaatgggcgaactacagtatacattaagatgaataagatgaatagtggctcttgtgtttgcatttgtttcattttcacataacatgtggatcatgtaaaaatccatagtcaggtttttcatttaagtgatatttgaatctatatataataaccatctaaaattgttagagaatgtggttcattcccaaaagtctggtccttgtggcataacgatctgagtataagtactttatacagaagagttataggtagcaacgtattgcaagacagaattttgtacctggcaaaagattatgcatttgttatttaaagggagaaggccagcttccttgttatgaatgtggataattttattttatgattcttttaaaatggcaggtactgcatatcacaattgaataaattttcataaaaaacagaatctccatgaatgattttttttttcttacatagagccaaggtcattatgtttctacacagacctacagcaatagtactagtttgcagctttcctatatcctaccctgctatgaaggtgtattgtactttggcaatgcctgggaggctctcccccaggcatatctatcatctcagctacacgtttgataggagctggatagctgacaattcacaattaagatgccagctaacacctaggagcgccaagtattctgtgtgcttgttgagagaagattcatgtgcactagacaacagcagttgctcagtgcttctagctgttttactaatggtagataacacttaattcaggagagattgtccacccatcactaagtctttatgctcatagcctttcacatcagacaatttcaacctgaaaaaattgtattgagatttaattgatgataggcaaaattgagaagagaacaggatgttagaatgttcttttacatgcaaacaagcttcggatgaggtagtttagtaacctataacatgaatatgagtttaaagccttctttcatttcaaaacagcctacatctaaaggctagatttgttctgtaaaatccaatgttgctgataatattcatattgctttcagcccctgcactcttctcttctcccccccccctttttgtggcctatatctcttggttatgagtagaagttgagggcagattgtttaatattgtactgaaccttctttgatgtcaagctacctaatgaatttctttgagacccatttttaaatcagttgttttcaatattcatttatgaaaaggtactgacgtattataaacatattttcaaaaattgatgttatcataaatttccccatgtgatttagtatttgtcacagaataaaagaataccttgaaataaattcagatctaaatctgtattagacattaatggatttttctttcatatagaaaatgtttaagaagtttgtagtgttttgaagcccaggattaggaacattgattaaaaatgaaataaataatgcttttaaaatgagtagacctcaaccatgggagagactttaacctccagacacactaagtttgaaagtattctgttagactacttattcatcttttctttctcctgggaacagtgttacggtcagtcgttgtttcacttgtattaatttacttatctactatatttttaacttctaattgacaggtactatttttatatacttacagggtaggccttgacattttaatacatgtatgtaatgtataatgatcagatcagagtaattgaaacataaatcactctgtacacttatcaaatttttttgtgctataaacattaaaaattatctccattatccattatgaaatatataattaattggtactcattattcttttttattatttatttatttgtcacgaaatagaatttatttatttatttatttttaattaggtattttcttcatttacatttcaaatgctatcctgaaagtcccctataccctcctgaccctgctcccctacccacccactcccacttcttggccctggcattcccctgtattgaggcatataaagtttgcaagaccaagggggcatctcttaccaatgatggccgactaggccatcttctgttacatatgcagctagagacacgagctctgagggtactggttagttcatattgttgttccacctatagggttgcagacccctttagctccttgggtactttctctagctcctccattgggggacctgttttccatccaatagctgactgtgagcctccacttctgtgtttgccaggcactggcatagcctcacaagatacagctatatcagggtcctttcagccaaatcttgctggcgaatgcaatggtgtctgcatttggaggctgattatgggatggatccccaggtgtggcagtctctaggtggtccatcctttcatctcagctccaaactttgtctctgtaactccttccatgggtgttttgttcccaattctaagagggggcaaagtgaccacactttggtcttccttcttcttgagtttcatgtgttttgcaactcgtatcttgggtatcctaattttctgggctaatatccacttatcagtgagtacatatcatgtgagttcttttgtgattgggttacctcactcaggatgataccctccaggtccatccatttacctaggtatttcatgaattcattctttttttttctttctgggattaaacattttaactattattttttttaattaggtattttcctcgtttacattttcaatgctatcccaaaagtcccccatacccacccacccccaatcccctacccacccactccccctttttggccctggcgttcccctgtactggggcatataaagtttgcaagtccaatgagcctcactttgcagtgatggccgacttggccatcttttgatacatagaattcattcttttcaatagctgagtagtactccattgtgtaaatgtactacattttctgtatccattcctctgttgaaggacatctgggttctttccagcttctggctattataaataaggcttctatgaacatagtggagcatgtgttcttattaccagttggaacatcttctggatatatgcacaggagaggtattgcgggatcctccagtagtactatgtccaattttctgaggaaccgccagactgatttccagagtggttgtacaagcttgcaatcctaccaacaatggagaagtgttctctttctccacatcctcgccagtatctgctgtcacctgaaattttgatctttgccattctaactggtgtgaggtggaatctcagggttgttttgatttgcatttccctgatgattaaggatgctgaacattttttcatgtgcttctcagccattcggtattcctcaggtgagaattctttgtttagctctgagtccagctttctctgtgatcctttgcttgtgggctcctgtgaacctgagattctaggtgtgtcagagttcttggcagtaaagttcctctgagaccctgaaatgttggtgtgaccagctccttttatcctatgatcctgttgtcaaagatcctgggcgtggttcagtgcctggaagtgatgtctcctttgaatagggtggagctgtctggtcagtggtcctaagattgcatggaggtggagagtcctctaggaaccttgggggttgtctgccgactctgggcccaaggtgacctgatgctggtgccaactggaagggacttgtcaccctggtcaggccaggttttctcactattcttttttgttgaacattggaaatcatttatcatattgtctgctagttgaatgtattgttttggaattattagcaagtaatagtaattcacatgttgattccactattcactctcacgacatttttttttccttccaaatgaacctagttgtcaaaaatatacagttgtagaatatttgattttgaacagcaagaaccagttctataaagattaaaatttcagtcccgtgactatacatttttgaggaagcactatgaaggctactagataaatatgaattaacaaacagttctcttaggattcaagggacatgttagttgcatactgtgagtgttcatattatatgcatgatgctggacttttcagtttgtgagattacaacagacttgaaattacatgaaattatttaactgttatatttaattctaatccttgaactatctttcaatttggaaagttcatttttcccatcatagttttaaatctgagccctgtgtgtatgatctggaatcatctttgacagtatacttcatctttttttttattaatcattttatttgtttcccgatcaatgttatccccctacctcgtctaccctccgtgtgcctcccactgcatgcccctcccctttgtttctaagagagtacttcatcttattcgcccttcttttcatttttgatcagtcacagagctttttcatttcattgttgaactttggtacagaccttggtcctttttgaaagagacattgacaaaggaagaggctggtcatacaaaaacaagaggtcagtgcatttgtggaaatttcagtttaatcactgtaagtaaagcaaaccataaagagaaaatgaagtaaggaagtttagctgaaagtgatgggatatggtagcctgcaactttcttgatggtaaagccatctgataggccaaacaaggactgttagttccatcctaaaagccagtactacacattctccagacacttaatgcattctctatcagaacacatatcaatgagtactatagttttcaaagttattttaaaatatttatatttaagtttctgtgttttgataatcccatgcggtaagaaataaaagtaggttttattttaggtgttttattttgttatgtggatggtggatgggataaacaggatccctttatgatcctcctgctgtatatataaattacagtgtatagaatactatgcaacaaaaagtctatatttaggtatctctactgttttttttattgtatgatagaacaaaaaaataaatataaagaagaagccttacagattttgatttatgcatctaaggtataatttacattttgaaatgaaaacaacttgaaaaattaatatcccctaattgttttggggataatactaggaattaaacattatatattgatttatattggctgtctgacctcccattctccttctctttctccctcccttacttttgagacagaatcaaacctaattgtctatattgtgtttgacttgattccatgttctaacccaggctgaccttgaacttgtgatcttttggattcaacctgagtggcatggattttaggtttcttgcaggaggcctggcttaattgatgattttttacattagttgttgataatgagcttgaataggaggaagctagcaattgaaatatgctagattctgattgtttttgctatttgataaggatatgagaaatgtatatttgacaaggatacgagaaatgtatgtctatgatagacaggtatatgaataagtcatgtgggtactataaatatgtacagttttcaacacttaaaatacaatgaataaaaaattatttaaccatatgcattcagacaaaaatatagaatctccagtttaccccccagttttaagtagatatatttaaaataaaacataaagattaacacagaaaaaaccagaacttcctacctttaaaaatcatgttctcagtaaacaacatttacatatgaaaattcagtccacagagaacacccaaagaaatggttcttttaagaccattatctatgtgtagatatcctgtgctaaaaatatctgtgaacattaaatttgtttgatctttgtctacatagcaatcatcatctataatgagttgttaattgcatggttttcacattgtacctgataggtgagaaaaaaggttgcagttctgttctgtattcatcaaagagcaattgtccttcaactttccttacccttcttaaattgcgagaaacttcttttaccacttgtttattgcccagaaaaatcagatagcaaaatacacaaattgggttaggaaaaggagtttgagcctgagttttatgctaatgatattgtttttcacgaattgcattcaaggacttcttttctttatgacagataaactctatcagctctgttttcattttcaggattttcagattaggaatctgatttcttggaataaatttattttaatataattcaatggaatcaacagaaattggatgtcctgtggagtacatgatagaattttagctatattacttagcttaagagaataaaccaatacatttttttttcctgtggaagttaacattttattgtaaatttgaatggttatgtcactaagttatcagatttagcagctgtcctaaaataattatagttataatttcagacatattaagatgtaaagtatgactgattttggcttgaatatgtggaatgcatttcattcttgcttctctcctatttactgtagagtgatgagtttttttttttcctttttgttcacactgtacatcatttatcccattatagaatatgactttgtattatgcttttataacaactttaaaggcaggagtggaggagaatattcctcactgcttagcctgttgatatttaaaatagatacagttaaagctatttccttgactatctcaagagtaatttaggcagtataagaaattgattttaataaataggaacgtgttttctgagaaaaaaattatagttaaacttgttttgtaaggagctatttttgtgtaacttgaggtagtacagcagtgcagcatcttcttataacagtgtggaaaagaaatttgtttttatataatattatcatccttaaacgaggcatattttctcctcttgaaagtgtatcaatcacatcagacatagcaggatcttgctagtgaacttgatggagagaatgaatgcagacacagagaaagatggcatgtcttctttgggaatttctatggaaattgtaatctattacagcactgaagtcaaaacctctgagactcaaatctggaaattgacacattcaacctttttgtgaatcagtccaaataaagttttcagcaagtgtcagcttcaaagcttatgcacaaatgtctggaaatgccagcactgtatcaaatagtcatattataattgctcaggtacagttcatgcattaaactatgaaaatgaatcttctcacggaattcaaatatctagtactattttgttgttttatatagacaaaatgggtatatatcattctttatattttatttaaactctgtcagatcatacatatatttccattgtattctttttttttttttggttttttgagatagggtttctctatatagcccgggctgtcctggaactcaccttgtagactaggctggcctcgaacaaagaaatccgcctgtctctgcctcccaattgctgctgggattaatggcgtgcgccaccatgcctggctctttttttttttttttaactttaacatttttttgatggatgtatattttgataggagggcaatcatgaagctaatttacctgaatagaacattctttaaaaatggtgaaacaatgaaacaatagtattaaaattagatggttttgtctaaaacttacaaaaagttcacacttacaatgttgttctaactctcttgaacagcttgaattatttgtttcatgtgctgtaatggttgcccactttctgaattccccagaaaagttagaagtatcagtgtagaactttctaattttaccttgatttcttttgaaaggttgctagaaatctagagaatttaatcaaattgaacatttgatcactgtttccttttatatttgtgtatttatctaatagactcctcttttcagcaaatattaaggctatatttcccttaaatgcaatgggctaattcaaaacataaatatatatatttttggataaaatattaaggtttcatgaaactgaaagattttttttttctcggagatcttgatgctttagccttggagaacataatgtagaagaatcttgctttcttttttctttttctttttttctttttttttttttttttttttttttttggtttttcgagacaaggtttctctgtatagccctggctgtcctggaactcactctgtagaccaggctgacctcgaactcagcaatctgcctgcctttgcctcccaagtgctgggattaaaggcgtgagccaccactccccagctagaatcttgctttcttttggatttagtgtcaaatgaaattttttcctactacgtaatatttcctttcctttgatcatgtcaatcagtatcaagcaagaccttctaaaataatgacatctgaaattcagaaaacttggagctaatttttactttaagtttcaatatatgtcatttaaaaaataaatattttattactttttgataattttatacattatatattttttattcaccctatctccttccagatctacttttaatttctatacacacccaactatgtcttcattgttttatttaaatcactgagtctaatttgtgtgtgtatatactcttgggtgtgtagccatccattggaacacagtcaatatgccagtggctgtatcattaaataaaacaaagaaagaaagaaaaagaactactcttttccaggcaggtatcaattatcaatagccctccagctccaggaggtgaacttcatgcctgcatcccccactctatgcagtgattttttttgtctatcttgagatagaataagtcccagctgttgtagttcatatgtgtagctgctatactgtgtcttgaaaacaccatttcattgtagtaatctgctgcctctgacacttaaatttttccaactccttttctgagatgattatctttgagctttgagaggaaaggttgtgatatagatgttatagttaggaataagcatgctatagtcttatattccttgccacttaacaagttatagttcatatagttatgtgttaatcatgtactgcaaaatgaaacttcactgaagaaccttgagagatgcatttatttgagtataagaatttcattgcgcgttggtttaatagtaagtccatttagcaggctaatacaagtaggttctcctctaggtcctaaatgacccatctagttacaggttcttgatcctgataatggtgccatttgcgccatgcatattgaagattcagcctcaaatccactcatgacattcatacgattttgtactactattttgccagagtggtggttataatagcttcagtgttcacagacttttgtagtatgtatagcaacgtccaggactttgaaagctagctagtagtagtgaagtttctagatgaataacagtttgacttctctgtgctcaatggctcaaaaatatggtgtcttgtccttgattttagtgagattgattttagtttctctgtatttaatttggtgttgactgttggttggctatatattgcttttattatgtttagctatgtgccaggtattcctaatctctccaagacttttaacgtggatgggtatggtagtttttccaaggctttttcagcatctaatgaaatgatcatgcatgtttttcccttgagttcgtttatatagtttattacgtttatggattttcatacattaaaccattcctgtattcctgggatgaagcctacttgatcatggtgaatgatgattttgatgtgttcttggatttggtttgagagacttttattgaatattttgcattgtattcataagtgaaattggcctgaagctctctttctttgttggatctttttgtggcttaaatatcggagtaactgtggcttcacagaatgaattagaaagttttccttctgtttgtattttgtggaaaattagaggagtttggcattagctcttctttgaaggtctgttagaattctgcactaaaacaatctggccctgggcttattttggttgagagtctttaatgaatatttctatttcctaaggggttatgagactttatatagtttacctgatcttgatttaattttggtatgtggtatctgtctagaaaatcgaggttctctagttttggagagttgagacttttgtggttggttctgatgaatttttgaatttactaagtttctcctatgtattcattttcatttctgattttgttaatttggatactgtctttgtgttcttttgataggttttttttttaaaggttttatctatcttgttgattttctcaaagaaccagctctcatattgttctctttgtttctaattggttgatttcagccaagactttgtctaggtctggactatagaagccgaagaacaatcaaaggtttgggttttaatattttagaaaaataaatattaactccgtctgcctatcttatatatttgtttttccattttgtggttacaaattgtatgtaggtactgttctcaatcctgcattaagagaacatgaaaaacaaatttcagcctggtgttggtgttgataatatgtaacctagtttcttatgagtttccagcaggaggaatgcagtttcatagaatacaaaagcaacaatgtgagatctacacatgcacacatactcacacacacacacacacacacacacacacacacacacacacctaaatctgtgtttattctcctgtaaaattcaggcattttaacccatcactggcatggctcacaaagtataccccattgatggattgatggatgaaatggtgttctcttaattgttgaataagcattgtgaatgccaatgccattaacatatattttcttcttcttcattcttcctgaatagctttcttgctcaaatttttagtggtaatttcagatagactctggatctctttctttagcagtacttcagtgatttcttataagactcaggacattaaaaatctataataacatggattgtaatgtagtctatataaatatatgaactagactgtaaataaagaaggcatttattctgtgtttgtaggtataaactcagtgtacttttgtagcaatcatgaaatcttcagtgaggtattggaaaaactgttaggtaaatgttatataaaaatatgtagtggttctgttgagtagaatctgttaaattacacatcacttgtgttaattgtgactgagtaaaaaagaaaggaaaaaaatctgattatagatgattatggaagttaccaaatagcattcttcgtattttttccttttgtattattctctgcttttgtgtcccttacatctttgtcatctacagtgaattggaacttatattcaggatgagataatatggggtcatttatttcttaaagtgcattccccaagttagattttatataccattatcaaatgtattattatagttttatatgcctcaattactattctataagtgttgcaattgatatactttataaagcttgtgtcatcagcttgacttctatcctagttttgtatcctctggtagtaaggttgtttttggttgtggggacagtgtataccatagtctagagttgttctcagcccatgtctcacttccaaaagagtgcccgtacttcataaagaaaaaaaacccttttctatgccagtgattttaaaatttaccaagcactacagtcacttttaatcacattcaagcatacttggctgccatctcatctcccctggggattgattctatagttctgtgtatggccccacaatttgaattattagcacattcacaatgatattgatggtgctggtttgaggtacataattagagcaacacttagtttgggtgttatcgttttttaacaaacaaacgcccagtcttgaaacttggccaacatttgttttaattaaagctgtttcatcctgcctttttttttttttttgtctttacatggttttgttgcatatgcctacctacctagtgctacgaatgtcagagagaatacagcaagaagctgtacattgcttgatgtccgagagagaaatggagttggcaagaaaaagaggggaggggggatatttattgaattcctgagtataatcagggttcactgtgtttagttcagacccctaccaccaatcttcatggggtccttttctactgtgaaaactgcagtctctatgtaggttactcttccattatccagatgcattctcagctcagacttcttacttcctaatttgtaataagtaaacttgtccttttacccttaagtttcagattatgtatgtatgtatgtatgtatgtatgtatgtatgtatttaacactcgagattttttatctcatccattccaccctctgactgttccacatcccaaacctcatcccagtcccctgtctccatgaggatgtccccaccccctcccttcaccccaccagacctctaaactccttggggcctccagtctcttgagggttagttgcagcatctctgactaaacccagaccaggcagtcctttgctgttgggggcttcatatcagctggtgtatgctgcctggttagtggtccagtgcatgagagatcttgggagtccaggttagttgagactgctggtcctcctacagggtagcccttctcctctctttcttccagcttttccataattcaaccacaggggtcagtagcttctgttagttgggtgtaaatatctgcatctgacactttcagttgcttgttgggcctttcggagggtagtaatgataggtctttttttttttttttttttttttttttgagcgcttcatagcctaagtaatagtgtcaggccttggggcctccccttgagctggattccactttgggcctgtcattggaccttcttttcctcgggttcttctccatgtccatccctgtaattctttcagacaggaacaattatgggtcagagttttgactgtgggatggcaaccccatccctcgcttgatgccctgactttcttctggaggtgggttctgtaagttctctctcaccactatagggaatttcatctaaggtctctctccctttgattcctgagagtctctcacctcccaagtctctggtacattctggaaggtcgtcctacctcctacctcttgaggttgcctctttccattctttctgctcgcccttagggcttcaggccttttcccccacccaataccatatcaggttcccctcttctcctgcttgtctactttccctcccaggtgcctccctctcttcccccttgtgattgctttcttctcccttccaattgagattgaggcatccccatttggacccttcagcttgatgaccttttgagttctgtggactatatcttgggtgttctgtacttttttttttttttttttttttttttgctaatatccacttattagtgagtacataccatgcatgtcctcttgggtctgagttacctcacttaggatggtattttctacttccatccatttgactgcaaactcaggatgtcttcattcctaatagctgagtagtattgcgttgtgtaaatgaaccccatttaaaaaataacaataatcttttaaaataacaataattttcattgaatgaatccaaaatgctcttaaccatctgtttttaggtagtctggcatttgtgggtgactgatttcaaatgaataaatagaaatcattctcttttgtcatacactttcccagatgaagaaataatcttgataatttaatagtgctgggtataaaggaaacatgagtaatatttataatcaaatataatttctaagcattaaatttaaagaactccatgattttttttccttctcaaatgtcaaagcagatactgaaggctgtaaatacaggtttggttagactcctatgatatgaaggttgctccatgctatttttctatgatcatatttatagatttctctctcggatagattcaatactgcacattatatttagaactgatatccctttatcattgtaccactaagtcactgattatttttcactgaatcattgtgaaaatagctcattgctttggatgactacatgccgaaaacgaatagtagctcactgccagttatagtgacagtaccatactgaattcttctttcattatggaaataaaagctatattcatttaaaatgactttccatacaattgaggatgtgactggttctaattatcggctgttttaaagtataccttcttcaataatctgatgactctcactgataatctgattaaaatattttttttgctatgttgatatgaggtggacatgttttccattaattttgtatttctttgctattataccatgatgaaggcaaaagataggaaagaaatatttattggggccctacagtttcagagggatataattcatcactgtgggaggctagcaaccgtggtgctggagcagtagctgggaggttacatcctgattcagatcctgaagcacagatagctaattgggaattttgtgagcatttgaaatcccaaagcctgccccactgtgacagtcctaagccagcaagccacatcacctcatccttcccaaatggttctattaatgaaggaccaaattattcaaatatatgagcctatgggagccaggcttattcaccaccagaggaagtttaaatactatggaatacataaacacatggttttaatatatggagtatctgtggcatacatgacctcagtggtatagtgcttgcatggtttctgtgagggtttgtattctctgcttattgttgcaacatttatatatgtatgtaggtagtataaattctaatgactattttacaaccttctgtgtacttatttaactttgtgaaacatgattgcctattcttttaatccaaattggttctaaatttaaattagtaaatatttattgtttacaaatatgtcatatattatatgtaagctagaaatatctgagaaaatatagtatatttaggagatttaaaatacaaatgaaatgacaaggtatataataaaagccatgacagacattaagtgataagattatagagagaactgtatcttgggtattctgggcccccgagatctctcaaacattggaccaccaaccaggcagcatacaccagctgatatgaggcccccaacacataaagagcagaggactgctgggtctcagctcaatcagggatgacccatctaaccgcaagagactgtaggccccagggtgtttagaggtcatgtggagtggggtatgtgggtggagacatcctcgtggagatagggcgttgggtaggaggaatgggatgtggaacagtttgagggtggactgggggggggggatgaaatctggagtgtaaattaataaataagtaaaaaacaaaaacaacaacaacaaaaagattatagagagatttcttaaagaattacccaaagatttccagggtatgcagagatcactaatggttaaaaatagtcatttgatacttggaggcctcaagagatgatattgtggttttcttcttagaagaaagaataaataaacagagaaagttctgagagaagtcttgcaatgaccatttgtctgattccattgcaaatgtgctataaaacctaagcctggaaagataggttagactctgagaatgtcaggataagggatcattgaggcaatttcagtggatattgggactgaagaatgttgtgagtgttcagtcagatatcttaaacgtaaaattaataaaagaaatcaaaatatagctacatagatcacccctggaatttttcagccatgttaagataagctaatatagtgttaaaataggttttagcataaaccgtgaaagggacagaggggcatttagaggaagcatggtagaagttgaaacattcgtaactagatacccagtggtttagtgttttcacataagtgatgtgtaatcttctgctgttttttcaacctaactaatacattccttcctacagagttgatggaacattccaaacacagtgtttaacatcttagcaatcagttttctgattactcattacagttctatctatcttcagtgtttttttcaggtagcatcttatcatcgaatctattcctggccacatagtagataacaacatcttgccctttcagttgtttaacaaaagttgtttgtcttcattgctccaatgcactaatgtttatataaattgttacttattcattatctatctctctatttgtaggtagtaggttacaagagggtaagggcttagttatgttgcccattatacctatgttgcatacatacttggtacctcatagatactctgcacctgtttatgaagtgaccagaataaatgaaaaggtgaaagagaatggcaggtcaaacaattaagccagtatttcaagtctgagggaatcaaagggtaatggtgttattaagggaatattgaagagtggaggaggagttgatttgtgaaaacagaaatagtgcgagataaatttagctcataaattctgacttaagtatgtgaagctggtgcaatatcttatgcagtgcagtataggcacgaggaaaccatgaagcaaggtttgggatttagatgaggatgtcagggtcatgtgcagagtctagccttttatcacagaggaaaaagataagagcaggaaggcaggatatcatatttgaaaaccgaaattttatttttcaatatctaatatgctaagcatggaagtgacttatatattctttttaattcttagctgggtcaacaactttggctatgaaggacttggagtcttactggatgtgctggagaagcttctggacaaaaaacagtaagaataaacatgtaaaacctttcacacagggagaaaaggacatgaaacctagtatgacttattttttattacctatttaggcaagaaaatatcgacaagaagaatcagtacaaagtcattcagtgcctgaaagcatttatgaataataaggtaaatgccatttacttctccctctgctacaaaagggggctcttgcttgacactatgtaagtaagcaacaaaaaaaatagtgggtacttattctactttcagtaatatgtttataatgcagattacccgagattttctttaatgggctttcaaggtgtattttgcttcacataaaatttcaggtgtattttttaattatgtcaacagtattaggttagctctcatattagatgatatatttttcctttcatgattatgaagttttctttattttaaaagatttatttttggtttgatcctagcctttaacagctgagccataatccatagactgagagaaattaggcaaagagaaggtctctaggttgggttgtggtatctcccttggaagggtaaatagtataactcattttcataaaaatgcctaaagcagataaactacaataaagatatttagttaacagtgttcaaaagcaacaaagttataaagtgttttccagtatcatgtttatattaccattatgggatatctcatatttctaacacattcatttctgaataaacatgccaaagtttgttactctcagggagaggttgcaggctggaacaatccctttgttttcattacgtgttatttttatttggtttgcttattatagtctacagttactcacttctctttctatcacaccaggatggctttgaaacttaaataaaaatgccatggtgaataaactaaaaaaaaaaagatttatttatgtgtatgcgttgctagataaatttacatacagcatgtgcttgcagatacccattgaggttgtaaaaaatcagattccctagaactcaagttaaaggcttgagctgcttaaggtgggtactaggaattgaacctgtgttctttataagagcaatgtgtactcttaactgctgtaggatctcttaatcccaagtactacgaaaatttaaatgtcataatttccatatagataacaaaattgtattatatacatatggaaatttcaagggtagggataagtttcatctagctttctgagagtgttatgagactgagatgtattttggtgttgaatcactttcagttgtttattatgcataaaagaaatctatggaggatagaatgaatttttatgtatgtataacattttttgtattatacaatattgtggaaacatacagataaaacaactgactaatcagtttgcttaattacataatgtcctttagatgatattttaataatctcaaagtacttaatgcaacactaattataacaatgaccagaaacttactaaatgtaaagtataactattagaaatcaatgcaataatattgtatatttaagcaatatataaaaacactctttctttgtcttgtgtgattatatattactgtctgtatcacatgcctatattaaccagcaaataatattattggtacatgcagtatggaatgagattgttaatgaaatccttcatcacctcacttgtactgatattttttacattgaattatgtataggtatgttgcacagatacatgtgtgtgaaggtcaaagtataacttgagggagtcacttctctttttgcaccatgtgggtcccagggatcaagcttcagttgtcaggcattttattgagtaccttcatctcctgagccatctcactgacccatctggaaatttctaatagtgactcccatcagttctagtacagaatttctgtacatctgcgcttttgtaatttagatcacacatgtcatggcatctaattccaaacagcaatgaacttaactgaacattgtttcttcaaagctcacgaagaatctctttctgaacctaacaaaagtagtaagtttatagaaagaaaacacagcacccgaagtcagagatgcagttcatgttttgccattcctcagtagacacagcctttgaaaaataacttagcctctggctaatcagtcttttcctctataaattgagctatgggagcttttgttctgtattcttattgattcatgttgtcaactatcatagttttataagataacaactcattataattagaatagtgactatagaaagttatgacagtaggattttctatagagccctattcccacaggtagtactcagatatgctaaggctcactatttttttttttcttatctgtttggcagttttgaagaacatgatgatttaatttaaattattctaaacagaaatttttgttactctgtgtttatgagttgaaaatatatctttgccacgtgaataaatgagtcctttaaattataagcatgggaaacaatccatacaatagaccttctgaatagaaaacacacagtgatatattcattttaagttggaatacattttccaaatcgaggaaagtaaatctcatgtgaaatgacttaaatgttatttttttggtctttgaagttgaggttatttacatcagaaaccattttacagtctgaatgttcccttatttattcagacccacagttacagtcttattaaaaagtttagccaggccaacttttcccatagaagttaaattaagaagcatcatgctgttcatatgttatcttgtaatagtttccaatgaaatgcaatgttgccatggagctgtaaaatgaaacaaacttttaatgagatatcagaaatatactttgtgagacaaaggtaaaatacattaaattaagttactataacttaatattaacttttgtcttgaaagtttactaataggcagttgtgagtgcatgtgtacacatttggggtcattcctataaaataactgatactgatacttctctgcccatcttcctgtgatatgtaaggaatcccaagtgctatgtccctgagtccctgatgcttgttactgcctaagagatgaggtatatggtcaagttaaataagggaagcttcacactgtatttgtattactttgactaacatatagtatacatgagagctttttagcattttggctcctctgtgtaccttaattttcaatgcaaatatattggaaaagttaaccccaaatcccacactttgctatggatatgttatgacataaaaatgtctttacaaagtatagtcaatatgtgttctatacattcttgtttgttaaacaagtattgttcccatattatctgaatattaaaaaaaactttcctgaggaataaaagaaatcatttttcttgaagccacaaaaattctaagttgtactcatttcaaataaaatagaaagaataactgcatttgaggggaatttccataattaaatatagcactaccctaaagatattgctttttgaattttctttcattttgggtttattttaaatgaaaactatattccatagacatttaaatgagagttcttttgtttgttttctttagtttggactacaaagaattctaggagacgagagaagccttttactgttggcaagagcaattgacccgaaacaacagaatatgatgactgaaatagtaaaaatcctttctgctatttgcattgttggggaagaaaacatgtaagtattgatatgttctatcttttacgttgaaaaaaaatgacacctgcaaaattagtatttttatttctttttggtaacttgaaaaaaatagtagatcttagaatatttttgattgacatacttactttatatttatatttatattattttacatttcactctttggatattgtatattccaaacttgttaaagaattaatttaagtgtacacatggaattttgtcccactaaagccatcattagtcaataggaaatgtgttaaaaattcaaaaagttactttgggaaacacagggtagacacacaggacacacatacacatacatgcacaagtacatgaacacagtcaactcactgggtgttgtaaatttttctagaattagagtcaatgctattaagttttaagctatctctccacatcccaatttgacttctttaatcgaatcagctacatgcttttattttgtactgttgtgctattatattttatcttgtatgttaatatgaaatgaagttccctatgaaaaaaaagcacagtataatttgtagataaatagcatgtgtgaaaaagagcatgttaaataatacatatattacatagttcatagttactctgcaagaggggtcattcaaagcattgtcttacttattacaagtatttgaaagatttgtctatttaaaaatatgtgaaaattgcaatgccctataaaatatcaaacactaatattaaaatacagaatgaactatgattacatgtatataagaagtatttctcatttctattttctcttgttttggtttacagtctagacaaacttttagggggcatcactgctgcagctgaactaaataatagagaacgattttcaccaattgtggaaggcttagaaaataatgaagccttgcatctccaggtgggttttattttcttatgaattatttgaagagttgttcaactttttggactacctgttattacaccaccttttagctgacatttataaaatagactataaagcacaattacttgtgttaatccaagttttttatttttcattttaagtcacctttattatgcattattatcactgataccataatttcatatttattgggaaatcaaagccttagcactaatgtggactaaagcgctaatacctcaatcagtactattatctgaccaacttaatagagcttgtaggcttttgtggaaatgtaacagaatagtcaggtatggcggcaaaacatttaagcattcagttgtatgggtcagaatttgatatcaaagtgctttttctgttagtgtatctaccacttgatgctccatgaagatcatcacttaaagagattttcctactgtatttaatttttcacgtcattttataataagtacatgtaaaatttttctgcttgatgtgaaacaaacaccatcgattttattttttattgtgttataaaatattggcattgagccaggtgtggtggcacacgcctttaatcccagcactcgggaggcagaggcaggcagattactgagttcgaggccagcctcgtctacaaagtgagttccaggacagccatggctatacagagaaaccctgcctcaaaaaatcaaaaaaaaaaaaatattggcatcatttttttcacagttagaaactttggcagagagaaagagagacagacagagagagagacagacagagagacacagagagacagacacagagagcctgtgggattataataatgtttctttggatattttaaaagtattttacttctatgatgagtatgtcgataaactttttatagtatgcttcttatgcatttgtgtttttaaaattgagatttccccgtagtgttttctaatctatgactgagttattcatgtttttatgttttgtctcaatggactttcatactttgtaaggaaagctctttttgatgtcttctctaatgttttgtccatgttgcagtgttggctgttagatttttttttttttttactgccagacacacatataataatcttgaactttgcctccaaagattaggaagactcacacattttatttacaatctaagttttcattacatttggaatagtttcccatatatggacaagtacatttacattgttcaaaaaatcttgaaatggaatttcagccacaattctgagttatcttcagtttactaacaagggaactgaattgcaagcaggccacgtaatcaatcctcttagaaccacacatcccttatgatttagaatgacggcttgaacttatggctttgggatataagcatctcgatatatattgtatgctcattatagtagcacatccatattaacgtgccattgtcattgtagaatagtttaccccagacaatgaaacactgctgacattctctggccttcatggtgctgcacagaatagaatgattaagtagcaagtgtttaacaagtaccatatggagaaattatagacatcttgctaaatattcaagaaattgttgaatactgattacagatgcaaacatatgcaaactacaatttgaaatttcctattttaatgagctacaaaatttagtaatttattatatacagagcctagtactctcctaagaattgtgaagtaggtttattaggcatatttaatgtgaatgaggaaatatcttctaaaagttataaaatatgttcagaatagtgaaattaaaaacaaaagttaaaatctgttgtttaaaatgtaattcgtgttgtattttaacggaattacttttctattttggtagtatcctgagacttcttattagaatgtcatgaagtaattctgttaaaatactgaactaattatattttaaagtaacttcttacagatgttttcaagctcaactatgataggattttcattattttcagtggttgaagaaacaggtcgacgataaatcacatccacacatgtgctctcttcattgcctttccttctgcttatttgcactgttcagcctcccacactttatttccttcacttcaacttatttacagttgctggcctctcatcttccttttcatttcatagtactcatctctagaagaataatctatatttattttctctgttttctaacttccctctcacaactgagttttctcacagttccaatattaaaacaacaaaccccaaaactttaatgatggtctaatttcaaaatccaatgatttcctaagtcgtggctacttgtcatcattgatcagcatgtcctccttgaaaattttgttttctttgcttctctgggcgccattctttttgcttggcctctgaatactccagattattctgtttttagtgaatttttttcttgcctttccagggacattttgcctattttctatcattcatcttcgccaattatcattttacatccatctacttatacattgatatatttatatgcattagcatttctgtgctcacaaatatacaggtttatcttctccatgcatattttcactgtagcttaataattaactgatttcctgcaaatcacctgataaatgtgaagggcacatttctctccctactcaaattcatgtctttgatgtggacccctacaagttacaaatttaaaatatcctttttaaatgatataccacataatattccaagcaatttacatatgttagctcatttaaattctcagcaaatctgagaagtatagaagtagtacccaattaagcgatatttgaagttggccttgagggagaagaatgtcactgatactgtgctaatagagaaacaatatccaaagattctgggagggaagcaaaacttgtaataggtgaaaatagaagctctatccatagtctgtcactgaattttcaaaagaagatagaagacaatacagacatccatttgtgtggatgtgtgtacacacatatacatatattcaaaaatttgcacaaaagacttgtctttccattgtaacaagataaattctgaattgaagtatcccttaatttttcagtctgtttcaaagttgagtaacggtatttatttttgcagtggtataaaaagcagcagctttggcatgagcgatcaaaactttgtaaatgcctcttctcttcttacataatactatgctcctcttctttttcttctgttttatctcctttgttctttatttttctgattgcaagagtttattttattttacaaattagcttttaaaaaataacgataaatctgaggagaatggcaaccctgtaggaggaccagcagtctcaattaacctggagcaccaaaatctctcaaacactggaccagcaaacagccagcatccaccagctgatatgaggcccccaacacacatacagttgaggactgccgggtctgggttcagtcagagaagatgcacctaaccctcaagagactggagacacaagggagattagagggggtggtgacattctcatggagacaggggctagggaggaagtgtgggatgtggaacagtcggaggatatacaagcaggagataaaatcttgagagagaaaaatataattaattaattaaaaaataatgataaatattattaatttggttcactatagaatttccatacaaattttatttttgcccatcctccatctctgcttctctccccttccctcctgcttgtatcctatggtgatctcctttgtcctcctccatatctctcatgcagcatatttctgagtttaggatccatgttcccatgtacatctatggaaatgaaaatccaaggtttatgagagaaaatttttgcttaggacctttagctctttatttttctccttttgattatgtgaccactgtctttcccatccttctgagttccgctctttgctttgctaatcctttcaagcacagaatgtttaagttctgcattgcctttaactctatgtctcagcctgttctagtttctttgcttccctaatctaattctatttcccccatggcctaatattttcttgtattccttatcattatgtctcaattaacaaacgccagaaatgtaatagttggctttaaattcactttaacaatatacatactgcaatcctaatgtcagatcatggtagatgctacttagctatttttgtacttatttctaggcatagtagctctctgtcattgctctgctgccaattgtcttgttttgttttgctttgccttttgttttttgttttctgttttgtttgtttttattacttccagggcattcattctcctctttattttagactttgttctgattttttaaaaagaatttttaaccttcattctaaccctttcaatcctcttccacaaagtaattgtgctgacatataggtttgttacatcactgcttaaaatccttcacagaattgttatgacctagggttaaaatctagtccttgtgtcctttcttcccaaatgaataaataaaagcacacttcatcatttgcctactgctttttctctaagtgcatagttcactattcatctgaatatactttctgatgtagtcatagtcatactatgctgtgctttatgaacatgttagacaatttcctccttatacctccatacctttgtacataaatacattctgttgcctggaaattcttctccatttcttttgttaattaacttgcactgtacatttttttctagttcttggtaggtacttattttcatgtacaccatctttttccctaactccagctgtggctaggataaagaaagaccttgttaatgtcaacagagtagttaataaggtcaaatgtgtgacagtgtcaataaaattttaaaagcacaatttatcacatctaatggcgatatggataatctgtctgagaatgccctagagttggcaattactgtactttataactctatgacttgtgatcaaacaggcggacaaatgtttgcaggttttgaagcctgttcgttaaataaaaacttcttttattttctagctcttttgctaagatactcatagaattccatttttattaatttattttatatgcatccactcagttataaacatatagtttatgatatctgttaaatgcatatgaataaaatgtagataatataaaaattttctgggtcaaaaacaagttaatacaaacacactgcttattttcactggtttaaaattggaattatggtcctattcctgcacatttgtatttaatggaaaaatttactgacttcctgtgttttttattaaatatttgtttctcattgatgtttttattacaaaacagaaacaaacatgggagacccatttaatagttaaaggcattttaaaatgcaattcttcaaaacagaatctgcatatttgaatttgtgaaagtcaagtacatttttattctttctggtatgaagtgaaggtaaattttatttaccatggtgcattagcacattatagtctgtgtaaacactccagtagtacaataacagtttctattcccctgtttttggcttattagccacgtgacctcagagagattgcctcacttttatagttttttttaaaaaatttatccatgtatgaacccgttggactaaagtattttaggttgtttacttcttatctctcgagatggattattttgaaagcagattgatttttgctctaaagaggacaatagaatttagttacattttaaaagttttatatccttggaatctcagtatcaaagttttgaatctttcattatttgggaatgaggtttgtaattattcaaaccttattttagaggatgctgtaacccttgtagtgggaaatattaaaatcaacctgctggcttatttctgcactaagcccagcactggctagccacctctgtcccaatgctggctcaaccaggctgctctctctagcttgctcccgcagtgcctgatcttggttttcccagctctgttttgtccctggagccactatttctttctcagccataaacccctgtagttagaggtcccacatcccattaaccaaatagaactgccaacctctcgattagatatcacaatacccattaacccggtaaaatcaaaactctgaaagctcatagtttaccagtcatatttatatatcaataaattctctactcacaagatgcccacacaataatttcaagacaattaataatcctccaagctacccacctagtttagatgaattattccaatatacttacctttatgatataactacctatggctgtttaaagccatgctggttcacacatctgcctccatcttggccttcctccttctcccccaagatgctttctgtctctgtaactcttagctctgtctccctttcccctgtccaatcacaggccttgagctgccctaatattttagtgtgattagacagggaatatcctgtcataagcttatcttcattaatgtctcccatgcaatgctattcagtcaaagctcctgtgttattctttatccattttgcccaaggtggtagctataaattacatttgtttgtttgttgtttgtttgttttgagccattgtactatagctagtgaatccaagttcttaatttagttttgatcaaagttaatctgtgattaaaagatcctgtattgatggaccatgtagagactgccatagccagggatccaccccataatcagcatccaaacgctgacaccattgcatacactagcaagattttattgaaaggacgcagatgtagctgtctcttgtgagactatgccggggcccagcaaacacagaagtggatgctcacagtcagctaatggatggatcatagggctcccaatggaggagctagagaaagtagccaaggagctaaagggatctgcaaccctataggtggaacaacattatgagctaaccagtaccccggagctcttgactctagctgcatatatatcaaaagatggcctagtcggccatcactggaaagagaggcccattggacttgcaaactttatatgccccagtacaggggaataccagggccaaaaagggggagtgggtgggcaggggagtgggggtgggtggatatgggggacttttggtatagcattggaaatgtaaatgagttaaatacctaataaaaaatggaaaaaaaaatcctgtatttaatggtagagttctctattgttaatatatgtgaacttgtgcacattcacttgcatgtgtttgaatgtacatttgcaccttggtagacagaaaagggaaagaaaaattattaatttggatgatgagatgctctctatattagttcatggttagttcgtgggtgtatatgggatagaatgtactccaaaccaagcatcattttctcattttgttatatttattttcatttcattatgcattttgataactcttacttattatagaacaacatattgttaatttatttctaggcttttatacttaatgtgtagctataatggtagatcttcttaatttatcaactatgatgcaacagataaatttcatcatcttaaacagccctagaagctttgattgtgtaaatctatgtgtggagtttttacgataactggaatgttcttgaattgttttctatttgtgttaaaatatagccacttagaaatattgttttctttttcaccttatataagttatgtattagctgaaagcctcaaatcctccatgtgagtaagaaagataatagtaacatccgtctcatgttttctatgagaattactttctagggtatattatgtaaagcatctctaatacattgtaatttataaaattaaatagcacagctgataagagtttaaattttttcattttcctctttggatattgtatatttgatccacaaaaatgggtatttactagtaatatattatagctctttaaataattatttattgaatttaggatagtttgataatttaagctttgaattcctaagaaattgctgtctgaaaggcctatttccaaatgatagttcatatattcatttttatactatatattagccactgtatcatagagctttctaattaatattaattcatctaaataaattttcacatttttagttaacttttaaaaatttttatttcagtttcatatattttgtgtaaatgtatcttgataaaagtcaaggaaaggatgcaagttaacagagtgttatcacattatgtaatatgctttaatggatttatttgatatagattggagtgttttaatatgtatgtagaacttagttatcttactatctgaggacagctagatctgaaggatacattttatgaccttttcagaggactgagtgtttattctttgtgaatttggggtattttaaggtaatttaaatatcctttcatattttttactaaagaaaatacacttaactgtaataccattgttaaattatgctaaacaacataatcttgattgatgatattgtttatagtataaagtcataatcatcgtaatatatacagaaatatttgcatttttattttatcatataaaaatgcctttggtgaatgtgttaccttcatgtattaactaaaaatatctttattgaacctaactatataagtgaaatttactttatctttgtaggtggcctgcatgcagttcataaatgcacttgtcacctctccatatgatcttgattttcgaattcatttgaggaatgaattccttcgttgtggattaaaagcaatgctccctgtaagttgaatatatctatttactatgctgttgaacttttaattttttttactcttcaagtaaaagtacattttgaagcagagaacaagtttgtcttttgctttttcctcaaataaaactttagatatatcgtaagctttcttttttatattatgatagtagtaccctcactatataattactgattcttaattcaattaatgatgtgactcaaacataccttttgatctataccaaaggggattattttctcttaattttgagacttcacaatgtgaaagccaagttttttttattcatttatttcaaaaatacatttttcatttaaatatttaatgcctaccttttttatactttatattgatttcatttataatagatttgttcatgatattcaggatactttgcttaaatataatattcttatcaggttgctttagaatttttttcaaagagaaagtttcatctcttaaattgaatgtgaatgtttgttctaattatggttatgataaactgtatttagtataattttgtagtctgtgataaatgagtaccctcactctgtgaattctagtacacagtatttaccttataattggattattatagatattttctgaaattgacttttaaaaaataatgttattacttatgatttgaaaatttcatacagtagattttatattctttctttctgcccagtcctctaagatctttccccacccctatccatacctaagcaacttcatgttctttatctcattgaaacaacatcaaaaccaacaaaaacatggtttgtggtgtgtatatccaatatttcattgatgaaaatttattttccatctgcaagcagctctcaaatgtgaacagcttcttggatgggggtagatatttttctttaactattacatctctgttatgttcttcaaatctctgatttctctgactgacgaaaatggaaagcattatgattcttgtcctgaagttttgtaatgaaggccaatttaaatatgctcttaaatatgagctgagtgaatatatcctccttcaaagaaatactgtcaaaatcatatggagagtgggttagtaatgtatattttgaagataaacttccctggtatttttgattaaaaatagaatctagagcaataaacctttaatataaaggggatcatttcttcactatcatatatttttttcatttttcataattgttatcatttagttattaggatttagtaaggatagagtagtcatacttgagtatgttctagatgttccttgtatgtctcttcctcatagaaatagttcaatccaaaacaagttcttaatttagaaaaagtaaagtggaaataattttattttttacatgatttatatgaaattgtttagaaatatttaaaattcattttacatgtgttgcaggaacatgtttagtaatttttagtgtggagattcaaagaaagaacatgaacacatgtttcaattacatgccttttcatcgtgctcttcttgaagaaaagtagacacaaaaatagaagatttatatcccattttctttgtttatataatttgaagtacactttacctgcatttctttttagaattcaagctcagctctgaacatcataaacccagtttgggtatcacccttgcgcatctatacatgtgattatcggtttgagttttcaaagctgcaacttaatggacaaatattaagagatattccaggtgatatatattaagcccaacaatctctagtgtggcatgcttccaaactttactcatattatttttggggaagttatcagaggtttgtaatgcatgtccttatgatgtattacaaaaacaaatctttgatgcccaagatggtattttgtgatcaggctatgggaaatgggggcggggggaaggcatggtatctcgctataccttgatttaaaaatttttttttgaaataccctttaactgtaaaatcacaaaatatcattcataataaatttgtttatacaattttcaggccatacttgggactgttgtgcttgaatatatccttgcatttgtttttcaattaacacagttgatctatatttgctttattttcttggtgctagaggtacatgcgaaagttctaactgcatgatttccttggtgatctctgatgagtatgtttagtaaaagtgacagcattgaatttgggttattagcaattagtgttattatagaagagatttttaatactttagtgtgaatagtcaagacactggcatgggaagaaaacctaaagaatggtatgatgttctttcatcttaaaataaaaataccttagctacatttctttctcttttaacttttttcttcctgtctatcttcctgtctgtcaccttcctttttctttcttttcttttcttttcttttcttttcttttcttttcttttcttttcttttcttttcttttctttctttctttctttctttccttccttctttctctctctctctctctctctccttctctctctttttctctctttctctctctttttctttctttctttctttctttctttctttctttctttctttctttctctctctctctctccttctctctctctttctttttctctttttctctctctttttctttctttctttctttctttctttctttctttctttctttctctctttctctctttttctctctttctctctctctctttttctctttctctctctttctttctctctttctttttctttctctatttctttctttatctttttctttctctctctctttcttctttctttctttctttctttctttctttctttctttctttctttctttctttctttctgtattccttcctttctttctgtattcctaccttccttccttcctccctccctccctacctccctccctccctcccttcctcccttcctccctcccttcccccctctcgctttcttttaggagatcaacgtcataggtcagtatttgaaattgcatttatgtgcaatgaatcatattgctgtccctgataagtatgttaattttaaattgtcattcatttcctgaattttattttttataatagactcttaaagagatagagaatgaagggcttgatattcagttgagagtgtttgaagagaacaaagaagatgacctaagtgaattatcccaccgtctcaatgacattcgagctgaaatggaatatcctttgacaaacaaaaaactaattacattttgaaaagcagaaattgaggatgattttttaatatccctattataggtcttgtctatgaaacaagttatatgtttttttttttatcaagagtctactatgatgctatgcttcatatatatccatgctgagaaattatccatcggcttttcagaatcagagctgtgcttttctgcctctaatgttttcttccctttcttctttaagcattccaaacaaacttgaacgttatgtccctccttaaaattcccacaatagccttatgcttttcatatacactttcttctccttttacataaaagtattaaatatatggagatacaatgaatagacatcgtattatcatagaaaatggtctctaataatttttctttcaagattagtaacagctatctgtactagcatcactaatacatacaaattgcttttattttggtcaataaacatacatcatattaatttatataatcagtcatttgatctatgctatagccatttaagtgccttttgatactttaacccagaactctcacgtacagtttaaagtagtacattgtacttttcattctactgcccattttatgttttaagatattggatggaatcttacatatattttatgtggactttcctggtcctcagttcatataatgtgagtccacttttaaaatgttttattgatttctaatagcatctacaccactagttttcatatcttagaaaaaaagtattttaatgtccacttgatttatttcttatatgtttttttaaaataagcttgctttatgattgttgacagctgagtgattatttgaaatttcttttatctgataataaatatagaatagcagtgtctctattggaacaagcaacagatcaaggcaatacttctttcactttttggctttccagtttgaatggccctcactattatctgaagttgacagtataatgaataaatgattattgaatgtgttgccacccaagtaagtagtcttggaaacatttctaggctggtttttctaattgacaggatgaattttttgctacagatgtttaaatgctataacatgaaattgaagcattaataacaataatagaaaccaagtgacacttttgatttttaaaaattagctacttcagtcataaatgtactattcatcaagattctttgctgtttttctttactcacttcctactgatattaatgaagtctaccatctgctgtataatatgctgaaggacactgctgcggaaccttacttattatccattctccaacactttctgctcatcagaaatgattactacatcaggtaagattcatatctgagaggactacatgtataatttgaattggatatcaaaagaaatttcaccgagtagtgggaccaaggaaatatatgcattatatgtacataaaatataagggtttttctactttaggcaacattttaaaaaagaattcatttattttaattgggacagaaaaagatagcttcatacaactatggtgcacccaagcaaacagaatttaagcagaatttaacctgtcatatattattgagtttgtaatgaatttttctgcttgatactagcaacccaatgaaaacattggaactgctagaattttttaatttttgtctattttaacaagtaagcttttttcatttcttcttatagtattcagtaaagtgtgtgatctttaaatgtaggaaaatattatggtatatattttagttttatctaataatactattttaaaaataaatggatatgataataaccaagagctaagttttagaatagataattgtgtctctataaaaatctggatacttatataataacaggtttatgagtgactgaaattatctctaagcttatgaccatggtcttaatgttaatgacagttcaagctattcatagttgctttatatatactcttatggcatactagattctttgaattcgcaaaatttactctaacaattttaaaaggaatactaccagaatgttttattgacagtaaaagttgacatttctaaaatagcataaggtgattttttttcttcaggctaatacaatgatttgatcaacatcatgatgttgaggacacagaaaaatgttgaaagaactaatccatgttttcttaaaaaaacagtataaatagtaatacataatggtaaagatgcaataatcatgaatattcaggtacctgggaatatgatttgtccagaataatatgtttcttgataaatgttaataaacaataaacaagctggacagtggtggcacatgcctttagtcccagcatttgggaggcagaggcaggaggatttttgagtttgaggccagcctggtacatagagtgagttctaagatagcaagggctgcacagagaaaccctgtctcaaaaacccaaataaataaataaataaatatataaatacataaatacataaatacatagacaaacaattaaaattcatacatggcatatttttaaaaattgtttgtgtttttgtggaatttgtccatggatttttgtgtgtatgtatatatgtttgtgtacagtatgggtatagatatgttcttgtgaacacagacagaggcaggaggtcaaattgattcttttgctctacattttctgtgaaattatcttatgaaaatgtctttctcactgaaactggtggagtgatgataagttcttctattccttctgtcaacacccaagacatgtctgggtttacagatgtccatcaccatccctacatttttccttgcatactgggcatttgaacccagttgtacacagctggtgctttaatccaccgagctatgtctgctgcccatgtaatcctttgctccttataatattcttgggtagaggtgtaacatatactttcatttcacaaattggataaaggggaaagctgtgttgttcttagtaattcataagggtgaagttaggaactaatattatttatctccagatctgatgatcgtttttgaaaccctaaagaaacaatgccactttcttttcattcttaattttaggaatagccacatgattaaatatacagattaattagagtctgtttttattcattttcaagtttttagtagtttgacaagcgatatttagagatgtttatatcataatttgtgttacataatatctctctgaagtactgttgaatttattagcccatgacaatttgtcttctgcaaattttaatgcaaaatgtcccttatttttatttttccagtcagtggtcatttttaaagccaaaataaccttgggagattaaagaaaaatggtgtgttttaaaacctttgacacgtcacacaaattgcaactgtagctatgcatattaaatgtacatgattttataaaacagattttttttagaaatatgcttcatacataggtctccacattagtctgtaaaagaaatgacacagcccagttttgtaagctagtgtgactttcctgagtaaatgctttgcactaaattcaagacatagcttgccacccaaggccaagaaacccatctctttttgaaaaggagaacttgtggctgtctagaactgtttctgtgctcatagatttaggactaagggatcatttattttcattaactttcgaaacaataccttaaatagatagataaggtcgataagtatttttgaacacaagcatgaatccctgcaaactagaatattaaggctgtacatactttcagtcgattacatcacactcaatttggccccctaatgttcagaccatgtttaagccttagtcatattttctctacagaaatgtaaatgttagtggaattatttctttcttagtgctcaggggggaaaaaaaactttgatctttttgcattctgaatcccttcatacgaaaattgattgaaattttgaaattgattgaatttttgaaattgattgaaatagaaaagtattctcaaatgttttctctttttcacaggccacagtattataaaatcattgaggagtgtgtttcacagatagtgctacactgcagtggcatggacccagacttcaagtaccggcagcgcatagactttgatttcactcatctcctaggtatggatcatgtgcacacttctgcctgagtctgagcactttttaagcctaggtctctcactgaatttctattcgtatctggtaatttattgtttctgcgactgttcaattgttataactgtaagtttggaggatcataagaattctccttacaggttgctatatttctttttgatgagtttcagcagtactgaatcaattgaaggtcagctatcgtaccccacacaaagccatgatgttttaataggtgaatgccttacattttagaaacgtgactcagaaagattgtggggatcaggtggagtagagtctatatagatatgctactgtggttctgaaatttgaggaaaaaatttacatggtaaggaaattatctgatacatttagagaatgccaagtagggatattgttttctgagaagtgatgacaaagttccattttgtggtatgctatcctctagggctttttagttaggggattatattttaaactaatcacaccattattgcttacattgatgcatacatttgattgtttttaaagacaacacatttttgaataccatctttataatactttcattctatggcagtggacagaaaaacaatagcagtcacagattgaatattatttctcatatattattttccatttctaaaccaatccatacttactgtaagcaattcaaagatttctacaaacagcagatatcagatatatcaagataacttcctttataacacagtacatttttaggtagcttttttatgaatgtgtaagtctgtcaatataagtacggctaagctgtgtttttcgtagaacatcgtgaagatttggccatgttcacattaaaattgggacaatgctaatacatgccagtttatgatctatcttggccattttaacctgtattctcttactgttttgctgtcattacttctagattgtttttatgtccttaaaattataaataaatcagctaattgatccctttcaccatgtgtttttattatcagcttaattgaacattcttttttgtaaattctagacattttctcatcaccttttaagaattaattgctattagtggtggttactattgaggtacttttattagactatacatatgtatacacaattgcacacaaaaatattaagtactttagcatcatctatgctatagagggatctcgatttgattaacacttgaacctcagtattctagtctagtctaatttcaaatttttgtttacttattatatttcttatatcatataaatcctttactaaaattctttagtaaaatttgttccagttgaaaccaaaatgaaaatcattgtcaactctggcttgcattacctctataaagcccctttagactatatcattttcctcgttgtgtgtaatattgtgttttgtttttaatctgtgtttgtttcctttcatgaaggacaattttgagattcattcatgttatatttcatctcttgatattgtattcctttatattgtgaagtagtagtcacgtatgcatttttaaacaaattgcatttcttcgtggacatttgcattcgttccatttttcaactgctgtaataaagctgttctctatcatttatataaaaccacagctcagacatagttttttttaattggatattttctttatttacatttcaaagttatttacatttttttatcccctttcctagtttcccctttgaagaccccctatccccttccccttccccctgctcaccaactcacccacttctgcttcctagatctggcattcccctatactgggttatataaccttctcaggaccaagggcctctcctcccattgatgagcgactaggccatcctctgttacatgtgcagctagagccatgagtcccaccatgtgttttctttgattggtgttttagtcctaggaagttctgggggtactggttagttcatattgatgttcctcctatgggtctacaaacccctttagctccttgggtattttctctagctccttcattggggaccctgtgctctgtccaaaggatgactgtgagcatccacttctgtatttgacaggtactggcagagcctcaaaggggacagctatatcaggctcctgtcaccaagcacttggtggcatccacaatagtgtctgggtttgttgactgtatatgggatggatccccaggtgggtcagtctctggatggtcattctttcagtctcttctccgaacttttagacataggtttttcctttggagaaatattagggtaatgtacaaagtttagtctcaaaaggttttctcatcatgtttattaactagatgtttataattttaagttttcttcttttagtacatgataattttgtttccactcagaagttaaataaaagattttcctggaaaacctgaactgaacaacgtgactacactttcctctaccacctctctctatgtaataatgtgtaattttcaaaagaattctgtagtgttaaaaattgaactataattgaagactttcattgcagtgataattatatcagagatattttggataattgtgggttttttttcctttaacactaaagagaaaattgtggtagtaaatgtacattatagtatagaataatgtatctttaataataattcatatggaaagtacagactcatatagtggcagtcataattagccgacaattccatgtcatatatttctaatcatttgtgctttacctgaacagatgcttgtgtaaataaggcaaaagttgaagaaaatgagcaaaaagcaatggaattttcaaagaaggtaagactgataaaactgtagtcctgatttttaaaacaataatttaaccacagtgcatagttaatccattactgcctttttgttttttacatgagacttcataacttgtagtactttcaattttgtagtaatttatactactagagtcaaacatttcacaatattgatttatttttaataagctagttattattccctcttcatcaacctaattcattaggtaagaaaaatcttactcatattatacttaattatgaatgaaataaaatcatctgtccaatagtttacatagttaaaactgaacaagcaaaagaaattccttcattgctttcctttcacactcacatatactacacagttccatggagaactggtagaaacttggtttccctttaaagctatgacctgagctggtgttgaaattttatggttagaatcttttggtagtgttcatgctaggcatgtatctctctctctcttactcgtttgagatagtattaaaacaaaaaggggaaaccttttcagccatctgacagaggcaagtgcctacatttgctcagtcctttaaagttaggacctagcttggagattacatcctcatttttgctattactcagaaaatattccagttacttctggacacttgaggaactatttttgctctttcgtgccttagaacggataataaaaggtagagatgaacacaatgaaattgtgtgaagctgtcattggtaaaatgtgtatatttgtgtaatacaactttattaaactttccttttaaatgaaatgccttaaatttccattgaatgacttagaatctctttaaatttggctagagtgtaaaattggagcatattgtgatgacctatcttcatatttcctgtaattatacaagttatcctgaaataatagaaaatatggtgataattacttacaactttaattgccaatatttagagtggacatgtggcattgatcaagttgccttttgcattaccttaaacttaaaataggtttttttactgtctttagatttttgatattttttgtaatatgcttttataatattcactccctaagcctagttttccaaaatattagactgtgattataagatccaatctcagcatttccattatttccctttgactctaagcaagccacttattttctttggattgtgctctttccaaaattaaaaagggagtctaagattaggaaggtgggaaaggacctcttctcttcataattaggtttgtatcatttttattcttccttgttacatttaacataatattaaatttaaagcagaaaaatgtgtgcttgtgcagatagtatatttgaaaatcactataggagaaactaactttgagaaaagaattatgattatcaacttagggaaatcatattgattaaataaaatcatatcgaaggaattctgtccttttcattctggtatttttatgttgttgttcatttgttttggtttcggagacagcgttatattgtgtcccccttcttggcctagaactcacttgatagtccaggctggcttcgaacttgcaccaatcctactgtctctacttcctgggtgtgagggttataggtatgcattattatgcctgcctaagtgctccatcttctcagtgaagtaggaaaagaagatcactgaaggatccgtagatctttcccctcaagtatttattgttgtggtggaaattagttatattagcaaagtttgttttttttcaccaacttctataaggcattttcctgtacaaaaataggcaggaatcaaaccataaataagcagggtttcaggtttgatgtaaacactgtcatccagtttacccagacatgtgtttttcaacttaccgggatagcattttgtaataatttcctaaggtcatatctagtaggaagatggatatttattaatagagaatgtgttgccctatcatttcatacagtttaagtgcagttctgggtgatacgatatatcacctttaaaaacagaaataatattgtcgggataatctatacaaatataaaatgtcttgggttgacattcacaataaaaaagaaaatgaaaattttagtagcaaatcctatatggtatttgctgtaaatatgagtctaacttgtgtctgtttagagtagtcattgaggtaagagctaggatatagtgcagtaaatgtacatacaccttttgtagagttggggtctttagcaccccatgttttcacctctcattttttccatctctgttttctcatgtacatatctatatgtatgtatgtatgtatgtatgtatgtatgtatgtatgtatccatgtatgcacgtacgtatgtgtttaattgtttatttaatttggatagtctctttctcttttttttttctctttctcttgccaccccattctgtatatttgttggtctatgtttgcctatgcacatcagtcagagaacaacttggaggattctgttttctctggccatcttatgtaattcaaggatcaaattaggattatactccttttcttagtcagggtttctattcctgcacaacatcataaccaagaagcaaggtggggaggaaagggtttattcagcttccacttccgtactgctgttcatcaccaaggaagtcaggactggaactcaagcaggtcaggaagcaggagctgatgcagaggccatggagggatgttacttactggcttgcttcccctagcttgctcagcctgctctcttatagaacccaagactaccagcccagagatggtcccacccacaaaggggcctctcccccttgatcactaattgaggaaatgccttacacctggatctcacggaggcatttcctcaatggaggctcctttctctgtgataactccagcttgtgtcaagttgacacacaaaaccagccagtacacctctccacttctacattcagaaccatctttattcacctcattttcctctcttctgttgttcttgttaaccatctgatataaaataaaacttcagtgtataacattgtattgtcagatattttgaagtactactttttggatgctaggcaatggagatttggcagcagtaatctctcagtgtaattcttgttaatatacatacttcttatcattgtgaaaacccaatctttttaaagactaaatacgtttagaactcataaatacattccatattttttaaatttcactttctaactaaacttaaaagaatggtggcaaatctttaataaacatgatttattctacaaatgaatttctataacaagctattttctattacacccgaagagtgatttcatagtccatccattttttccttttattaaaaaaaaaaaaaaacggagaattacacctgtgtgaatacttgtcagaagaataattaaatatctttctttgtagctctctgaattcaccaaagcaaaaactgttcttcatatttagttcatagtatttaaatctttctcaaacacatatgagtaattgtgcattcattttggtcattgcagttcgatgaagaattcacagctcgtcaggaagctcaagcagagcttcagaaaagagatgaaaaaatcaaagaactggaaacagaaatccagcagcttcgaggacaggtaaggaaacaatgtcgacttgacgtcacaatgaatttagtgatcgaaaattatcttgttagtcagaaggaaaaatgtgatcagaagcagacctttagtttgttgttcacagattcacattttagttgaaataagtacagatttgatttttccaggacagtaaatcattttaatgtttggaaataaataaggcttcatttgctcaaactgccctgaatatttttaccagaatacattatacaagccaaactgtttgtgacatgaaattttcatgatgatgtgaaaaattgtgtgcatagtattttctttcaaaaagaatatagaaatgctcatgaattttaattatccaaaaggcttcttgagatctttaaatcaagacaatcttcaattcagaatgtagacactttatttctagctgcatttctttgcatacattcaaatatatctcttagttaaggtgtctacactttagaactacgtataacctcaacaaatgttgtggcttaaaagaataatatgaactttagaaggtgcctttaaatacttaatgtctaggaggtagtggttgattgactacatctctttctattattatgctgaggaattacttccaaagtccctggtaaactacaaagtccccaccgtggtacccttagttacccacagcccatatatcatgtatgttcaccatttaagtctttgtttttccttctagtattatgctactgctgtctgagaactagatttctcttattttctcattccccaatggcgagatatctctgtgttctctctgcccttggcagttttctctgctttgtatttctttgcacaaacgtcccactcagtttcatatgttcatacatcaccttttagtaggtgtcaaggcttttgagtctatcttacatttgtagctgtccccataggcaagtcttttgtattgaaatcaaactcaatgtttttgatcttttctatttccttaaaccagctcagtctccatttttatttgttttaaaatttaccactattttcttaacacgaaagtttgatttttttttttgcttgaccttttcctgacaaagaatgttagttcctgttttatttaaattctcccagtgcctttttcacctcttcatcaaaccacactcctttcttgtctacttccctcacattttgcccaagctattttaattgtctcctatttgtcttcctgcctatagtttttcctcctccagttcatgttttatgccaatgaagaatgaattctcatagaacattgttccaattattattactgaagaatttattgtgtgcagtgcttgcctgttgcatctgggattaaatgaaacctccttatcagaaatattaaagcctcctggcaggcagggctgctttacattttactcccattgcagcctagcctctgactcctctcttaactctgctcttgttcaatctcctttccttctattagatctgtagattcctggctctatacttttcattcttccaactttatcacatgatggctatatatattttaataattttcacaaagtattccatagtctactaacataagtactcggagatttgcaaaacgtcgcatcctatcaaatagtgtgagctatcctacactgaagaaaccctgttgctcatgtccttctctgactcatgtgaccacaatatcttttcttgttttcatttttatgtttgagacagggactccatttgtagccctgtttagcctgaaactctgtgtgtagtccaggctggccttgcattcacagaaagccatctgcatctgtcttctgagtgctagtattaaagggatgtattaccttgcttgcctgagtacagtaccttctatggttttttttttgttgttgttgttttttttttggtgtcagaaaagcaaccttatgctaacactcatcttgatgaagcttttcgttgtttcttcttctttctcctccccctcttcctctccctcttcgtcttcttcttcctccttttcttctttttattgagacaccctctcactcttcagtgcaggctggtgtgaaactctctgtgtagaccagattgtgctgtcatgccctaacaagctgtagcaactgctgtgctgcattaaattccggtctgattgtttgacttgtaattattaaatgaagaagtgactcatatgacttgatactgagacgcttcaaacttgtgaagtaaatatttacttgagttaaaaccctatgcacttgtacattttttaggtccatttatacagtgagcagtactcctaatctatatacctcaagtctttatggctttaaggaatttgcgattgtgattgtacaaatgacttatatctaatagaggaaaaatattgactgcagcttaacatctttattgaatatttatattccccttctgcattatattttttagtgaaaagaagaaacatagattgtacatcacaagtattcaaaataaactttattttccaaaatacttgtcaaaaaagtacagattttctaagattgaatttttctaatattgtcattaatcttacataagagtaaaaatcaggcttgttggtgcaattcctctggatttctaaagagtatttcattacaggaatggcaagccatttttgagtatacaaatatatgtacatgtatttatatatgtaaacatataagcatgaatatacatatgaataaaatttgttcaattcttgttaacattgtaaaggatatatttctgcaatcatacctaagtttaaataaaaattctaaagcatatttataaataaaattgttatttaaattgtttatccaaattttagttaatattttttattctgaaagttatttcataatttaactgggacaggaaattatcctagtagaaattttatattagccaagataaaaggacttcttcctggtaaaagaattattcaccataccatgaaatttcaattaatgaaatctaatattttgatttaaaaatgtctgctaattggtactagtttctttgaaatattcccatgttcattttgtaaagggaaccactgtgatcagtgatgttttacagtttatttaatccttaaaagtaatgtaggatgtagtgtcatcttcttgtaatcaattggcattagggaacaaacctgaagttactttctgacagttaaaagaagttattctccacttatgaaccatgtgtatgaattagttttcatggtaaatgatactttcattaggagaaagagaaccacattcaaatataaatcctcaattttgtttggttttattttgttttgtttgtttttgctttgcttttccaaaatttcattttgtctgttgattaaatgaaaaactataaaatccaatcagaatttggatttagcagttaagatcctaaaacatcttgaccagtattaactatatttatacttctatacaagcctacttaaagttggaaacacacagcttcagggagagttcatatctttccatcgtatcttcttctttttttttcttttttattagttattttacttctttacatttcaaatgttgaccctcttcccttgtttccctctgcaaaccctctattgaacctcctctcccctttgtctctaagacagtaccctccccccacacactggtaggactgtacgagctgaaggggactggaaccccataggaccaataccaaaatcaaataatggactcccccccctcctgccccccgagctcccaaggactaacccaccaactaaagagtatacatggatggatcatggctcgacttacatatgtagcagagaatggcctcatttgaaatcctcttttttttacaatgtgctatctttgataatctgtctgtctgtctgtctgtggtatctttgattatctgtctgtccatctgccagcctgcccatccatttgtttgtgtgtttgtttatttgttttttgggctgaggatcaacctaaggcttccctatcatgcaagaactctagtaaatgagttacattctcagccttcatttagttttttttgcatttattttccttatcataagcattgaggtaaagatggcgtcaaatgtcctatttacattactaggttataataaggacaaaaaggaatgatggatgtaagatgttgatatgattatatgggtatgcaaatggatgatactgaggattaatcattagtatttgaagacagctaaattagtagtactgtgaaatacttcctataagactaattgacacccaagggatttaatccatgaccttgtcatactttattcaaactttaatcatctaggctaacaattccatgccgtatactatactttttggctgtatttgtagtaaaatatattgttttattatgttatacttttcccccaaaattgtagaaactgcctactttccttctcttaatatattagtagaaatagtcattatctgaattgtacagtgtatgtcaaaacatgttaattataggttccgataaactggataatctggaaagctaaaaaaaaaaaagaaatacaagcttaaaactggaacacctaaagtatatgtatattttgtattatattttctaatgagcattaaacttgtttctgtttcagggagttccatctgcaattccaggtccacctccaccacctccactgccaggtgcaggaccatgcccaccaccaccacctcctcctcctccaccacctccacttccaggagtcgtccctcctcctcctccaccattacctgggatgcctggtattccaccaccacctccaccacctttgtctggagtacctcctccaccaccaccccctgggggagtttttcctctcctatcaggaccaattgagctaccatatggaatgaagcagaaaaaattatataagcctgacatacctatgaaaagaatcaactggtccaaggtaagatataacttcagggccctttttgctttttccgtgattgacaatgtgtgagaaatgggctgctgtacgtgagtatcaggcagtgtaaagatactgattactgacattattactttttcctgtgggcttaccatctttatgttcaccttgaaatgtgcaacctagataacttaccaaatatgttgacattgtactagagacaatggaaaatcatattgaaaagtatttgaaatacatgatgaaatgaaaatataacaggtttattattgtaaatattaagtactgtcaatttctcattacaattgtttgctaataacaggttgtctttggtatttttgttcttcagaatgttaagggttttattcctttaattttatactttaatattgtggaaaggaagggacccaaataaatgggtggataagacagtttggggaagggtaaatggaagcaatgaatttattgtacatgtattcaaattacataataaaatttaatacttgttatgtgtttaaaaaaactaagtataaaagtaatatatatacacatatgtatatatacatttgtgtgtgtatgtgtatatatctctatatatgtacatatatatatctatatatatgtatatatatacacatacacacacacacaagttgaagagatatactctagtatgttgagggtcttttcagtagacattttcatatgtacttttttcattgctgttgggtagcttttctgtatagcaacagaattgtaattgttcctctgaaaatttatatgtgtaattttatatatttgaaattgatttagtagagagatgaacaaaggcaagtaagtggttgaaaaattaaataggaagtcacaacacaaaaccttatcagtgttatttttgtgttagattgagcctaaagaattatccgaaaactgtgtttggctaaaacttaaagaagagaagtatgagaatgcagatctatttgcaaaactggccttgacatttccttcccagatgaaaggtaccttttatttttaaacattataaattcttgtgcctgttatattggaattcatttctctagtaaaatgtgctagggaagtatgaatgcattgttttctcacaggaaaccgggtcaaacataaataaattcacgttttagctacagttttatctataacccaaaagctcttatttgaattttgttttgcataaatattatttaacataaagtataaattgtaccattatttaatatttatggtatatgtagtaaaattgccattttgctgaggaacaggagattaatttgtagatttcccatggaacacaaatttgcatcatggaacactagtacctctgaactatatgaatgatattggaccaagactggtgtggtagcacttaaactttatttattttaaatcgtgtattatatatcaaccttatttttctggaaattttctagatttccttataagcatatgttctcaattaatgtccatatatgatccttagaaaatttggttgtggacttgacaatagaattacttctttaagatcttataatcttttcagtattgcacacatgtagttcaattaatatgtaagtctcacaatgagtcattgtggtcttttgttttttatttgaccatagtgattttagtagttattgcagaaattatcattgagtcaaatgtagacattacattgtgtaaatcagcctttacaacaaataatggggaatattctgtagttttttttttttaagtgactatctttggagaaagagaatcgcaaatagagtggggagatcagaaggactatgaaatttaaacaatttttatttattttagttttttcttatttgctgtcatccacttccaatttaaaatttctccttcagtaccacttatccatgcctataacaaagtatccacagagttgtttgttttaagatgtgtataggaaacataaacagatttcttttttaaacttgtatcttattctgaagatattatattttgtgtttgtaaatattacacaatttaataacaaaattcaaatagctgaaattcttcttctgctataatatatttaggataattagatactcagtctgttaaatgtttaggcatatagtttttgcctttggcaaggtgctgagaatgaaattattctctagcgtaggttaatatgcagaccaagatggctgtagattcatggaaaccatttagcctccagatttcatgtatgagataccatacttgctgtccttttctatttaaagtgatgctgaacgttttttcttcagttcataggccatttttgactattttttcttgattttctcactttgcatctttgaatatttttgctgtgaaacacttgctgttgacttttctgttcaatcctacacgaaacctcttttataaaattacacttttgcctggtttatacaaatggctaagtaagcttcgattctgtattttacaaatgaaggtagtaagattagaaatagaaggacaaaccatagggtagagtgtggtgtatgttcaattgtgtgtgtgtgtgtgatttcttttaaaatcaacccattacaatgtaagttagtaatggtagtgcaaagtgctgcctacttgaaaaaggctgttgaacagagttgcatctactttcctcaactgtaataaaagcaacttccactgactgaattacctcatccataatgggaatagactaatgtttaactaggtaggaaaatgaaatcagcttatatacatttcagcacctggcatcctcactgcttggtatctaacagacacttaataaatgttcattaggttttcacctttatttatctgatggtgggtgtgtatgtgcgttgtttttgttactgacaattactaccaatgtttgtttggaaagagaatctcctgtccttccttcctcgtggtgctcactagatagagctcatcagttacacagatgtaaattttaatgcccttgccaaaacctaatcaaaccagaatgacaccagacaaaattattcaaattatgcactcactgctgtgtatgctgcctctctcattccccttaagtttaattcttcaaatttctctgtggcattactcctattttgttaattttgagtatttaagtatatataaggacagtggaaacctttggcatcattgaattgtttctgaagggggtgcagcatttcaggatcagttaaatattatagaacatcctgtacatggaagcaatagaaaaaacaaattttggtgacccaacacgtattaattacgcattaattgtcttcttgttgaaattctgagttgaaattcgttgacattcacagtgccttgattcataatttggtcaatagatggcaggcttagtaagaaatcagcaggaggttctggctccagcaaacaaaagctgtcctgccctggctctcatagctttagggcaccactttcttctccattctactgctcattgcagctcaatcagcaccattctgaaatgagccaccaacccatcgtttctaagacctatttccaaggctgttagattcagtgttccaaaaccttttgagaactaccccctactgcaaggcctttggagagcacatggctccattcccactaaatgcactataaagcattactagtctataatgtcaagtgaatgtttgaaaattcaaagtagctgagagttgctaaatagaaagaagcattaatgcaccagttttaatacctataatatttagatttatagttattcttagattttttagggaaaatcattttttttttaaaacaatctttttttttttgatttatttatttatttatttatttatttatttatttatttatttatttatttatttattatatgtaagtacactgcagctgtcctcagacactccagaagagggagtcagatctcgttacggatggttgtgagccaccatgtggttgctgggatttgaactcctgaccttcggaagagcagtcgggtgctcttacccactgagccatctcaccagcccgggaaaatcatttttaatcttccactaaaaagcagtttatctctattttagaaaaggattatttcattttattttacaagtttgtaaaatacctagtatgtgcacagacaagaactgatcattgtcttctctgtgcagcagaaagctaactcatcgtctattgactgaggtagagagattaccatattttgtcaggttggagtaaatgttagaatattgaacatttattcaaaagctatgagagcataaaatacatctactgtagaattgtaataaaatgaataatacaggggtggtgctatgaacatttcagtacagtttcaatatagaaagatggaaagaagtctttctagagagggaataacattagcaaaatattaaaaatttagatgactgaaacttaactgaatttattggaacaaagaactactcgtgaattttgtaacacccagggtcagaagagattcatatgaatagcgatcgtttgtatgctaagcctagacacaaaaacagaaatcaggcagcttatcacatgtagacatttgccttgtttgaccattctgtgatccaagcttgactctttgttattggtgcagattcagctggttattagaaaactatatatattaattaggttgaactcagattttagagccagcagcgtcaagccctagtctcctattaagttaacagtgggaggaagagaagtgcgtactgggctgaaagcacacgcagcagctgctggttttggagtgagcaaacttggtgagaacttcacagtgaagaatggtggttcgctcctttttcattaatgtgagcagaatcacatactataaagcttgctcaaaataagagattcttacgaaatacagaaatgaaaacgagagtttataaactcttttgccagacttggatagaaattcttattctatccccaatttgcttttatagcattattaataactaatagaaaaggccatacaaaaattatgaaatgtgtataacactcctcttcctagagaattagtcttctggggtcatattccattttgtttctggcataatattttcagtgagaaaattcatgatccctgtttgtttgaatgatggatcttgcaaattgtgaatgaatatcactagcttgggcaagatataatgacatcaaatagtaggaattctttttatcatctgtaagcactttactaattttcaaatcctgcaattttccttattatgacattgatgttcttataggccatcatattgctgcgacagaaaacgtaattcaacatgttatctgtattaaggaaatagaaacattacatgtatataagtattatacaaacatgagagcagctgtagaagtttttcagactgctggagtctttcagaatatacatatctgtaactattggaatttgtatgttttttagttatattttattcagttagatatttggagatatataaccatgcagactttaatgatagtgttattttgcctttacaaaactgcagcaattatagataataataatattatataagagttaaagtaatgattgttaatattaactaaaattgaaataataatgaaatgtgtagcttataactgctaattctaattagtgtttgtagggttctctagaggctttaggaagaaccaagatagtgcgtgtttggaagttgtaagcaatttctttggttttaatgttgcttggaggtaatataagaaaaaaacataagaggttaataaaacagctttgtcaataacatatttttacaatgctgcttaggtttaataataaatgaaaatgaggttttataaatattttaagtacagataaagtttacttttaatacttgtagtatcatattttggtagaacatagtttgatgatgtctgtacatacaattattaagttttctactaaaagacattttaaattgaatttttaactttgaatttggctggctagccctgaatatatctaatgttgctttatttcttacagcacttttctatattttttaagaaatgaaaaggcaaaagaatggtaaagtctaaattatgtccattttcataatacagaaaattgtccaaatcgctttacaatgatgtactgtcagtctcaccatgtacacactttatatagtgatgttatcgtgtctacagagtaatgatgtcctagcaaacaatttgtcatcatgatgacacacatttcttccagtgctgaagatgagaaatacactgcaagttgtagaggacgccttcacgtacttccttacatggtggaaggtttaagatttctttttggggtctttttctactagatgttgcatctctagtaccatctccttgagtcttagatttttcatatgtggattttaggggaacattatcaacattaattttcagtcattttacaatcctatctttaatccattactttattatatattcattttttaggtttctgttatttgattaccattgttatcttagccccccccccccaattattaacacactaggagtttccatttaggatggcatgaacactttttttttaaactggcatttattagcataagattagggattttagagacagagattttgtcattctttagagagatgttgagatagactaccttccgcattctaaccaaggggattttaaaatagctgaccttacgaattgcaatatagattttaatacttctggtattaatgccatcagtacaatgactactaataataacaggaattattataacaatagaatgataatataacatctcatatatctcaatagctgtgattttgtgaatccatattgtatttagtcgtcatttcaactctatatggtttattgttttatgtcttgattttgtagggagtaagtgagaagaatgtgattttgagccaaggtttgttgttaatgacttctatatgttagagcaatgagttttaatggcctttctgcccttagtaatttgttcattttgttgaatagtttaacagagctctttttcacacatttaatgatgtagtacttttatattatattatcttgtgaaatgtgtcatcctattactcttgcactaaaggcacttcagagcaggaagcagaggtagcaagtaataaattattctctgaagaaaataaatttatttttcctatgactaatttttttcttttgtcattatttccatagaatagtcactgataaaatggtatgatgattttggttctgttttttgtcattaatggaagaatgtagttttgtggtattatttgtctaatgatgctttattaatacacagtggatgcaaacataaagtaatgaaattaatttttacttggaacttttagagttaataatattaacgatgctttgcattgctttatttgctttttgagatatgagctagagagtatctttctccctggtttttgaattctaaacagcgtatgaagtaagcacaataatagttgttcttttgataatgtttgcaaatgaaaaattgtcactcattttgaatcattattctacctatatttgtgttattcagataaattacatcgactagcatataaattttagcagttctatgaaaagctccacaatattatatatatatatatatatatatatatatatatatatataatcttagactgatgagaagtaggaccaaatggtttctgggctttacaaagtatatataagttagagtagagaaattcaatctggctaatgcatttaatatacataatacctaatagacataatacgtaatcagtccactttgatgactttaaacatatttcttccttttaaattcattcttcataaatatgtgagcataacagttttctagtaaccttaaaatatgttcaatagatttcattattaatatcattatgttaaaatactttccaatgtcttataaggtaaatgtgtcattatatgcttataaatcacctcagatattgtatgggaagtaatacatccaacccactattgtgacttttaaataccatgttatagatataatagattaattcatagcaaagccccatctattattattattattattattattattattgttattattattattattattattattattattataacctgacttacttatcacacatttcccctacaattaacaaattaacaaattgatcgcacatttagtggtttggctgtagttctgtctagcatgcatgagatcctggctatactccggactgaaaaaataggagaatacacacaaacacacacacccacacacacacacacattttgcatgcaagcacgcacgctcgcatgcatgcatgcaagcacacacgaacacctcaatttattcttcagagtatcaggaatcctggcagttctcttccaagttttgaacttcaggataccatatcgtgtcatgatatttctttccttgctaaacctcagttcatttctctgcttctgctgttgtgttaatggcattcacatgtgaagaacatatcactgatcattcattttcttcttaaagatcttaaaatcttcttattaatttctaagcgatttgtattttaactcttcctagttcctggattggaagctgttataaaaaactctatatttctgtgaccttattgtatttctttttcatttttgcgaataacttattgtgtggcccttctactagaatacagtcttcacagtattgatgttattatcttgtatcctacattactcaactaatttcttcagaaaggcagatagatagctcttttgcttgtgatgttttagtcttcttagactatactagatcctctggcaagtctgttgagtgaataaccaaagaattacagttataataccaaagctaatagcagaaattaaagaataatatttctttattattggctccaacacacatacacacatgcatacatattcttatgattacatttagattgctcatatttagtcactagtaaaaatgacattcataagtttttcataagtgaccaaatgtgtttcttcaaaaatctttcttatcactgattaaacactagaaatctgcttaaagcctcactgcttccagtttttttttaatgttaatgtgtattttcaagagttaatgtttcacctcatttggagagttttaattttatatttttacatttatattttaaaggcttcatatattgctttgcagtattttaatttcttttaatgtttatttttaaaatttgttgttttgacttttgagaattttttaaattttgtgtgaatggatacttacatgaatacatgtctgtgcaccacttgtgtgcagaggccagaagatggtctcattctctgaaacttccatacagttgtgttctggcatgtgggttcttgctacagaacctggctcctccggaatagcagcttgtacttttagtaatagagatgtcttattagatccaatttagttctcacttttttttctgggtagctcaggctactcagaaattcataatctaccaatcattaagtactggtaaggctacaagtatttactaacacactggagctaaataacagtttaaaatagcattgctgatgctttattaaatatagaaaactttgctgaagcaaatgtttctttggtagtttgttgttcaaatttgaagaaatttctatttcttgttaatgctattgggagaaatatgaaatataatgactaataaactatcagaatgttttgtggaagtgaagataattttatttcatagattcttaataagattgacagttacacagggtggtggtagcacatgcttttaattgaaagttttaagaggcagaggcagaaggatttctatgagtttggcaagcctcatgtacagaaccctgtcatgaaacccctctctccaaagaagacagacggtttctaaattatgtattaatatttatgtatattctgtataaaatatgtggcttatcatcttacaagaaaacaacctgcagcatcttaataagtattagttttatggatctctgtaatgaaaccttaaatgttacttgggctctcataccttattgtctgttctaggctatataggatattaatgaagacctttccttttctcctgagcacagaaagaaagctcaggtcacctccatgctacatgacttagttgtgctacaaatgaagagatgtggaagtcagatgtgtagcccaatttcacaaacttatacttttaaacactactggtgttctctgtggtatacctgtatatgttaaagctctattatcagaaatctcaactggggagtcatagtctccttatctgtctcacataacaaaacagtatgctttgaattcttgtgtattgacgtgtcttcttcttgcataccctatatagctaatgtaagaatttagtgtatatagcttttctaaaaattttagttattttagatattgtaatataattacagtatttttccctctttgttcctccaatccctcccatatacctcttctgctatctttgaagtttatgctaccttttctttaattgaaggtattgatctctctctctctctctctctctctctctctctctgtatatttgtgtgtgtgtatgtatttggatgcactctaaatgcacaaatacaacccctcagtctgtgtatgttacatgaatatatatttgttctgggctgaccatttgctattagataacaagctgtggggccctttgggggagaccataatttctctctagttgtctgtagttctttacatagctgactgaaccaattcatccactaaattctttacagtgtgtggaaatatgtgtctcaatatataatactattccaaaagaaaaaaaaagaaaaaaaatgttgctacctacccttggttaagttttccatgcaaaagttatctttgcttttcttatcatagcaaaattaatactattatgatttatctctgcataccaacatcatttcctaatactgtttccatctattggcatgagtttaacttcgataatttctaatttaagttacttttatatgagcctcaacaaaatatgtgatgcattcaaatggcagacttaactattatgaattatcaatatctcctccattagaatggcttattgagagttttctgtgtctggtttcatgtgataagaatagactgataatcaccaatccttgacactattttttttcttttttttttattggatatttatttcatttacattttcaatggtatcccaaaagtcccccacaccctccttcccccactcccccacccacccactcccacttcttggccctgtcattcccctgtactgaggcatataaagtttgcacgactaatgggcctctctttccactgatggacgactaggccattttctgattcatatgcagctagagacacgagtttgaccatttcctcaggctctgttccatcctcatccttgtatttcttgaagacaggataaattttgggtcaaaagttttgtttgtgggttgatgtccctattgcaccagtggggtcaaaaaaaaaaaaaaaaaaagaatagactgataaaacatgtgttgtttcctagcatgcaatagcttataatggaaggcaactctgcaacatgtgatgccattaggatagtcacaatttttctataaaagctgatgagattaggtagcttttgttgcattaacaggaacaataaagattctatcactgttttcctaagtcgtagtctttgctccttcagtgtcagatgacaggcctgctaattattggcattttcattctgttgcgcatgctcgtttttcttatgcagacaatttaagtgttttaataattgattgcattatcaaatgttaatatatctacatgataaatgagaatatggctctaaaacctttgtgttatagcttttagacattcattttactaattatacaaagtgacagtttttaatccattataggtcattactgaaaacatacaaatgtagaatgatgacaatttcttaggtacagggttttcaggtacatggtagctatattgtagtatttcagagttgggcaaagcttaactctgcgattcttcagaatgtttttttactttctattaaaaataattctagccatattatttttcatcttgacttacaaatctaacccatgaaactgtgaggttttagtagtgtttttagccagaaagtctctcaccaaataacaaaactacccatgtaataaataggtaataaaaccagcatgatgctgttctgattctgttaatagtaatttttaagttaatcctttcatctgtttgtggttaatgctttttaggaccagtgaaaccagtgagaaccaactggaacagagttagtgtccaagttcagaacaaagctgcctgacccattaaactgattgagttgataatcttactgattttagcacagtattgaaaccaatttaaataatatgccacatatacatggggaagatagcaaaagctgttaattattctaagcatccctttttaaagtggatttcaatgggttaatgttgtattcctataattgcagtgtctaagaagagtttattgttatagggctcttaggttcattgttttcctgtttcatttttaaactgtcacacgaatcccagcaatagtaataggcctgttccaccataactagttcattagaagctagaggtcaaagttgagacctaggctttctgttccttaagcagacattctaccacttcagttagttccccaacaccgtacatgtattttgaactgatttttaaaattaagtgatgcaaatgcaattatatttatgtattatatgtgacataattatatttgttatcagctttttcagattcaataatctattaaaataaaactatcagtttccatggtgactatattataattatgtgctagtgtttatatactatgtgttatttacttgggaatatgtattaataagttagtgtaattaattagactggacccttcttagtatgcagaaatctaaagttttttttttctgatcaatttaaattttataagtagctgaaaataatttctctttttttgtaatttagtatttgtatgaagtaaatagttgttctccattaataaagtatactgaatttatataactttgtatttgaagtgaaacacaactatttaagtaattttacttctattttgatatatttagcctataacaatttacaatctcctagactaggggtacttttcccccaaaataattttaaaatttccagcagaagtggaaaaaggaaaattgctatggatatccattttcaaacaatagttttcttttatgtcacatattatatgaaatctgatatttatcacttagttccttcatggaaataggaattactatggctatattccattttgagtgttattttaaatttcatgactatgttattgtagattgtcttaattctacctcatagttttttgtaatttaattcaatagttatattgttctttcaattacagcacctccagattggtatcattaaaattgtaataaatatatgcaaattactttatgaaactttaatacatttactttactccttcagcactgtgccatctgtcagatgattcatgtatattctgtacgtaccatgcatttgtcatcaagaaatacatatatacgattaaaacatacctttttatctaaagaatgaatgtctaggacagttgggactgaattgattcatagggtacttgttatctcattttgttccgaatacattacatgtattcactcaattaaacctcataaaaggacatcattaaaatatattttattatgtccataatgtcatagggagattaattcactcaatagaaaacaacacaactgaatttgaacttggtggttttaatttccagactgccagcttccagtgaattcatatgatgttagaaatttgaattgttaagataggtcctgtttctatagacataaagcatatattgtagaaatcatagtcctaccctcttcatctgagacaactgtcaacttcattttttagcaggaatggcatgagggaaaggaaaggaaaggctgtagattttgttctgaactctaagaaggccttttccgatgatccacaattttgcatctgtgagttacttttgtgtctgaacagtatcattcattcttggtatctaaggttatctcttctcaaaccagatagtgaaggtggcatttgcaatttttgaggaagatgaaaaacttaaaacatacattgttattgtcttaatccctcccattgaatacgcttgccaaaagttctctttaacaattactccaggcctcctttatatgaaaaaataaaggtgttttccaagttgatttcagttatgtcaggggctaaacattctgaaccagtactgatgtttcttttgatgggaatagagataattcctctgagtcatcttttctaaaaggagacactatgcgagattattctgtcactcatgtatttaaactttattttaagcttatatctcacattactgctagaaatactttaatcttactagacaaattataatatcatgcttaatgtaaacattaatgcattcctcacagtcttctgaagtgtgggcatttgagtaccaaggtcattccaaaacacgtggcaggaggtgactgttggcaattgcaagtatgccagcatggaatattgaatcaaagaaatcaatatgtcaccttgtccaaatcctttcttatactatgtcaaaccgattacatgttatcaaaaaaaatacaaaccatttaaatgtttcaggaagctgaaatttacaatatattgctgaattagttaacacaaaattgtattatccttttcatttcctatattaaggaccctgatattatgcaattcttgtatttaagatcctgcaatttgctgtactttcagatgttgtgttagggtccaatttgggaatgacttcaatattttttattgtccgcatatttatttatgttttccatttaattatttattcattttacatcctgatcactgccccacctccaggtctccccttacacagtcccttctcctattccactctccccattcttctctgatagagtggtgtcctctgggtatccccccatcctgacacatatttgaattatcttaaatttgaatcattagcaacaggatataaaagttgacaaagtgcaatcagtaaagcacatttgcttatgtttatcgatttactttgtgacaatttaacattttagtaattagctaccaggttgcagcttactgtgatataggaaatacatattagaacaaacattttgccatatagagttactgaggcattgagcttgtaaagtgcctgtttgtagaatgtctgaaattttgtattattgaaatcatcatttgaatctttggaaagaaattaaaaatttccctgttttactttattttgtacgacaaaaaagcagctatcttagaaccgatgtggtaaattttcactcttaagttcttctctgaaatatattctgttaactcatttacttacagtgctgacattggtgactcgaatgtctctaccatttgttcttgataggcaatataggcaatactgggataaaatttaaaaaaacttttaaatattaatatttggatatataatattttaactattgtaccaaatttgttctttatggatagtgcattttagaaaatgaattctcttatcagtgagtgcataccatctgtgttcttttgagattgggttacctcactcaagatgatattttcttttctttttttttctttttttttttattaggtattttcctcatttacattttcaatgctatcccaaaggtcccccatacacacacccccaaccccctacccacccactccccctttttggccctggcgttcccctgtactggggcatataaagtttgcaagtccaatgggcctctctttgcagtgatggccgactaggccatcttttgatacatatgcagctaaagacaagagctcccgggtactgattagttcatattgttgttccacctatagagttgcagttccctttagctccttgggtaatttctctagctcctccattaggggccgtgtgacccatccaatagctgactgtgatcatccacttctgtgtttgctaggccccggcatagtataggaattttatattatttgtgactattgagaagggtgctgtttccctaatttctttctcagcctgtttattctttgtgtagagaaaggccattgacttgtttgagttaattttatatccagctacttcactgaagctgcttatcaggcttaggagttctctggtgggatttttagggtcacttatatatactatcatatcatctgcaaaaagtgatattttgatttcttcctttccaatttgtatccccttgatctccctttgttgtggaattgctctggctagggcttcaagtacaatgttgaataggtagggagagagtggacagccttgtctagtccctgctattagtgggaatgcttccagcttctcaccatttactttgatgttggctactggtttgctgtagattgcttttaccatgtttaggtatgggccttgaattcctgatctttccaagacttttatcatgaatgggtgttggattttgtcaaatgctttctcagcatctaacgtgatgatcatgtggtttttgtctttgagtttgtttatatactggattatgtagatggattttcatatattaaaccatccctgcatccctggaatgaaacctacttggtcaggatggatggttgttttgatgtattctaggattcggttagcgagaattttattgagtatttttgcatcgatattcataagggaaattggtctgaagttgtctatctttgttgggtctttctgtggtttaggtatcagagtaattgtggcttcatagaatgagttgggtagagtaccttctgcttctattttgtggaatagtttgtgaagaactggaattaggtcttctttggaggtctgatagaactctgcactaaatctatctggtcctggcctttttttgtttgggagactattaatgactgcttctattccttcaggggatataggactgctcaaatcattaacctgatcctgatttaactttggtacctggtatctgtcgagaaatttgcccatttcatccaggttctccagttttgttgactatagccttttgtagaaggatctgatggtgttttggatttcttcaggatctgttgttttgtctcccttttcatttctgattttgttaattaggattttgtccctgtgccctctagtgagtctggctaagggtttatctatcttgttgattttctcaaagaatcagctcctagtttgcttgtttctttgaataattcttcttgtttccacttggttgatttcacccatgagtttgattatttcctgccaactattccttttgggtgaatttgcttccttttgttctagaccttttaggtgtgttgtcaagctactagtgtgtgctctctctgttttctttttggaggcactcagagctatgagttttcctcttagaaatgctttcattgtgtcccataagtttgggtatgttgtggcttcattttcattaaactctaaaaagtccttaatttctttctttattccttccttgaccaaggtatcattgagaagagtgttgttcagtttccacatgaatgttgactttctactatttatgttgttattgaagatcagccttagtccatggtgatctgataagatgcatgggataatttcaatatttttgtatctgttgaggcctgttttgtgaccaattatatggtcagtttcggagaagttaccatgaggtgctgagtagaaggtataaccttttgttttatggtaaaatgttctgtagatctgttagatccatttgtttcataactactgttagtttcactgtgtccctgtttagtttctgtttctaagatctgtcagttgatgaaagtggtgtgttgaagtctcccacttttattgtgtgaagtgcaatgtgtgctttaagatttactaaaatttctttaatgaatgtggctgcccttgtacttggagcatagatattcagaattgagagttcctctttgaggattttacctttgatgagtatgaagtgctcctccttgacttttttgtcttttttgatgactttgggttggaagtcgattttattagacattagaatgtctaccccagcgtttttcttcagattatttgcttggaaaattgttttctagcctttcattctgaggtagtgtctgtctttttccctgagatgggtttcctgtaagcagcagaatgttgggtcctgtttgtgtagccagtttgttagtctatgtctttttattggggagttcagtccattgtggttaaagttggcattttgttctcgtggctgtcttttttcaggttttttgaaggattacttttttattgctttttctaggacgtggtttccgtccttttattgttttttttttgttttttttttctgttactatccttttaagtggtgggttcgtggaaagataatgtgtgaatatggttgtgttgtggaataatttggtttctccatctatggtaattgaaagtttgtttgggtatagtagcctgggctggcatttgtgttctcttagtgtctgtaaaacatctgtccaggatcttctggcttttatagtctcttgtgaaaagtcttgtgtaattctgacaggcctgcttttatatattacttgacctttttcccttactgcttttatattcaatctttatttagtgcatttttttgttctctgattattatgtgtcgggaggattttcttttctggtccagtctatttggagttctgtaggctacttttattttcatgggcatctctttttttaggtttgtgaagtttacttctataattttgttgaagatattttctagccctttaagttgaaaatctgcattctattctactcctattatctgttagtttgttcttctcattgtgtcctggatttcctggatgttttgagttaggatctttttgtacttcgcattttttaaattttatttatttatttatttatttgtttgtttatttatttatttatttattttacattatttactctctagtacctttatttatttatttatttatttatttatttatttatttatttattttttaattaggtattttcccttgtcaaagatcaagtgaccataggtgtgtggattcatctctgggtcttcaattctgttccattggtctacttgtctgtcactataccagtgccatgcagctttgatcataattgctctgtagtacagttttaggtccggcatggtgattccaccagaggttcttttaaccttgagaagagtttttgctatcctaggttttttgttattccagatgaatctgccgattgccctttctaattcgttgaagaattgagttggaattttgatggggattgcattgaatctgtagattgcttttggcaagatagccatatttacaatattgttgtttccatgttctctatggaatcttctgcacctgagattctctcttccatctcttgtattctgttgctgatgctcgcatctatggttccagatttctttcctagggtttctatgcctcactttgggttttatttattgtgtctacttccgcttttaggtctagtatggttttgttcatttccatcacctgtttggatgtgttttttctgtttttctttaaggacttgtaacctgtatttctttaagtgaattattaaagtccttcctgatgttctctaccatcatcatgagaataggtgaatatgcttgctatgtatgctgctagaccattttctgtcttgaaatgttaatatgaaacatattaagctttggatatacttggatctattaaactatgaagattattgtcaatagcattttcacaggttggttggcattaaacctgaatagaactgtcagaaagtaattggattaagggtagtcctaattcttgaataagaaaactacatatcagaatggtttcccttccttttgtgaatataaaccatactatttatcatattcctcttgaatttttggcacttttttctaataggaagtatgtgagaaaaaaaatacttgaacttttccacctgaaacagatatcagattgttagttagaatatggattgtgctgtataatataaaaatgattttgggccatttcccaaatatttgatcattttattgttgtttcttctatttcaggtataatgtatatttttatttgttatttttgtttttgtctaatgatatatttagtgtgtcattagcaacccaaattagttttctaatttatttatttataagaatgtgtgttatcacaatggattagagctcagaaaatgggatgatgtgttaatatcaagtaactgccataatatgctgtaatgatttaaatataaagagacacagaaaactaattttcttgccattcgtgaaaaaattaaggattgatattttattggaccatcagtcatgggatggagaatggttaatggggccctgccttttactgctgaactgttggctgctgatgcattctgaggatagaaagtcgttgcctccaatgttgacccatttccaagcccttcaagctctagtgaatacctccaacagtctcacagattaaattcagtggatcacaacacagaatgaattgactagaacgtgaataacaattgtatgtaaaataacagggattcgcatgggaaagtgtgtgtgtgtactatatatgatgtacacgagtgaactttacagaaaacatttaattaatattaatggtatgtttggaagatgtggcatgaagaagagcttttcaatgttttaatcaagctgtgtttcagtaatgaatacatatgactagaatgtttagaatagataatagtactttaagtaggcttttaaacaataggataattctgagattttaaggatctgaactatggcagtgtcaatagcagtgttaaggaagaagggaaataccaaaaagtagaaattaacaggttttagtgacttactccaagaaaggtgacagaagagggtaagtcaaatatgatttctatgtatcatttctataactagatttatgatgagaaggaaaaggacaacaaattaacctcttgatataataaatttctcaagtaagaaatttcgatgcccacatgctgtgagtaattatatgttgaaaattagtatcagaatattgtctgagtttcagctagctagaaagttggagttacagtcaatctgaacatgtatgatattcatgaaaatgaagttggccatagtggtataaacttgttatcccaagatacttgaaatgttgaggcaagagaattttacctttctcttctatcttgaaatgtagaccaggctggcctacatagtgagaccttgtaccatttgattttttttcaattttttattatatactttcttcatttaaatttcaaatgctaaccagaaagtcccctaactccccccccccccgccctgctccccgacccaaccactcccacttcttggtcctggtgttcccctgtactggggcatataaagtttgaaaaaccaaggggcctcttttcccaatggtggccgactaggccatcttctgatacatatgcagctagagacatgagctctgggggtactggttagttcatattgttgttctacctatagggttacagaccccttcatctccttgggtactttctctagctcctccattggggcccctgtgttccatcaaatagatgactgtgagcatccacttctgtatttgccaagcactggcatagcctaacaggagacagctatatcagataccctggtcttttcagcaaaatcttgcaggtatattcaatagtgtctacatttggtggctgattatgggatggatccctttttggggtagtctctggatggtctacccttttgtcttagctccaacctttcctctgtacatccttccatgggtattttgttccctatgctaagaaggaatgaagtttcaacgcgttggtcttccttcttcttgattttcttgtattttgcaaattgtatcttgggtatctaattttctgggctaatatccacttatcagtgagtgcatatcttgtgagttcttttatgattgagttacctcactcaggatgatatcctcccgatacatccatttgcccaagaatttcataaattcattgtttttaataaccgagtaatactctattgtgtaaatgtaccacattttctgtatccattcctctgttgagggtcatctgggttctttctattttctggctattataaataaggctgctatgaacatagtggagcatgtgtctttattaccagttggaacatatgtccaggagatggaaatcaaaacaaccctgagattccacctcacatcagtcagaatggctaagatcaaaaattcaggtgacagcagatgctggcgaggatgtagagaaagaggaacactcctccattgctggtggtattgcaagcttgtacatccactctggaaatcagtctggctgttccttagaaaattggacatagcactaccagaagatccagcaggatcatttgatttttaaatgaaataaaaataaagccccgaatgtaaataaaatcacccaatgacttaacaataggaaagtaataataaaaacctaaaagaaaaacaaaacaacacaaaccataacaaacaaataaaagtcaaaacaatactatccttatctgagttctgtagataccaaaagtttataaaaatttcgtagacgaaagcccaataaatgaaatgccaagaatatatctcaagatatttttctcttcaatttcctgaagatagaagttggtttaattgagttgactgtttgtgaaacagtcaaatcagaggaaaagagaataaaatcttttaagttttccatgacagagtatatttgttcttttaattgtttcatattcagagtagttaaaagtcatatcaaaatttatttacacctcagtaccactgatgctgctgatgattgttgagatattagaaacaaatcatgaaattttggaaggtaatgaaaggatgacccacaaatctcaatgaagatgatactgagttagaggtgttcaacactagaaaagtacatgacttacaagttaaaataacaacctggcttagaggaaaggatttctagttgttattttctttgcttgcttgtttgttgttcttcataagtatgacctcattagatgttctcatggatatttattaaagataaaatctgatgcaaatcatcatggaaaattagcaagatttattagtgtatattacttaacaacaatattaatgttagtacctcaaaatccgtaaaagggactatatggaacggaatgaaatgtgttatctctgctttctcaaaatagtaaatatttatttacttaatttacatttcaagtgttatccccttatccagtttcccttcctccagcaaactccatatcccctcccccttcccctgcttctatgagggtgttccaacacccacccacccactcccacctccccacccttgacacttacactgggtcatctatggagccttcataggaccaagtacctctcctcccattgatgtctgacaaggccatcttctgctacatatgcagctggagccatgtacatgtgctccttggttggagtcttagtccctaggagctctgggggaaggggtctgattgattgatattgttcttcctatggagttgtgaaccccttcaactccttcagtcctttctctaactcctctattgggaactcaccgctcagtccagtggtttgctctgagtatccacctctgtatatgtcaggcactgccagggcctttaaggagacagctatatccagctccttttagcaagcacttcttagcatccacaatagtgtcagaatttggtgactgtatctgggatgaatccccaggtgagacagtctctagatggcctttccttcagtccctgctctacactttgtctccatatttgttcccgtgagtattttcttcccctttgtaagaaggacggaagcacctaggtccttcttagaaatagtaaatattttaatgtaggttaatatattttatgtctaatataggttacagcaattaatagttgtactttgggaaactaatcacaatgtagaaatcttgtgcatagactgcttcatttacaaacaaatataatggttgggaatgtggaagtgtccataatttgatttaaattatttttgtcacatagtttttgatactagcaaggaaaaacattggatataattgaccttattaatattaatttcatacagtttaataaaagttatgttagtgattttacaaaataaaacctttattcatttatgcttctctaaaatgaccttgtaaaatgtcaaaattgttattgtgtgctttttaaaaatacttaatgatttgtatttgatgcatttaaactctttattgaaggtcaaggattctattagggcatttttgtcagtaaaatgttgacagaaactaactaggtagttcaattctcactgacaacactgtcacatttgttaagaaattgcctaatgataaggccaaatttttgctcattatttttcttagtaaaacccatgaggtcattaaatattgcctcaattagagtgtgtattgtatcaaaatttaggtaccaaccagaattcttatttaatagatactgagtttacgttgtcatggttgaatcattctcagagagatgggtatgggagagagagagagagggtggagggagagggagacagatagagaaagagatattatctaccatgcatttgggtgatgtgaagctggattttacaaagcattggtgtttgcttttatctcagtaatattttgggtgtattcagattgaaattagatatgtataaatcatctaccagcatactccaaattggcaataaagacacagtagaatattataactcttatttgtaaattattttctcatttccatcttatgggtctaaaaatccaagattttatatgcttctaattgtttagcctttgtatatcatatatgagttattagaatactggttattagtgactatagattttaaattcaactgcttttaactttaggagtttgttttttaggttcccatggttttagaagtccttgatgtgttattcatctttctctagatatagggattcatttatacttcatctttcctattttctgtttattttagagtataattttatttttttaattttctgattgttttgcataataaaaccgtgacacactccagtgtggcgttcatgaatgtaaattgtattggggaagcagacacaggatgatcttagaagacaaacatagtctcggtagagatactttcattaagagtctcaaaacactaaatgaagtaacatgaattagcatgcatttttgtgttaaagacagcagtttatattacaatcaatattagtaaagctcacttattttagttctaattcttgtatatcaacagaatgttaaaaagaaacagataccatttggtaaatcgaatttatttcgagaagtaatagcaggctttgaaagcttcagctccaactccgttttaccactacctaattgatactctgtaagatcctcagttgttttgtactcagagtgaggataaaaatgttatctactttaatcttatttagagagttgagttaatatatgctcattttgttgttgtggccattttgtattaatattaatttacttgtgtcatgatcatgttcacattgtatagcatcaggttgccaaatggccattggtaggatggccggagaggagacgagttttgcagggacggggtaagtcaggcacagtggtcacaagaatctttcagctctgactgactagtaatcaggtttttttctttatttatacaggtttcacagaacaaagacagattaattattattcaggaagtacatactctattattttgtccctgagcatattttgatttctcattacatgtcaggagttacgagttcagtcacaattaaaatgtagaaatggaatagattttattttccttatcagccctgtgattctagttcaaagcaaacacatttattatatgacaacattcttttaggctacagttttaaagcactccagacaaactaagtatccgaaacaatctttttattagtagcaaatactaatacctaactccttttatgtatcatttcatcatcatcatctatgctataatgtaggaaaagttattttaatctattcatcgtatttactgagttctattcctctagggatgtactctgtataatctcctatctttgaactaaattttcagagaactctaagcatattgtcaaaagagtctttgaatatgttaccaattctcatggctagtaggaatttgtcaattatgtttgagtttatattattccaattatataccatttgattttgctcattgtcataaaggaattcctagaattttagtgcttatctgtgcttaattcagtctctggggcatacggaatactttcaaatagggccagataaagctatttccctaaaaccagaagggatagtaatttcagatattcctaagaatgtgcagaaataattttcttggtaacagacatagagtgattcataatgtagaaaggccccatgaaaatatcaggccggggccaaaacctaaaagagacattatgacagcaatcacagcttttgtctccattttgatgaaactgtgtcaaaccagctgtgctggcttcttcatttttatgaatagaaatttgttaataaatttaagcaacatatagttcataggtgggggatgagaaactatgaagtgctaagcatcatggacagatatttaatagagaaaatacaaaatgataatacggaaatcagtctactgcaaaggaaattgccattaaaaatgtattttcatggcataaagtccctttcgtactctttttatttgtgtatatgactacactttagctgtcttcagacacaccagaagagggtatcagatcccattacagatggttgtgagccatgatgtggttgcttggcattgaactcaggaactctggaagagtagccagtgctctttaccactgagccatctctccaacccctgtgctagcttctaaactttcactctttccagtagttataatgatgccaccagatggtaatttttttccatttaaaactcttttttaaggtattttcttcatttacatttccaatgctatcccaaaagtcccccaaaccctcccccccactcccctacccacccactcccacttcttggtcctggagttccccagtactgaggcatataaagtttgcaagaccaatgggcctctctttccactgatagcccactaggccatcttacacacgttctcgcgaccggccaggaagacgcaacaaaccggaatcttctgcggcaaaagctttattgcttacatcttcaggagcaagagagcaagagccagagcaagagcaagagcaagagcaagagcaagagagagcaagaaatcgagaaaaagaacaagaacaagaaagcaagagagagaatggcaaaacccagtcccttttaaggagaattatcctccgcctaggacgtattactccctgattggctgcagcccatcggcccagttgtcatcacgagaaaggcagaacacatggcgggaaaactgcccctgcacatgtgcagattatgtttactacttagaacacagctgtcagcgccatcttataatggcaaatgtgagggcggctcctcacaaggccatcttctgatacatatgcagctagattcaagagcttcgggggggtactggttagtccatattattgttctacctatagggttgcagatccctttagctcctctctagctcctccattgggggccctgtgatccatccaatagctgactgtgagcatccacttctgtgtttgctaggccccggcatagtctcacaagagagagctatatctgggtcctttcagtaaaatcctgctagtgtatgcaatggtgtcagcattttgaggctgattatgggatggatcccagggtatggcagtctctagatggtccatccttttgtctcatctccaaactttgtctctgtaactctttccatgggtgttttgttcaaaattctaagaaggggcaaagatggcaattttaaaagttctattttcatgtgtagtgtgtgtgattgcatgtgtttctgtatatcatgtgcttgcctgatacccatgaaggcaagaatatggcatttcatcttctggaactgtatttggcgatggttgagaaccagcttgtgagtactttgtactgaatttgggtcctctacaagaacagcccgtgcccttaaccaatgatccatatctctaactctaagaaggaattcttggtgattgtttatttttgtagaaatgtagtcaattctttgccatgtctgctcacagattatggtcaacatacttaacaactttgattatactattatatgtttaagttccttttaatttctgtgaactgtttaacaattcaaagaacaattttattttgtagatcatgtaggtggagaaactgatggcgagaaaggcatatacttgtgtatggtattcaactaccaactgaacttctgttttgaatagagatctttaaatcaatagtttgttatcagtcagaaagttatgcatgtataatttttttatttcgaatatgttcctgcacagaaagagccatggagtagatgcataattcctaacataaggcatatgcacgttgaaatgagataaatagaattatctttcttatgctgtgttattcgactctgtatttattagcatttaagttgtaataaaattcacacttgagaatgaagtggatttaagttaatgatactaaaataaaaaaatactcaatgatggatttacctcttattttagaaattttaggctgtgaaaaaacagaacaatagcagaaatgtagtatttctaagctgtccactctcttaactaaaggtagaaattaatattaaacattaggttctgtcaaaataagggcctggcaacttgctgaaaatttgctacaagttctgcagcatttttaatcctctagatttaatgcaaatgctcgtgattcatgtcttcactaattttgtggtttaggtttctatggattaaatgtctttataaaacatttaatgttatcgtcttaatttgtgattcctatgcaagtattttatgtgaaaataataattgtgctgctgcgtatagaaacaaatattatttcctcacctattgctatgcccacatatcagtcagttttatctgttgatcacagcctccattatatcagatcattgtgctcagtctctaatgtatgcactgcacttatgcttcaaacagacctgtatgcttgttcatttataaatataactgacctagtagccttgtacctgccagataccacttccccaaatgaacaatctactcctttgatttcatgtctttatgcttacttcatgtacaactgtgtgtacttctagttattccttatgtctgctttgagaatactgaaaattcttaactgtacctgagtggagcctttcattgacttaatatgtgttctattaatttgtgtattttctttcttaatgctttcttctattctccttctcttttacaacctatttttaccttgttgcaggtaggaattaaattaagtgtttgctttgttctctttataacacctactagtgttttgtcaggccatttttttaagtgacttctttagttaagatgtccagcacatgcacatggttttaatttttaaattttatttatttatttatttatttatttatttatttatttatttaatgtgactgtatgtatacacatacttgggtatactgatttgcatgtatgtattaatgtgtgtaaaaaacttgtagaagatgtctctcttctaccccatgtatttttgacatcaaacttcagataaaaaggcttagcaacaaacagctatatctgctgcatgatcatactggctcatgaatgtgttttaaatcatctcacaaagtatgaaactgaataagtgaaaaagttgaagtttatgatctcattataactcatacaaaagttacatatttactgtatagcatagagaaacattgaaacatcccttttgctcattcatgtatttgtaactgttagtaacatgaaaagcctcacaaagtttgggtctttcactttgaactttttccttgcttattcaagcagttctatttttgtaagctatttagtaggcccttcattaaaaaaaaaaaagtaaaagcatttccccaaccctaaatatttatttttgctttcactttcccttcaaataaataatttattatttgaattcctatcaaataccttcggatcaactataggactcacaacagttcataaataggaacttgaaattattccttcatagttctacagaacttcatttaagaagtacatgctatgttgcttagtatttgtttcattaattcatattttttttagtgtctaataggtgtttggttttttttttttggctgaataaaatatgtctccttacatggaaaggtttatattctagttatgattatgaatttaccactcctgcccatgcttacctcacagtaccttatacaaacagtcaggattatttagctcgaggtattttaggacaaacattctcagataatcatggttatgaaacatttagttctagaggcatacattgtcaaccgtaaggaaaataatactcattaacatttattgatattttttactgtataaagattgttccatattatctgtcattcattcttcatatctttttgaagtatataatattttgaagggtaatttgggaaaatatttcaatagttgaagctccagatggttaagtgaatcccataagatctgatagaaagacagaactgggcattgagccggcaaagtttgattctggaggtcttttctgcatataaattccatgcaataaaccattttgtaaactttaatggaagtgaaaatacaaataatgttaaataagtcagtttctccccttgaagtgacaattgtaattaatagctgtatcgggaaatgatagtgctaatttagtgatacttagaatcctctgagtgtagttccataagtgagaaaaatcaccagaatgaatacaaaagatgggtttaaatgttgctttatgaatccttatataattttcagagaataattagctattttgaggctcaggatacaaagctgattttaataatatgtgccttataaagcaattattaatacttaactagaaaaactagttggctgagtaggacttgaagtgtaaagaaggcacaggccagtttggtgaatttaattccttcaaataatagaagaatttttctgtaggaattttgaacttttgccaagacagctttttgactgtggtgaatggatacaaaaccatacaaatctgtacgttcttctcaagaataaaatagtggcaagggttggaaataggtccaagtggttaaaaggacatgatacttttgcaaaggaatagagttaactttcctgcttgcacacagacttgctgtcgactacctgtaattccatttccatgcgaaattatgatctcttctggcctctgtgcgcactcccccatatgtgtgtatacatacacacacacatatatatatgtatatatatatatgggtctcatatacatatttgtgtatatgtgtgtatatatatatatgcatatgtatacacacacacatacacatatatgtataggtggatgagactctcagttttgtggggatgagtgtgcatttctcacacataatccctaatgtttgtgaaatatatcagaatagtaaacattggggaacaggtaaaaattcaccgcagaaaagtaatttgaatgtatggtatgatattctcaagtagagacctctgcaagacaccaccagtaatttgttaacaaagttgctcaaaattcagcattaccttggattattatctggacatcgtttacaaaaaataaaaatagaggaagactttgactaaacacagatgaaaccaaggagacggcagaaataactctccctacctctctcttttcttcatgtgttcattgagcagaaaataagcatggagaaaagggggtggacagctgctgtgttcttgcttgtcagttttcagttggagagaaatgcacagagagaataccaggagaggctcatggtcccagtctgctgtcacttaatagttgtaatgtttgcctttggtaggtattttgtcatctcccttgctatcccttgtcaatttctgtgcttgtcagtatgccttctctacttcaatagttggggccccaagtgttagtgttaaagaaattagagcgtgtaacacctttgtctcttagttactgaattagcatggattcttggagcttcccagcatcagcaggcaaacaattttagtagcactctgtctttcttactgcccatcaccgaaagcttatcttgcacttctgcaattcattccctttgcgtcatttttaattagacataccactgtgtcaggaaagtaagaatatgtagggaatggaaataagtgacattacaaaaagtcccttttttttaaatatgtttttttgaacacttcgacctgtgcattctatggggctatcatcagtacccaccaatccttgtctttgcctggtctgtctactgctattaacagtttgtaaggtcctagtacattatcactcggtgcaaactatcactgagcccaatcagatagacagtaatgattttatgaaggagacatggcaaatgtcaaaggataaaactggtggtgatgataagtttttaaggttaagtaataactgagaaagaaagaatgggtaaaaacacagtttctgtcaagtggcttatgagtcaggttgatgcttgcctttgctccttagagtgactttatatatttatcattgttgtttctattgtgattactaatttatttattctaatgagttttacgtctatttttgtgtcctacttctggcattacttttgctgtgtacttctctttgcttctatttctgctcacactttttctctattctttttcatgaaacatgttttaatcttctttatcctaatcccttcataaattctgagcatccacctttataactccatgaagcagatcgattcctttactctctgagacctgagtacagacagaaatttctcaggtaaaatctccttgcaacaaaccatcagctttttttcagagcagcaaagattctcaagatcaagtatcagacttaatgagagtaaactctggagtcacaagtactggtattatatatcacactgccagttactaaacagttaatcttttctaagatgctaccttctaaatacctgtaaatatccttcagctgtaaaatcagaaaaaataatcatacgattacttcatttgccagtttgcagaagatagtatgcatacaagaaaactatgagctgtgccctaagtatgaattgattgattcttgcattctgtatttagttctgaggatattatattatttttaacatagtcatgtcatttatggtgcaatgggaatacgtacatgtatctcctaggaaggagtttccatagcacctttcacatatttctatgataattccagtgcctctttccttgataactggtcattttttttgaagttcagaaaaactcaatagaaggggaaacacccatgtgaatagagctgacctgccatagattaattgtacttcagagatgttctgccaccatggtacaggtatgagccaagacttgagagaagcatataatgataaaagtttcttacttgcctaggtaaacagggaattgttgcttgcaaaacttattgcatgctgttagcacaatctgggttaaacatttgtgttctctatagtgatgtatccattcataacaggtccatttttttaaacatcaaagcagatcgtgaagaagggaaagtttcttggcaccaatactcagatattttcagttgttgattaattatttcaaatatagtacagcttacttgtactttatgtagcagaactctaattttatttacttgtaaaggagtcagaaaaagcctggaatcttgcaagctaagaataaagttatatgtacgtacacacgtacacacacacacacacacacacacacacattttgagatagcttttaaagatattttcaaacattacaaattaaatatattcgtccatttgtccttactttaacaaaataagtgaggacaagaggaaaggaaaaagagacattttcttctgcaagacttaaattcatttttttctttaaagaagattttatatatatatatatatatacacacacacacacacatttcattccaagcacaaatcatatacagaagttaattactaattagaagggagttccataagacagtcacaaacatgcaagcatagagtcaaacagctttacatatatcagaattgtgcctgtgagacaatgtaatcaaggttttttacacttatgttccatgttcattctcaccataaaggatttcaatcacatttatcagtgtttgtttgatagtgaagccagtgctaactaaattttctgagaagtgaatgaattaactatagtactacacagacaagagcttgaattatccttatcatttaagaattacactgatgcttgaggaataatctatactatatgcaaactaaagccaattcagaaaatgttaacaaaatatttcctctcttagtagtgttctctgtctctctgcctctatctctgtctctctctgtctctcccctgggggcacagcaatgaatgaataaatgaaatattttattcgtatagcttataatcatgtaacttcgtcagtggtatagaagattactaaaacatttcaggcacctttctcttaagtgttagatgaaagagattgctcttcattataaaagctaacaattagaaatagtttgttatcactgccagaattttgatatccttacctgtattgtatccaggaatctcaatgatcaatacctgttaacagaatcatgcttaatgatagacagttattgtacttaaaatcttttacacttatggagcccctctatcttagagtgcatctcatatggatcatgaagactgaattgtctttccctaggacttaaagaaatctagaggtatttgaaaatctttcccatccaaatatgaaaagagatacataaataaaagcagatgaaacatttttaacacctaacttgctttaaagttttttttgtttgtttggttttttgtttttgttttttgttttttgtttttcgagacagggtttctctgtgtagccctggctgtcctggaactcactttgtacaccaggctggcttttcatgtaacatattttgatcatattgtttccccaacacatactacttcaatatcctttacagtgtcttaccaacccaaatttgtgttcttctgctctttccagaaaattccccctaaaacaaaaattttaaaaatgaaaatcaaaataccaataaaagacaaagaaaagaaatacttttttcttttaaaaaaaagttcacttttgtgttggcatactactctttggtttgggacacgaggcctttcttggagtatgattgatagacccatcgctactctaatgaagaattattacattgcctttctcctgtgctatcagttgcaaccatcctcttagtcaggtgtgagactttgtttccacttcccattcacagttctgcagttttattttagcctgtgcaggtcttgtgtgtggtatgctgtcacagtctctgtgagttcatctgtatattagtccagctgtggaattttttctacttttaattttgtagtttgatggtgcctggaaaagatgaaagctattcttctgattgcctaatcatactccaatatcatttatgttataagccttataactatttcatttgaaaataaagagggaccagtatgagtacaactactcaacaaatgttttaattgttgaatgcctccctgtataatggtgaaaattaaacacagtgaaaagatcataagtctcacactatgatgtatcactttttaaattaattgtggtataaagatatatgctttcctaatcaagaataacttaaggctcctgggagacacatccctagaaacaatgttccttaaggagattgtttgaggaattttcctgactctgaattttgaactgcaggtggccctcttgatctttcagcttagatcttatgtttttttggacttcctttctgtccatatcaaagtacttagggaaatacttttacccagattcttaaatttcctactaaaactcctcattactttattattagtttataggcaccatgcctttgtttcctcacatgtacaagattttgaaaatattgcttaatcaacatttagaatgcctatgatgtccttctgcagcaggagtccctaagagcaaattgtattgttggtaatgcttctaaaagattatcccagtgctttgtatgttgaattctatgtaatgtatatcttgtatatattgtttttgttcttttatattcttttttaaatattatttcatttatttgcatttcaaatgttgcccccattcctggtcctctctctaaaagttctttaccacatccctccacccctttgcctctgagtatgtgctcaaccagctatgtcctcacccatccccactcaccccctccatatctctttcctaggctatcacatctctacaggattaggtgcatcctctcccactgaggccagacaaggatagtcctctgctatatatgtgccagcagccaaggaccagcccatgtatatattcttaaagtactgctattttatcccatgatttatttttggaaatccatgatagtatgaggcttttaggattatcaaaataaattaccatgaatattaattgataaagcttcaagtgttgttattcaactccatcttaataccttctcaaagtaattttacaggaatatcctagttctattaatgttaagaatcttaaactttttggaaaattgtgggcagaattaaattagagtaacatgatatttaatgtgaatcctgaacgcataccaataatagtattaaattaaatttttagaagttgaaaaattagaattttcccttttgaagtaactaaagtatatgcatttgctacttttgaaaatattatatttacataaactacaaaggacaagggatagtgtgcaaaatagattgtgcttcttagtgcttttctgtggaaaacatatgtgcccatagccggaacgtttcagcctaagatgttcatcaattaatgaaattataactggaaaataaaatataaccgcaattattgacatgttccttgtaaatattttgtagtcccactctaacaggcacagatacaaactgaccttaaaaatgtcacatgtagcattgtggctgctggactattgtctaggagagacacagaggaggcctcccagggtttatttgtatgtgccttttgtgtaaagtttttgtctagacagttactgtgccaagagtagctatttgatagcacctgcttctggtgtggaaaacagagtcttttatttagagaacatcagtagccatttcattcatcaatggtcaatgcacctacataaagatgaacataccaatgattccaaaagaaagcagatctttcaacatcaggggcacatgtaaacattgtatctacctatgcatccttctgttttactttacatgcaatcacatcctattttttttgaagggggaaataattaattcagaacaatcatagaaaaaaatcccaaacttcactttttaatttaaaaccctgcaatttgtgaaatgctgtggtaatgttatacataagcttgctcatttgcattaatattactttaatcttcttaaggtattagaaaaagtaattgcattatagaagtaatgatgtcaaagtagctatagaatactttttaaaatgtgggattattttcaatgttttattgttcttccatctaaatgatttggggggagtaataatttttttcatggttagccattttcaatgtgatgatttctactaccttttttacttactagttctgtcactgactccatctgtttcccctatcagtttctttttctactgaagctagcgtttttgttttgttttgcaaagattgatccaaggccacatacatgctaggcaagtgctattccattgaacacaccttaccccttgctccctgtcactcatctcttcttattcttagcctttagactgtgtggtgcaaaacctgtgaatacattgaaattttcttgctttcttttttctcttttaaaggaactttcacctatctgctgctcttatcatcatgtaaccttaatccattgccctgatgaatcacagattatttattttttcaacattaatctcttgtggacttttcatacacataaggctatatatttttttcccatttttttatagattctttacaaaagagtgtgttcgtcaggtatatgttacattatatattatactatcacagtattgcaatatataccacatgtacatacttatgctttttcttattgcatatagctaataatagctattatgtggaaggttttgtctagactcttgtccctaattttaagctgattccttctttatgtcttttatttatgttgtgttacatttgaaacccagtaattcaagtttcaaactgaccaaaaacttccatttagagagtatattctgaaatccctctccttttttttttaaactttgtattattctgggtgtgtatatatgtgtatgctggatattcagtttggaacttaatgtatagtagcaagttgtttagtatagatttataattaaaacattacagtatttctcctttatttaagagagtcatacacctacattggttatttcatgtttctcacaaatacttctgcttttccatttatacccctgtgatagttaacagattattaactgaaccttggtctattcaaagagcaggactgtaaataagacactgtcataccattattgaacatgtacaaaccattgtagcctagagttaccagagaatccaagagctatattttgaaagtcttaaacatactgttatacaactacaaatattccacacaatgcactacaataacaggtcacaatgtgctattaaatttctgtgagcatatttgttcttcacatatacttacatgtctataaatcccctagatttgatatcaaatccatgtcaagaaatcaatatgtgagatttttatttgtaagattaaatacagttaaaaatcacttaaagttttaaacattaaaaaaagaaaaaacatctgtacttttgaaatgtattcatttccaaagcaagataatgacattggacaccagaaagaatagatagttatagtagaatgctagtgaatgtctctctaaagttcatctacattcctgttctatgtttaccttatgttttctttttattctattcctattttttctgtaaaataataaatagtgtattatataaattcagttagaaaacatacattatttaaaatatctgcttaagtaaaacaacacaacttctgccaggagtctggttcgaacaccagatatctgggtaccttccctgcaagaagagagctttcctgcagagaatactctacccactgaaaccaaggagagtgctaccctcccaggtctgcttatagaggctaacagagtcacctgaagtacaagctcttaacagagacaactataacagctagcttcagagattaccagatggcgaaaggcaaacgtaagaatcctactaacagaaatcaagaccactcaccatcatcagaacgcagcactcccaccccacctagtcctgggcaccccaacacaaccgaaaatctagacccacactaaaaaacatttttcatgatgatgatagaggacatcaagaaggactttcataagtcacttaaagaattacaggagagcactgctaaagagttacaggcccttaaagaaaagcaggaaaacacagccaaacaggtagaagtccttaaagaaaaacaggaaaacacatccaaacaagtaatggaaatgaacaaaaccatattagaactaaaaagggaagtagacacagtaaagaaaacccaaagctaggcaatgctggagatagaaaccctaggaaagagatctggaaccatagatgcgagcatcagcaacagaatacaagaaatggaagagagaatctcaggtgcagaagattccatagagaacatcgacacaacagtcaaagaaaatacaaaatgcaaaaggatcctaactcaaaacatccaggaaatccaggacataatgagaagaccaaacctacggataataggaattgatgagaatgaagattttcaacttaaagggccagctaatatcttcaacaaaataattgaagaaaacttcccaaacataaagaaagagatgcccatgatcatacaagaagcctacagaactccaaatagactggaccagaaaagaaattcctcccgacacataataatcacataataatcagaacaacaaatgcactaaataaagatagaatattaaaagcagtaagggagaaaggtcaagtaacatataaaggaaggcctatcagaattacaccagacttttcaacagagactatgaaagccagaagagcctggacagatgttatacagacactaagagaacacaaatgccagcccaggctactatacccggccaaactctcaattaccatagatggagaaaccaaagtattccacgacaaaaccaaattcacacaatatctttccacgaatccagcccttcaaaggataataatagaaaagaagcaatacaaggacggaaatcacgccctagaacaaacaagaaagtaatccctcaacaaaccaaaaagaagacagccacaagaacagaatgccaactctaacaacaaaaataaaaggaagcaacaattacttttccttaatatctcttaatattaatggactcaattccccaataaaaagacatagactaacagactggctacacaaacaggacccaacattctgctgcttacaggaaacccatctcagggaaaaagacagacactacctcagagtgaaaggctggaaaacaattttccaagcaaatggtctgaagaaacaagctggagtagccattctaatatcggataaaatcgacttccaacccaaagttatcaaaaaggacaaggaggaacacttcatactcatcaaagataaaatcctccaagaggaactctcaattctgaatatctacgctccaaatgcaagggcagccacattcattaaagacattttagtaaagctcaaagcacacattgcacctcacacaataatagtgggagacttcaacacaccactttcatgaagggacagatcgtggaaacagaaactaaacagggacacagtgaaactaacagaagttatgaaacaaatggacctaacagatatctacagaacattttatcctaaaacaaaaggatcaacattgtaaaaatggctatcttgccaaaagcaatctacagattcaatgcaatccccatcaaaattccaactcaattcttcaacgaattagaaggagcaatttgcaaattcatctggaataacaaaaaacctaggatagcaaaaagtcttctcaaggataaaagaacctctgctggaatcaccatgcctgacctaaagctttactacagagcaattgtgataaaaactgcatggtactggtatagagacagacaagtagaccaatggaatagaatttaagacccagaaatgaacccacacacctatggtcacttgatcttcgacaagggagctcaaaccatccagtggaagaaagacagcattttcaacaattggtgctggcacaactggttgttatcatgtagaagaatgcgaattgatccatacttatctccttgtactaaggtcaaatctaagtggatcaaagaacttcacataaaaccagagacactgaaacttatagaggagaaagtggggaaaagccttgaagatatgggcacaggggaaaaattcctgaacagaacagcaatggcatgtgctgtaagatggagaattgacaaatgggacctaatgaaactccaaagtttctgcaaggcaaaagacaccgtcaataagacaaaaagaccaccaacagattgggaaaggatctttacctatcctaaatcagatagggggctaatatccaacatatataaagaactcaagaaggtggacttcagaaaatcgaacaaccccattaaaaaatggggctcagaactgaacaaagaattctcacctgaggaataccgaatggcagagaagcacctgaaaaaatgttcaacatccttaatcatcagggaaatgcaaatcaaaacaaccctgagattccacctcacaccagtcagaatggctaagatcaaaaattcaggtgacagcagatgctggtgaggatgtggagaaagaggaacactcctccattgttggtgggattgcaggcttgtacaaccactctggaaatcagtctggcggttcctcagaaaattggacatagtactaccggaggatccagcaatacctctcctcggcatttatccagaagatgccccaactggtaagaaggacacatgctccactatgttcatagcagccttatttataatagccagaagctggaaagaacccagatgcccctcaacagaggaatggatacagaaaatgtagtacatctacacaatggagtactactcagctattaaaaagaatgaatttatgaaattcctagccaaatggatggacctggagggcattatcctgagtgaggtaacacattcacaaaggaactcacacaatatgtactcactgataagtggatattagccccaaacctaggattcccaagatataaggtacaatttgctaaacacatgaaactcaagaagaatgaagactgaagtatggacactatgcccctccttagaattgggaacaaaacacccatggaaggagttacagagacaaagtttggagctgagatgaaaggatggaccatgtagagactgccatatgcagggatccatcccataatcagcctccaaacgctgacaccattgcataccctagcaagattttattgaaaggacccagatgtagctatctcttctgagactatgccggggcctagcaaacacagaagtggatgctcacagtcagctaatggatttatcacagggctcccaatggaggagctagagaaagaacccaaggagctaaagggatctgcaaccctataggtggaacaacattatgaactaaccagtaccccggagctcttgactctagctgcatatgtatcaaaagatggcctaatcggccatcactggaaagagaggcccattggacatgtaaactttgtatgccccagtacaggggaacgccagggccaaaaagggggagtgggtgtgtaggggagtgggggtgggtgggtatgggggacttttggtatagcattggaaatgtaaatgagctaaatacctaataaaaaatgggaaaaaaaaagaaaacagcaaaaaaaaaaaaaaaaagaaaaaacatctgtacttttgaaatgtattcatttccaaagcaagataatgacattggacaccagaaagaatagatagttatagtagaatgctagtgaatgtctctctaaagttcatctacatttctgttctatgtttaccttatgttttctttttattctattcctattttttctgtaaaataataaatagtgtattatataaattcagttagaaaacatacattatttaaaatatctgcttaagtaaaacaaatcaatggagaatgtcttactgtaacgatgtctataagtatcatttcttcaaggatatttggagcaaaggattaaaaaatgagtcattgttataaggtttgacttcccttgtggtcacattatcatgtttatttgtatatttttgtttgcttgcttgcctttgaagacaggatctcactatgtagccctcactgacctaaatcttattataaaaattagactggcctcaaactcaaagagatatacctgcctttgcagttataagcattatttttataagttgttagtgaatcaaaaacttactttcaagctctttactcataaatgtgattatatttatgtcttaataattctaaattaatgaatacatactgagttttaaaaggctactatgaacacacacatatctacagaagtgttttatttttttcttttattatttaaatcttcccagtaatcagtaggatagggagctgtgtcttatctgtgaatataatataatgaatatatgacttcagtgttatttgatatttttttacatatttctactttgtgttattagattattattatcattgtttttttttaaaacataggttgattatttttattgtgtttatttctttgtgatactactttagaatttcaactcagtaatgaaaaatatatttgtagtgataaaaataaaaacataaaaaagtacagatattttctgatactacattgtcttagtttatacaaaaattaacatgattaaaaaagtgattgataagtactgtaagaaatttttgtaatttgctttcattcttatgtatgtagatgatataataattttaaatattttctgagtacaaacaagtatgattagattaggcttaaaaatagtgtatatggtaaagacagccttttggcctttttgatagcctaaacttccaaaaataggaaagtgaaaatcagtgtgcaatttttcaggtctgtaaaatatcttaccttgagattgtatagaactggtttgagtgaaaagttaaaacttcatcctccagcaatgttctttcattacattagactagggggaaaaaaaaagaagttaaactaccttgtaatgatttaaaaaataatacacactcaagatctttgcacaactgtgctattttaatataacctttttctattatataaaaacaaaacaaaaaaaaaaaaacaaaataccgggcaaccaactaaccaacccaaactagattcagaccaatatacttcaagcaggaatatattacaattgtaatctccttcaaactttccgcaacttaaattttaaaaagtgtttgtgtttgtgtgtgtctgtgtgtgtgtgtgtgtgtgtgtgtgtgtgttggatgcagtaatctacgaaaagtctctatataacggtgaacatgatatttttctagacagtgttggtctcagaggtccccattaaaaagaatacgtattgctacttctcaaatcttgtcagatactgggtatattacctgcatgcacaatggaggcattgaggataccagtctacctttatgataaccttgttgatacacttacagaacatattgactgttgtatgcattattttagtgctaccagagctttgctgagaagcctttgtaagaaatacacagaggaagaaatcacaggccttggattctgaaatgtctaattcagtcacagtgatacagtgttcaaatgaactatagcagatttaatgagcaatctaggacagagacacatgtactggacacaccagggaaggagattacatgtgcagggactaattagcatgaaatatgaaaacattcatataagttgtcttgatctatgggagtcttttattattgggaatgacttttgcatgaagttaatgaagagaaattcaagctgtataaagaattttaaaatagtatttttaactttttgaatctgtaaatatctacattcaaaaaagttgtagattataaaatgggatgatcaaattaatattggcctattacctacaattgaaatattttaaggaagagaacagaaactgtcctcagatacctagtcagctaatttacaaggactcagaccttggtctcttattaggtaaacattaaatattaagtattgtcttatatcttatataaggaaacttggggataatgtattccaccattagaggcacatttctttaatttagctgtttgcagattgtatatatctttagcaaatatacttgtatgtagattgatatttcaaatttgacttttttcaaaattgtattaattaatttattttaatttatttaatttatttttttactctccaaattttattccccccaccccatatccaccctctgactattccccatccatatctcctctctaccccttctccacatggatgtcagcaccccacctgacctctaaaccccctggggcctccagtctcttgagtgttaggcacaccatctctgaatgaatacagacccagtagtcctctgctgtatatgtgttggtggcctcatatcagctggtgtatgctgcctctttggtgttccagtgtttgagagctcttggagttcagattaattgagactgccagtcctcctacagggttgccctcctcctcagtttctttcagtctctccctaattcaacatcagggatcagcaacttctgtccagtggttggatgcaactatctgcctctgactcttttagctgcttgttgggtcttctggaacgtggtcatgctaagtccctttttgtgagtgttccatagcctcagtaatagtgtcaggccttggggcctcctcttgagctggatcccactttgtgcctgtcactggctcctctctatttccatccctgtaattcttccagacaggaacaattatgggtcagagttgtgtctgtaggatgggaaccccatccctcacttgatgtcctgtcttcctgaaaattataaacactattattataatactttatattagtaatggtgaatattaggcaattagggataattcttttccccttaattttgtgtttaaaactttacatggagatttggaaacataaacgttaaattttataagtctatttttaattggatattttctttatttacattgcaaatgttataccctttcccagttttccccctcccagaaaccccatatcacatcactcctccccctgattctatgaaggtgttttctgccctaacattctcctacattaggacatcaagccttcacaggaccaagagcctacctcccattgatgccaaataatgccatcctctgctacatatggaacaggagccatgggtactctttgatttgtggtttaggccctgggagctttggagggtctggttggttgatattattgtacttcctaggggtatatatactttttttgtttcaagtgatatcattttcgtatatatctaaaggtcttcttatatatttatattaaaccccttactacctaagatattgtttattaatttggttttaaggtattataatatataccattgattttgttgagatagtaatggttgttttttatattcaactgatggaattatataaacaaggatcccttttcataactgacaagttatactttagctacattagcaactgagtggcatataataactgtaatatagacaggctcaagagaaattatccaagttgtgctattcattatccctggcttccattcaaatggagttggatgtgttattttcatattctccatcttgagtctccatctgtgacagtcccttggcagaatttcaaactactcctaatttttaactttgtggttggtactgagccagttttccatgctttgggaaggaggtccccatttatgcacatttagtactgtgaggccctcgtgattgtagagataccagcaactatgttggaaagtcaaattaatgggttcatagctgagtcttgaaactgaagcatatcaaattgtaagtggccctgaaagttcatggtctaaaattctcactgattacatgagagagatctagaaacattgtttttccttactttctcatgcacacctttactgaggaatggagatcttggtaattccttggtaaacataattcattagagagcagtataatagaggttaagtgtagacttttttctatttttactaatttattataatgtatattttagttttccttccctcttgtcttcctagcttctatcccataactcttccctgccaatccactcctcctaaatttcccatcagaaaagggcaagtctcccattgatatcaatcaaatgtggcatatcaagttacagtatgtctaggcatctcttcctcatataaagactggaggaggtgacctggtcagaggaataggtcccaaaagcaaaagttcctctgatctctctgttaggaatccaacaaaaacaccaagttactcaatgtaacaggtatgcagagggcctcatttagacccatgcaggctctgtgattgtcagtttcatctccgtgagcttctatgactccaggtttgttgattctgtgggttttcttatagtgtcattgacccttcaaacatgtaatgctgtattgaataatttagttgtgattttatatttaccattactaaattttaacaatgccatttaggaaattataattatgtgtgtgtgcgcatgcgcatgtactcatgcatgatcattttggaatgtttatactcttattcagactgaggcactattattgaaaacatttattaaacacatttacatttttattcacatggtgagataaaagaaagtgcttttcacaatttatataacttaacaaagcatatctcagttaatttcgtttgttatatcacttatcaagtctacaacggttttgtgtggccatcacttctaagcttggtgagttgatggctagaaataaattgaaccttctgatgaaatatataagttctcttctgaccaaatagggctgtagttcataccatcagatgtcagaacactgagtaagaattcctcttagtagtttatcttgtctggggatgtgaggcctatggttgcatccaatatgttttaaatttcatgtatttcttagctttattagcctatatgttaagtattttcaatttaatttgtagactgatatgttttatatatgttgctgtaggcacatatgaactgctgcattttagaaattgaaacaataataccattgttggctttatttgtctctgcatgtcttcatttggtgatatgcttttgtttatgaatgttaataatgttttatctttacactttcattgctttacaaaaataattttgagaattttttaaccgatgccatggaaaacttatcattctatttttaaatatttttcatttttatagatagtcatgtcttacagaaaacattctgttcttgcaagcttctcctagtcttctaaagaacctagtggggctagagagatggctcagtggttaagagctccgactgttcttccagaggtcctgagttcaaatcccagcaaccacatggtggctcacaaccatctgtaattaaagcagatgccctcttctggggctgtctgaagacagctacagtgtacttacatatatttaacaaataaatttttaaaaaaaagaacctggggtttgttgctgacatctgagtcaggatgctcacaaccacttgtaagtacagctcttgggttctggtgcactcttctggcctctgaaaacacacccacactgcctcatacacataaacacaataaaacaagaattaatactagcaaactgccacaatgtgcatgtactcttcttttccagaccagggttatatattgatagtgtattgagtggaggaccttaaacatgctatagaaatgagctactgagcctgtttccttctcagcaaaatctcgaacatcatttgtaacattttgcattaaaatggaagatttgtattagattgtgaacaatgttgagacattattattgtttatacttcatcctaagttaattatatatgtgtgtggcttttaagaaattcatattgtcttctctatttgttactacttataaattattttatgattgatgacatctaagcctgttttggctcattcattcattcattcattcattcatacattcatatacctttttccactgtattcattgagaacttcccatggtaacacatttaaagaacagatgataaagaaagttgacagtatacacatatacagtgctaaaattgcataaagagtgagaaaaggctttacatggttgggtgattttttggcagaatgagggtgtttttgcttgtaaagtgttcacttcagattaaatgtgactgtcatgttccaattatgtttcagatacttaattgtagagaagtggattgccattttcttttttgatgaggttttccttttataatcccaattataagttgatagttagattctgaacatcgtttttctcagaaataattattgttgattctgaaaaacaaagtaagttaataggaaatttcgttcactttattgttgaattttgctaaaatatgtattgattagtgaggaatgactataatgcttttaggatttttacccacatcaaacatactccttgtctatgaaaataaatcataataaattccagcataaatgaacagaagtgagtttgtagtggacaagtatatttctaaagttggaattcacgatagttgattaaaataaaaatgaatgtattttatattattattttatataggatagacatgcatttgtttgtgcattacaagaacatcacaaatatgcaaaatacagaatcagtctcttagtaggtagttaaatggataaacaaaatgtgatacactttcgcatgcatagtcagctataaaagaagagggtctattattccatcaacactgaagaaactggacaacttaatgctaagtgaggcttgtcagatacagaaattcaaatacctcatgtttttactaaaaagctaatctttaatagaaaattgaatagaatagttgtgagatactggaagggctgtaggcagaggagatgaggaggttttgtcagtctgtccatttgttgaatatgaaatgtaatatccaacattcagcaacacagtaggaaatttttgcttcatagcaattaattgaatatatccaaataacttatgggggtgtatattaatcattttttcatcttatggcatgtatcaaaacaatgaaacctgacatattcatttctcaatatatgcatacttaaaaataccatacaattgctatatggaaataccaaactgtatttcttgtaaatatataattactatggctagctaattcatattctctctctctctctctctctctcccccccccccctctccctctctcaacttcatctattatgtaaacaaaactatggaaaatttcagtattaaaaaacaagtttttaagtcttagattttaaagttgtattcatctggcaatatatacagtttaaatagatgacaatttcatttacttatttaagtatttaaagatgtaagttgttttattaacttttgggtcagctccacacgtgtataaaagctgaccctgtccgctaacacccttttctttttctcctatctttattgaccacacactcaccacttccttgggttcatatatatgtcccttgttaaattaaatggtgaacaaaaccatttatttttatatagggtacaagtctgcagaattacgtgaatatcatcatttacaaaattcttttgaccatactcaaggccctgcatctcagaaaagtttacagattccaactgttcacattaatgtggctggagttgatagttttccgggaatgccgtattgtgaatgtgaggaagcttcctcggctttagcttttcaatgttagagtccttgtgttcaattattttccacaaaaggctctgaatcttgcattcctttgctatgcttgtcttgcagagtactactgatgcctttgctacttagctcagagtgctttcgatatcctgtgtttaaatagagcttagcagaacgacttttataaattttcatggtttttttatgtgtatatttaaggctgagggcttggccattcttacaaacatgcatgcaaagacatgtgtgagtcaaatggcagaaacaagaacttttatatataaattaaaataggaatattgcatcttttctggctggcagttttaatagtgcatttctgaaattagttgaaagtactgtatttacctttttaaatatttacaaagtataacaataccactaattcaatagagatatttttaaaaggaaaaccatctttctatcttctaagcagagacttcctctaatttgcatttagagagctctaaattaaaatgctaaaaggaaagcaacgaattccagccactgctgctggtactgtaaataagactgaattacttgatataattttaaatgaatactcttgatattgagacatcatgttctcacatcatgcaatggtaattcacagaataatagaaacgtttctttggacatactttttacccctattaagatatgagtttctttcttctagatcatcaaattcaattttgtcatctctatacagaaatagatgggtataaagagaagtcactgaatggtttgcctatattaatgttattttatttgtgaatcattgtaactgagtttcagtatacaacagaaattatatactagtgctttgtttttagaaacacttgctacagagtaggaaattgtgacatttcattccaaaatatggaatatctttgaagatttttacattcaaattcctcatacgattttgagatagcattggaaatgtaaatgaaataaatacccaataaaaaaagaaaaaaagtacattaaaataaaaagccaatataccaaaaaaaaaaaaatccccatatgagcaagtaggttctcagcaggttttaaattttcttttatcatctgtgtttttcatcaactacatttctttttaacttcagtatctttttagttctcaaatccaaatcatataatgcacaaaaaaagatatttctcataattcgatcagaaatctacaagccaaagtccaagaacgccatcatcaacaaactatcctgtatctgtttctatattatttcttgttataaatgatagtattttcacctacagaaggctgttcatttgtttctctggttcatgtctaccactaaattatctctgttccccattacataggatttaatttgtcatcataactggatcattttaagcaacatattctatgtctcattatatactctcttgatataaggaaccttaaagtcctgttattattctccatttatgtttctcggagaattgaatcctttggacagacacaagtgtcaatgtattgattgctcttccattccatcttctctatttagttcactgtatttaagctttgttctccattgttgcactcttgaatacaacaacatagagccataccaatttaaggcttttcaatttttgctttacaatttttatttgaccttctcattagcatctgattcacttgattctggtttcaactgaagttttagtgcaggcttccatagttctcttattctctgggtttcctctatcttcacttgtacattcatcctccacttgctgttttcacagttatggctgttcggtaagtgggccactgagtaggatgtgtagtgaaggggataaagaaacaaatacagatgacttcaatttccttcaccttgttcaaagtgttaacatttattgaaaatggagaagaaactgttaagaaatgaacagatcattcttctcttttattaattggtgatcattatgtttttttatttatttaattatttaattatttatactctagattttattccccacagaacccctggtccacccacgacttccacatcccatacctcttcccttcctgctgtctccacatggaagcctgcatcccggaccccacctgacttctaaacatcctggggcctccagtctcttgagagttaggtgcatcttctctgactgaatcctgacccagcaatcctctgctgaatatgtgttgttggcctcatatcagctggtatatgcttcccggttggtggttcagtgtctgagagatctcaagaggtccaggttaggtgaggcttctgatgctctgacagagttgttcttctcagcttcttccagtttttccctaattcaacctcctaggccagcagcttctctccattgattgggtgcaaatgtctgcatctgactctataagcttctagctgggtctttcagaggtcagtcatgatagggccctttttgtgatcaatgttagacagacaccatagtgaagctactaggaaactaatatcaagttgtaagaattaaattggctttattaccgaccattggcaaaaggatgccacataaaatgtgtctgtatgaattcaccctgtacaatattttgcatggagaggaaatggaagtatagaataaagatcctggagccttctgccaattagagacaatgaagatgcagagaatatctgtagatatcctaagcacaatcaatttatctctaatgaatcctttacatgcaaagctgagagaacatcaaagaagattgggtagaaaagagggtaagacctggaggaccagaatgcgacctgctacataagggaaaataatcatgtgaaatgtcaacactgttcttgcttcaccaagactagcataataacaccaccaattgacattccaatttggatggaaaaaattccacatcgtcctacccctagatgaagtaggagaagtggttgatacctgctgagagagggagaaccatcttcctgccagaatgagtacccacaagtttgtgcaatctcaggtgatcattacctggacatatgtatatataagtaatgctcggtacattgtttataggtgtgtgtgtgtgtgtgtgtgtgtgtgtgtgtgtgtgtgtgtgtatacacatggatgtcatacacacagttatatatacacatgtaataataaatcagaagtcataaatttcagatagaaaggaaacgtggaggagttggaggagttggtgaagttgtgggagtgttagagatatacataatcatgtatgtagctagttctctaaaaagaaaagtatggatatcaagtacagaaaatttaggaagctatagctacaaaaataagggtagtgttgtcccatatcccataaaaccagaataatatattccaagaaaattgatttacccttatgaataaaatgctactgaatagttaggtgaggatatggcaaaacatccatgctattgacaaaatattgagatcgctgatgattttaagaagatcagagttagatggttagtaactgtgaaataaattgtatgtgaattaaggtgttattttaagaaaaggacaaaaattgagtggagaacggatggagagttttttgtctatgttctataaagtcatagggaaagattgaatcagctgcttagttcttcgggaaatgaagacatctgtcattaaaatggataagtggattcaggtgaattatgctatcctacattgattacttcacaagaaattgtgaaaatttaacaattgatacccagttaccatataaacaaatgagtgattaaacatcacttaatttttttctagaaatagggcaagggcgatgattttctttgtacttatctaattcgtgtggtatatttaattaagacatgttaagtgataagaaaataatggttaactacaataataatatattttctagctcaataaattggatttacacactaccccttacataataaccatattatatgacatataattgcatgttgtctataatacacattttaatcaaatgatagtgataatttttaggagataaaatgctttttctgttttgttttgtaggtatagtacataaagtatttacttgaaacatttcaaactgatttaaattaaccaagtattgtcttttggcatatagcaaactctggaaaggtgtcctggtctgttagttttgatttttcttgactgagtaacctctgttttataaatttaaactgatgtatcagataattttagatggatcttgactttgttttgtgatttcaagaaaatgaaatttgaagcatttttagggaacttgtatcctagcttttcattcacatgaatcaaaatatggtgacattttatacatacacacacacacacacacacacacacacacacacagatacacacacacacacacacacacacactaaacaacttgcttatgttttgatttatagataatttcaaatataagactagaaaaaatataagcaatgaaaacaacactagcatatgctatgtctttaccaaagtcacatataattcaattattccttttcccttggtcttcaggttcccctattctatatctttcctttttagttttttttccacaactccagttcctcttcaaactcctttactgtgaaattatccctattccaatagcttatcttttctagtgttgtattttttaagaaatatttgtgggcgtggtggaacttgtgaatctagctgtatatgtagcagaggatggcctagtcggtcatcaatgagaggagaggcccttggtcctgcgaaggttctataccctagtatagggaaatgccaggaccaggaatgggagttgctgggttggggagcagggggagagggtagcgggagtggataggggatttttggaggggaagccaggaaagggcacaacatttgaaatgtaagtaaatatataattaaaaaagggaaaaaaaacatgttcataaaaaagaaaaaatagttggtactgtactcatatctgccaacactgtaggttggtcctgtaggttggtcattttgtttgtctgcctatctgcctattctctctctctctctctctctctatatatatatatatatatatatatatatatagagagagagagaacttttcattgcatattacccatgtctctggtccagatgtaggtaatagaaaacttagtatatatatataaagtctagtatcaccagtgtggttgtgtaaatttttgtgaattttccgattttattattcatcgttattattcaatattaaaataatcttttgaaaatattttattttatttatgtgtaaggactggtaaatatacacatatccttccagcgtctacagagtttagatatgtggagtcccctgcaagtagatttatacatggttgtgagtcaccactcttgccttctagtaattgaattctggtcctataaaagggtagttctcgctgggtgtggtggcatacggctttaatcccaacacttgggaggcagaggcaggcgaatttctgagtttgaggccagcctggtctacagagtgaattccaggagagccagggctacacagagaaaccctgtctcaaaaaacaaacaaaaacaacgacaacaacaacaaaaaaggttagttctcagatttgatcattgagccatcgttccatcacataatatcttggtgttttgtttacttccagatttttcaggaacaatcactttatgctatccttgaaacatcccactatttttagaactactgcattactttatagcactacaaatgcattttaatttaatcttatagacacattgggtaatatcaaaattagtgttgtctttgaagaactaggttcctattcatggggcagtgtttgtgaatctgctatttataataataggtagatgattctaacttttataatgcaagaaatcactatttacttttaaattaaaagattataaaacataaaaatttacctgagaataattttctcatttagtacatattaggagcttttcgttgtatattacccatgtctctggtccagatgtaggtaatagaaaacatatatatatatatatatatatatatatatatatatatatatatatatacttttataatatgtataatttataaaacttagaattctatatataatttataaaatgatatatattatttataatatatatcattttagaaatatcaaatacttgtaccaaaatatgaaaaactgctgattaaacattaaaactgccttttaaacattatccattatgttaatatataactgacttacttcattaactgaaataaataagaattgaaaatattaaaaagaattagataaagagttttagtgaggacgctggatctttatgtacttggtcactttatagctattcaaaaaactaattcatcagagagaacaataagtagtcagatatcttatattactttgtttaatttttttattctcaacattaacatcttcagaattttatagcatttcttctaagttgtgattctatatttttgtaagtagtttgtaattgagaaataccatttgctcaaacaaatttacacatgttcagtgaattcattattctgctttatttttctgaagttgtttgcatttattttccttcctgatcctctcataagtatgataactgatcttaatgcaaataggcataaggtgatccacagcaacaaatatgaagttcacattctttctatatgataagagctagtaattgagcacgttgaatatgaaaagcactgcacagagagttctctggctcttatgttcattagaattgctgctatttccactgaagttcatggtacagtccatgccctttctttcctaactgcattagattagcttgccaggttacattattcattaggttgctaagacttgaggcctgagcttgaacttcatagcatgatagtgtttgatgtttttattctgttatcagtgctttatctgttaaggaaaacaagtatacttttaatttgttttttcctagatctattcagtacagatttctcctttgttaatcatttatttttctgaagtgtacattgaaaataatggtgtttttttcccttcattgtgatagtgatttttaaatgcttgctgtttgaaacattttcctggaatatccaaactcagtgtgtcttagttcaatacttcttttcaactcatcctttccctttattgccataattttgaaatgtcttttctttttattcatgcatgtttaatgagtgattacatattctcacttgtcttcttcaacaacaatagcaaaattggagagtatgttcaaggaattttatttggaagtgaccaatctacttgacctcaagtactcacaaataattgaaacaaatctatttttgttcagctatttgaatatttaaaaccatctcaagaaaggaaataatcttaccactaacaatgaaattggactcatcattggagtttatgaaaatgtgttggaaattcacttagcttaagggtacaaatgaactttgttatgctctttgaatgttacattgaactagttcattgcctgaggatcctatttattatgtctgtctgatttaggagttttggtccttctttgtcctttgatttgtcttatctttgtaaagcctatcatttctttgtagcttatttgttatggtgccatggaatacctgtacattaagtatcattagataaattcttttttgaattccaagttaataatctaggatacggtgatatatatttgcagtcaaatggaattaaaaagataacatgattattaggtttgtaaaattattttcttgagagcatccgttttagactatggtatcaggaccctgagagcacttgtgcaagtctatatacggctgtgtatttgaaattcagcagcctttccagccaataatgtcagtagttataccttcttaagaaagtatttttaatctagtcttatgtaatgtgtagaaaaatgtgaatataacaagtcttttgttaattttttaaatcaactgaaggcttgaattttctatagaaaatcattttccctttctgactctttcatattcaggtgatattaaacactgattaaaatattgagattttaattcttaattatataatctccctggccagagttgttaaatcttgtgattcaggtagcatagaaattcagtgtaggcatcttttttatgaacaaagctgtacgatttacattgtttccaggtggttctgggaataagtgactagatcatgcagctgatggcttgatgagtttgaaggctgatgtttataacagatgcttccaaaatgtggattatgaagtatttttaaaggatttgtacatagagataacttctggtttatacttttggcagtatatatttcttgctgtcttgcttttgtctccttttcatttttatttccttcccttatccttttccttctttcccttttcttttccttcttaatctatctaatggctcatggactttaacttttaaattgtatttccattccttaaatatagccagacagatttgtaaggctaattgatattactattattatttcaagaagataatgtaaaattgcagccatgtgtacgtgttagaatcatataggtggaatgtaatggtaacattgcatataatctaatgatgctgcctggaaaacatacactggagtcagtctgatttttataaaattccctttcaaatcgccagttttttttttatattgggaatgtaaatgctatttcagtttatacgttctagataatgcttataaatataataacctatagaatcaaaattatatatcgtattatataaaagattccctttaattgaacaatttttattaattttgaggttataacattcctctcttttttcccttctcaacctcctgtatactcctcttattctcatgcaaattcctgtatcataaaaattacttttatatgcccaataaggtcttcaaagacatttttgttacatgtagactctttttacatccattttccctcttcttgtgttctgacattctaaaatgtggactgttcaaaaattattctttctcactctcagttccatttctttttttcttattttcttattttaaaattaggtatttatttcatttacatttccaattctatcccagaagttccccacacgctcccccacccactcccccctaagttccatttcttataactgctgtcatgatctgtcaatggtatacactgcgtaattcctttacctttatctctcaatcaatgagctaatattccccccctctggggaatgttagttatcagttttatttaacgtatacacacacacacacacacacacacacacacacacacacacacacaggcactcccacatataggcacacacagaaaacacacttgcacccattttcgtgtaaagtttttgttaatatgaagtaattttacttggctctgttacataatcacacaaagcaaaataaatgtttatattaacatgtgctaaagtcttactccattttatttctttaaagtccgtgaacattcatgtttcttatttgtttttagtacccgtagatattttaagtttttcctgagggttatcttcagaaaagatttatggttgcatttgctaagatttccccaacctgacttggtgctatgctttttgattttacttctcttttattcttatgaacatctgtgattttaggttgtacaaacattggtgttttacttgtcaattctcagggaagatttttttcctcttccactccacaccaaacactcatatgggcagttttcctttcatgcccccagagaaaggagcaaattcatatccaatttgctgctgttaaactgagataatagtccagggtgttttccagaccattttctttttctttttccaccctaatcaggcccataccttggtttctatgtcccatattgaatctttgcaaaatgaagctttagctaatcttcactcaaggtcaaaattcttgcttctgaactttatctgcctcagaacaggggaacgccagggccaagaagtgggagtgggtgggtgggtgggggagcatctggcagacttttgggatagcattggaaatgtaaatgaaataaatacccaatttaaaaaatccagtaaatatggagccaacaataacaacaacaaaaattcctgcttctgctgtttatccttctctctttgctttaccctgcttttcggcatctaggtattgcttttttgtaaatattgtttatgttatattattttcaaatatccataatagttaattcttttcaggaaaagcttattatctcaagatatgtattcttgaccatactttcagaaacagaacttcaaggaagaacttttacattaaaatttgatgtccaacttattttattattattttatagctttttggatatttgaataaagaaagtattctaccttgttttttcttgttaaacttaactgaatattaatactcattttaaaatgatgttaaaatagccatcaagtggacaattagcatagttattgtatcttttttttataaaaaaaaacccttgtatttatttttattttctagtgtatctcacttagttcatattcttaagtaacaaaatgatgctttaaataggagaagctgaaaacagcataaatatggtatatgtagatatttgtattatgaatggacaactaattatgaattcatgtgtacgtctatgttacttatggtttattagatcatggcattatggaccttgagtaaaagctgcctacctgcactaacagaaactctgcttgtcatgcagcatggcttcacattagaacattttgtcactgtaaaatctaccacttataatggatttacaagggaaagtcaaatgctaaaataggtttcctacaaaagatggaaattaaaaaaaaaacaacaaattcaccgttactaaatatatatatatatatatatatatatatatatatatatatcaatgaatgcttgctatattgtagatatatcttaatcatccatacaaatgctggagtccagttgctgctaaggacttgtttttaaactttgttaaactataatttcaacttctatctcagaaatattagaaactagagtagtggcttagtacatactggaaatattttgttcttgtggaggacctgagctttgtttccagcatatcatttgggtggctcatacctgcctacaactccaaattcaggggaatcaaaagcctctgcactctacgaatctactgttttgtgtacacctagtcacccactcagtgcccccacatacatctcatatgtgcacacacccatacatgcatatacaattaaataatactagttataatcctttgttacaaatcaaagtagttttcattccacaatataaaaccttttattcagtgagaattatgttcattgcttaataaatattctaaataatattcatttctagtgatataaagatggtagagtcatggatgatatctttaaatgctcatgcaagagattggagaaccagatatctgaagaaaagataatgcagtttattaattgttacactacaataggaaccaactattttataatcaaacagaagaaaatcactaatcctcctttaaaagttgaggaaagaatccctgaggaagtggcattttagtccaggcaaatgtgttccagtctagaaagtacagtataccgaacacttggcaaagatactcagacatagagtctcctcacttatccatgattgataaatattctgttatgtctcaattactggggaactgagatctttttttagtttagtaatacctaaggttgccaaagttataagtgttaccctatttttgtttaataggaaacaaataaaagttagcattaacatcttagtgtttgtaaaatataattcgatactcagcatttagatgcatttttagtagaaaaaatttaaaaaaatgaatttaaaacaaaagttaaaaaacctcatagcactatattaagtataaatatattaagtatgtatgtataagtacatatgtatgtatactaaatatatgtatacaagtattgatatattaagtatatatataatattaattgtattagctatacatcttatgctgtggtttaagtatgcagcatagaagagtaaattgatcaaagaggtatgggctttgaaggtatcgagaagaaaatttcaggaacaaatgcaatgactaatttaataaatactgtatttattgctacatatttatatcaaaaatagtaatagatctgaaagatcacaaagttgttcctatcttaaattataaaatatcagattttgcatcagtaagataaattgtaggaaagactgagaaatagaaattggattatttctcctgtaagaaaacaatacatgcattttttcatgcttagccttatgtagattctactgcaatatgtatgtttatgtgtttcagcttcattgattacatggtttaaagggttttagtgtggctaagtcctgtagattcagctgtaatagccttcagtaatgataaactgtttaatgactgcccaaaatacagcattttattttgactatatcagtaagttttttttattactactattttatattctctattttgtcaacaggtaagtcattcccaaagattttgtatattatggaattttcattctattttatatgaaaatggaggctatatgtaatttttactatggactatgaaattactaaaattgctaaagcaaagtatatacacagatcctttattttaaaaacagtaatcatcacaagcattaaaagaaagctccagaaattcctacagaatagctatcttttgggaaagttaacttattccatcttggttaaattatgatttaatgaaagtggaaatggtaactgatttacaagtctgttcttttattttaagagatgttttccgtgtatcatctttggttctggaatttgctatgcatagtatgcttacctataattaaataacacctatgtttttacttcctactcttgtagattgcatggtttcaaatatttctcgggggccatggaatatgagatgacattttcagatatcccaattaagtgcttttcactttgttttatattttacatgccaattcaactaaacacaatagtaggcaattatggtaacggagacagtttgtcaaaatggactctttaccatgaagaggtactattacagagtagaaatatatcaagtgagaaacatttaataaaatataagatgatagtgtcattaataggtactgttagaaagggagtgaaatatttgccttgggcactgttactgaacatgtcatgtttgcttaaagaggcatagggtgatatagaatttaaagaatcatacacaatttaaagatttaattgaagtagtaatttgtcatcattttggatatgtgtttcttagtgctagtgactgcttcctggaactattttctaccttgtgtattagggtctccccacccaccactaccgggaaatttactcttaattctattgcattgacatcatttgagacagcatgtcatttctgtatatcaatacagaagttgtttgtaatatcttttttttaatgccacaaatgcaatcagtaagtcaagagagtcacctgttgtcttattggcaggccacctacctgatccatctggacttggactgagagaagccttaataactaccattaggttttttatattgtcagatttcatacatccaggacaccctggtcagtggatgacagccaatttatctcctgcagttaatgatgtagacaaatactcatatttcagtttcacctcaatacggcaaaagtaaatagtgttctagtattcattagcagtttgctaggtagtaactctttctatgcccataaactggcacaggccactgtttctgtgcattgaccatcgagcaaactacttttgctcttttattgactcacattgatgatgttgtcatattctttcgcagtaattttgacagagccttgtggaatgaatttgttacatgcatcttttaaagacttcaaatttcattctgatgctagtatagtgctgttatactctgcagatgacatggaaattattttttttttcattagggaaacaagagggtggggtacttgcttactagctgtgctaactttattttcgtatttaattttgttgaagagcaatttcaagaagctttgggccattgtatcaccttgtctcattccattatagatattgatgcaacatggatcactgaacagtataatctcttttgcacagtttctattgatcttgtccagtaaatcattgtatgctgggtttgttctgaaatcatttatagcataaaagctcttcttgaatttgaaaatcaagtaccttcttgtaataggcaagttcatacaaagttagaattcattcattttgttttgttcaaaccatggttagaaatccttttcccactaagcatctgaaagaaggcttgtgtactcactgttttcatttgatgctttcgtgtttcctatagtacatcaccattagtttctttgcaatcactatgtagtctgtaatgaactgttttgttctgagcttttgattttgttggacttagaatatgcttgccctcctctgatgtaacattgtcactttttcttattgaactgtcttagtttgaggagagcacaaattcctctttcttaaccccttttagattatgtttgtcctaattgactatattagtcctgctctgggtctatccaaagtcatcatgattgcaaacactctgaagtaacttggttgtcagattcacatttcctgtaccttttcactgtgatttcttaaacattctgtccctgtagaggaggcatttattgggaaggtaaagcacactcttcttattaatttttgatatgcataagacaatcatgtacgtacccgtgcattaattaagttgtgtaataataggtaaagggttattattgatataggtgaagagaaaggaagtaaagaatgttttatagggacagtcagatcttctttttgtcttaatcaacagagaatgtttcacctgcaatgcgtgtgaagggagataagctcaacttttttcacagatacagttcctcctgcaactttcctattttaattatatttacctttgctatacagtggacaggatttacagatagatggttcaagtgcttccacctgcatcacacacatagaataacagtctgcaaaataactcaccccgaagcaacattctatttaaaagtgaaaatattctaagatcaaaacttcacgcatcttctaaataagcatagttgtttatttgcctatttaacacatattatctctgtggtgtgtgtgtgtgtgtgcacgcgcgcatacctgtgtctgtgtttgtgtgtgtgtgcttttgtctttttgtttttgacattctctaccagattttatgtattgacttcctgctccttccctgtagatataaccattgcttaagtttagattcaaagcattctaggctaaaagcagtgaggtacactttggcagcagccatagggatgcagcaatgatcccccacagtgtgaggactgaagtggctagggtgaagtaaaggccaatctaatggcaggcacagcatgtttgaaatggtttaggaggaaaaagagccagcaggttgctgtcctgatccagacaaattcatttgctgtttgtgactattagcagctgcttctcatcggggctattactttctcttttatctttaataagtttgtggcaaaaccttaaattaccagtatttcttctttattctgccacaatgaaggtttcgtttaaactttatgaaatgtgattttactttcacattgtaatatctctacctatgtttgttacatttttctatcttatacatttctagaaactagtaaaaattttggttggtacacatgatattacagtgtacaatttagcagtattattcaaagttattgaatttatcttgtacataccattataaataacttgggactcttggctatttattttgtgacctcagaaattaatgaaagctgcacagtaggtgacacctaattgttttcagtaagctgctagttttatgttcttgtataagattttattttttgctctagtgttaaaatactttatagcaccaaacattttattattaaaggatagttcttacaggagacactttccataggtgggtcattatccaactcctttttaatttagtccttaaaacttacatttcaaaccatttctgccatctacaataatagagcacatgataaaaatttcttgataaactgaagacattgaatggtaatatatttaaaaataaaatatttgttacccttttatgtagtccaagtctttacctgccttagctgttttgttaacagataatatagaagtgtttatagaattatgaagttttttttttagctactgtgtactttccaatggcaaattttgttctttttcttctactctggtgacagccacaactatctctaaaagggaagaggaatctatgcaataaccatttttgaattttatgtatgcattcagtcttaattagtgtatgaaacatattcctatttattttagaaatctgtatatatgaactatacaaatacatggaacatccttgaattaagagtgtaattgtccttaaatgagttaaaagtgagaaagtcattaacattgtggattgcctacagatgacaaggaatttccctttagtgttagagtttgagatttaaaggatatgcaagatgacttttgaggattgccattgaaagatttccccccttgttcaaatcggggttcatttgtggagctatcacagactgactgtttcatatgctttagaacagttgagtcaaactttgctaataatccatggagttttaaaggtatatccatcctgagtcctttcctatggagattctgacattcttattcagcagttagaattcacattgtaactaagtgatagaaaagaatagaagaacgaagacatggtgtcaagtatttttccaaagtagtgggtgatgtaacaaggaaggataatagattgagaagaaaaagggtcaggagtctgtgctaagaatagaacctttatgcttatttaaattgcattcttctcatgtgtttgtacaattccaaaggcctcttaaatactacttttctgctttcaaatcagaagtcaccagcaggctaaagctaagtttaagaacaaagaagaaacgaaaagttcaggtactctattttaccctcgcaaaaagattttctaatgcttcgatcaccttcaacagattacatggctgtagcctccgaactgaagaaaattactgctgaaagataaaattgaaagctgttggaatccaaatggcaaaagaagagacaatatagctctgcttatttcccattgagctcagccagcaacaaaccaaattgaaacattcagtatcacttttatgtgcataaagcaaaagaagaatattatacaaaattcaaagtctaaattcatgtgacttttggggggtggtagaattcagtttttcagtttactttcagccatttaatcacaagtgaatcatgaccaaacatagtcaagcctaataataataaaaaaagattttttaaaataattccattactgttgatttgctttggtgtttatgttatataaagacacacaataacattatgggagaatataagaggagtaaaacaaaagactgttactttagtatcagacgggctgatccctgtaggatagattcacttaaaaattatgatgactataaatgtgctgtgtaatatgaatgatttttgaaaaccgggtttattagtaaacaattattatagggcattattaaacagtgatttacaaggaacacgttgaacatttactaacattttcaaaagaataaataataacaaatttaactctttttcgaaagaaaagggataagatcctgatcaattatgaggtacctcttatgtcatatgtaagcaaatggcatacttcaggacaaatctgtctgggcatgtggttttgtaaacaagatattttattgtaatgtttccatactcattcattttcttattttatatggctgcttcacattgaagtgcctgagtggaacaaaagtattttggtctgccaagacaaaataaaaaatgtttactcac

SEQ ID NO: 267 - DNA, 292789 bp, mus musculus; identical to SEQ ID NO: 266

SEQ ID NO: 268 - DNA, 1523 bp, mus musculus
gaggggccgggccgggcgctgagggcggggcttggagggggagggccctgatgggggcggagaagcgctgagccttgggcggtgctgagactagtgggagtctgcgctgccgctgctgttgctgccgccgtcgccgccgcctccgacactgccaccgccaccgccaccaccaccggccgtgcgggttttctttctttttctttctgtcttttcttttctttcttgatttgttgggttcgccatattgacgaggctgtggtacccaaggctgcggaagctagagtccgccggtggcggagccgcaagctctcggtaaacggcccattggggccctcctccctgtcccagcgaaccccctccctgcctgcaccggctcccaggcctcgcgggagtcggccgccgccgcctcgccctccagggaggcggccgcctttaccgccccagggcttggggtgggtgacgggagtgaggacaggagcggtagctaagcgagcaggcctggagtggggggacagaggcggcgactaggggaaggtgaaactgccgctgcaggaggaggagcaggaggaggtgacgcaggagaaacgcaccgcccggagcttgtctgagctcagcgcccgagcctgaggggagaagggggaagagggctgcggccggccgagagggaggcggcggccgtggtcaccgctgccctagggcggccagggtgagggccagacccctggtcggtacgcgtcgcgcgtcgcgagcccgcccgccatccgcagcctctcatatttttgtccctcgccagcccccggcttgggatgctcccaggttaggcccggtcccgggatcgagcttttgcatctcgtctcccgcctccgcgtggcccgcttcgtaggagactcccgggttgtgtttggtgagtaccgagcccggcggcgcccagggcctccggctggctggagggctggggaggacggcgcgagggggtgtgtgtgcgtaagcggtcctcccttgggggcctggctgccggggttgggggtcgccccgagccccggccgtcgcgggcgcgcgcgagcctccgtggtgcgcgcggccggcgtcccgcgagcgtgtgtccgtgtccgtgagtgagcgtggcgctgtgtgtgcgtgtgtgttttggactggcagggaaaatggctgacggctccggccctcccccttcctcccccttccctgcctgacgggagtggagaggaggaggaggaggagaaggaggaggatggagactccggcgcgccgtgccgcccctccacccgcgcgggaggtcggtcgggagcgcgcgggggcgcgggcacggcgcgggcgggggcggggacggttggttcgcgcgccccttaacccggcggcggacgccctcggcctgttccacttgacaccgaacgccattactgaggtggagtgatttggagcgggagcgctaggccccggcgacgcctggctatcaggcccgcggacgagttggcctcctcgccgccctcccgcgataacccgca

SEQ ID NO: 269 - DNA, 89473 bp, mus musculus
tgggggcggagaagcgctgagccttgggcggtgctgagactagtgggagtctgcgctgccgctgctgttgctgccgccgtcgccgccgcctccgacactgccaccgccaccgccaccaccaccggccgtgcgggttttctttctttttctttctgtcttttcttttctttcttgatttgttgggttcgccatattgacgaggctgtggtacccaaggctgcggaagctagagtccgccggtggcggagccgcaagctctcggtaaacggcccattggggccctcctccctgtcccagcgaaccccctccctgcctgcaccggctcccaggcctcgcgggagtcggccgccgccgcctcgccctccagggaggcggccgcctttaccgccccagggcttggggtgggtgacgggagtgaggacaggagcggtagctaagcgagcaggcctggagtggggggacagaggcggcgactaggggaaggtgaaactgccgctgcaggaggaggagcaggaggaggtgacgcaggagaaacgcaccgcccggagcttgtctgagctcagcgcccgagcctgaggggagaagggggaagagggctgcggccggccgagagggaggcggcggccgtggtcaccgctgccctagggcggccagggtgagggccagacccctggtcggtacgcgtcgcgcgtcgcgagcccgcccgccatccgcagcctctcatatttttgtccctcgccagcccccggcttgggatgctcccaggttaggcccggtcccgggatcgagcttttgcatctcgtctcccgcctccgcgtggcccgcttcgtaggagactcccgggttgtgtttggtgagtaccgagcccggcggcgcccagggcctccggctggctggagggctggggaggacggcgcgagggggtgtgtgtgcgtaagcggtcctcccttgggggcctggctgccggggttgggggtcgccccgagccccggccgtcgcgggcgcgcgcgagcctccgtggtgcgcgcggccggcgtcccgcgagcgtgtgtccgtgtccgtgagtgagcgtggcgctgtgtgtgcgtgtgtgttttggactggcagggaaaatggctgacggctccggccctcccccttcctcccccttccctgcctgacgggagtggagaggaggaggaggaggagaaggaggaggatggagactccggcgcgccgtgccgcccctccacccgcgcgggaggtcggtcgggagcgcgcgggggcgcgggcacggcgcgggcgggggcggggacggttggttcgcgcgccccttaacccggcggcggacgccctcggcctgttccacttgacaccgaacgccattactgaggtggagtgatttggagcgggagcgctaggccccggcgacgcctggctatcaggcccgcggacgagttggcctcctcgccgccctcccgcgataacccgcagtcgctcagcggcccagtgccctgagaaggccgagccggttatcgctcccccacacctccctcgccccctccggctgctcacggtgggccaaaggcccggaaggatgttttgatgccgaaatcgcttccaagcgacagtagaccgaccacctttgtatttttagctgttcctgaaggaggaggaaaaaacgaagacgaagaaaggaaatactagtatgtgcaagtttgtaactgataaaaccttgagatgctggtgatgtgaggctgcaggcttgataaatggcttgtttttcattcattgtgaaatatttaagttaaacaggtgcgaagctgggggttttgtttctgtttggatttcttcagagactggaagataagatttttagatacgacgtgcttaaattattttgaaagttctgtagttaacaccgttaattgaattttcacagccacagtttacaggtgtgtgtaattgccacagagggtcgttgattgtaaatgaaggaattgtggggttttggtaatatttttgtttctgttagtaggagaggcactcgaaataatttttttttaaccttaaaacccaccagccttgcatctctctttttttgtataatttgacttatgaagaattattttgggtgtacttacgtgggaactctgtagccagtaataaaagagctcattcgcttcatttattataaggattggttaaccatgactaggtttgacacttgagcttaattaaaaatagatactacaaactcttctttagatccttctagtctactaaatcatcaggctgccattttggcttcagcaaaatgtctttcaattcttagaagatttaggtattaagtatacagacatagcaacatttatttttgcaatgtttaaacttacttgctttgtcatacttgtgactttaaccctttatactttattgttccagtgtttgggtagaatgaaagccagaagtatttggaatttaatgtttcaagtgtgaaaataagaagcaaaagtatgttttgttttctcttactaaaaagtctgtcttttgagctatatgaatgtcttcatgctttttcttacccctcccaccccctacagaagtatgccgtcatcttactgttctgctgttgcttccttttgtttgctgaccttggtagaatcgaagggactatctggaagggttaaggaccagaacagcatggacaagaaatcttaggtttttttaaaatttttctgaaagtaactttgaagagatttcctccttaaatcatggagcatttcctggggatcccttcatttcctgcctatcagtggaatgctccatccagtaggatttaccttgggtcttttgtcttttagcatcttgaaatacatttcctgatactctctagaagagcaatttagtggtgtctcttcaatttcttttttgacataattataattaaagctacttacagatgtttgtcatatgccagtcatttagttattgatgagttagacacatgaaaacataatattcgtttatttttttctatttaatggatggatttttaaagtttttatatttctagaattttattattggaaccagtctttgtttaaagcaggtgagaggaaattacttgaactatatagtgatgtctggggctggaaaaccggctcagtagttacgattagagttcctgcagagaatacaagttggagttctagcatccacatcaggcagcccacagactgtaactccagttccgggggatctgacacccctctgacatgcgcacacacacacacacacactaatttaaaattaacccacatgggctggagaaccaatggctcagtggttaagagcacagactgctcttccagagttcaagtcctagcaaccacatgttggctcacaaacctctgtaataggatctgatgccctcttctggtgtatcagaagacattgacattgtagtcatatacataaaataaataagtaaataattaaaaaataacacatgtatatatatggattagtctttggtcccctatgaagtgaaatattttgtggttgttgaactacttgaattttattttaaaaacacaatacttttattattttgcatattatgtttcttttcttgctgataagttttctgaatcttgaaattgagaaacaagtctagtttccctttcattgttttaggatctgcatctttgagaaccatgttatttgttgctgtcttgtgcttttacaagtgtttgggaaggatttgcttcattcatactctggatgttagactcacttgcaagtggttttgtttatctgatatgggactgaatagaagctatattttaagagtactgtgaatgattctgatactgtatcagttaaaactgtggggctgttgcatattgttatagatcttttatagataaatacggaaatggagctttttctaactgctttccattttcaggataattagcacttatttagtattagttacactgctaatcatttaaacattctcatttattacattatataggtattattgttattataccagtggagggcctgccatctgtcatacttagctagtgggacttaagtttaacttaagtgccatattagagaaatgatactgactactattttaaaagaaatttagaacctttagtttgtttgttgattgtaacagagtagctttagattagttttatttttaaaattatcaaaattgatatttgaaaattagcttgattggccatggaaaatagaacaaataggtgtcttccatacctctactaatatgttcagaataataggttattagttagtgactttatgtctaaaataatactaggcaatttttacattcctgaaataggtttcttaggaattcatattatctcaacatacagtgaaattgtaattccagtttgagaactcagaatttcatttaatttaaaattttactttcagtaaaaaatttaagactaagggtttcttttagcatttttgtagtgttggttgttaatcatggaatgaaaatagccacaacagatgtttggtttatgtgccttgtttccttagggcctcatgattgctaggacagttaagtgctaccaccaagttacatctctatctctatgatcattctttttaaaaaagatttatttactttatgtatatgagtacagtatcactctcttcagacactccagaagagggcatcagattccattacagatggttgtgagccaccatgtggttgctgggatttgaactcaggacctttggaagagcaggtagtgctcttaccctctgagttatctctccagcccatctatgatcattcttaatatcatatcctaaatcctcaaatatctttagtgagtcttagaaaatggaattttattggtttttaaagttcttttgtattatttatgtttctgtgttttgagacaggagctcacaaacctaggctggatacaaactggctgtatagccagaagtgactttaaactgatcttctgcctctgccttccaagtgctggggttgcaggtacttgctggtacatcatctggctctgaattttcttacatagaaaaaaaaaagagagagagagactatgaaattttctgacatgttattggtgctaaaatgactagtatatttttagggaaaagataattggaaagtattctactgtaaaaatgagatatttacctaaaattatacttgatctttgccaaaaggctgagaaatgattaaaatttatatttcaagcacacctatgctaagtcctctacccatcataggtacatatataccttacatgtatattcagcaaatgacttttggttggtgttttcagactggttccctatgaagcacagattggcctcagcctcctaagtacatgagaatatagacctgccatgccacactgagaagtttccaattttattctgggtgattgccctaacagttgtttctctgtctcaactgtgtgtcagaatcatttgtggaacattttcaaagtatttttgtcttggtcttattctatagattaagcccaggacaagagagttattttgcagttcattttaggggaaagggaggatttgcagtcctgtgcattttgtgttttgttagcaatacacttgaacctaattttgtcaatcaatttctgacttgaactcaaatatagggagaagttcagcacttagattgattaggtttatgagacagtgattgcacaggcatgactcaaatgtattatttcacacattcatgagttttgggaaccttctcaattaaggtttctggctccagagttatgtttttaatatgttttaatgcattggctatttttatctatcacaaataattatttggtatttgctgtgtcctaggcattgttctagcaaatactattgtgtaaaaggagaggcgccagattagttatctataaagtcccacctaggctctaattgccatcatttttatgtgtgtcatagaaactgatttaggtagatataagcagtagaccattaaaccaatgggattgtcctattttcagtttctttaaaataacatagtctgaatttattttctctagtgaaggatgtatcaaggatagtgtaaatgaggttttgggtttttttgagacagggtctcaccatgtgtgtaaccttggttggtctgaaacttgatagatggaccaggctggccttaaactcaaagagatccacttgcctctgcctcccagtgctaggataccaagtctgttatgcccagctggatatgagttctttgagcattcttcacatatgggctttaggaattgagtctttactttcctacattgggtgcctttgtattaattcattttgtttagttgctttggttgttgttttcccacagatctgctcatacctgtcagctcttggaagcctgaggcaggaacattgcttgtgaatggaggtgatggacaatgcagggagattctatctcaaaattgtgtgtggtgtgtgtgcttttagggtcttttgggttgttggattctgtctacacaaactcagttctaagtcactcattgatagatccttagccctcagaaaatgtctggcacacccatttggtggacatagtcaattctctgtatttggttacatttatttatgagggggggagttcttgtagaaatcaagaggacaacttgcctttcaccatctgggtctctggaatgaaactcaagatacacctttctttgtccactgagccattttaccagccttcaacaagatttttaaaaaatacttttgctggggctagttccatggtttagaggatttattgcttttctaggggacttggattcagttcctatcacctacatggtgattcacaaccttccataactctagtttcagagaatccaatgctgccttctgatctctcagcatcaggcatgtacatggtgatcatgcatgttggcaaaaaaggaacttcacattaatcagtcattaaaatatttgctattttgatatttcccttcactagttagaggagtcctgacttatgtgagtgagcgggcgggcgagagagagagagaatcaatcacttggttagcctggagcttgctgtgtagtccaggctggcctggaactcagacatgggtcatcccaccccatccatctatcttatgtgtctgttaaatgcacacatggattctgtgcctttgagaccaaaagaaaacattgggtcttttggaactggagttatagttgtaagccacaaggtggcttgctagcaaccaaacctaggtcctctgcaagagcaagtactcttttggtttttcgagacagggtttctctgtgtatccctggctgtcctggaactcactttgcagaccaggctggccttgaactcagaaatccacctgcttctgcttcccaagcgctgggattaaaggcgtgcgccaccactgcccggccaagagcaagtactcttaactgctgagccttgatagttcctttacgatgaattctgcaatgaatctagtcttttgtttattttttgtttttcaagacaaaagagtttctctgtgtaacaatcctggctgtcataaagcttgctttgtagtccagtctccgagatctgcctgcctctgctttcccaatattgggtttaaaggtgtgcatcaccactgtactgctaaacctagtccttctgaacagaaggaaatggcccagtgagatgaagaaacataaccaagatagcatgtataatatagattaccttcttcatgaagttatttccataatgaactaataccagttgttttttaaacaaatacctttgccatcattcatcagttaatggatagttaaggtcagggattttgtcctttactttttattatttgcagtacacttacaacattattgatctccttgaatggcaaaattggggtcctatttgatttgcttgcagtaccagggattgaaaccaggccttggacatgctttagcaagtgttctctttgccactaacctgtatgtatctccaatgccattctttcatcttttatttactttttattttgaaacagagtctcacagacttgctgaggctggttttcattaaattcattttcttttatttttttatattatttttatttatacaaatacactgtagctgtcttcagacacagcagtagagggcatcggatcccattacggatggttgtgagccaccatgtggttgctgggaattgaactcgggacctctggaagagcagtcagtgctcttaactgctgagccatctccccaaccggaagttcattttcttttgactgactaattgtaaagataaatgtcacagggctgatattctgaaagagtttttaaaaagttgcatgtttattggcagggttagctaacccttgaacaaaacaaaaggaaaacttcagctgggcatgcaagcctttaattccagcacttgggaggcagaagcagagaccagtgttctcttgagtttgagccttgctactattctacatagctacatagcaagactttgtctcaaaaaaacaaaacaaaacaaaaaaacaaaaaggccaaaactttttgctcttaagtttttaaaaattagtgtatcttttttttttttacaaagtatttttacaaagtagcaagcctcaaactcaagagaacactggtctctgttttttcttggagacagtgtttctctgtgtagccttggctgtcctggaactcactttgtagaccaggctggcctcaaactcagaaatctgcctgcctctgcctcccgagtgctgggattaaaggtgtgtgccaccacgcccagcagtgtatcatcttgtacaaaatgaatttcattatttctaaatgttattgtgtactttgatcattatacctccttattacctgttcttgcctctgcttttctcatcctttttccaaattgttgccgtccttactttcatgttctatactttataatttagcttatcttctagaggtcagtatttttgttggcttgaaagttccttaatttatttattcactttacatcccaatatcaggttctcctcccagtaccccctcacacagatcttccccccttctctgagaatggggagcccttcctgggtgtcccccatacctgcacaccaggttactgcaggtgcgttctctccctctgaggccaggcaagttggtgcagttagagggacaggatccacaggcaggcaacagattcagggacagcctctgcttcagttgttgggggacctgcatgaagaccaagctgcatttgaaagtgccttaatttttaatttacattgaagtattactgacttgagattgtgggataaataaatgataattgttgccattacttttgttcattacttataccacccaagaaactgaggcaatgaagtgaagtgacttatagccaggatcactgggtcagtaaaatgctcaagaaagagtaggcacagagaaagccttcaagctaggtctgtttgaagccctgctccctctaccaaaccctacttatggcatggccaggttggaccacttctcccaccatatctgttggaatgaattggactgaacctccatacagatgttatcatttatgtgaacttttaacatgatgtaccatgttaatcaaatgttatcaaaggaattgttttccttcagatgattttgagctgttagtcttggatgttaaatctcaacctgtacattctgaatatggaagggaaagacgggggaaaaaaggtagagaaggggattcccattcctgtctttgtgccttgtgttttgctgactggtggcttttgaaagtcaacaaatattggtggttggttacaggtctctttttcttgtctttattctcaatcatatgagcttcttgagtctgtttattactttgacaccagagaacatggcagtagatgtttagacctgtattctaaccttaacagagtggtttgtttctgagcacaatagtgcaaaacgattgggttgcttttctttataataactcaggtcaaaggaaagattaggcaaaccttttctataagaggccagataataatagtttggactttgtgggccaagaggcaaaattgaggacattgaatggtatgttgaaataaaaatgtaactagacacattaagtataatataggtctaatgagaaaaagcaaaacttggtttgggagtataacatagtattttgttggttgattgcaaatatttctgtgttaaatctttcttaatcttgtaggttgatcaaaaaacaaacaaacaaacaaaccaagaggttggatatagtttgtcatcctggttttgcctgacctggtttagagaagtggttcccagacctggagggcttgtccaaaaatttctctgctcattcccagagtttatttcagttagtccgcagaggcttagaatgtgcctctaaaaagttcccagataggaaattaccccaagaaaataattccattaattctaccatatcctacttcattgatctattacagtgtagttctatattgaatattctgctttgtgcttaaagttcaattatatagtaaatgccagttattactggattgtactgtgtattaggaattatacaaggtagtaagaatacaaggttaataatcccagcactcaggaggcagaggcaggtggatttctgagttcgaggccagcctggtctacagagtgagttccaggacagccaaggttatacagagaaaccctgtcttgaaaaaacaaaacaaaacaaaacaaaaagaatacaaggttaaaaaaaaacccagagttgtcccaccctatattaaaatgaatttaaaattagtttccatatttactgcattagaatctttgagccaatacaattttgaaaggaggccagtgatgtaagctaaattggaaaactgcattatcaaatacagtgaaacttcatttgatataaaattttaaaatatcaaagttctctttcaagacaattaagctgtaatttaatatttgatggaaagctttcaggggtgttatactttttttctgattatgaaatgtagtcttttaggtagctagaaataaagacatccatcatcattctgccagtcattagttttagctctttactccacttctgtagataacttttttgttcaaaacttaacataaagttgattttagtatgattttacaactttatttcccactttaaaaaatgtcctattcactttttaacttttatttcccatactctttttttttttaaagacagtttctacttttttgtagtagtagtttgtttttctgagacatagttttatgtataccaggctatgctgtaactcactgtgtaggtgaatgtgaccttaaacctcctacctcctgaatgccgggattataggagtgtattgccatgcacggtttatgcagtgctgagtattaaaccagggctgtactaacaccagacaggtactacaccaactgagctatattcctagcccatagcttctatttgacagttgaacgtaatcaggaattttataaattcctccattctgagaatggagaaacactgttatttagctttgagagatttgaattctttgaaagaggacaaggaagtacacttgaggatggagtagtattttttttaatttgttttctttttgttgttgacttcgagacaggctttcatgtttctggtctcaaactcatgatcttcctgcctcaccttcccaagagctggtagagaatacaggcctgtaccaccatgcctgtctcgttttttccctccttaaagccagtaacttaagtgtaatctcttctggcctccagctccctgtgatctttgatcttcttgcttcagcctcaatcaagagtgctaggattatagtcaggaaccaccaggtctgactggggaaagtggttgtagtgtatagctgaatgaagactaaagaatcttcccatgaatttattttttgtgagagcttccccttcctattatgcattgaagttaattagtcatataaatgtaagctcggggttgttttaatgccctttcttcctgctttccccaaatacttctcaaaatgcttgcaccagatactgtgccagttccataagaaacaaaagtcattttgacagtctgcttttgcaaggttctttctcattctcagacctaattggtcagtagttggtgtagtaagtactccagcccttcataatccctgtctctgcaccccttcctctgtgtattaggtattgtaacaggttaataaggaatgtcttcctttccacctaccataccctcaacaatcccaaagacttagattatagttgtaactgctaagtggtgagactgtatttgatcttggtgaaattgtaaaaaaaaaattcaaacttaaactgattactgccttgctgtgatgattgacttaaattcattcatttatcatcattataggtgtagggagatataaggattgttaatttttttcattagatattttctttatttacatttcaaatgtcccctttcctagtttcccctctgaaaattccctatcccctctcctctcccccttctcccaacccacccactcccattcctgatcctggcattcccctatactggggcatagagccttctcaggaccaagggcctctcctcccattgatggctgactaggccatcttctgctagagccacgagtcccaccatgtgttttctttggttggtggtatagttccaagggggtactggttagttcatattgatgtaaggatcactattaacgtcttccttaaagaccctaggatgctggggtagacagttacctaagagctgtatctggtgcaaggaactggatatttactaagcgtgaggctcttgagctcaattctcagcaccaaaaaacaaccacaaaaagtgtgaaaaatatagtgataggagagattgctcagtttggatttttaaaatgaggcttacaaatcttgaaagatgtcattttgatgctgcctggattggagtaggaaccatcaggtggtgtttcttaaccttgatgttactgattaaatactatttgaccagatatttcctcgaggcatgctgtatacttactaattatctctgatttctacctatagaatttcagtaggacctttctccctattgtgatgacttataatggcttcaggaattggaaaagtgtgtaccaaatgcaaaattgagacctattacttgaaacaatacaatggcagaatgaaagcgtggttttagaggaaaaactagtatagcatagaaagaacactggtgagagtgagtcgggaggagttatgggagatgagacttagtttaaggctaggttacagatactatgttagggcatttaagtttggatttcataataagtgaagggtctttaagtgaaagacagtggtttctgggttttctttttaaagataattctgaggggttggggagataggacagtcattaaagcatgaagacctgagttagttaaatccccagaactcaaagtcaggtacagcaatgaggaaatagagctagatggatcacgccagcccttcctatttggacagttccaggcagatgaagagaccctgtctcaaaacataaggtgggtaatatctaatgaactatacccaaggttttcctaatctgtatacacaaacacagattctaagcatagcatggtagatatactgaagtagaaatgtagcagggaattgaaatagtattataatagttctttttaagtaacaaagattttggcaatgaaataaaagaatgggatcccacagggttctgtctttgtctctgtatggattctagggcaaaacaccttttaacttctcctagctccaattccctcccactaggagctgctgactgctgagacatgttgaaaggtcacagagcagaatctgggttataggactactcacgcaatgtgtacctttacattacagggtgaattatctaaatatatttatcatctttgtcctctacatgtaagaggtccaggacctggcatcagaaagagttaactataggctctccatgttttctttagctgttatcttgctactttaaaaataattgaatctgtaaaaatagatgaataatctatctgtttaaggtagctgtaattttattgcttatttttgtagggtttatttcctttctttttttaaaattttatttctttaatgtatgagtgctctgctgcatatacatccacctgcctgaagagggcacccgatctccctaaagatggttgtgagccaccatgtggttgctgggaattgaactcaggacctttggaagagcagccagtgctcttaactaattagccatctcctaatccccatgtatttgcttttttaaggagccctttttgtttttagtgagaattggggttattcagtggaagggtagagggagaagtggagtttggaatagtttttcaagtaaaagaaaatggaaagggtacaacaaaattgggattgacaaagtgcttgaagaacagagggatgctacagcttgaatatttccttagcctgtttctatacctacatggagtctggagagctttacaaaatccacattcatatgggctaattgtagttggccagtagcttgcagtgtgaatttagggaccatagatttggtagtgtagatgtataatttttgacagaacaacataagccatgattgaataatcattgctgttttgtggtgccaaggattaaacgcatagttcatacattctaggcaagcgtcctattactgaggtatgtccctagtcccaagcttgaagttttctttcatctgaagtctagcttaagcttcaagaacattaatgcagcttaagattggtagcctgctaggaaaaaaaaaataatatttaaggggaaataagtttttctgagtagaagtagaagatgagtgcataggtaaatgcactagcagtgttttttgttcagcatgaattcagagaaaatagtgataccccactttgattactttttaaagggagctagccaaacaagcttattggtttttattgctctttctgtctgtctgtctgtctgtctgtctgtctgtctcttttcccttttttctttttttttttttttttgtttgcttttgttttgggtttttgtttgtttgtttctctgtgtagctctggctatcctggaccactttctctatggtctaggttggctttgaactcacaaagatccaactgcctctacctctcaagtgcttagaaggcttatatattttttcttagcctaacagttttcaaagattgtattgggtgtctcacaaccaggtataactctcctgttctagcaggtcaatcaccctctgacctccataggtatctacgtgtgcgtgcatagaaataataaaaattaagtaagaataactcattgcctatcagtgtaaatgtttttatgaaaaaagactttcccaaaataagaattctcaagaacactggtggtttataatttttccatctctgaaagacagctgggtgtaatattttgtgacaagtgatatctaactaagaaaaaaccttgtgatctctagtaaatagaggatctcatagattccagggaacccccagaccctgcttggagaatcagtaacttactactagactgctatcgacaaagtttagatctttagagtggcatctaatctactataaaactttattttttaactgataatttacctgtatagtcaccagtcaggttattatatagaacatttttagtagtagtctagatggttcccttattactccaaaacatattttgacctttctactacagttatgtgcacatcattaatggataaattaaacattgatacattgatcatttaatttttattgattattatcgatcaatgtatcatttaatttatccattcttcttttggtggacactctgatttcagtgatttttttttttttattttaaactaatacaaatgttgtcacagagcctggcatggtggtacacacctttaatcccagcacttgggaggcatgtggatctctgagtttgaggccagcctggtctacagagtgagtttctggacagctggggctgcacaagagaaatactgtcttgaaaaacaaaaatcaaccaaaaaggtcaaatgtcctcatatggtgaaaatatatattatacagtggaatattagcaataaaaagcaaagtagtggtatatgtttcaactttcatgaactttgaaagcattctgaaatgaaagaaacccgttgtagaaagtagattaagggaggctgtagggagtggggagtggctgcataatggggagtatggtttctttctggtgctggtccagggcttcttgcatactatgtgctactgagctctactcccttagctttggtatggtttttctcttgtgggtcataaaaatattctgtaattttaattgtgcaactctaaatatagaaagacccattcaattgtacggttcagataaattgatttgtattatgacttttgaataatacaatgagataatgtcattaatgggaaacattttgaaattgtttagtttcctttgtcatgtcctttattcttctacatctgttacttaactagtctgggttcaggcaaaaagatatacataaagatagttattaatgatctatctgccttgattaagatatttattgaacaaagtcttggttctgaatcagtcattctgttcaattagtcacctttaaagtgttttgacagcttaacagtggtgaaggcacctttaatccagcactcgggaggcagagataggtagatctcttgagttccaggacagctaaggctacacagagaaaccctgtctggaaaaacaatcaaagtctgttagctagtaactttgagttcatcttacgcagtcatttcgagagtagggtaggtaatacatgttacagaagggtttattgcttgatacatgatttatgtcttaatggtttaaatcaacatttctcatgaatgttggctgataatgtttattgtgctcttatatcctttgcaaggatttaataaattttaggtaaatatatacctttttgttgtaaatagaccccgaactataaataaatctggggtggtttttcgtttctttttttttttgaaagaaaattactaaggtagatagtggtgaatttaactttgtgttatatgtatgtttcaggaagcagaactgtaattaataaaccaatgacaaggtgaaatagcattttgatggtatgaaaattttctatggcagcaaggagttttgcaatgttaatatgtctggggggaagaatagatgtaggcaatttcatttggttatttccaaatcctaaattttctttgagccatccctccccaaatccctataaagttgtggctttatatttatattatatatttatgtatatatttgttttgtttggttttcatgaaacaaaagtttaccttttaaaaaataagtcttttgtctgttgattctgtgatactaagaatagcaggcaaatttgaatggtatgttggtgccaggagcaaatgatatcatagcataacatgtgtacagagtgatgtagtaattgaagtagaagtaagaaagctgttccacatggcatctgatggttttggtatacccatgctaggcttaggaattcaaacctagcagtcacaactacttccaaatctgttatgttatattaataggtttgtttggacttagttacaatatatatatgtatatattttgtttggttttatataactataaataaatttaatttttaattttgtttctggatatatttaaatgacatttgtttaatgtttctctatgtagcactggctgttctggaacttgttttatagacccagctggccccgaactcagcaatctacctgtgcctcctgagtgctttaattaaaggggtgtgttaccacgcccagattccctatgcgatatttataatagggagtttttaaaagattctctaaatctagaaccagaattagccaacttgagccagcttattagcattgatagaaacctagtgtgtatgtgtttgtgtgtgtgtgtgtgtgtgtgtgtgtgtgtaatcaagtgaattagaactacaattggatacttatcactaactcacttctctaataaatgggaaaaatacatttgtacctcaaagtgtggtttgtttgtattttctttcattcaacagataattgtgtagaactgcataattttgatgtcatcttgttactggcttctttaatttccctgctattaatttttttttttagagccaggacaaactctgataggaatattatgacactatgaattgtattgcaaagggtaacttttttttaacttgaaaatcagttttcacaaaggacaatgtaactattaattataatagagttttgggctaatgtaacataatattaagagttgtattatataaagatgttgaaattgtgtatttcacaaatcatccatagtaattgtggcaatgtatatcaaaatcagaaaatcttgataatgtatataatttggagatccccactcccactcccagccagtctagggatcatattcttaaggagcctttgaaggttcaaaaataagaattagcaagagttaataataatctaatcagcattttggaaaaatatatttactgggtcccttttgcatgttcctggcacttgtacatcctctcattaaagttttctaataatctctggaggtgttagccacctggagagagcaagatgatacttggaaattgaacttgtgatcctgttatattgcactatgtattgctgcaagaagaacaacctatgttctgcaaaatcagcttggaaaaataatgggactcatgagaaacagtgaaattaagagcagtttggttacccaaaggtgtcttactttataattagtaacagttaaaagttctaatagatgtagtgacatatgcctttaggtctagcacttgagaggcaagaggtgggtggatttatgagtttaatgccagcctagtctgcaaagccggttccaggacagccagggctacagagaaaaaattctttatgtctcaaaaaaccaaaacaacaacaaaactaacacataaacagaaaatgtcctcaattcctgatagtataagaccctttaaaggttaatagaagggaaggggtgtttagaagggttaaagttactgagttagaatatgaggttaaagtacatacaaaaattaggtaaaactgcaagaaaaatattcttagaacatgtggctagacaaagccaagaagagtgtgggacaataaacttatggctacaaaatagtatgattaaggaaggctggcaacaaccacaattatgttttatgaatttgacaactaggtacctcataaatagaatcatatggcatttttgtatcctattgtaactggcttatttcatattttattttataaaataatacactcattttcttgcatgtcacagcttataaaaatcttttttgaaacagtcttactacacaagctagccattgctagcctggaactttgtagagtaggctagcctcaagctgagagatctgcctgtctctgtccccagagtgctgggattaaaggtatgtgccaccattcttggtaaaattacctttctttaaaagcaacacacaggggttctaatttctccccattcttattaccacctcccccatcttcattaaagcttaggcatttggctggctctttaatttttacttttggtgctagagattgagtttagtgcctatacagtgcttacattctcccattgtgctacaacccaagccttccctcaaagtttgtaattttaattaaatttggtttgtctgttcctttgttgctcatgctattaggaaaatccattgtcaaatcctagactgttgaaatttgccgtttatgctttaaatcagtgaagagtagacaaaataatattttcataccaaaattttctgtttcaaggtgttggtttgattatagaaatttcttggtctggatctttacataatttcatcacagatcttttctctctctctctctctctctctctctctctctctctctctctcggtttttttgagacagggtttctctgtatagccctgggtgtcctggaacttactatgtagaccaggctggcctcgaattcagaaatccacctgcctctgcctcccaagtgctgggatcaaaggcgtgcgccaccacttcctggcagatcttttctttttcattaccccatgttgatgtgtgacacacattgctctgataatctgttcttggtttttttggttttattttgttttgttttttgtcttttgttttttgtttgttttggtttttttgctcttagagcttttcagattgctatctaacactctgtaaatttgctgactgtagtgaatttttaattttatttatactcgtcaagtccagacctttgacttggctcttgggttttgctttatattgtcctttttatatttttattgacagtccacctttaaaggatagaatcacattttcctttcctagtatcatgctttcctttaattttttgaagatacataaaagagctgttttgaagccttgcttagttgggcatctggactctgaaggttttttccccgtaggtagaccacatgttcctgtttgttttgttttcttttttttaatttatttttttgtttgttttttgtttttatttttttctttttcctgtttgttttcatgtattttaatttctaatgtaaaaatggacccttcatacaatgtagtacattgggcaatgatttttttactggcccaacacatctaggactttgtttgtttggtttatttatgtaataactagctgaacaattttaatctttcctgtaatttttggaatctctgcggtctctgttgtgtgttccaataagcagtgtatgtgtcttgtctttgcctgcccactcttccactcaaatattagcttttactaattacctactgattgctctattgttttacataatgctttgggttatatataaaattacccagtctggttcctgatccaattaagttctcattttccagggataatcctttgtgctggttcttggggctttggttttgacccaggatggttgtttgcagctctatttctctggttcttttggtaaactaagctgggtggtttttattggcttttatggagctaccagaatcttaattgaaataaagccagtttaccataaagaacttagattttttttttttgtttttacattccccctggtggaacctttatacctcttcagaactgaagaatcagactgcaggtgggttctcttatagttgaagcccctacttcttagctgtgtggaggcagcatcgaccctgtgacttttagcccatcttctgccttgggatcttgaacctgtggataaattggattaagagctattaggactgtagtattcttggcttgctgcccttgaagtagaactttgccccataaatagggcctagatggaacaaaagagcccagtcttcctgcagtcttccagaagtgcttgtaatgaaaatcttaccaaaaatagaaagctacagttaatttgatgaattcagttgtattggagtagtaggttatacagtttactctttacaaagaaaaattccctccaaaagttgtgatggggtttgaggtcttttgtttgcggataaggatgggatgtaaataataagagtgtagatttcttacaattatggaatctgaaattcaaggtctaggtgttgataggtttgcttggtttttttttctttttaggaatgtgtgtgtcagtctgtgttgtgtgtgtacctgtgtgtgttggagaacgtgtgctgtctttgttagatgagtagtgtgtcttaaacattacaagtcagttatgcttaatgtcctcagtatagatgctttggaatatacttaaggcattagccagttaaggtcagtttgccccattctaggatttaaccaagtagcagctaacttcttgataacacttgccttgaagttagttccagaagaaaattgaaattacttgatacagctaaactggtatactggctacagtacattctttaagttgaatatagcaatgaagcttcagcttttccctttttacctgtcatttacatagtcatgctttcttgacttgattcactggtgatgatactaaacttgaatagtttatgcttgctatatctaaaataaaatattctcttttctcttttacttacaggttatgcaatggtctctgcaagatgttttattcttgaattggaaccttttacgactgacaaatgctggtactttatctcctataagtggactataatttcttttcttaagacaactacataagcagacaaaattgcaaagatctgccctgtgtcgagtatgacagccacgactcgtggctctccagttggagggaatgacaaccagggccaagcccctgatggacagtctcagccccccctccaacagaatcaggtaagaaattaaagatacaagttaaagccacattgctatgtctccttaactcttaagtgctaagtaaggaaatgtgatagaattgccaagtaaccataaagtgaatattttaagaaaagtagtaaatgcaggttttcagtagcaaaatacttaggtgctgaaatcaacattgttttctgattttttttcagatgtcttacattcttacattatcagtcttcaataaaaggaatgaattaagcttggtatcaatcctgggagaaaccattgtataatttagtgtagcatatgggaccaagaaaattataattctattttgtatgccaaatacataaaatcattaattgtcaatctaaaatatgagtatgtactgaagtattattactggtgtttaaatttcaccttttcactatactagctttatgactaggtaaattatataatctctaatcctgtttcttcatttatatgatagtgataccagtaatggaacttcatagcattgtttaaggatcaagtaaaataagggggaatggaaagatgggggttaacacccagagtgaggctttcccttctaagggaaatggggcgggggagacttatgtgaggaggtactggaaggagaggaagggctgatgttgcattgtaaagtgaataaataagttaatttaataataataaaaatatcttggcacagatactggtgtcagtatttgcttgccctaaagctcttaaggcaatattgtattatcgttcaatttacataaggtttctagttctgattcctgttcccccattagaagattttagtaggaagattttactagttaaaagaccttgatttttgtaagcaagttttctatatggatcagtcttttgtttttgtttttctgagtcaggaactcttaatgtagctctagctgtcttggaactcactatgtagaccaggttggcattgagcttgcagaggttctcctgcctctgcctctcaagtgctggcattaaagatgtttgccattatgcccagcttagattcatcttttttttaagagattttttttccttgtttgtttgtgtttgtttttagtcttttggtcagttttgtgcacttcatctagagtgccaactttatttagatgcagttgtttacaataccgtttgtgctctttgggtgcagggatggaacttccttgtatatgctaagtgtgtgctgtaactcagagctgctccacaccccagatcctgtaatattctttccattccttttttttttttaaagtcttggtggcttgtggcagtgtgtcttttctttcatctctggtactgctaatttgtattgtattttctctcctaattagtcttttctaggggttttaccaatttaatgccccctcaaaaaagcttctggggcttggataataaaccccataagcatacaacatgcttttactctcatctgcttgttcttcactgtctttggatttggtttccttccttccattctttcgttcttccttttttacttttctttttgttttttgggtttcttgtttgtttgtttgtttgagacaggatctcactgtatagccttgactgtccttgaactcgctctgtagaccagtctggtcttaaactcacagggagatccaccttcttttgcttcctgagtgctgggattaaaggcttgagccaccaccacctggcttggatttgattttcttgttttcatctcctgaaattcatttcagccttttctaatatacacagttttatactttgaagaattaaattgaataacacaaagagtaataagatttgtgataatgtaactcctacagtggtgttatccgtaaactaattgaaattgtgtatgcacttagtaacagacatgctgcttacagaggtacacatttttgtagtgtttgggtaaattttaaagcaaaagtgttattgtagattacttttatctgtggcttggtgttagtttcttgctattcagttattatatgttatcaattctatcattactcttatagaaaagaattttttccctttctgactccccttcctctcccagttgagagaaatgagcaagcccgatactctcatccaaatgtggcaactttgttaattcattttcttttacagttctcatttttaagacatagaacttagggctataaatttgaaggccagtattttaagtttctttaagtatagtcaaagggctgttggatagtaatgattatttttaaaccaggagctagtagtttctgctttattacctgcattgtgcatggattctaacctcttttgcagtgtttatggctttgcaggactttcagtgaaaaaaaaatcccagttgttaacataatactcattttgaaacacattctctcactatgcagctttcgctggcctggaaaactctatgtaaaccagactggtgtcagtctcaggactcatatctctgtttcccaaattctgagattaaaagcacatgttaacttttattttcaaatctacttcatttttttagaggtcttagatttgtgacattaatattatatatctattaggtattatatgcacagtgtttgctaagatggctggtatttttaaaaccaaagaacaaaaacaaattacatttttgcttatagaatccctctgtttaccttagaatttctcattgtttcttattgttattctatgttctttaatgttagtgttttaagtacttcataagatctgatactgttggatcacaaaggagcaaccaaacctttactcagagctcaagttaggactttgttttttacttttagttgttttcttttcattatttttaagtgtgtgtgtgtgtgtgtgtgtgtgtgtgtgtgtgtgtgtgtgtgtctgtctgtctatttatgggtgtgtgcatataagtgcaggtgcatacagaagtaggtgtaaggtctccctggagctggtatgaaaggtgcttgtgaactgaactgccttgtcctagtcccaggaattggactctgttctctggaacaacagtacactctcttaactgctgagtaatcaatccctccagcccaggtctcagtttctcataagctttacatatatttacttaaagggaagttagaaataataactcaatcgagtcagttctctgcactgtgtgtgtgttctgggtgtttaattcaaggcaataggctcagcagcaagtgccttccttactcagccatcttgctgaggcccataaagggaatttcttaataaaaattttaactttaaaatctgtacctgtagaagcaactcttaagttataagacataaaaaccagtaacaagtgggatgaatattcctcagatgcggtatctgagaaggctctggattataatttggcaatgtgtgccaatagctttaaaagaaattttctatactggtattgttatatttctagtattcttaaaatttgttttctacaagaagatttatacttgacaatgctttatttaactttaatttatgtaatgctgaagaatttgaatacttaagatactgaatgatggctcagcggttaagagcgctgactgctcttccagaggtcctgagttcaattctcagcaaccacatggtggctcagtaccataatgggatctgatgccctcttgtgtgtctgaagacagcgacagtgtactcatatacataaaataaatctttaaatagatattgaatggataattgacagatatagttccagttttatcgaaaatttatgcatgcatggccagtttttatttagctcataaaaaagtaacaaggggtcattacaatgtcattactggttttttatttgttggtgtggtgttatatatgcttacagttgtttttgtctgtgttttttgtaagaatatgaatacacaaggcaaagtgttttgttgtttaaaataaaacaggcttctaaagttacatactgcagatagcttttttgtatggggtttctagcacttgaattctttgcttggcaacttagctgtttgttaagtgtagtagtctccattttaagtataaaagctcaccattaggttgttagtctgtcttggaaattcagcataaattttggaaggagaacatatcattgaaatcataagctttcaatgatgtctttgtagaattttatgttactaacatttttaaaaataatgctaatatgttagtgtttatgtatgtgtgttaatagaaacttacatctataatgttattttgttaatcaagacttcatcgcctgattcgtccaatgaaaattcccctgcaactcctcctgatgagcaaggtcaaggtgatgctcctccacagattgaagatgaggaacctgcatttccacacactgacttggcaaagttagatgatatgatcaacaggtcagttggtttcatttctaaaaccaaggcttgtttgtttttattatagcattatgtgtggtgggtaacataatggcagtgaagaggaactgttgccttaattttcccattatagtcactgccaagtactttacaacccatggttcatgatgggtctaataaaaaggagcaagaacatgctcttatggccttagctgtttgttccaaagtagaactagttatttagttttcctttttaaaagttggtgaaatttctttacaattgacatgttcttgactgactttaataactttagggggggcatgaaacaaaccagatcataaggagtttcttagaatgtccttcatgatgttctgcagggtaagaaaaggttgtaaagaaatgagaagaacatatcaaaaaccccatctgagcattgtccttaccgggcagtgtgagttcaacaagggccgctcaaaaaaactgggcactggatgagctggatggctcagctattaagaacactttaaattcctggcacctgcatggcctcttaacagctgtcacctataattccaaacccaggagtctggtggcctcttctgctctccacacccatacatataaaataaattaattaaaaatgagaatatttttaaaaaaataatgaaaatacaatttcttacaggtactttgctaaactttttggtgtatttttatttaaagtcaaaactattaaatacatgcccacggaaataaaaatcctttcattaaaataaaactgagttggttgtagggtcctacactgttaatctcaacccttacagggtagaggtaggcagatttctgagttcaaggccagcctggtttacatagtgaattctaggacagctagaaccatatagtgagacttggtctggaaaaaaaaacatgcaaacaaacaaatatctgattttcttagtagtaagggtgcattactaagtatagaactatgttgtataataaataaaatagattaatttctctaacccctccctcataacccctagctttattccccctttcacatattccaaaagtttttttaataatcaggagtacatttttcatattatatttctgttttctatcatgtatgtattgctttttctacacatacaaaatcttactgtaattttgcaacttgttttaacttgtaggaaatattcttccatttgactcattttcaaaggaacatttatgctgctactagcagcctgtatatagtaatcacatgcaatgaactattgaaagtatgtatttaagatgatccttgattgttctcagatgacataacaaagttgcattgttatatttcagttttgtctgatggttggtaagatatgcagattagatactaggctgcatgaaaacggttcttgatggaaaaaaagacaaaggatgtttaaaaataaatactgggtagttatttgtttctaatatgttattagaaaaagttgatagattatcaagcataaatcagtctaagcctcctgaaggtttttttctttgtgaggaagttcaaggcctctttaatctgaatcctgaaaacactttcctgtgaagtttttgtaataggcttctgtgatgtctaattgatattttattataggagtttatattaatttttaaaagtctgcttgtagagacaacagatgataattgtaaaaactttatccagtaccaatgttttcctatgtaatgctattttaattaatattttcatagtgaaaaaaataattgtaactagtaactgactatagtacctcttttatttagtgcataaccattaagtctctttattttattaattcctaggcctcgatgggttgttccagttttgccgaaaggggaattagaagtgcttttagaagctgctattgatcttagtaagaaaggtatgtctcagtatcatgcttttctaaatggtgtgcaactagatatattttcactttattcttgaaaactccattttcctgttaaaacacagtaagtgttttaagtaagtatatagtaagcttacaaatagagggttgtcctttttaaaagaatgtgatctcgggagtgctagacataaagtgtatatgaattcatatttctaaagagtaagtccattgtttagatttgcaatcactcagtgatttaaaacatttctcttatgggaattccataatatacacaaaaggttttacaattaaatactctgtatgtgatatatagtacaaatatcagtcaggtttaagtagcttgcagaagtgggaaggggatggtgaatatcctaaggaatttctgatcttgagatgagtcacatgtaaacctataaattacttaagcttaactgaagcaaaggtgcatgactcttaacctttgattctttgaatgaagatgactattttgttgactttttttttttcaatttatatattcattgtggttgggggttgagatacttacacaatcaagaacttgcaagagttgattctttttcatccaccctgtaggtccatgggagcaaactgtttttataagctgagccatatggctagtccagtaatgtgggtttttaaaaaaaataaaattagcatttaaaaaatataaaatacgggcggtggtggtgcaggcctttaatcccagcacttgggaggcagaggcaggtggatttctgagttccaggccagcctgatctatagagtgagttccaggacagccatggctatacagagaaaccctgtctcgaaaataaataaataaataagtgtgtgtgtgtgtgtgtgtgtgtgtgtatacatattttatttatatatatatatatatatatatatatattgtgatttttttctctaaaagaaaaagacttgtaaaagtggttctgtgtttaaaagaaataataaaaacccagtaaagggaatctgatactcagttgtccagaagtaaggttaatgttgaaattgagcaatcttattagattattctcatctatttctggtgctgtagaattctcttagtagaggactatggttatctatggtgctcagtttttaaggcactggaattgttttgggttttcttgagacagggtttttctatgtagccctggctgtcctggaactcactttgtagaccaggctggccttgaactcggaaatccacctgcctctgcctcccaagtgttgggattaaaggcatgcgccaccactgccagcaagatattaattttgaaaataactaatataaattgcttaaaaaaattaatgtcttttttatagtaccttgcttgggttcatggcatttcctggaaaggggaattttactcacattagttactccttctttgtttatcaatcttgaaaagctataaaataagttattcagatgattgttgttttgcactatttaaatgaacattgctagttacagtctaaacattaactgtgtaataaaaacctggtattttagtgacattgaaatctattacattgacattcagcggcttgtatatcttgctcataattatttttggcaccagtttattttagataaagctcaatttaaatatcacccatattgtatgattacaataaaatattttttgtacaaattgagatgttaaagacattctttgtatttgatgacaggttgttctgttgtctttttttaaaatcagatgagatgaaacaaggatataaaaagtgtagggttggtaagatgtcctgatgatctgaattctacccctggaatccgcttacaggtggaaggaataaactgacttcacagttgtcctttgacttccatatgaactccttagcatccatctttccatatatgcatgcatgaacacacataaataatgcatctttaaaaaagaagataaaataggttcttggcttggaagaagaaagatttgtgtagatagtaaaataaaagaagacaaaatgattcatcgtacttacttggtcatttggagaatagtaagaatatgaatgtctgctaagcacatagtttgcaaactaatatttcaaaaattaattatgaaatgtaaaatttaaggcttattttcagaacaaaatggtataaaatacttagagtctctgtcacatgttactgaccatcattttgggtttaagatacagtgtcataatttgtagtattttcagttaattttttattcatttttacttcattaatgattatacctaagatcttgtacatgttaagacttgctgccttcgcaatgagccatatccccagtcctgacttactgttaatattatcacattaaatgtaacttttgcataattattttaaaattttatttagggtgggagggctgaagaaatatccatgcagttcatttatggatgcttgctgctcttggagaagaaacccacccaggtttggttcctagaacccatgactggtggcccacaaccactggtaataccatctcctaagcacctgcattcattcagcatggtataaactcaggtcattacatacacacatacttaaatttttctttaaacagtaattctgagttaaatttcttttctgacatacagaaactttgaaataacaatagtgttatttcattgtgaacatttttttcccagatgtgctctgcaactgctagcttgttatacatgctgttttctgatgacttatgcctttcatcatatagttgagcacaattattttttttctcccctttcttaggccttgatgttaaaagtgaagcatgtcagcgatttttccgagatgggctaacgatctcatttacaaaaatcctgacagatgaagcagtgagtggctggaagtttgaaattcacgtgagttttccatttgacttttacaaagcagattatatagtgatcctttggatgggaagaacaagtgtgtgtgtgtgcgtgagattaacatgagattttagagttaaaaatacatggtttaggctgggcagtggtggtgcacgcctttaatcccagcacttgggaggcagaggcaggcggatttctgagtttgagggcagccagggctacacagagaaaccctgtctcggaaaaccaaaaaataaataaataaattaattaattaaaataaaaacttggtttaacttttctccctggttcttcattgccttgtgaccttaggcaggtcaccgcattttattgaaaacctgctgctatcgattataaaatatgctgctattttatgtattaaaggcaaaatgcccaagaaggagaaaataaaacacagatttgggggcaccagaaagttcagtgttacagaagtgatgagaaatgaactcacatgtctattttaatttagaacttgaatcatgagctactactgttctatagatagagttctatagacttgattcaatttacatttgatcctttttaagtaaagactacttaaagtgatttcaggtccctaatttcaaagagacaaaaacaatcagtaatcgttatttgtaggatgaaattagagtttacttcaacagtgaaaagaagttgtttttggactaatatgctattatgatacaaacctgtttctatgtatgcaaatagccataaacaggtgacgttttgtggtctgaatgggtttttcaattacaactatggggtaaaagtcccacaatctggtttaacataatttcttagatttagagcttggcaatgtagtcttctatcagggtaagtgatacattatttcaattttagaaaaaatgggaatttgtatcttatctgaagataacagcagaatttggcaactcataggacctacttcatttttaagcaagtagctttttgaaagcaaattaattctgtcagtactagtgaatcaactattatctatcagtataaaaaacaaggagctcatttaatattaacagtaattagggttatatctgtttgaaattgcaatgttttcatattattaatcacctttctctcatatataatagagatgcattattaacaatactcatcgcctggtggagctatgtgtggctaagttagcccaagactggtttccacttctagaacttcttgccatggccttaaatcctcattgcaaattccatatctacaatggtacacgtccctgcgagtcagtgtcctcaagtgttcagttgcctgaagatgaactctttgctcgttctccagaccctcgatcaccaaaagtatgttaattattttcaaatttaaatattaagatagttctaccacagaactgtaatattagtctcctagtaacatggcttaacactggtttaattatactcaaaaagacgttctgcattatagtttgaattctttattttgtaccacagctatattttattgtttgtactactatttagtttttctgtgtagtaataattgacatctgacaaccaagtattttttgagtattatatataatatagcactaggagcctttttgcatagtcatagcattttagttcagtgcttatggcttcttaatttttttctccatgttaattaactatacttaattcctgttatcttttagtcaatctgaagatagtcatagttggattaatataacatttcaatagtagtaataacaataatagagaaggacattatgactcattaaaaacctcaggtgtgaatcaataaggccatgatgattttatatattctaaggttgttaaggttgtttgtttgtttgtttgtttgtttgttttttcgagacagggtttctctgtatagccctggctgtcctggaactcactctgtagaccaggctggccttgaactcagaaatccgcctgtctccgcctcccaagtgctgggattaaaggcgtgcgccaccactgcccggctattctaagtttttttaaacttaaaaatagatacatgcgctgggcagtggtggtgtatgcctttaatcccaacacttgggaggcagaggcaggtggatttctgagttcgaggccaccctggtctacagagtgcgttccaggacagccagggctatacggaaaaaccttatctcgaaacccccccccccaaaaaaaaagataaataagttaaattaaaaaaaaacagatacatgctaaactataattagtcttattctagttaccaagacaaggtttctgtgtgtagtcttggctatcctggaactcatagtccaacctggccctaaacttgtagagattcgcctggctctgccttccaagtgctagaatagatagatgcatatgctaccatgctcagcatcttagtgaagaaaattttaaaaatacattacataaaacatgtcctttttttcccttcctttctttttttaatacaagtaatcccaaaagagatctgtaaactttgggcttagggcaaaagagatggctcagtggttaaagagcacttgctgctcttttagaagaagtggattcagttgacaacacccatatgttagctcacagtcgtccttaatttcagtcctaggggatccaaagctcttttacggtctctgggcaccaggcatgcacatgatgcaaatgcatgcagacactcacacattaaaaaaaaaaaagagagagttaatgccttagtaatggccttctaagagcaaagtaaaatgtaggaaaatagtaagcatactaaaattcgtagtgtagatttcttagagaacttagaacttatattcctatgattacatatttttgtatttggtctttaaaaaaatatgctgggcatggtgaggcacagccaggtggtggatctctgtgaggtttgcaagatccaagacagccaaggctataagttttttcaattggaaagttgatttaaaaaaatgataaaatgggaactaaatgtattcatagcatccagtctggttagtactaccacatagttcacattataatttgttttacttttttctttttgtttgtcctgtaatgcaagaagtttatcaaacctatgcctttgctcatggtagtagatgtttaattcctgcaacatacgggttagttttcagtagacaattcacttttaggcttcaagattatttatatggaaaatttaaatacttataaactacaataagaaattgtctcagaagttgttacactagattttctttgatctattattacttaaggtctttttaactttttaaattgtttttcatataagtgtttttaggtattttggaaagccatatactctaaaagtcggatagctgagacagaaacatagtctaacaagtaatactgatatgagcagtgtgtttgttcctttaatctaattcatgcttactatttattgcttctgcttcacagatcaattactatgatcgttttgaagccttttcaagaatgacttaacattaattggctttaatatatcagtcaaaatagtactttgtttatcctaaatgccaagaaagtaaacttgttaattgtattgtagggttggctagtggatctcctcaacaagtttggcactttaaatggattccagatactgcacgatcgttttattaatggatcagcattaaacgttcagataattgcagcccttattaagtaagtaacattttaaagccacatgttaaatatgttattgctgtttttattttggctcaattcagaaatggagtagttggagctggagagatgattgctcagtgcttaagtggctgttctttcagatagtaaacgtgaggtttattccctgtacctatggcaggtagctcaaaactgtctttaacaccagctctaggagaatccagcgtctctggcttctgagggcatctatctgcctatatacctaatccaaatgtgaatacatacacatagaatgtcttaaaaataatacatgtcactcgggaggcagaggcaggtgaatttctgagttcgaggccagcctggtctacaaagtgaattccaggacagccaaggctacacagagaaaccctgtcttgaaaaaaaaatacatgtactatgagaatttactaagttgaggttaagaagtcaagtatttacgggggttttcttttcttatttcagaccatttggacagtgctatgagtttcttactcttcacacagtgaaaaagtactttcttccaataatagaaatggttccacagtttttagaaaacttaactgatgaagagctgaagaaagaagcaaagaatgaagccaaaaatgatgctctttcaatgattattaaatcattgaagaatttagcttcgcgggttcctggacaagaagaaactgtaaaaaacttagaaatatttaggttaaaaatgatacttaggtaagttattcatcttggaaataattacttacatgaatttttagagtcaatttacaactgaatttctcttacagattgttgcaaatttcttctttcaatggaaagatgaatgcactgaatgaggttaataaggtgatttccagtgtgtcatactatacccatcggcatggcagttctgaggatgaagagtggcttacagcagagaggatggctgtgagtaaacaaacacttagtctagaatggctgtcagtaaagttagtaatgctagcattctaaattaaaagttgaaatttgaatgttttggttaatttacagctttgttaataatcttgaaattttaaagtagcatatttatttgatcgctgggtatatctttggtaaatttattgttgaatgtaattattacaagtttgatagtatttgaaacatattgaagaaggggcatgtacatatgaccaattccaactgatggcttaaaagtacaaaatacataagagggcatgtagggcgcaactggaatcttagcactggagaagcagggagattggctacatgtttaaggccagccagggttacatattgagaccctgtctcaaaatatatattagaataagagctactttttatctttattttgagaatttgtttttaaagtgtataattttgtatcattttgtctttaaatacttagaaaattgtttatttcctgtatatattttatgtatgactgctgtaataagttactaattataaaactgatgatatttgagtacatatgtggcaaacaggagccatttgtagcaaaccaatatctttacttccaagaatctcttttgttaataggggaaatgattagaatgtgattttaaaagaaaatatgaagtaattacaagtatagctagctcattgaggcctttggtttagttgacagcaaaaagaaaaatatacaggatatttaaatcagtccctgggttaggaggtcaggtggtagatgtctagttttgtgtacgtcatgtgtctgtcttcattgagaatgctggtcccttagctgtgtgacccatcctaaaacatatagaaaatatcattaaatgtataaaactttttgtgatagtttgacattgctgtatatttgttatattttagaaaagtttctttaacaagttggggaaatttaaacttatattagctaaaaagattcatatttatagcacattttgggcccacctacctttattctaagaaagttgaatactggattacctttttaaaaaaaattcgtgagtcctactttattgttcttgaagttagataaatgacagtcaagatggcttagtctagcacagtattacagaaacaaacaatggaagtataagacttttattcaaattcaagtgccactctctgcaaacgtgtttactgtgctaagaaaatgtatctcttacttagatttcaaagatgcaagcaacaataacatccagtacatggcagtcaattaataaatcaaagtggtttggttttttatttggttttttgagacagggtttctctgtatacccctggctgtcctggaactcactttgtagaccaggctggcctcgaactcagaaatccgcctgcctctgcctcccgagtgaaatcaaagtgttttaaaaagtatcttttaacctaataagaaaaccattgtggggcagaattagtttaaggaaccaaacaccaaaaatggccctctgcccattcttcttaaaccttaagtgattgttgcatttaaataatatttttatgagttaaatgctggaatgtacaatatctttttgatgatttcagtgtttgtaatttatggagatatttattccccaataaattgctttgtcagatatgatagttcccagctttaattccagcacttgggatggatatggaggcattttgaagatcacaaacttaagactagcctatgctacatagcaaaatgccatttcaggagaaaagagcttactataaatttttttaagcaatttttatgaatacaatgcattcttgcatattatcttgtacatatgcttttggctttctatgtattctttaaattatattttagtactttaaaaaggtcttcgtgttttattttgttttgaaacctggtttttaaattacctttaggaatggatacagcagaacaatattttatccatagttttacgagatagccttcatcaaccacagtatgtagagaaactagaaaagattcttcgctttgtcataaaagaaaaagctctgaccttgcaagatcttgataatatctgggcagcacaggtaaggctcttgaaacctcttaaatgcttctggaagaaattcttctagaaacttcctgaaattgtcaataatgcttgaatacttaacagttcatatttggcaaaagttaaagaggcaaaaaataagggaaactaggtgtggttgtgtatatctgcaatctcagcagatgaaagtgtacaagtaggagaatcatgtatcggaaggtaacttaggcttcaaagcgagcgcaagcttctgaccgagaaatcaaggatacaaacagctcagtggtacactgtatttgccttagtaccacaaaataaagtaatatttgttgggaaaataaatatacatctatcattgacctcttaatagacttagcaactcctcagtatagttcactcactcaattccaaaacacttaaaacttttcagaaggattagcaacctttctgaaaaggttttaaaagccacaaactacataaacattgttgaattctaatttacaaagctttggttttttgcttttttcttgttgttgtttttgtttattttatagagatatagaaaatagctttgtttttgagtatttagttccagtttggggaaaaaagtaataacaatgaaagtattagtatattcgataaactaattaaaatttaatatttcctaaagtacatgttaactatgcatatgcagaaatgaaattgtcagattttagcaagaagcaatagttaagaattttacatagagattaaatctttttaattatgtggtgattaaatggtgataatttcctgatggtcattagcagtcagtatagatgatgtttctattgttcacagtttagtgtctatgtgacctttgtttttatttattaataggcagggaaacatgaagccattgtaaagaatgtacatgatctactggccaaattggcatgggatttttctcctgaacaacttgatcatctttttgattgctttaaggtaattattaacgcagcattgttattaccattttatatttagatagaattgattcattagaactacaagttgttattaacccacaaatacttaaaaaactcgtaagacaatttctgatatgaaaggactttatctagtttgaaagactttgccagtgttttctttctacaaacttgattttcattttcatgatagtgctaatagccctaataaagactcttgttcaaaattcaggttattgttttgaatatcttttcccagtctcttttggaagtaggttgaagtatagaaaagtaggaaaggaagattgtgagaaacataagaggtggcaataaaagaaatatcagtacaatggtattctgaggatatatactcaggtaaagcataacttaatttacaaggcagtgccagaccatacagtcatactcacattgattctgtcatgttcttttatatagtgttaacagtctcatcagttactgacattcagtgcatggttaattggttagtgaatttgtgaattaagaacatgacattataagagtgcttaggaagggagggccttttaactattggcattacatcattagtcactaagtattactcctgaaaatagtgattctgactgggaacataagttgccataacactctggaaggttatattgtgtccctgattaaatacaatattctgggaatatcagtatagctcagcagtagaatgcttgcttagcataacaaggctctcaatcagtcccaaacaccaaaagattcttgcatatatgcaccagcttgcatgtccaaaaacaagtgaactgaagtggtttgtaatagctacaaatctctctatagagaggatagataatggatgttcatataatggaatacttcatgggaatgggaataagcaaactggaagcagcatggatgaatttcattgtcagaatactgaaaaagggctgaaactatgtagtaatttctgtatcttgattaaattaacataaacttcagaaatagtcccagatggctcttgagattctattcaccacataagaccaatttgtcttagtatatgccacatgtcttagtcagggtttctattcctgcacaaacatgaccaagaagcaagttggggaggaaagggtttattcagcttacacttccacattgctgttcatcaccaaggaagcaggagctgatgcagaggccatgggagggatgttgcttactggcttgcttcctctggcttgctcagcctgctctcttatagaaccaagactaccagcccagagctggtccctcccacaaggggtctttcccccttgatcactaattgagaaaatgccttgcaactggatctcatggaggcatttcctcaactgaagctcctttctcagtgataactccagctgtgtcaagttgacacacaaaaccagccagtacaattggtttttaatgtaggtagtgcttacatactgcttacatacatacctacactgggtactcttaaaatgaaatcactttacatcttccattttatatttcacagtagggggaaaaatgacctctaccccaggcatatagagtcagtcactaggtataaagcctaaaagtcaatattttcattaagtttctctgatcagtttttttgttgttgttagtttggtttggttttttttgtttgtttgttttttgtttttttgagacagggtttctctgtgtagtcctggctgtcctggaactcactttgtagaccaggctggcctcgaactcagaaatccgcctgcctctgccctctgatcagttttaacacattaaaagttataaatcagatatcttgttgaaatttttacttctttgaagggaacaaattaatgaatgttttctgcatttttaaatacatcatacacatttcacacatgcaaagataaacttttccccataaagacagctgtagtaagcagttattgtgaatgcccttaagttaatagtcattcatccttcatgttgaggtgactcctgaaatagtggtgaagtatgaccagtgacagacttgaaaaaggaaaaagtataaaacagtcattacatcatttgggtcttctttctcccaggataatctcttgatacttccttaataattagttccttaatgattaattgattccccctttggattatcaagagcttgctaaatagcaagcacttttttatagttggggagcatctcactgtatatccttggctgcttggaactcactgtgtataccaggtcgccctcaaactcgagagatctaccacactaccttaaaaatgaagaggagaaaatgaaataagggttttcatttcatttaaatatctttctaggccagttggacaaatgcaagtaaaaagcaacgtgaaaagctccttgagctgattcgtcgtcttgcagaagatgataaagatggtgtgatggcacataaagtattgaaccttctgtggaatctagctcacagtgatgatgtgcctgtagatatcatggatttggctctcagtgctcacatcaaaatactagattatagttgctcccaggtaaggaggtggtgtttggcttggttgtattacttttgtgcccctacagtactaggtagtatggctaaagtacaggataattttaggttattttagcattatctttttaatgattttaagaattgatgtttatttaagcctgcctttcttaggtctctacaataatgttttaagatccatctgagtctctggaagaggaggtacaaacaataggccatttagtgataatgttgtcaaatgtatggtaaaggaatcaaatagatcataaaatattaaggctgagttagaaactttggaaataaatattttctttgctcataaaagataaagaataattagaattttctaggtagtagattctaatgtcagggtgttgcattagcatgttaatgcatgattttattatgagatagaatctttttaagttaaaacaaatctcaaacctagtaaattataatcaaactttactgaatgtatgtgataaattttaggattttactttttagagtttggtagtaaatatgaagttaagatatacctagagcactttaaaaaaattaaactcttagagttacagtatattttatatttatcatgttaatcttataagaaaaaccgactttataattccatggattattggaatttagcttaatttccttatacatttatctttaaatactgtgacttagaattttcccgagtattgatctatataataaaacactgaaattgtttaaggaccgggacacccaaaagatccagtggattgatcgcttcatagaagaacttcgcacaaatgacaaatgggtcattcctgcactgaaacaaattagagaaatttgtagtttgtttggtgaagcacctcaaaatttgaggtaagacttttaaaactagacagtttaaatatttttatttatggtttgttaatttcaatttgtaaaagaaaattttaaagaaagttaatgaagtgccaggaaactaagaagaaaagggctccttttggaacaaaagaatcttttgtcattcctacatcctttgtttcattgatatggaaagtaagccatgattaagtgatcagtactaaaatctaagtgatcttgctgtttgatgctgtgtcacatggtagttttcacaccaaaaaaaaaagattgtttttttaatttttaaagttagtttagaagattaaattgcatggagatttaaatgatagtagatggaatgatagaacactggattttttaattttttaagatttattttatttattatatgtaagagaagaggacatcagatttcattacagatggttgtgagccaccatgtggttgctgggatttgaactcgggactttcagaagagcagtcagtgctcttaactgctgagccatctctctagcccctgaattttttaaatatttcttaagtatactttaggccagcgatggtggtacacacccttaatctaagcattttggaatcagaggtagatagatttttgtggtttccagatcaacctggtttacacaattaggtctaggccagccacgactacagagtgaaaccctatctcaaatggaaaaaaacaaaaacaaagaaactccaaaaatgaaaaataaataacaaaaaacttaggtgttgaaaaaatggtacaatgcttaagaattctaggtagtcttccagaggactaaacttcagatcacaactatttgtaattcaatttttaggagatcccatgccctcttctggcctcagtatgtactgaatatacatggtgcacagacacacgtgtaataaaaataaatatttttaaaagaagaaagaaagcgagttaatggattaaaaaaaaatgtactattttaaggttccaaaatctgtttataagtacaatttgtcctcttattttctgggcatgagttagaatggttgacatagaaaggaaaaattatgtggcatgaaagaaagcttgagtgtagtggaactaatattcataaatgaagtgtgaacaatgaaatcatataatctcgggagtattctttaaataatcatggtttccttgtataatagatgcaggtggaggaaaaggtaatgtttgtcaaagtaatgtattttgagtatgtttggcccagggtacatatgccacttaacctttctgaaatttattaactctcaggtagacatagtattcagcaactcctagaaattaatgaccttgtctatactagaatatgaaagttgtactatctatgaaagttgactgtgaaatttgttgtgtgacaagaacaacttggctgcaaaccaaatgttcccagggaataacttaaacagctagtagtttttaaaatattattactttttttttttttttacttttggggggtaggaactcgtttttgtatggcagtcagagaacaacatgttctcaccttcaaaaatgaaaataatggggatcaagctcaggttttcaagctggcagcaagtgccttttcctgctaagccatctgtttggcttctaataatactaataattaaaaagtaaaaaacattggccagcaattggcaatgctggttctacaaagaagtttggatttttggaattttcaaaaagtcatgtattcttataaaaatgctttgctactgccatattataatagatacaactgattcttgcttttcaagtaataccatttttaatttttaacactaatttcttttaagttgcttaatgtcattaaggaagtaaatgagtaaagctggcttttgagtttttaattagtagctaataatttagtggtgataaacagttgattgcaagagtttaattgcctaattatattgttaagctcttctcgtttcagtcaaagtcagcgaagtccccatgtattttatcgccatgacttaatcaatcaacttcagcacaatcatgccctagttactttggtagcagaaaaccttgcaacttacatggaaagcatgagaatgtatggcagaggtatgtattgtaagataattgaactgtgagaaataacagtgattgccattttctattaggagtaacaattatatttttatttattttttatttcaatcttttttttttacagtctagactctatactcctcccagtccaccctcatgactgttccacattccatacctcctcctctatcccctaacctggtcttcctgagggtgtccccatccttcctatcccctacccagcaggcctccccacttcctggggcctctagtctcttgagggttaagtgcatcttctctgactgaacccagtccaggaagtcctctgctgtatatgtgttgggggcttatatcagctggcatatgctgcctggttggtggtccagtgtctgagagatctcagggctccaggctaattgagactgctggtcctcctacagcttgttaaccacctccttagctttttccattccagcttttccctaattcatccacagggattagcagcttctgtccattggttgagtgtaaatatctgcatctgactctttcagctgcttgttgggtctttcagagaacaatcatgataggttcctttttgtgagcactccatagcctcagtaatggtcaggccttcctttaagctggatcccactttgggcctgtcactggaccttcttttcctcaggctcctctccatttccatccctgtaattttttcagacaggaacagttctgggtcagaggttttgactgggatggcaaccccatccctcacttgatgccctttctactggaggtgggctctataagtttcctctcctcactatagggcatttgatccgaggtccctccctttgagtcctgagagtctctcacctcccagatctctggtacattctaaagcccccgccacccaccgtgttgcctgtttgattctttctgctggccctcagggcttcagtccttttcccccctcccaatacctaatcatggtcccctcttctccctgtccctttctcacccaggtgcctccctccctctctccctcccccctcctttggatttgttctccctcccaagtggggttgagatgtcctcacttgggccctttggcttgttaaccttcttgagttctgtggactgtatcctgggttctgtacattttttggctaatatccacttactagtgagtatcatacatgtccttttgggtctgagttatgtcattcaggatgataatttctagatccctccatttgccatcttgagattgtagacaaagctgcccttgatctcactgaaatctgcttgcttctgcctccaagtactggaactaaaggcatatacaccactatacccagcaccatcttctatattaactttcttaaaggaagatggacttattaaaattcttaccaatatttgcttatgtgttatgactgctagtgctttcatgtgctggtgcctaccaatctttccggagtttttttgtatagacaaaaaaatgtgtaaaccacctttcagttgtcactgaggctttagttcactggtaacattattactttgctgacctcaattgatacttactagaaaagtgacttacctcattcgttgcttttccttgttctcagccatgaagtacaaggtctatatgggttttaaaatactgttattaaatagtttgttagcattttccacttacctggagaaatggctgctttgggacctggaccaaggaattaaggacttcttaatgggaaaagtatgaaagtgatcatagaataaagtttatgttgaaagaatgaaggattttggtgtttataggccaaaactagaacaaaataataaaaataactatatgcattgaataaataacatataaacacataaaagaaaataaaagacccagaggaccttaacaaaacatttaactagataaaaatacagataaaatttaaagtgcctagaaattgttataaggagttaataacaagaaaatctaaatctcaaaactagcagttgagccacaacttgttcatttgtctctacagtcagcttcaccatgagaaaactattctgcagtagtttgactaaggactagtcctccccacacaactcctagtctaggactgcacttggtttcttgcacagcaagctgctagccttcttattcttagtcctttgttacagatgccctcttaaatatgcagatgtgacttcattaccctgcccactcagtatctatgttagttgaaacttaaatccaaacattataagccagcattaaggccctaattactgcaccacagctggctccagtggtccataccaggggaaataaatggccctattttcaaccctgcacatattaagtcagaaatattcttggaaaaactgggtgctatctgcctctgatgcctatctagtgacacagatattgtgcccaaagggtggagagaagccatagagacagagtttccacatttagttatatttgaagaaaccagaacattccatgccaagtaaattgtctacaaagagatggataaagaacgtctaaaaattgtagctcccttttaactgctgtcacatagtgaaatggtatagcaaataagtttccacctagaaggcaaaatgagagcccttctgcgatcctagtctcactgaggactcaaaaattatactacatcacccactcagagctggatatggaacaggttgaaatttcttcagagaaactgtaggtggctagtaagaactttaaaagatgctcaatatcactaatttttaaaatgtgagtcaaaaccatggtaagaaagtatattgtgatagaggacaacacttggtattgttgagactgttcagaaattggatcttcattccttgtgggcttatttattagttagactggtagttcttctaaatattaacagaatttaccatagtatggtccatattcaagtaaaatggaaacaaactttaaaaaacttggaattgaacattaatagcaaacttgttataatagccaaaaaatagaaataataaaaagtgatatgtcacctggcagtggtggcgcatgcctttaatccagcacttgggaggtagaggcaggaggatttctgagttcgaggccatcctggtctatagaatgagttccaggacagccagggctacacagagaaaccctgtttcgaaaaacaaacaaaaaagtggtgcgtccatatagtaacacaactctcttaaaaaacctgaagatttttaaattggtaggttgatgatgattagaacatattttatttgcttgaagtgggagcacacatctttaatctcagcactcaggaggcagatttctgttagtttgcacaggacagccagggctacacagagaaaccttgtcttgaaaaaacaaagtttattaacagatgaactcaattgattttgatgtatttattttattatatgtgagtgtgtgtgtgtacatatatatacacacacacatacatacatacatacacatagagacagagagagacacagacagacagacacacacacacaccatatacatgtatggttcatgaagtagtcagaagagtacatcagatctcctggaagtggagttgcagtttgagacactctgtgttatgctgggaaatgaacccagctcctacaagagcaacaagtagtcttaccgaatgaaccagttccccaatctcagcttaatttttcacactgaattctaaaatggatctcacaacttgatacttaaactgattttgtgttggttatctgccaaccaattttctaagatttctgaattgatcatatatatatttcctccatgggatacctgctacatagacaaggagtggttgtcttccttatttgctagcaaatcaaaaaattgttggaactctttatagtaaaattatcagcttttatttgtttggtgttttgtttttgagacaggatctttctgtgtatccctgcctggcctggaactcaactatatagaccaactgaactcagactcataaagatctgccagccttcaccttctcctccccattgctgaagactaaaattttgcactaccacttcacatttattacaaaagtagtgtcttatttcttgacttttcttgattactgtttgtgtttcattggactatttcaaagctctatgtccaaagtgttaagaattgaacacaaaatggattagggcaggttgctaaaaccagtggggcaaaaatggcatcttgacagcctagggaaactgcatcaatcagctatgtaatcaaagtgagcatcatgaggattgacacagtgccttctgattattaacaccagcagggtatacttctctaatattcttgcccagaatttatagccccagtatatgaagtaggaaaaggattgttctaaagagttttggtagcacatttaatagaccatttcctttgggttgtatgtatagaagggatgtgtattttattaggatattagatgggtttgaaagcaccaattatcaatgtaccaattattagcagatttgcagttgccttatataatgatagaagatcaatgatttttttttttaactgacaagttacttggttgaaatcagcagtggtatgattatccatatatataaaatgcatctttttatttttcctaatttgcagacaatgaagactatgacccacaaactgtgagactgggaagtagatatagtcatgttcaagaagtccaagaacggcttaactttcttaggtgtgtttaatataattagtattgctctctgacgagtatagtgactgattaactgaatatgctgtctttgttgatttttttttccccctttgccacagcttcctttgttgcttaatgctttacagttagtgagtgggttgtataccatccatctcatttttttttaagctgtagatgctggaaatgtttacttttagaggacaattttttagaggacaatatatggattattttatttacattccaaatgttgacactcgctcccctgctcccggtcctcgctcccagagttcctcctccctagaggacaagcttttatacattaatacaaatcagatggagaaccatactatcattagtaccatcgggactaagcaattgagagcaaaattcttttggaccaaagtggtctgagtcctttagtaccttgttctacagtgtctggcaaaggtagtttgaaattaggttattaataacattgtctctaagaggatgaggtaaatgcgtattttcattaatccacattgcaatcttcaaagatttgttccattatatcagcttttagtgagtattcctttaaagatttaaaaagtcctttgtgctcaaaagtttataacaagaggtacatcataataagtcagacaaaagaaaaaaaaaagacaagtgctaattatcagtacttctgaaaattgattgcatttgttgctctgatacaggttctggagaatatttttgtgttccccccttaattgttgacttaattttattgaactcttttggggagaaaataggattgtatgatgattttttttaatttattatatgtacgtatactgtagctgtcttcaggcactccagaagagggcgtcagatcttgttatggatggttgtgagccgccagccatgtggttgctgggatttgaactccagacctttggaagagcagtcgggtgctcttacccactgagccatctcaccagcccctgtatgatgatttttaacttgagaaaaactctcccattttttaagaatattggcagttgtttaaagttgatgcttttcaaccaagtagaaggacctcacattgataaatgttgccttcgttattagtcatagttattaatggcctgttttgtatcccttcggcttactagaactagaaaatggtgcaaacacctttgccatagtttggaattgaagaagctagttatttaattacttaactgggaataatagaagcccaaccagagacaaaagaaccttatttttggtacctcttttattttagcctgtgctaacacactttctattttacctcctatttgattaacaagaaagagtcagatattttacagtaaccagtacaaatgacttgcttgcttcttccttccttccttccttccttccttccttccttccttccttcctttctttctttcgttcttttgttcttttctttgttttagtttgtctttgatttttctagacaggctttccctgtgtagccctggctatcttggaactcagataaaaactgagaaacaagttcaatatatatgattgtggtatcggtattatttcatacataaacgggtaggttgtatttcaggatatatgtcaaataaattttttttatgtttttctaaggtttttattgaaggatggccagctgtggctgtgtgctccacaggcaaaacaaatatggaagtgcttagcagagaatgcggtttatctttgtgatcgtgaagcctgttttaagtggtattccaaattaatgggagacgaacctgacttagatcctgatatcaataaggacttctttgaaagtaatgtgcttcagcttgatccttccctgttaactgaaaatgggatgaagtgttttgagagattcttcaaagctgtgaattgtcgagaaggaaaactagtagcaaaaagaagagcctacatgatggatgatttggaattgataggattagactatctttggagagtaagtcaaaaataggagctctgtcaacattgtacttgatattgtatctgatgcttgtctcaggagtctgggttttatccttatctcaagtttgtgtgttccttactagcattgtttaacattcttttaaatctaaagtataaggttgatctattgcaggctaaagtgtcttttatgatattttatacttctatctttaaaacttaggttggttaaaactgcttctgtttttaacttattttagatgtctgcaaattatatacatacacctaggtgttccatgtggtatttgagtacctaaacttttcaaataagtaaagcttgaagttttggggtgtttgtttgtttgtctgttttataagcagtggaggggcttgaaaggcagtgcatacttaaacgtacattaagccccaggttcagtcttcagcacatattttaatgttacaaacccttctcttaatccaaatttgcacttcagataaaatgagtaggtgccacatatttgaaaagtatagttctaagccagcctgaggttacagatagtgtaagatcctgacttccaaaaataataataccaataatcaaactttacatgatgatgtgaaatgtatagaggaagcctgtgtgtttttgttcattgtctccaggcttcttaatcttgctttcattaaaacctctttgcagggatcagccttgacacatgtcatctaaacactagagtgtggaacatagtttgaaaaccaccaatgtaaataggtgtggattgtaaatattatagaactgaaagaagggagaatttttacactaatctgtattcaaaaagcatctcattttcttctaactagtttaaattcctccttgaaagcctcacactttggtcaaaaccatattttatttgtagtaaattttaaacattgcatttatgccttgatctttttgtctcatttagtcaaccagtatgttgttgaatagtgtattaaaaataactaaggatatgatttgaatgtaaatgcccgatgaaacatttcttgagaaacattattttttttttatgtaggttgtaattcagagtaatgatgatattgcctgccgagctattgatctccttaaagagatatacacaaaccttggtccaaggctgcaggtcaatcaggtgagtatcagtgtgcattaaaacttgtacaagctagccagtgcacgcctttagtcccagcacttgggaggcagaggcaggcggatttctgagttccaggccagcctgatctacaaaggacagccaaggctacacagagaaaacctgtctcggaaaacccaaaaaaaaaaaaaaaaaaaaaaaaaccaaccaccttgtacaagctaggattctaattaatagaactataaacctttcaagattttctctttaatttagacttaactggaaattgttttatttcagctactcaaaaacatatataaaagccaggtatggtggtaatatgcctgtgatcttggtatctaagggcttgggggaggaaaatgtcaggttttaagactattttatttggactatatagtagcactttgcatcaaaatacgtaagtacgtacatacatacataaaatacttacagaatactatttaaatgaatcttgccttgatagttttgaagtggttgggttactttgaatgttgattattatgtattgaaatactaaagactatgctgagtgttttttcaaaactagtacataccctctaaatttctttgttttaatctcatttatccttatttgatattagtttctctttaaacaataaactatctgcttaaaatatgattattgtttagggcaacattgttacgtgttctcatctatctttatttggcacattatatttgtaggtggtgatccatgaagacttcattcagtcttgctttgatcgtttgaaagcctcttatgacacattgtgtgttttggatggtgacaaagacagtattaattgtgcaagacaggaagctgttcgaatggtccgagtgttaactgttctaagagaatatataaatgaatgtgacagtgattatcatgaagaaagaacaattttgcctatgtcaaggtttgtgaataattgataactcggattaatttttagttgcttggtattttcctaacccattgccctattttaaaatgtgtacaagggaaacagaagaaaagaaatttatctttttgaaaatgtatcttaaccattaacaacataagtatcttatggaaatgcttgattatttttgtggtaggatagtttattagggaagaaagcactcataagagaagtaggtcagagattctatagctctttttttccttgaaagtttgtgattattttgttttacttaaatatgttctcactgtgtagcattcagggtggccttaaacttagattatcacagcttctcctgtgcacggattatgtgtccagcatgttatctttttaaaataatagaccttttatttcttcattgtcagtttttactttattaatttttcttttacataaaaaataccatattagccgggcatggtggtgcacacctttaatccgagcacttgggaggcagaggcaggcggatttctgagttccaggacagccagggctacacagagaaaccctgtgtcaaaacaaaacaaaacaaaacaaaaaaactatattgtgtgtgtggccatgtgtgtgctaaggtgcaactgtggagatcagagaataatttgaaggagttggttcttttgccatttggtcatttgattctcagggaccatttgggtcttcaggtttggtagcaaccctctttatatactgagacatttcataagccccaaatttcaatataattgtgtgttatatacacattttcatgtttacaaacatggtgtacccaccatgctcctttgtgaaagccagcaatagactttggatgtcctattctgttactattattattttgtttcgactgttctcctaatgagctaggagctagatgggcagcaaacaccaatcatcctatttttgccacccacacttagaattacaagcacatctagctaaaaagctattatggggctggagatttggacttgggtccttatttttcatgcttgtaaaccaagcactcttaaaccactgatacatcccttcagtttcactttttatactcatttatactgttaaaccttatagcatgccttttagcctaatatttggaaggcataggcggtgggttgggtgggtggtggtccaagtttgagactaccctggtcaatatactaagttctagctcagccaaggctctgtagtgagattctcttacaaagtagaaaaaacaaaacagtgtatagttactttttccttttttaagatttagttttattttctgtgtatgagtgtttgcttactgcatgcatgtgtttcatatgcatgtttggtgcccttgggggtcagaaacaagcattagaactcctgggactagagttatagacacttgagccctgtaagatgagctgccatgtaggtactaagaacctaacctggttcctctgcacgctatctcaaatcaacaacaaactcacttgacaggcaaccagggtagctaaaacataatttcaaagagttgaattgtatttcttttaaggtcttaccatttagtaattcaaatgatatttatgttaagttctttcttgatgatataaattcattttttgtatcatactttcaagataaaatgtcaacataatgtagttttgaatgacttgatgttaagagctttttgggcaattctgggcagtagtgcatgcctctaatctcagcactcaggcagagaatggtggatctctcctagttgaggacagcttggtctgcagagcaagttcaggccagccgaagctacagggtaagaaccagtctcacaaatacagttaagacaaaatttgtaacagcttttttttgttgatgttctcaaggtaaacctttttgtttggttggtttggtttggggttttttggtttttgtttgtttatttgggtacttttttgttttgttttgaatcagagacagggtttctctgtgcagccctggctgtcctggaactcactctgtagaccaggctggccttgaactcagaaatccacctgcctctgcctcccaagtgctgggattaaaggtgtgcgccaccactgcctggctctcaaggtaactcttatcttacacatttataagcatcaacgactagtgatttgggctttacaagtatagaagagaatgaaatgttcctactatttctgtgtcttaattgggagctggttgtatatagttgcttggagttgttcatcctggcctttaattggtaatccttcttccccagcaatgactggaatttctggaatgaagcaccatgcctgatatttgtattaattccttataggtcaatacattattttatatgactatgggcatgaaagtactaacagtggaatatagtcatggtgttttggttgctggggtatttatagttaagaagaataaatattttcagggcactacaaggtcttcaattcacttttatttaataagaacatattcaatgttaaagttccatgtgtattttcttggcagctaaatttggagatttgctaaatgtagtattttccatttcttttccccaccagagctttccgtggtaaacacctctcttttatagttcgatttccaaaccagggcaggcaagtagatgacttggaggtttggtctcatacaaatgataccattggttcagttcgaagatgtatactcaatcgtattaaagccaatgtagctcatacaaaaattgaactctttgtgggtggtgagcttattgatcctggagatgaccgaaagttgattggacaattaaacctaaaagataaatcagtaagtatattaccccctgataattttttaaatagaacctcaccctgtatttcattgttgaacatttgttctgttaatcttaatgtcagatgctaggattataatactaactcagacatgcgttggaatagaatatatcaaaacaagtagttataacagagagtactttttgaatgtacttttgaaaatattagcatctagtttttgtttaattatttaatcatgtaatgattgttttggatgcacatatgtctgcactatatgtgtacctggtgcccttaaaaatcagaaaagggtattggatttcctggaactagagttacagaccactgtgaactgctatgtgggtgctagtaatggaacccagatcccatacaagagcagccactgctcttaatcactgagccacttctccagccccagcatctagttttttaaattcagttgttgacatatcactagattccaagttttgtgttttctgttatttttttccttgtctttgattctaatatgtatcattttcagctaattacagccaaacttacacaaataagctccaatatgccttcaagtcctgatagctcctctgattcctcaactggatctcctggaaatcatggtaatcattacagtgatggccccaatccagaagtggaaagttgtttgcctggagtggtaagtatattcagttgttcaaggcattatacttgctgagaattattgacaatagacaatacataaacgaggattttgttgttgttgaagaacgctttgtttaataaggtaaaatgtctacacaattatccttcagtttgaatgaagccctctgaaacgtaattgtaactcagttaaaatttttcttttttaaagatttatttatttattatatgtaagtacactgtagctgccttcagacactccagaagagggagtcagatctcgttacggatggttttgagccaccatgtggttgctaggatttgaactccagacctttggaagagcagtcgggtgctcttacccactgagccatctcaccagccccctcagttaaaatttaaaccaagagccgggcgtggtggcgcatgagtttaatcccagcccttgggaggcagaggcaggcggatttctgagttggaggccagcctggtctacaaagtgagttccaggacagtcagggctacacagagaaaacctgtcttgaaaaaaaaaattaaaccaaaagttccctgtagttaataactgcatggttatatttacatataattaatccattggaatttaattataacatcttggtataaaaatttaaagaggtactaccactgtcttacatacttgttttataaaatggatccttttaaaacgtcgtatgtaggaaaaaactgtaatatttctcatcatatccccccccaaaaaaaatcaccgacgggaatcccctattgacctctgttttcacttcataagaactttaatgactgcaagtaacaccagctactccagtgtaagaacaaactggttagaaatttagaaagtggcatggtggcagtttcactatatgtaggtgagaaatagtgtaataaaacagcctaaaggtatcacaaatgtggctcagatgatgttttaggcctgtaccataaagaatttgtacaggtaagatgagcaaggataacagaagtaacaggagccaaagtatggagataagcttttaggaagaccttttttgaagcccaggagtaatttttcagctaataatttgtgtcttatattctagataatgtcacttcatcccagatacatctctttcctttggcaagttgcagacttagggagcagcctaaatatgccacctcttagagatggagcaagagtgcttatgaaacttatgccgccaggtaagatgttttcgatgatgacacaatgcatgctaacaataaaatgtatattaacaaattcctcttctaagtgaaccatatattagtggttggtaaactagcctgtaagccaaaatcttctaacaacttatttttatacaacccaatacctaaagaaagtgtctaaatttttcaagggttaaattaaatcagaacaatatctatttggagtattgtgagatggctcaatggataaaggtgtgtgcctgcaaatctgatgaattatagaagagaactgactctcttcaactgtcctctgacctccatacatttgccattcactctcacatacgcacctataaataaatataataaaattgttttaagttttgacaccagattctataaaattttagtatctgtagtctattcagttttgctgtcttataggtatacccattcatttaaatattatttgcaaatttttgttgatcaacagctgaacagcttagtagcagagatcatgtggcccaaaatcctgaaataatgtacacacacacagagactaattgattaacttaacagtttaaaaatcaagctatagtgtccaagtttgaaacagtgaacatttgattaaagtatgtattgctttactaagcagaatgagttgtttttcctaagagctatctccttccaggagtttaaagattatttttaaatatgccaaagtctgttttaagctcttcatagcctctcttctctttctgtttctgttttccctctctgtttctttttgtctgtctctgtctgtttctgtctgtctcttttgcactctctaagacagggtcttactatgtaggttttgctggcctagaatgcacagagatccacttgcctctatctcagtggattaaaggtttgcaccacagtgtgacaggctccttttttctgcattctctcaatgtttgagaatatatatatattcagttttttgagtactgtgatgtctttcagtgaaataaactaggtaatctgaacgtcataaagcagaaaataacttggaggtaaaaactgttgctgttacttacatttcctttggaagtgggttttttgctttgttttgttgttttctttaaatcagtctccaacagctggaaactgttgactggaggctcctggatgagagatggtctcatgtttaggctggctgattaaaaggcactggttggcattttggttctcatttgtttacttttaaatcaacccaagttcggtcatgtattacagaagctcaactgaatgtttaactgaattgtttgctgttttgtgctcttgaaaatgctagaagtgatatagatgtgaattgtgttttatttcagactatgcctctttctcttacagatagtacgacaatagaaaagttaagagctatttgtttggaccatgccaaacttggagaaagcagccttagtccatctcttgactcacttttctttggtccttcagcctcacaagtgctatacctaacagaggttagttttttgtttttggttttcatttttggatttagttcttgtttaaatttgatccttgatgtgctgctatgaagaatgtggataagattattataaggtggttttgaagtggtcattgtcttagcattcttgatggtgaaatggaggttatgttttaaatcccttttaatacaatccttctcttctccctctcccccttttatttgcaggtagtctatgccttgttaatgcccgctggtgcacccttgactgatgattcctcggattttcagtttcacttcttgaaaagtggtggtctgccccttgtcctgagtatgctaaccagaaataacttcctaccaaatgcagatatggaaactcgaaggggtgcctacctcaatgctcttaaaatagccaaactgttactaactgccattggctatggccatgttcgtgctgtggcagaagcttgtcaaccaggtgtagaaggcgtgaatcctatgacatcggtaatacagactttgttttggtttctaaaatatctagtagtagatagtcatttttaaggttaaatttctcaatgattctaaagtctagagtttaattttgactcagtattaaaattttctttccagtatatgtcttgttgatagaaatgttcacttatttctctatatttgtattaaaaatacacacactcgaaaaaccaaaaaaaaaaaaaaatacacacactctaccctggctttcctactactaatttaagagaccatttccttcagtttctttctgaccacttgagttttactacactctaacttactgtgaaaaaaaaagccacataaatgaatttctaacttgtgccaagcagataccagtggtgttaagattttgtaattgatttagccttttgccagtttctgtcccatcttccttggcttaaactttaattatgaaggccttatcattctgtcttcgcctggatctttgatccattttcctgatctcaacatatgctatagtttaatgactagttaaaggcccaactatgcaaatagttgctaaattactgatagaagacaaaagtctttaggagaatgaggcaagaggattagaacatatcaaagccagcctgggctatggaatgagaggaccttctctttaaaaataaaagtcttaagaaattttctttagaaatcacttagatcatattggaggtgaatggcatgttggtgattatgatatgtagttgttatatatacacatatgagagaatactataatatttcaaggaagaacctttttatttttaaaatagtttgcaaaataattcataaatgaaaaaattttaattaaatttgttgggggctttttttgttttgttttgtggttttgtatgtttgtttagtttttgagatagagtttctctgtttagtcctggcttctcctgaaccaggctggccttgaactcagaactcatagagatctacctgcctctgcctcccaagtgttggaattaaagttatgcaccaccacgtccaggtataaatgaagttttatgatactcaagatttgcctagtagcaatcctaaaggtcaatggagatggaaagtaagagggtgtaattaggtaattgacaatagtgaggcagaataagagggagatcttgatctttttaacgataatttatttttattttatgaaattgtggttctgcctgtacttttgtctgagagtgtcatatcccctggagctggaatcacagacttctattgctgagctgtctctccagcccccaataataattgtattatcttagtctgaccactttcatatgttggaaattttctgtaagccagccaggcgtggtggaggcttataattgcaggatctggaaagctaaaacaaaaggaccacaaattcaaggccagcctgggctacataggacaaaaaaaaaaacagataaaaaaacgaaacaaaaggagtgaacttttccataaaaataaaaatgactaagattatatattatttactgtggtccatttcattaggattttttattttatttttatttatttatttattatatgtgtgtatactgtagctgtcttcagatactccagaagaggacatcagatttcattacagatggttgtgagccaccatgtggttgctgggatttgaactcaggacctttggaagagcagtcagtgctcttaaccactgagccatctcaccagccctcattaggattttttaaagtaaattttggcttaagaggaaaaactgattcttatcaggtgtggtggttattacctgttatcccagcacttggaaagccaaagcagaaaggcagcaatgagtttaacacacacacacaccagctttaacgtgagactttgtatctcaccaaatgaggaagagctcttgttaggataaaaagattcttattttaatccaaggcatgactgcttaatgaagtatacaatacaaaaggcaataatatgcttcttcttgtatcttttctataatactttgagaacatggccatttgctagctgtagatactaaggtattgtaattgtgaagtatttgttggcaattgaaagcaaaataaaaatttagtaatagggatatcttaaacatttacagtatagagaaaagttacaactcaaaatcagaagtattcagctactttatctgtttctcattgattaaaacacttagtatacaattacataaaagtactgctatcttttgtatgttttatttttttataattgtaatttttctaattttcaaagtagaacttgataactggagattatgagcagggtctgcctaaggatacacatttaaaaagatatgatttactgcattttgagatgagtttggacttgatctgttcatagaaacatgggttagatgaatctagaataggggattgtagagaaatctgtgccacttgcataccatgttggcagggtggaatactttgcatgtgaatgtggaaagaaaacatcttgggaatgttgatgaacgccataggaatgattgggtcaagttgtatacagaatactcaaataaaatggttaactgtttttcaggtcaaccaagtaactcatgatcaagcagtggtgctacaaagtgcccttcagagcattcctaacccatcatctgaatgcatgcttagaaacgtgtctgttcgccttgctcagcagatttctgatgaggttagtattgtaagagttatatagggggagtgtgtgtgtgtgtgtgtgtgtgtatttatttacaatgttttacctgtcataattgttactatacaattttttaaaagtttttattctgtgtgttttgcctgcatgtaagatgtctgtgcgcagcttgcatgcctggtgcccttggagatcaaagaggacttttggatgctctagaactggaactacagactgttctgagcttccatgtgggtgctgggaattgaacccatatggaagagcagccagttctaaccactgagctgtctctctaacccaaaacaacctttttaaaaattcaatctagatcattgtttaatgccaacttagtattattagtactttattttcaaattttgcataatagcattctttcagagtgtatatacaatatttagtattcacacaaacagtacacaataattgttctgtactttttttttttttttttttttgcagtcaatacttcccttcagttctaatatccaataaccactaatttttttgtcccctatgaaagtttttattttctagaggtgtgtgtgtgtgtgtgtgtggtttttttagttggttgtttttgtttttgttttccgagacagggtttctctgtatagccctggctgtcctggaactcactctgtagaccaggctggaactcagaaatccgcctgcctctgcctcccaagtgctgggattaaaggcatgccccaccacgcccggctattttcttaagttgtattcagttggattgtgtgcttataatccaaacacttgagtggctgaagcagaaggatattacatagaaagcgagcctgcaagacccaatctcaaaaaataaatacttttttaaaaagctattgatgactttgaattgtcaatgttctaaggttcaatagatcattccttttggttaaatattatcccattgtatgctactcatggtggcacatacctttagacctaggacttgggagacagaggtaggcaaatttatgtgagttctaggcctgcctcatctaaatagtgagactgtctgaaaaaaaaaaccaaaatatgcatgcatttgtgtacactcaagggacacatacacataaataagtagatagatggatcatatatcttataaaaacatatataatcccattattaatattctatggtttgtttatatatgttaccaaatatacttggatttttttcccttttagatatgattagaactgctctgaaatttttataccattatttgaacttcctattctctacacctgggaatgcaatgtttgtcatttctgtggtggtcaacactaacagtattctcaagttttaattaatcattattttataggcttcaagatatatgcctgatatttgtgtaattagagctatacaaaaaattatttggacatcaggatgtggaggattacagctggtattcagcccaaatgaagaagtgacaaaaatttatgagaaggtaagaatcatgagaggaatatgcccactatataaatgaatgttaatgttttgctttattttttatgtgtataagtattttacaatgtgtgtacatatatgtaccatgaatgtctggttccctttgagttcagaaaaagggattggatcccctggcagtagagttatgaacagttgaaagccaccatgcagatgctatgcattcgttgatcctggtttctctgttaagagcaagtgctcttgaccgctgaatcaactctccagctcacacttctccattcttaaggaaaacttgagtaggaaggacttcttgatcagtacagtgtcctcattatattgaacactttgttcttattacgattttggtgtttggtatagtgtctctttgatatattcattcggaaaatgaatgaaagcctatttcagtcacattaaaatcacagcatatttggggttaggaaaaaaatttaaagccttactgagcagttttccagagatttttttaattaaatagcacaataacattgtgccagagtagtggttcataaagaagcaatggttagttgttggttcagaagtgtacaactcagaagggtctctaggagcttcttaactacaaagtgctcaatgatgtatataatcagtatatatatatccaatgccttttgggtcatagcaaaatattgacattagacttagttttctattatagttgtttttaaattatttcaaaaaaacctcacaaaacaggtaaaaagaggaaacatgtagtttaatgataagtgaattttaagcactaagcttttgaagtttcatagtattttcttttaagcactttctaaattaacttactaaggattaggtttctttatttattgcactttgcaaacaatattagtttttgttgtttccttcccttcttcctcccttctcttgttctctctgttcccctgcgaggtgtcttcccttacactttcatattacataggtttttcttttaaagcttctttaaataatttgttcccaattattttacagaccaatgcaggcaatgagccagacctcgaagatgaacaggtttgctgtgaagcattggaggtgatgacactgtgtttcgccttgattccaacagccttagatgctctaagtaaagaaaaagcttggcagacatttattattgacttactgttgcactgtcacagcaagtaagtttcttttttatttttaagaaacttgatcttatttttgtaaaatagaatcaaatttatgttggcacaaggtattatagaaaccaaatactctccatggcacattaatgttgaggaaattttcactttataatatttgacctcacctaaatttgtttaattttagtctgcaaaattgaatagaatattggcctcctgtcttgtattcctaggtgtcagctgttattttaatgtgaaattttataagagggttaccataggagtttatgcataaagatcagttaattgaaatccatcatttttttttcattttaagggtatttaatcagtattagtaatgtttcaagctgcttttatacaagcaattcagatttaagacaattcaaatctgtagaaattggcttccaaccttttataatggtctgattctgatcccttttttttattacttttttctttattggatattttctttatttacatttcaaatgttattccctttcctggtttctgctctggaaaccccccccatcccctcccaccttcccctgctcaccaactcacccactctcactttttttttttaagatttattattatacataagtacactgtagctgccttctgacataccagaagaggatgtcagatctcattgtgggtggttgtgagccacgatgtggttgctgggatttgaactcaggaccttcagaaaaacagtcagtgctcttaaccgttgagccatcttaccagtcccgtcccccccactcccacttctggccccggcattcccctacactggggcatagagccttcataggaccaaaggcctcttctcccattgatgtccgactaggccatcctctacattatgtatgcagctggtcatgggtcccaccatgtgtactctttggttggtggtttagttcttggaagctcttggtactgattagttcatattattgttcctcctatggggctgcaaaccccttcaactccttgggtcctttctctagctccttcattggggacactgtgttcagtcccatggatggctgtcagcatccatttctgtatttgtcaggcactctgatcctgatcttataattataaaaactaattaggccagacatggtggcacacatctttaatttcagtactttggaagcagtgacaaggggacctctgggtttgcatctaggctgctctacattacatgttccaagacatccagggctacatagcaaggccatgtctttttaaaaaaagtaaaaaaataaaaaacaaaaaaccaagcacaggtcattggcagtggcagcgacgttggcagcgccaccgtacacacctttagtcccaatacacctatcgctgaagaggcagaggcggttggattttcgtgagttcaagaccagtctcttttaatagagctagtttaggatagccaaggtttcttaaagaaaccctgtctcaaaaacaaaaaaccaccagaaaaatctaattggtactgttaatggctcaggtacaacttacctagtccttgaacaacacattaatatgatacagtggagtatcaagtgagaatgtttaacgatcagaaaagagtgatttccttgaaaacagccattctggcccatctgggtggtagttcctttaattctagcactggggaaagtaggaggcagtggcagacagatctttgagttcgagcccagcctgttctacagagtgagttctaggacagccagagctacacagaggaacttgtgtggggttgtggaagaaaagaaaccctttttcatgtgatcaaacaaatgcagaacagggaaagcttgttacctctattggataatggtgccacagttagacatctgtgtacattataaaaaatagtatgaatcattctagttccatttaatcatcttcaaggaaaattgtataaaacacagtagttctctgtcatgcttttcaaatcaatactacagtataaagaagagttgtagcagtatcctttctatgatagcataattcccactggaccctcttctaaggtacacctggatcaaaattctgtggaagggggactggtaggtgttttaaggtttgatatggggcattttatatctattagagcctgttcagaaaaaggttagaaggtattcctcaaactcttcagtgacagtatgaggtcatagccttgaacatgcattagtaaactcatttacatgttatttttccatgactatttaagtggatgttagttcatgttcctaatgtatcacccccttccccaagagaaaacaatatattaaacataaatcatttccatttcagaactgttcgtcaagtggcacaggaacaattcttcttaatgtgcaccagatgttgcatggggcacaggcctctacttttcttcattacgctgctctttactgttttgggggtaagagatttaaaaatatgtttaccagtgtaattccttcaacaaggaatgatattctggaatttgtggatttagcttgaactagttagggcaatctatacttaataaaacaatagttaactcagggtttttgaaaagggaattcaaagtataaacatattgattcactatactgtattttatcattttcagagcacagccagagagagggctaaacactcaggcgactactttactcttttaagacatcttcttaattacgcctacaacagtaacattaatgtgcccaatgctgaagttcttctaaataatgaaattgattggcttaaaagaattagggtaagttgtagttaatactttgtttatattgttaagaaatagtgcttcatttataaatggttcataatttagaacattttaagcttaaaggggaccaaagaacatacattacattgttgggttttactttatagaatagaatgcattactacttacagaaaacatgtgcttaagatttaatacaagctaagcatggtaccacatgtgtttaagcccagtacttgggaggcagaagtaagcacatttctatgagtttaaggctacatactgagaccttgtcagtgggggtgggaggggttgtcatattgaggttcagcttttctgccttttatttagcaagttatcattttaaagaaattactgcccctccctgcctcggccaaaaaaaggtagtcaaatacactaactttgatcataagttgttgaagaccacatgaaaatttatttctgaggaaatctatagttgtattgattacttttctgtttctgtaatgtgatatcacaacaaaaataagggagagggaatggggtttaagagtccatcatattgccgggcgtagtggcgcacgcctttaatcccagcacttgggaggcacaggcaggcggatttctgagttcgaggccagcctggtctacaaagtgggttccaggacagccagggctatacagagaaaccctgtctcaaaaaacaaacaaacaaaaaaaagagtccatcatatcaagaaaggcatggcagtagaagtagggagctggccattcacattgaaactgaagaatccagaaagaaagaacaggaagtgagttgaaaaatcaaagccagcagacacacccttctagtagctaatgtatttcctccagcaagattccacctcctggaggtttctcaggtgtcccaatcagcactgccatctggggaccaagtgttcaaacatggaatcttattagggaacatttcacacccaaacttgaacagagtttagccttcagattagcacttctagtagtcaaagcacatgtatagaaatttgaaagtttaacttgcttgaaaggaaagcattggaagaattgtctaatatccttctagctttcttgttctgattcctccatttcataagttaataaatatttgatttttgtatccctttgacaggatgatgttaaaaggacaggtgaaacaggtgttgaggagacaatcttagaaggacaccttggggttacaaaggagctactggcttttcagactcctgagaaaaagtttcatattggttgtgaaaagggaggtgctaatctcattaaagtaagttctgtgttcttggttctaaactacatatcctatccttgtaagtattgtcgtttaatatgattgttagcactaggtctttggtgtatttgttatcatttttaatttttgatattataattacattattttctcatgctttcctccctctaatgcccaatatacccttgcttgctcatttccaaaatcacagcttttaaaaatatattttatttaatcttttttttttacactccagattttatccccctcccagtccaccctcttgactgttccacaacccgtacctcgtgtgtccccccaacccccgtccccatctccacgaggatgtccccactccctggggcccccagtctcttgagggttagacgtatctttgaacccagacccagaagtcctctgctgtatatgtgttgggggcttgtatcagctggcatatgctgcctggttggtggtccagtgtctgagagatctcagggctccaggctaattgagactgctggtcctcctacagcttgttaaccatctccttagctttttccattccagcttttccctaattcatccacagggattagcagcttctgtccattggttgagtgtaaatatctgcatctgactctttcagctgcttgttgggtgatttggagggcagtcatgataggtccctttttgtgagcactccatagccttagtaatagtgtcaggcgttggggcctccccttgagctagatcccactttgggcctgtcactagacctccttttcctcagttccttcagttctttcagacaggaacgattcgggtcagagttttgagtgttggatggcaaccccatccctcacttgatgcgctgtctacaagttccctctccctctgagctccctccctttgagtcctgagaatgtgtcacttcccaggtctctgctatattctggggggtgaggggagtctcctacctcctgagtttgcctgtttccattctttctgctggcccacggggcttcagtccttttccctcacccaatacctgatcatgttcccctcttccctttctgtcccctttcccatccaggaccctccttcccttccccctcctatgattgctttcttctccctcccaagtgggattgagatgtcctcacttgtgtccctcagcctgttaaccttactgagttctatagactgtatcctgctgattctgtgctttttttttgggctaatacccacttattaatgagtacataccatgcatgtccttttgggtctgagttacctcactcaggatgatattttctagatccatccatttgcctgcaaaactcaggatgtcctagttcttaatagctgagtagtattccattgtgtaaatgaaccacattttctgtatctattcttctctcatgggacatctgggttgtttccagcttctggctatcacaagcaaggccactatgaacatagtatagaacccatgcccttgtagcatggtggggcatcttttgggtatatgcctaagagtggtatagctggatcttcaggttgatctattgccaattttctgaggaattgaactctgtggcacaagaattccattggctcacgttctaagatcaggaattgataaatggagcctcatgaaactggaaagcttctgtaaggcaaaggacactgtcagaaggacaaatcagcaacctacaggcaaggaaaaaaaatcttcactaaccccacatctgataaagggctaatatccaaaatatatgaagaactcaagaagctaaccaccaaaaagccaaacaacccaatcaaaaaatggagtataaaactaaacaagagaattcacaacggaggaatctcgaatggctgagaagcacctaatgttcaacatccttagtcatcagggaaacacaaatcaaaacaaccctgagattccacctcacaccagtcagaatggctaagatcaaaacctcaggtgacagcagatgttggatgtggagaaagaggaacattcctccattgttggtgggattgcaaactggtacagccactctggaaatcaatctggagattcctcagaaaattggaaatagataaaacctgccttttaagaatttttaccaaggttttacaatgtttgtttagataatataaagcactagttagtgtctttcagtaaccattgcatgtttgtaggtgttatatgtatgtaaaatgtaagtgtaaagtgttacttagtttatgtctttatacctttaaaaaaaaccaagaaactacatgtttggtaaataggtaaaagtagaatatttttattagaaaatccacaaaaaatttctgtgatataagacttaaagacagaaattctaagacaaatatttctctttccagattatgtcactgctaatatttaatcctttctttcaactgtttaggaattaatcgacgacttcatctttcccgcatccaatgtttacctgcagtatatgagaaatggagaactccctgctgagcaggccattcctgtgtgtggttcaccagccacaattaatgctggttttgagttacttgtggcattagctgttggctgtgtgaggaacctcaaacagatagtagattctttgactgaaatgtattacattggtacagcaataactagtaagtacttttaaacatatggttatccttgacatacacagagccagtgactttgatgccctgtattccataaactaggcatggtattaatataatcccagcactggggagggggttataaaaaacatataaaaacaggaggatcttaagttgaatatcatcctcagttacattgatagttccagtccagcttggctatatgagatactgtcttataaacatacaaataggatcatagattggtaggtgagggagcctgcaatgatgtgggttgctgtcttttttttttcttttttaaagattttactttatgtatatgagtacactgtagctaatcttcagacacaccagaagagggcatcagatcccattacagatggttgtgagccaccatgtggttgctgggaactgaactcaggacctctggaagagcactcagtgctcttaaccactgggccacctctccagcccatggattgctgtcttaaatgcatttattaatggagaaatgccatgtgagagccctgcctcctgtgactgctcaggtagtagtgtctgtgttttgtcagcttaagagaacttaaacatcataaaatcacttctgtctttgtttttcagcttgtgaagcacttactgagtgggaatacctgccacccgttggaccccgtccaccaaaaggatttgtggggctgaaaaatgctggtgctacttgttacatgaactctgtgatccagcaactctatatgatcccctctatcaggaatggtattcttgccatagaaggcacaggtagtgatgtagatgatgatatgtctggggatgagaagcaggacaacgaggtaaatttcttttatcacttctgttctctgtgaaactcttgattaacaacattctttcattagataccaagggaataagtacagtcaccagtttccacaggattcccctccaaaagccctcaacccaagatggcaaaatttgccaatatacaagtagtctaaatggaacctacacaaatctattttcatactttaggtcatctgtagattacatcaaatctctcatacagtgtcttatataaaagtctgggcatacttcgtgaacccacagataaatgttagtggatatgaagatttgattgtgttgtgatttccttccttagactgtccaaagtatgtttgaaggttggcacagcctctgccacttgggctacctcttagtggagtgtgtctccattacagcagttacaaagaatccatctctttgaaagtagtgtttgatagaagttgaaatttaactagtttaaatcgacaatggccaaccttttggcttttctgagccatattttggaccaaaatttgtcttgtgccacacttcctttcccttcccttcccccttttttgtttctgtgattttttttttttttttaaggtagtcttgctatgatgtccaggctggcctctgaaggtctccagcttcagttttccaggtgatagggttatagtgtataccaccacactaggctaagtttttcacttttatctgtgtttgctcccttttgcttacacttatattttccctcaagtcttatctcttcctgcttaaaaacaaaactcttgcctacttcaaatactgtttacatgatcttgtgacaaaagtttaagtttcatgaaaagtaaccaaagcagagtaaagcaatgggaaaaaatgtaactggtaacaaccagtaaacgttgatggtgggggggctggtgagatggctcagtaggtaagagcactgactgctcctctgaaggtcctgagttcaattcccagcaaccacatggtggctcacaaccatctgtaatgagatctgactccctcttctgatgtgtctaaagatagctacattgtacttacatataataataataagtctttgggccggagcaagccagaggtcctgagttcaattctcagcaaccacatgatggctcataaccatctgtacagctacagtgcactcatatacataaaataagtctttaagaaaaagttgataaccgtcaaagaagagaatgtagcagtactgaagttggttcttttttgtacccacactgtgtgtctgtgttgtttgttgttttatccacgtttatagtgttagactcccatgagttgtatttttattgtcataagtgtttttagatattttttcttttcttcccttcattcagcaaaattggacttggtctgaagaaagagcttactacctctggggcttctaaaccaactctttcccagacctcctgaacttagatgatccagggattggggactgagtatttttactttctcccaaagcttcatatggggagtttacatccaaaacctggttaggaactttattcctatactcaaggtttcaaatacaagatgtccactgaagtataaatttttctctgtagccctcaaaattttgaaccttggtaattttcatgttataccttctaccactatttgtgtttaacttaaggttctggctatgtttcccaggttgcccattaccttctgggctagccttagtagctgggattcaaggcacatgctcttgatgctcagctttattacttgttttccaaggtcttaaaatgtgcttcctcgccttagctcctatgaatactgcggccatgaacatgaatatacagaaatctcttagaccctgcttctagttcttagcatagtaggtattgtggttgagtttaaagtagaacatctttgaacaaaagctccttaaatctttctgctcgtttttttttcttcaaagcagtgtttctatgtagttctggctgccctacaacttgctgtgtagaccagattggcttcatactcacagaagtctccctcctaagttctaggattaaagacttgccagctttttgtattttaaattttgaattgtgggtttaaggagtcctctgtctattcaggattctacctcctcatcagataagtgattttccctttttcctcccactctgaattcattgcctctcttggcagtatttttatataaaagtttttcattttcttgagatccaacttgtttgtaccttcaacatcatagtaagaaattgttatcagctacaatgtcttaatgattttgccttccaagtttggttttattcttttaactctaacttttaggactttggtacaaattgttttttctatgtaattttaaggagagctcagcttcattttttttataactattaatgtctatattctcacatgaaatggcaggaacaaacactaactgtaaattaaatgtatacaccttttgaaaattaagtgcttggaaacaaagtaaaagtgtatgttcactaactggaatttatctcaacatattttactaaacttctgattagctcattaataatacctttttggtttctagagcaatgttgatcccagggatgatgtgtttggatatcctcaacaatttgaagacaaaccaccactgagtaaaacagaagataggaaagagtacaatattggtgttctaagacaccttcaggttatctttggccatttagctgcttctcgactacagtactatgtgcctagaggattttggaaacagttcaggtaaagtagatggacagtgataaaccacatatcttaataaatagctcatattcctaaaatatgtatcttaagatatctttatgttctagccttgattatgaaaatataagatgcatatacagtagaattatcgtaacatatattccttcctactactttctaaattattttgagacacagatcacagataatagtttcacctataaatacttcattgtgtgtctttgttttaaaacataatgaatctattactgtgctttttaaagatcccttgatattgaatatattcagcatttcaactttcccattatctcatataatttttcccaaatctgaaaccatgtgaaaaccatatagcttaaatagtattttctctcttttttttcctgcatgttctttaaggtgcccagtgagatccagaggcttgatcagattagcatatttttggttttgtgcaggagataggcatggctattagatgggtgatatgcctatatagttttacctccatgaggagttggtacatggcatttttctgcctcttctgatggtagcagcaatcatattattcagcttatacaatgaaattcttccagctgttactctatcaaaggaacaggttaatttagagcagttttgatgatttgaaatccaagattgaacatttgaaggaggaagattcattgattgccttttcataatgatatagaggcccactattgctggattgtgtgtaggagaaaaaccatgaaagaatagacaaggccaccgtgcgatggtggcgcacacctttaatcccagcactttgggggggggggtgcaaagggaggcggatttctgagttccaggacagccaggtatacacagagaaaccctgtctcaaaaaaacaaaaaaaagaatagacaaggccaggcttactgtttttataatattcatttggtgagaacagtctttagcttatatagatggtgagacactgcctcaccggctgttttgctatccatatcatgtttcctatagttttacagtaaatacagtgtgctgctctagaaggttgattggggtgcttggtttttttgctttgtttttttttttttttttgtttttaagtcagtacctactgtgctatagtacttcagtaagaaacactacactctctaggtggtgtacacttgctaggctggggggtggcagcagtggtgccacatgcttttaatccctgcaatcaggagacagagtttgagcccagcctgatctacatagtcagttccggacagctagcgctacacaaagaaatcccatcttttaaaatagagaaaaagaaaaaaagtcactgtactcttcatagcaatatatagtgttttgttacttaaataagtactatttcagggtgcaggggatacagttaagtaatatcatacttgcctagcatgcccaagggccttaactcccatccttagcagtgaaaaacacaactcttccaagggacctctaggcagctgacagaactagatggttgcctatcttcccctgcttctggcagagtgagaaagaattgtttttttatactcccagcaacaagaacaattgcagtttcttatagataccctaactaagcccctacttagtcgacactgggagcttgcctgtaacactttattcaatattatcacccagaaacacccccattcctcttctcagtctatacatcctgttttgcctctctaagacttttctaaatccaaaatatcttcctgttattctaagaattgcacactttctcaccttttatgctgaaatttgtctcttgattatagttttccttcttgtattttgttttgtggcttagattttggtgttttgaaatttgttgttatttgagacttgtagatagcccagcctagccttgaaatcaggattcccttgcctcagctacctaaatactaatattataggtatgtaccacagtgttaggtatttttatctcttcttacatgcttggtgttttctgttccatatagtagttaggtttgtatgattggttctttgcaattatattcagattaaactttggagagagcaagaaagaaaagcacattaatgatgttgtaggcatctaattgcacatgcatgagcatctgttcacttaataactcacgataagaactggtacctcggtgtcttaacaaatgtctctgttgtaaggggtatatgtatttcaaagtgtggtgaattgtgttacagcttgaaagtaaatagagaagactagtgttatttccaatagtgtaacaaataatagatctgattttttgttgttgtttttgatttttgagacagagttcctctgtgtatccctggctgtcctggaactcactttgtagaccaggctggcctggaactcagaaatccgcctgcctctgcctcccaagtgctgggattaagggcatgcgccaccactgcccggcctgaattttttttttagtctatggcatatataaagtacatttgtcataatctcttgggaagaatacacttaggtcctctgtgtgtattattctgtgactacaatgtcacctgtagattccatcagagccttactgaagcaatggctattctcagtttgtgttatatacatatgtaggaatgataattttggaattagtttatctaagtccttagaacactgaaaagagattaaatagaataaattaaatagaataaatcaagcttttcttttttcacatagaaaaatcagcttaatgaatgtacatgtacacattctttttgtctaatccaaaatgtggcaaaatgcttagtgataagatccaccatctcattttaatggcatctacagctgagttcaaaatgcatgtgtatgtcacactatctgaagcaacaacctttctttcttagggctatgctgtttaccaaccataccattagttctgtggcaattctttgccattttaataccacttttactatgggtctcactgtccccctcaatatctggacataaagacttttttgtgtttcctacttgctccataattgccttacccacaactgtaagaaacaaaatgttgtattgtggttgtcacatgttacatgttatattccattcatttctcaggctttggggtgagcctgtcaatcttcgtgaacaacatgatgctttagagttctttaattctttggtggatagtttagatgaagctttaaaagccttagggcatccagctatgctaagtaaagtcttgggaggttcctttgctgatcagaaaatttgccaaggctgcccacataggtaagtgctaatatataatactgtgatatgctaataagaataaaatctttactagtgctaatatgaaaatggaatatgccactattaaactcctacaactgaataagtacagtgaatatcttaatactgtttgatggttttttgtttgttttgttaaataacttgatttcttttggtgtttttaatgtcttactatttcatacttttaattcttttatattttcctaaggaactaagatgacaatttgcataatgactagagatattacttccacgtttgccttttatcttagaatttagttactgtagatacactgagtttagaggatgacaggctacaggtgttatttttttaatgagataatcacttttgaaacaatatcagctattgccatcttttccctacacacctaatatcatcatattaaggtatgtatacatacaacatactgtaaaagttaaggtgaaaacgtcatattttgttgttgttgtgatggtttttatttttattttttttttgagacagggtttctctgtgtagccctggctgtcctggcactcactttgtagaccaggctggcctcgaactcagaaatccgcctgcctctgcctcccgagtgctgggattaaatgtgtgtgccaccaccacccggaggtttttaattttaaaggaacttttagtaaaggggcttttaataactcttgtctgtagcttgtccctaaggcaggaagattacaaaggtttaagaatacctattaaaaatagctaagggactggtgcagtaactagagtcttaagagcactgacagctcttgcaggactagagtttcagttatgagcacataatgttggctcacaaccatgagtaaccttagttttggcagctctgatgacgacctggcctcctcaggcagtaggcatgcatgtggtacagatacataatactcatagttaatagaagacaatctatatccattctctctgtataaaatattaaatatgcattactgactgtcaaatcacaccaacgttctattacagtgctataaggaaatctgttactgtgtgtgtgtgataatttaaaaattggaggcgctagagggaggtccaacttaataagaactggctgttctgccgggcggtggtagcgcacgcctttaatcccagcacttgggaagcagaggcaggtggatttctgagttccaggacagccagggctctacagagaaaccctgtttcaaaaaaagaaacaacaacaacaaaaaccctggctattcttgtagaagacccaggttcaattcccagcacccacctggagacatacaactgtctgtaactccattttcaggagatctgacacctcctcctggcttctctggacactgggcatgtacagtatatgtagagatacatactggcacattcatttttgtaataacataaaataaactagagctcaacagttacaagctcttgctgctctccagagaaccaagtttagttcccatggcacacaaactccaaggaatccaacacccttttctggccttgataggcatacaacacatggcagacacacaaacttacacataaattttaacaataacaaatactttttaattgggggcagtgaggtggttcagctggtagaggcatttggaggttcaagttggcaaagtgtcaggagagaaccaacttgacaaagttgtcctctcaacatgcattgtatatgtaatagcacctgcagccacacacactataaatagtgcattttaaaaaatagttttcagccgggcggtggtggcgcacgcctttgatcccagcacttgggaggcagaggcaggcgaatttctgagttcgaggccagtctggtctacatagtgagttccaggacagccagagctacacagagaaactctgtctcgaaaaacaaaacaaaaaaaattcgttttcggtctggtgagatggctcagcggttaagagcacgactgctcttccagaggtcctgagtccaattctcagaaaccacatggtagctcacaaccgtctgtaatggaatccgatgccctctactgctgtgtctgaagatagctgcagtgtactcacataaataaaaataaataaatcttttttaaaaagaatttgctcactctatatatacatacttaattacttttggtagattggcataattgagcactttccacaggggcccataattattctcaaaacaaatcacaacatggtagactaaaaagagcttaagctcaagtagccctgtctttttgtttgtttggcttggttttgtttttccaagacaggtttttttctatgtattcttgggctgtcctagaactaaaacaggctgaacttgaactcagagatttgcctgcctctgcctcccccagctggcctattttcattcccacttcactcaagtgtggatggtgatagttctcaagtaattttgtcacgaaggcaaaggacagcatgtaatcaaccagcatagtgtaaataactaggaaatgccgtcagtattggtaacatcccattaccttagaggtttcattaactatgtaaataatgaggtgtttagagaactgaagagtgaatccttttctgataacttcttaaataatatctttaggtacgaatgtgaagaatcttttacgactctgaatgtagacattagaaaccaccaaaatcttctggattctttggaacagtatgtcaaaggagacttactagaaggagcaaatgcttatcattgtgaaaaatgcaataaaaaggtatgaattaatctatttagataacaatggtacctcttaactgaaaagctctgggtagtcgatagtttctagtgaagaaaaacagttttctttaagagagagagagagagagagtgtgtgtgtgtattttaaaggaagaaatttaaaaggtaatactagaataaacaaaattgtaaaattgtaatcgcttaatacctttgtttatatgaattaatatgggtacatttgtttctgcctagaaacaaactccagagctgatggaggaaaacatttttcctcttatatccagaattgttttgctgaaattatttttttaaatacagtaaaaaaattttttaccacctgattagattttgtccattggaacttctctcttcaagggagagggacattcatacttaggaatagtaaattatgtttatcttttctgccttccaaaccattttacctctaagtcacctttattgtttggccccacaccacttagagaaggatgaaagtctgtacattgggattatggggtatgaaacaacaccgtctaccactgtaggttttgaggcatgagacaagttcctaaacttagcaggacaccctatcttaaggttcagtagtgccatcttaggaggattgtaaggattaaatatgttatcacctgtataatattaactaccttctaattgcccaataaaaagtaaactattcagtttgtttacagcaaacaaccttagttggaataactataaataacaaacagtggctaaaggcaaaggtagtatagaaactaggcagtaaataatatgtaaaggactaatttttgcaatctgtattaaccggttataggccatttccagttaatatttacatcaacttcacagaaatatcttaagattacaattcaagtaaatcttataaaaacttgatgtgtagtgctttttaagagtttgcttaaggggctggtgagatggcccagcgggtaagagcactgactgctcttccagaggtcccaagttcaaatcccagcaaccacatggtggctcacaatcaactgcaatgagatctgatgccctcttctgttgtgtctgaagacagcgacagtgtacttacatataacaataaataaatctttttttaaaaagtgactttgcttaagaggctagagagaaagctcagccatgaaaagtgcttactgcttttgtaaaggacttggatttagtttccaacaccaatatgtcaggcagttcacagtcatctatggttccagtttcagggactctaatgctcttgtttggtctcagccaccagcacacacttacacataaaattatttactctaagagctacatatagtgatttacaactacagaagaaaagcccaagttccaggttcaggcctgcctaacttcatagtgcactaatctgaagccaactggaactataatatgaggccccctatcccaagggaaaaagatttaagagaaaaaagtttacttggtctcatggtcttgatggttcaagcctgtaacttcaaataggagactgaggcaagaagatcatacattcaagacctgtctgggctacagagcaagttcaaagccagcctgagcttaagagaattagaaatgtagctaaaggatgactgcttgcttaacatgtgtgacaccctgggttaactttcagatttggggatggtagtgtttgcttggattttggtttactttttgcaatggattgtatctattaattttctctattgattttaggttgatactgtaaagcgcttgctaattaaaaaattgcctcctgttcttgctatccaactaaaacgattcgattatgactgggaaagagaatgtgcaatcaagttcaatgattactttgaatttcctcgagagttagacatggaaccttacacagtggcaggtgttgctaaactggagggagataatgtcaacccagaaagtcagctgatacaacagaatgagcagtctgaaagcgagaaagcaggaagcacaaaatacagacttgtgggtgtgcttgtgcacagtggtcaagcaagtggcggacattactattcttacatcattcagaggaatggaggggatggtgaaaaaaatcgttggtataaatttgatgatggagatgtaacggaatgtaaaatggatgacgatgaagaaatgaaaaaccagtgttttgggggagagtacatgggagaagtatttgatcacatgatgaagcgcatgtcgtacaggcgtcagaaaagatggtggaatgcatatatacttttttatgaacgaatggacacaataggtcatgatgatgaggtgataagatacatatcagagattgctatcaccacaaggccccatcagattgtcatgccatccgccattgaaagaagtgttcggaagcagaatgttcagttcatgcacaaccgaatgcagtacagtctggaatattttcagtttatgaaaaagctactgacatgtaatggtgtttacttaaaccctcctccaggtaagtgtcaagagttcgcttcttatagcaaagagtaattcttatctttaagatttattagtaggctgtgtgtgcgtgagtgcgtgtgctgtttttttaagatagggtttctctgtatagctctgaatatcctggaaatcatgctgtcggccagggtggcctcaaactcagagatcacttacctttgcctcccaaatgctggaatcaaaggtgtgcaccaccatcgccctgctatctttattcatatctataaatgttttgcctacatgtatgtctgtgctatatgcttgaattcttgaggaggccagaaaaaggtattagattcccctgggactggagttgctgtgtgggtgctgggaacttacccttggacctcagtaagcccaacaagtgctcttgattgctgagccatctctccagtcttcagtcccctttttttggcaggtgaaggtgtgtgtgtttggttggttttttttttttttttttttttttaagatgtttctttgtcaccctggctgtcctagaactcagaggtctgcctgtctctgcttccggagtgctagaattaaagctgtgtgccaccatgccctacttaaatatataaaattaacattttcattttgaaaggatgtaagttgatgcttttggctaaaattacatttaagatgatttgtgtttgagtactaagtatttattgttatactgtttggagataagtttttgtttgttcaagctgatttttgtttaatgcattagtataaagcattgtatttggctctaatatcagtaataataatttcataagtagtctaagaagagttttaacaaagtgagaatgcaaagtacaaacttgtttgaaaatggggcttgaacagacttttaaaatatgtgcatgtggttttttttgttttttttttttagggcaagatcacctgtctcctgaagcagaagaaatcactatgattagtattcagcttgctgctaggttcctttttactacaggatttcacacaaagaaaatagtccgaggatctgccagtgattggtatcttgttttggatttttatttctgtttaagatttggtggtggtctttgtagagtgctctgtatttttttttcagaatcacaagacttttattcaaacttaagaggcaacatttaaaaagtatatagtaataagaaatcatactaaaatacttggcataaattcaaagggtaaaaatagtatagaggccattataatacctttttagcaattgttatttactcagggccattgatagggttcagtggtgaaagctcttgccaccaaaccttgacaaaactgagcttaagcccagaaccaacatggtagaaggagagaacctgccaggcagtggtggtgtacgcctttaatcccagtactcaggaggtataggcaggtggatttctgagtttgaggccagcctgggatatacagagaaactgtatctcggagagaaaaaaaaaggattcctgccaatagagtccatttccctcgcgtgcgtgcgtgtgtgcgtgcgtgcacgcgcacacacacacacacacacacacacacacacatgtgtaaaaagcctctttacatatccagaagatactatactaaggaaagaagttatttttgtcatttttttggagacaagattactctgtatagatatcagtattttgaaattcactctgtaaaccagactggccttgaactaagattcccaaattctgggattaaagatttagaggattaaaccacctctggctagtagtggatttttaaatacaagcttttgccaattttataattccataagactaggccaatctatatagtatccatctctctcctcctcccctcaatgtccacttcatcctaccccaccccatacacacagggtttactataagaaaggtgaactgaattgatagtctgatagttgtactttgttttgttttaggtatgatgcattgtgtattctcctgcgtcacagcaagaacgtgcggttttggtttgctcacaatgtcctttttaatgtttcaaatcgattctctgagtaccttttggaatgccctagtgcagaagtgagaggtgcatttgcaaagctcatagttttcattgcacatttttccttacaagacgggccttgtccttcaccttttgcatctcctggaccttctagtcaggtaattgtacctttgtttatatatgtatttacaaaaaaaaataaactttcctgaagttgaagagaaacagaatgtgtgttttatgtgtagcacaaattatctgacacctagactgataaagcaacagtgtgtgtagataatgtcttcaaaagataatttcccgccaggctgtggtagcgcatgcctttaatcccagcacttgggagacagaggcaggcggatttctgagttcaaggccagcctggtctacagagtgagttccaggacagccagggctacacagagaaaccctgtttcaaggggtaaaaaaaaggataattcccttttgtgcttgctgacaatgaaaactggagccttgagtatttaggaatgttatctaccactgaagcacaccccagcccaacccacgttgtgtttccatgtgggattttcataacacttcttttgggtggatctttaataaacatttttggtgttaattgcagcaaagtgaaaaatctataatgaattccaaagctgggtgtggtgccacaacagtttgtggtacagacctgtaatttcaactgctagagaattgcaagtcagctcgggccaacttagttgagatggtttcttcaatagtaagaagagatcttggtagataagctcagtggcaaagttcttctctaccattagcatatacaagtcctttgggtcaatctagtgttggtaagcagggtgaatagaattcatgtgatcagtccttccagaaaagtattcttatttcaacatacacataaaataatctttgcactttgttgagaatcagctagtattttctcctttacaggcttatgacaacttaagtttgagtgaccacttactaagagcagtactaaatctcttgcggagggaggtttcagagcatggacgtcatttacagcagtatttcaacttgttcgtaatgtatgccaatttaggtaagaattaaatttttcataatctctgttaaagtatcatgttaaatgatagtcattcagaaggtccaatgatgaaataatgttttttcttttttctttatatgaaactgtctctaaatacagaatatcctttgcccgaacccctgtgcactttataattttttacataatacttctgtggtaaacacaagtgagattctattgtcttaagttttgcttccaaaaagcaatactacatctacctgctttattaatatactcattcccaggcgccatccaattcactaactgaatcagaattaccacagttagtgcaaaaaaaattccatgtttttactgtgaagagtcatcaattttggaataaggtctagaaaagaagtaaaataaattaaaattagaggaaataatgtccattcaattagtgctagcagtataggagagcacttttctcatactaattccaggtttgatttccagcatccctaataattttttaaactaagaattgacttaaattactccttgatctttctaatactacctgctcattcctgttatgttactactagaactgtacctaaatatcatgcacaattgtcttccactgttttattttgttgcaaaagattagattgggggacaatagttgtctaacatggacattttcagcatcaaaggatggggtacgcctttagtttcagtactaagagaggcagacagatctctgagttaatttcaaatatttgtcctttttgttttgttcacaaagttcattccatcctaatgttttctttctctgttttcccccctctctacttgctttctgtctctctttcactgcaggagtggcagagaaaacacagctgctcaaactgagtgtacctgctacctttatgcttgtgtccttagatgaaggtcctggccctccaattaaatatcagtatgctgaattaggcaaattatactcagtagtgtcacagctcatccgctgttgcaatgtctcttcaagaatgcagtcttcgatcaatggtaatctattctt

SEQ ID NO: 270 - DNA, 95300 bp, mus musculus
tgggggcggagaagcgctgagccttgggcggtgctgagactagtgggagtctgcgctgccgctgctgttgctgccgccgtcgccgccgcctccgacactgccaccgccaccgccaccaccaccggccgtgcgggttttctttctttttctttctgtcttttcttttctttcttgatttgttgggttcgccatattgacgaggctgtggtacccaaggctgcggaagctagagtccgccggtggcggagccgcaagctctcggtaaacggcccattggggccctcctccctgtcccagcgaaccccctccctgcctgcaccggctcccaggcctcgcgggagtcggccgccgccgcctcgccctccagggaggcggccgcctttaccgccccagggcttggggtgggtgacgggagtgaggacaggagcggtagctaagcgagcaggcctggagtggggggacagaggcggcgactaggggaaggtgaaactgccgctgcaggaggaggagcaggaggaggtgacgcaggagaaacgcaccgcccggagcttgtctgagctcagcgcccgagcctgaggggagaagggggaagagggctgcggccggccgagagggaggcggcggccgtggtcaccgctgccctagggcggccagggtgagggccagacccctggtcggtacgcgtcgcgcgtcgcgagcccgcccgccatccgcagcctctcatatttttgtccctcgccagcccccggcttgggatgctcccaggttaggcccggtcccgggatcgagcttttgcatctcgtctcccgcctccgcgtggcccgcttcgtaggagactcccgggttgtgtttggtgagtaccgagcccggcggcgcccagggcctccggctggctggagggctggggaggacggcgcgagggggtgtgtgtgcgtaagcggtcctcccttgggggcctggctgccggggttgggggtcgccccgagccccggccgtcgcgggcgcgcgcgagcctccgtggtgcgcgcggccggcgtcccgcgagcgtgtgtccgtgtccgtgagtgagcgtggcgctgtgtgtgcgtgtgtgttttggactggcagggaaaatggctgacggctccggccctcccccttcctcccccttccctgcctgacgggagtggagaggaggaggaggaggagaaggaggaggatggagactccggcgcgccgtgccgcccctccacccgcgcgggaggtcggtcgggagcgcgcgggggcgcgggcacggcgcgggcgggggcggggacggttggttcgcgcgccccttaacccggcggcggacgccctcggcctgttccacttgacaccgaacgccattactgaggtggagtgatttggagcgggagcgctaggccccggcgacgcctggctatcaggcccgcggacgagttggcctcctcgccgccctcccgcgataacccgcagtcgctcagcggcccagtgccctgagaaggccgagccggttatcgctcccccacacctccctcgccccctccggctgctcacggtgggccaaaggcccggaaggatgttttgatgccgaaatcgcttccaagcgacagtagaccgaccacctttgtatttttagctgttcctgaaggaggaggaaaaaacgaagacgaagaaaggaaatactagtatgtgcaagtttgtaactgataaaaccttgagatgctggtgatgtgaggctgcaggcttgataaatggcttgtttttcattcattgtgaaatatttaagttaaacaggtgcgaagctgggggttttgtttctgtttggatttcttcagagactggaagataagatttttagatacgacgtgcttaaattattttgaaagttctgtagttaacaccgttaattgaattttcacagccacagtttacaggtgtgtgtaattgccacagagggtcgttgattgtaaatgaaggaattgtggggttttggtaatatttttgtttctgttagtaggagaggcactcgaaataatttttttttaaccttaaaacccaccagccttgcatctctctttttttgtataatttgacttatgaagaattattttgggtgtacttacgtgggaactctgtagccagtaataaaagagctcattcgcttcatttattataaggattggttaaccatgactaggtttgacacttgagcttaattaaaaatagatactacaaactcttctttagatccttctagtctactaaatcatcaggctgccattttggcttcagcaaaatgtctttcaattcttagaagatttaggtattaagtatacagacatagcaacatttatttttgcaatgtttaaacttacttgctttgtcatacttgtgactttaaccctttatactttattgttccagtgtttgggtagaatgaaagccagaagtatttggaatttaatgtttcaagtgtgaaaataagaagcaaaagtatgttttgttttctcttactaaaaagtctgtcttttgagctatatgaatgtcttcatgctttttcttacccctcccaccccctacagaagtatgccgtcatcttactgttctgctgttgcttccttttgtttgctgaccttggtagaatcgaagggactatctggaagggttaaggaccagaacagcatggacaagaaatcttaggtttttttaaaatttttctgaaagtaactttgaagagatttcctccttaaatcatggagcatttcctggggatcccttcatttcctgcctatcagtggaatgctccatccagtaggatttaccttgggtcttttgtcttttagcatcttgaaatacatttcctgatactctctagaagagcaatttagtggtgtctcttcaatttcttttttgacataattataattaaagctacttacagatgtttgtcatatgccagtcatttagttattgatgagttagacacatgaaaacataatattcgtttatttttttctatttaatggatggatttttaaagtttttatatttctagaattttattattggaaccagtctttgtttaaagcaggtgagaggaaattacttgaactatatagtgatgtctggggctggaaaaccggctcagtagttacgattagagttcctgcagagaatacaagttggagttctagcatccacatcaggcagcccacagactgtaactccagttccgggggatctgacacccctctgacatgcgcacacacacacacacacactaatttaaaattaacccacatgggctggagaaccaatggctcagtggttaagagcacagactgctcttccagagttcaagtcctagcaaccacatgttggctcacaaacctctgtaataggatctgatgccctcttctggtgtatcagaagacattgacattgtagtcatatacataaaataaataagtaaataattaaaaaataacacatgtatatatatggattagtctttggtcccctatgaagtgaaatattttgtggttgttgaactacttgaattttattttaaaaacacaatacttttattattttgcatattatgtttcttttcttgctgataagttttctgaatcttgaaattgagaaacaagtctagtttccctttcattgttttaggatctgcatctttgagaaccatgttatttgttgctgtcttgtgcttttacaagtgtttgggaaggatttgcttcattcatactctggatgttagactcacttgcaagtggttttgtttatctgatatgggactgaatagaagctatattttaagagtactgtgaatgattctgatactgtatcagttaaaactgtggggctgttgcatattgttatagatcttttatagataaatacggaaatggagctttttctaactgctttccattttcaggataattagcacttatttagtattagttacactgctaatcatttaaacattctcatttattacattatataggtattattgttattataccagtggagggcctgccatctgtcatacttagctagtgggacttaagtttaacttaagtgccatattagagaaatgatactgactactattttaaaagaaatttagaacctttagtttgtttgttgattgtaacagagtagctttagattagttttatttttaaaattatcaaaattgatatttgaaaattagcttgattggccatggaaaatagaacaaataggtgtcttccatacctctactaatatgttcagaataataggttattagttagtgactttatgtctaaaataatactaggcaatttttacattcctgaaataggtttcttaggaattcatattatctcaacatacagtgaaattgtaattccagtttgagaactcagaatttcatttaatttaaaattttactttcagtaaaaaatttaagactaagggtttcttttagcatttttgtagtgttggttgttaatcatggaatgaaaatagccacaacagatgtttggtttatgtgccttgtttccttagggcctcatgattgctaggacagttaagtgctaccaccaagttacatctctatctctatgatcattctttttaaaaaagatttatttactttatgtatatgagtacagtatcactctcttcagacactccagaagagggcatcagattccattacagatggttgtgagccaccatgtggttgctgggatttgaactcaggacctttggaagagcaggtagtgctcttaccctctgagttatctctccagcccatctatgatcattcttaatatcatatcctaaatcctcaaatatctttagtgagtcttagaaaatggaattttattggtttttaaagttcttttgtattatttatgtttctgtgttttgagacaggagctcacaaacctaggctggatacaaactggctgtatagccagaagtgactttaaactgatcttctgcctctgccttccaagtgctggggttgcaggtacttgctggtacatcatctggctctgaattttcttacatagaaaaaaaaaagagagagagagactatgaaattttctgacatgttattggtgctaaaatgactagtatatttttagggaaaagataattggaaagtattctactgtaaaaatgagatatttacctaaaattatacttgatctttgccaaaaggctgagaaatgattaaaatttatatttcaagcacacctatgctaagtcctctacccatcataggtacatatataccttacatgtatattcagcaaatgacttttggttggtgttttcagactggttccctatgaagcacagattggcctcagcctcctaagtacatgagaatatagacctgccatgccacactgagaagtttccaattttattctgggtgattgccctaacagttgtttctctgtctcaactgtgtgtcagaatcatttgtggaacattttcaaagtatttttgtcttggtcttattctatagattaagcccaggacaagagagttattttgcagttcattttaggggaaagggaggatttgcagtcctgtgcattttgtgttttgttagcaatacacttgaacctaattttgtcaatcaatttctgacttgaactcaaatatagggagaagttcagcacttagattgattaggtttatgagacagtgattgcacaggcatgactcaaatgtattatttcacacattcatgagttttgggaaccttctcaattaaggtttctggctccagagttatgtttttaatatgttttaatgcattggctatttttatctatcacaaataattatttggtatttgctgtgtcctaggcattgttctagcaaatactattgtgtaaaaggagaggcgccagattagttatctataaagtcccacctaggctctaattgccatcatttttatgtgtgtcatagaaactgatttaggtagatataagcagtagaccattaaaccaatgggattgtcctattttcagtttctttaaaataacatagtctgaatttattttctctagtgaaggatgtatcaaggatagtgtaaatgaggttttgggtttttttgagacagggtctcaccatgtgtgtaaccttggttggtctgaaacttgatagatggaccaggctggccttaaactcaaagagatccacttgcctctgcctcccagtgctaggataccaagtctgttatgcccagctggatatgagttctttgagcattcttcacatatgggctttaggaattgagtctttactttcctacattgggtgcctttgtattaattcattttgtttagttgctttggttgttgttttcccacagatctgctcatacctgtcagctcttggaagcctgaggcaggaacattgcttgtgaatggaggtgatggacaatgcagggagattctatctcaaaattgtgtgtggtgtgtgtgcttttagggtcttttgggttgttggattctgtctacacaaactcagttctaagtcactcattgatagatccttagccctcagaaaatgtctggcacacccatttggtggacatagtcaattctctgtatttggttacatttatttatgagggggggagttcttgtagaaatcaagaggacaacttgcctttcaccatctgggtctctggaatgaaactcaagatacacctttctttgtccactgagccattttaccagccttcaacaagatttttaaaaaatacttttgctggggctagttccatggtttagaggatttattgcttttctaggggacttggattcagttcctatcacctacatggtgattcacaaccttccataactctagtttcagagaatccaatgctgccttctgatctctcagcatcaggcatgtacatggtgatcatgcatgttggcaaaaaaggaacttcacattaatcagtcattaaaatatttgctattttgatatttcccttcactagttagaggagtcctgacttatgtgagtgagcgggcgggcgagagagagagagaatcaatcacttggttagcctggagcttgctgtgtagtccaggctggcctggaactcagacatgggtcatcccaccccatccatctatcttatgtgtctgttaaatgcacacatggattctgtgcctttgagaccaaaagaaaacattgggtcttttggaactggagttatagttgtaagccacaaggtggcttgctagcaaccaaacctaggtcctctgcaagagcaagtactcttttggtttttcgagacagggtttctctgtgtatccctggctgtcctggaactcactttgcagaccaggctggccttgaactcagaaatccacctgcttctgcttcccaagcgctgggattaaaggcgtgcgccaccactgcccggccaagagcaagtactcttaactgctgagccttgatagttcctttacgatgaattctgcaatgaatctagtcttttgtttattttttgtttttcaagacaaaagagtttctctgtgtaacaatcctggctgtcataaagcttgctttgtagtccagtctccgagatctgcctgcctctgctttcccaatattgggtttaaaggtgtgcatcaccactgtactgctaaacctagtccttctgaacagaaggaaatggcccagtgagatgaagaaacataaccaagatagcatgtataatatagattaccttcttcatgaagttatttccataatgaactaataccagttgttttttaaacaaatacctttgccatcattcatcagttaatggatagttaaggtcagggattttgtcctttactttttattatttgcagtacacttacaacattattgatctccttgaatggcaaaattggggtcctatttgatttgcttgcagtaccagggattgaaaccaggccttggacatgctttagcaagtgttctctttgccactaacctgtatgtatctccaatgccattctttcatcttttatttactttttattttgaaacagagtctcacagacttgctgaggctggttttcattaaattcattttcttttatttttttatattatttttatttatacaaatacactgtagctgtcttcagacacagcagtagagggcatcggatcccattacggatggttgtgagccaccatgtggttgctgggaattgaactcgggacctctggaagagcagtcagtgctcttaactgctgagccatctccccaaccggaagttcattttcttttgactgactaattgtaaagataaatgtcacagggctgatattctgaaagagtttttaaaaagttgcatgtttattggcagggttagctaacccttgaacaaaacaaaaggaaaacttcagctgggcatgcaagcctttaattccagcacttgggaggcagaagcagagaccagtgttctcttgagtttgagccttgctactattctacatagctacatagcaagactttgtctcaaaaaaacaaaacaaaacaaaaaaacaaaaaggccaaaactttttgctcttaagtttttaaaaattagtgtatcttttttttttttacaaagtatttttacaaagtagcaagcctcaaactcaagagaacactggtctctgttttttcttggagacagtgtttctctgtgtagccttggctgtcctggaactcactttgtagaccaggctggcctcaaactcagaaatctgcctgcctctgcctcccgagtgctgggattaaaggtgtgtgccaccacgcccagcagtgtatcatcttgtacaaaatgaatttcattatttctaaatgttattgtgtactttgatcattatacctccttattacctgttcttgcctctgcttttctcatcctttttccaaattgttgccgtccttactttcatgttctatactttataatttagcttatcttctagaggtcagtatttttgttggcttgaaagttccttaatttatttattcactttacatcccaatatcaggttctcctcccagtaccccctcacacagatcttccccccttctctgagaatggggagcccttcctgggtgtcccccatacctgcacaccaggttactgcaggtgcgttctctccctctgaggccaggcaagttggtgcagttagagggacaggatccacaggcaggcaacagattcagggacagcctctgcttcagttgttgggggacctgcatgaagaccaagctgcatttgaaagtgccttaatttttaatttacattgaagtattactgacttgagattgtgggataaataaatgataattgttgccattacttttgttcattacttataccacccaagaaactgaggcaatgaagtgaagtgacttatagccaggatcactgggtcagtaaaatgctcaagaaagagtaggcacagagaaagccttcaagctaggtctgtttgaagccctgctccctctaccaaaccctacttatggcatggccaggttggaccacttctcccaccatatctgttggaatgaattggactgaacctccatacagatgttatcatttatgtgaacttttaacatgatgtaccatgttaatcaaatgttatcaaaggaattgttttccttcagatgattttgagctgttagtcttggatgttaaatctcaacctgtacattctgaatatggaagggaaagacgggggaaaaaaggtagagaaggggattcccattcctgtctttgtgccttgtgttttgctgactggtggcttttgaaagtcaacaaatattggtggttggttacaggtctctttttcttgtctttattctcaatcatatgagcttcttgagtctgtttattactttgacaccagagaacatggcagtagatgtttagacctgtattctaaccttaacagagtggtttgtttctgagcacaatagtgcaaaacgattgggttgcttttctttataataactcaggtcaaaggaaagattaggcaaaccttttctataagaggccagataataatagtttggactttgtgggccaagaggcaaaattgaggacattgaatggtatgttgaaataaaaatgtaactagacacattaagtataatataggtctaatgagaaaaagcaaaacttggtttgggagtataacatagtattttgttggttgattgcaaatatttctgtgttaaatctttcttaatcttgtaggttgatcaaaaaacaaacaaacaaacaaaccaagaggttggatatagtttgtcatcctggttttgcctgacctggtttagagaagtggttcccagacctggagggcttgtccaaaaatttctctgctcattcccagagtttatttcagttagtccgcagaggcttagaatgtgcctctaaaaagttcccagataggaaattaccccaagaaaataattccattaattctaccatatcctacttcattgatctattacagtgtagttctatattgaatattctgctttgtgcttaaagttcaattatatagtaaatgccagttattactggattgtactgtgtattaggaattatacaaggtagtaagaatacaaggttaataatcccagcactcaggaggcagaggcaggtggatttctgagttcgaggccagcctggtctacagagtgagttccaggacagccaaggttatacagagaaaccctgtcttgaaaaaacaaaacaaaacaaaacaaaaagaatacaaggttaaaaaaaaacccagagttgtcccaccctatattaaaatgaatttaaaattagtttccatatttactgcattagaatctttgagccaatacaattttgaaaggaggccagtgatgtaagctaaattggaaaactgcattatcaaatacagtgaaacttcatttgatataaaattttaaaatatcaaagttctctttcaagacaattaagctgtaatttaatatttgatggaaagctttcaggggtgttatactttttttctgattatgaaatgtagtcttttaggtagctagaaataaagacatccatcatcattctgccagtcattagttttagctctttactccacttctgtagataacttttttgttcaaaacttaacataaagttgattttagtatgattttacaactttatttcccactttaaaaaatgtcctattcactttttaacttttatttcccatactctttttttttttaaagacagtttctacttttttgtagtagtagtttgtttttctgagacatagttttatgtataccaggctatgctgtaactcactgtgtaggtgaatgtgaccttaaacctcctacctcctgaatgccgggattataggagtgtattgccatgcacggtttatgcagtgctgagtattaaaccagggctgtactaacaccagacaggtactacaccaactgagctatattcctagcccatagcttctatttgacagttgaacgtaatcaggaattttataaattcctccattctgagaatggagaaacactgttatttagctttgagagatttgaattctttgaaagaggacaaggaagtacacttgaggatggagtagtattttttttaatttgttttctttttgttgttgacttcgagacaggctttcatgtttctggtctcaaactcatgatcttcctgcctcaccttcccaagagctggtagagaatacaggcctgtaccaccatgcctgtctcgttttttccctccttaaagccagtaacttaagtgtaatctcttctggcctccagctccctgtgatctttgatcttcttgcttcagcctcaatcaagagtgctaggattatagtcaggaaccaccaggtctgactggggaaagtggttgtagtgtatagctgaatgaagactaaagaatcttcccatgaatttattttttgtgagagcttccccttcctattatgcattgaagttaattagtcatataaatgtaagctcggggttgttttaatgccctttcttcctgctttccccaaatacttctcaaaatgcttgcaccagatactgtgccagttccataagaaacaaaagtcattttgacagtctgcttttgcaaggttctttctcattctcagacctaattggtcagtagttggtgtagtaagtactccagcccttcataatccctgtctctgcaccccttcctctgtgtattaggtattgtaacaggttaataaggaatgtcttcctttccacctaccataccctcaacaatcccaaagacttagattatagttgtaactgctaagtggtgagactgtatttgatcttggtgaaattgtaaaaaaaaaattcaaacttaaactgattactgccttgctgtgatgattgacttaaattcattcatttatcatcattataggtgtagggagatataaggattgttaatttttttcattagatattttctttatttacatttcaaatgtcccctttcctagtttcccctctgaaaattccctatcccctctcctctcccccttctcccaacccacccactcccattcctgatcctggcattcccctatactggggcatagagccttctcaggaccaagggcctctcctcccattgatggctgactaggccatcttctgctagagccacgagtcccaccatgtgttttctttggttggtggtatagttccaagggggtactggttagttcatattgatgtaaggatcactattaacgtcttccttaaagaccctaggatgctggggtagacagttacctaagagctgtatctggtgcaaggaactggatatttactaagcgtgaggctcttgagctcaattctcagcaccaaaaaacaaccacaaaaagtgtgaaaaatatagtgataggagagattgctcagtttggatttttaaaatgaggcttacaaatcttgaaagatgtcattttgatgctgcctggattggagtaggaaccatcaggtggtgtttcttaaccttgatgttactgattaaatactatttgaccagatatttcctcgaggcatgctgtatacttactaattatctctgatttctacctatagaatttcagtaggacctttctccctattgtgatgacttataatggcttcaggaattggaaaagtgtgtaccaaatgcaaaattgagacctattacttgaaacaatacaatggcagaatgaaagcgtggttttagaggaaaaactagtatagcatagaaagaacactggtgagagtgagtcgggaggagttatgggagatgagacttagtttaaggctaggttacagatactatgttagggcatttaagtttggatttcataataagtgaagggtctttaagtgaaagacagtggtttctgggttttctttttaaagataattctgaggggttggggagataggacagtcattaaagcatgaagacctgagttagttaaatccccagaactcaaagtcaggtacagcaatgaggaaatagagctagatggatcacgccagcccttcctatttggacagttccaggcagatgaagagaccctgtctcaaaacataaggtgggtaatatctaatgaactatacccaaggttttcctaatctgtatacacaaacacagattctaagcatagcatggtagatatactgaagtagaaatgtagcagggaattgaaatagtattataatagttctttttaagtaacaaagattttggcaatgaaataaaagaatgggatcccacagggttctgtctttgtctctgtatggattctagggcaaaacaccttttaacttctcctagctccaattccctcccactaggagctgctgactgctgagacatgttgaaaggtcacagagcagaatctgggttataggactactcacgcaatgtgtacctttacattacagggtgaattatctaaatatatttatcatctttgtcctctacatgtaagaggtccaggacctggcatcagaaagagttaactataggctctccatgttttctttagctgttatcttgctactttaaaaataattgaatctgtaaaaatagatgaataatctatctgtttaaggtagctgtaattttattgcttatttttgtagggtttatttcctttctttttttaaaattttatttctttaatgtatgagtgctctgctgcatatacatccacctgcctgaagagggcacccgatctccctaaagatggttgtgagccaccatgtggttgctgggaattgaactcaggacctttggaagagcagccagtgctcttaactaattagccatctcctaatccccatgtatttgcttttttaaggagccctttttgtttttagtgagaattggggttattcagtggaagggtagagggagaagtggagtttggaatagtttttcaagtaaaagaaaatggaaagggtacaacaaaattgggattgacaaagtgcttgaagaacagagggatgctacagcttgaatatttccttagcctgtttctatacctacatggagtctggagagctttacaaaatccacattcatatgggctaattgtagttggccagtagcttgcagtgtgaatttagggaccatagatttggtagtgtagatgtataatttttgacagaacaacataagccatgattgaataatcattgctgttttgtggtgccaaggattaaacgcatagttcatacattctaggcaagcgtcctattactgaggtatgtccctagtcccaagcttgaagttttctttcatctgaagtctagcttaagcttcaagaacattaatgcagcttaagattggtagcctgctaggaaaaaaaaaataatatttaaggggaaataagtttttctgagtagaagtagaagatgagtgcataggtaaatgcactagcagtgttttttgttcagcatgaattcagagaaaatagtgataccccactttgattactttttaaagggagctagccaaacaagcttattggtttttattgctctttctgtctgtctgtctgtctgtctgtctgtctgtctcttttcccttttttctttttttttttttttttgtttgcttttgttttgggtttttgtttgtttgtttctctgtgtagctctggctatcctggaccactttctctatggtctaggttggctttgaactcacaaagatccaactgcctctacctctcaagtgcttagaaggcttatatattttttcttagcctaacagttttcaaagattgtattgggtgtctcacaaccaggtataactctcctgttctagcaggtcaatcaccctctgacctccataggtatctacgtgtgcgtgcatagaaataataaaaattaagtaagaataactcattgcctatcagtgtaaatgtttttatgaaaaaagactttcccaaaataagaattctcaagaacactggtggtttataatttttccatctctgaaagacagctgggtgtaatattttgtgacaagtgatatctaactaagaaaaaaccttgtgatctctagtaaatagaggatctcatagattccagggaacccccagaccctgcttggagaatcagtaacttactactagactgctatcgacaaagtttagatctttagagtggcatctaatctactataaaactttattttttaactgataatttacctgtatagtcaccagtcaggttattatatagaacatttttagtagtagtctagatggttcccttattactccaaaacatattttgacctttctactacagttatgtgcacatcattaatggataaattaaacattgatacattgatcatttaatttttattgattattatcgatcaatgtatcatttaatttatccattcttcttttggtggacactctgatttcagtgatttttttttttttattttaaactaatacaaatgttgtcacagagcctggcatggtggtacacacctttaatcccagcacttgggaggcatgtggatctctgagtttgaggccagcctggtctacagagtgagtttctggacagctggggctgcacaagagaaatactgtcttgaaaaacaaaaatcaaccaaaaaggtcaaatgtcctcatatggtgaaaatatatattatacagtggaatattagcaataaaaagcaaagtagtggtatatgtttcaactttcatgaactttgaaagcattctgaaatgaaagaaacccgttgtagaaagtagattaagggaggctgtagggagtggggagtggctgcataatggggagtatggtttctttctggtgctggtccagggcttcttgcatactatgtgctactgagctctactcccttagctttggtatggtttttctcttgtgggtcataaaaatattctgtaattttaattgtgcaactctaaatatagaaagacccattcaattgtacggttcagataaattgatttgtattatgacttttgaataatacaatgagataatgtcattaatgggaaacattttgaaattgtttagtttcctttgtcatgtcctttattcttctacatctgttacttaactagtctgggttcaggcaaaaagatatacataaagatagttattaatgatctatctgccttgattaagatatttattgaacaaagtcttggttctgaatcagtcattctgttcaattagtcacctttaaagtgttttgacagcttaacagtggtgaaggcacctttaatccagcactcgggaggcagagataggtagatctcttgagttccaggacagctaaggctacacagagaaaccctgtctggaaaaacaatcaaagtctgttagctagtaactttgagttcatcttacgcagtcatttcgagagtagggtaggtaatacatgttacagaagggtttattgcttgatacatgatttatgtcttaatggtttaaatcaacatttctcatgaatgttggctgataatgtttattgtgctcttatatcctttgcaaggatttaataaattttaggtaaatatatacctttttgttgtaaatagaccccgaactataaataaatctggggtggtttttcgtttctttttttttttgaaagaaaattactaaggtagatagtggtgaatttaactttgtgttatatgtatgtttcaggaagcagaactgtaattaataaaccaatgacaaggtgaaatagcattttgatggtatgaaaattttctatggcagcaaggagttttgcaatgttaatatgtctggggggaagaatagatgtaggcaatttcatttggttatttccaaatcctaaattttctttgagccatccctccccaaatccctataaagttgtggctttatatttatattatatatttatgtatatatttgttttgtttggttttcatgaaacaaaagtttaccttttaaaaaataagtcttttgtctgttgattctgtgatactaagaatagcaggcaaatttgaatggtatgttggtgccaggagcaaatgatatcatagcataacatgtgtacagagtgatgtagtaattgaagtagaagtaagaaagctgttccacatggcatctgatggttttggtatacccatgctaggcttaggaattcaaacctagcagtcacaactacttccaaatctgttatgttatattaataggtttgtttggacttagttacaatatatatatgtatatattttgtttggttttatataactataaataaatttaatttttaattttgtttctggatatatttaaatgacatttgtttaatgtttctctatgtagcactggctgttctggaacttgttttatagacccagctggccccgaactcagcaatctacctgtgcctcctgagtgctttaattaaaggggtgtgttaccacgcccagattccctatgcgatatttataatagggagtttttaaaagattctctaaatctagaaccagaattagccaacttgagccagcttattagcattgatagaaacctagtgtgtatgtgtttgtgtgtgtgtgtgtgtgtgtgtgtgtgtgtaatcaagtgaattagaactacaattggatacttatcactaactcacttctctaataaatgggaaaaatacatttgtacctcaaagtgtggtttgtttgtattttctttcattcaacagataattgtgtagaactgcataattttgatgtcatcttgttactggcttctttaatttccctgctattaatttttttttttagagccaggacaaactctgataggaatattatgacactatgaattgtattgcaaagggtaacttttttttaacttgaaaatcagttttcacaaaggacaatgtaactattaattataatagagttttgggctaatgtaacataatattaagagttgtattatataaagatgttgaaattgtgtatttcacaaatcatccatagtaattgtggcaatgtatatcaaaatcagaaaatcttgataatgtatataatttggagatccccactcccactcccagccagtctagggatcatattcttaaggagcctttgaaggttcaaaaataagaattagcaagagttaataataatctaatcagcattttggaaaaatatatttactgggtcccttttgcatgttcctggcacttgtacatcctctcattaaagttttctaataatctctggaggtgttagccacctggagagagcaagatgatacttggaaattgaacttgtgatcctgttatattgcactatgtattgctgcaagaagaacaacctatgttctgcaaaatcagcttggaaaaataatgggactcatgagaaacagtgaaattaagagcagtttggttacccaaaggtgtcttactttataattagtaacagttaaaagttctaatagatgtagtgacatatgcctttaggtctagcacttgagaggcaagaggtgggtggatttatgagtttaatgccagcctagtctgcaaagccggttccaggacagccagggctacagagaaaaaattctttatgtctcaaaaaaccaaaacaacaacaaaactaacacataaacagaaaatgtcctcaattcctgatagtataagaccctttaaaggttaatagaagggaaggggtgtttagaagggttaaagttactgagttagaatatgaggttaaagtacatacaaaaattaggtaaaactgcaagaaaaatattcttagaacatgtggctagacaaagccaagaagagtgtgggacaataaacttatggctacaaaatagtatgattaaggaaggctggcaacaaccacaattatgttttatgaatttgacaactaggtacctcataaatagaatcatatggcatttttgtatcctattgtaactggcttatttcatattttattttataaaataatacactcattttcttgcatgtcacagcttataaaaatcttttttgaaacagtcttactacacaagctagccattgctagcctggaactttgtagagtaggctagcctcaagctgagagatctgcctgtctctgtccccagagtgctgggattaaaggtatgtgccaccattcttggtaaaattacctttctttaaaagcaacacacaggggttctaatttctccccattcttattaccacctcccccatcttcattaaagcttaggcatttggctggctctttaatttttacttttggtgctagagattgagtttagtgcctatacagtgcttacattctcccattgtgctacaacccaagccttccctcaaagtttgtaattttaattaaatttggtttgtctgttcctttgttgctcatgctattaggaaaatccattgtcaaatcctagactgttgaaatttgccgtttatgctttaaatcagtgaagagtagacaaaataatattttcataccaaaattttctgtttcaaggtgttggtttgattatagaaatttcttggtctggatctttacataatttcatcacagatcttttctctctctctctctctctctctctctctctctctctctctctcggtttttttgagacagggtttctctgtatagccctgggtgtcctggaacttactatgtagaccaggctggcctcgaattcagaaatccacctgcctctgcctcccaagtgctgggatcaaaggcgtgcgccaccacttcctggcagatcttttctttttcattaccccatgttgatgtgtgacacacattgctctgataatctgttcttggtttttttggttttattttgttttgttttttgtcttttgttttttgtttgttttggtttttttgctcttagagcttttcagattgctatctaacactctgtaaatttgctgactgtagtgaatttttaattttatttatactcgtcaagtccagacctttgacttggctcttgggttttgctttatattgtcctttttatatttttattgacagtccacctttaaaggatagaatcacattttcctttcctagtatcatgctttcctttaattttttgaagatacataaaagagctgttttgaagccttgcttagttgggcatctggactctgaaggttttttccccgtaggtagaccacatgttcctgtttgttttgttttcttttttttaatttatttttttgtttgttttttgtttttatttttttctttttcctgtttgttttcatgtattttaatttctaatgtaaaaatggacccttcatacaatgtagtacattgggcaatgatttttttactggcccaacacatctaggactttgtttgtttggtttatttatgtaataactagctgaacaattttaatctttcctgtaatttttggaatctctgcggtctctgttgtgtgttccaataagcagtgtatgtgtcttgtctttgcctgcccactcttccactcaaatattagcttttactaattacctactgattgctctattgttttacataatgctttgggttatatataaaattacccagtctggttcctgatccaattaagttctcattttccagggataatcctttgtgctggttcttggggctttggttttgacccaggatggttgtttgcagctctatttctctggttcttttggtaaactaagctgggtggtttttattggcttttatggagctaccagaatcttaattgaaataaagccagtttaccataaagaacttagattttttttttttgtttttacattccccctggtggaacctttatacctcttcagaactgaagaatcagactgcaggtgggttctcttatagttgaagcccctacttcttagctgtgtggaggcagcatcgaccctgtgacttttagcccatcttctgccttgggatcttgaacctgtggataaattggattaagagctattaggactgtagtattcttggcttgctgcccttgaagtagaactttgccccataaatagggcctagatggaacaaaagagcccagtcttcctgcagtcttccagaagtgcttgtaatgaaaatcttaccaaaaatagaaagctacagttaatttgatgaattcagttgtattggagtagtaggttatacagtttactctttacaaagaaaaattccctccaaaagttgtgatggggtttgaggtcttttgtttgcggataaggatgggatgtaaataataagagtgtagatttcttacaattatggaatctgaaattcaaggtctaggtgttgataggtttgcttggtttttttttctttttaggaatgtgtgtgtcagtctgtgttgtgtgtgtacctgtgtgtgttggagaacgtgtgctgtctttgttagatgagtagtgtgtcttaaacattacaagtcagttatgcttaatgtcctcagtatagatgctttggaatatacttaaggcattagccagttaaggtcagtttgccccattctaggatttaaccaagtagcagctaacttcttgataacacttgccttgaagttagttccagaagaaaattgaaattacttgatacagctaaactggtatactggctacagtacattctttaagttgaatatagcaatgaagcttcagcttttccctttttacctgtcatttacatagtcatgctttcttgacttgattcactggtgatgatactaaacttgaatagtttatgcttgctatatctaaaataaaatattctcttttctcttttacttacaggttatgcaatggtctctgcaagatgttttattcttgaattggaaccttttacgactgacaaatgctggtactttatctcctataagtggactataatttcttttcttaagacaactacataagcagacaaaattgcaaagatctgccctgtgtcgagtatgacagccacgactcgtggctctccagttggagggaatgacaaccagggccaagcccctgatggacagtctcagccccccctccaacagaatcaggtaagaaattaaagatacaagttaaagccacattgctatgtctccttaactcttaagtgctaagtaaggaaatgtgatagaattgccaagtaaccataaagtgaatattttaagaaaagtagtaaatgcaggttttcagtagcaaaatacttaggtgctgaaatcaacattgttttctgattttttttcagatgtcttacattcttacattatcagtcttcaataaaaggaatgaattaagcttggtatcaatcctgggagaaaccattgtataatttagtgtagcatatgggaccaagaaaattataattctattttgtatgccaaatacataaaatcattaattgtcaatctaaaatatgagtatgtactgaagtattattactggtgtttaaatttcaccttttcactatactagctttatgactaggtaaattatataatctctaatcctgtttcttcatttatatgatagtgataccagtaatggaacttcatagcattgtttaaggatcaagtaaaataagggggaatggaaagatgggggttaacacccagagtgaggctttcccttctaagggaaatggggcgggggagacttatgtgaggaggtactggaaggagaggaagggctgatgttgcattgtaaagtgaataaataagttaatttaataataataaaaatatcttggcacagatactggtgtcagtatttgcttgccctaaagctcttaaggcaatattgtattatcgttcaatttacataaggtttctagttctgattcctgttcccccattagaagattttagtaggaagattttactagttaaaagaccttgatttttgtaagcaagttttctatatggatcagtcttttgtttttgtttttctgagtcaggaactcttaatgtagctctagctgtcttggaactcactatgtagaccaggttggcattgagcttgcagaggttctcctgcctctgcctctcaagtgctggcattaaagatgtttgccattatgcccagcttagattcatcttttttttaagagattttttttccttgtttgtttgtgtttgtttttagtcttttggtcagttttgtgcacttcatctagagtgccaactttatttagatgcagttgtttacaataccgtttgtgctctttgggtgcagggatggaacttccttgtatatgctaagtgtgtgctgtaactcagagctgctccacaccccagatcctgtaatattctttccattccttttttttttttaaagtcttggtggcttgtggcagtgtgtcttttctttcatctctggtactgctaatttgtattgtattttctctcctaattagtcttttctaggggttttaccaatttaatgccccctcaaaaaagcttctggggcttggataataaaccccataagcatacaacatgcttttactctcatctgcttgttcttcactgtctttggatttggtttccttccttccattctttcgttcttccttttttacttttctttttgttttttgggtttcttgtttgtttgtttgtttgagacaggatctcactgtatagccttgactgtccttgaactcgctctgtagaccagtctggtcttaaactcacagggagatccaccttcttttgcttcctgagtgctgggattaaaggcttgagccaccaccacctggcttggatttgattttcttgttttcatctcctgaaattcatttcagccttttctaatatacacagttttatactttgaagaattaaattgaataacacaaagagtaataagatttgtgataatgtaactcctacagtggtgttatccgtaaactaattgaaattgtgtatgcacttagtaacagacatgctgcttacagaggtacacatttttgtagtgtttgggtaaattttaaagcaaaagtgttattgtagattacttttatctgtggcttggtgttagtttcttgctattcagttattatatgttatcaattctatcattactcttatagaaaagaattttttccctttctgactccccttcctctcccagttgagagaaatgagcaagcccgatactctcatccaaatgtggcaactttgttaattcattttcttttacagttctcatttttaagacatagaacttagggctataaatttgaaggccagtattttaagtttctttaagtatagtcaaagggctgttggatagtaatgattatttttaaaccaggagctagtagtttctgctttattacctgcattgtgcatggattctaacctcttttgcagtgtttatggctttgcaggactttcagtgaaaaaaaaatcccagttgttaacataatactcattttgaaacacattctctcactatgcagctttcgctggcctggaaaactctatgtaaaccagactggtgtcagtctcaggactcatatctctgtttcccaaattctgagattaaaagcacatgttaacttttattttcaaatctacttcatttttttagaggtcttagatttgtgacattaatattatatatctattaggtattatatgcacagtgtttgctaagatggctggtatttttaaaaccaaagaacaaaaacaaattacatttttgcttatagaatccctctgtttaccttagaatttctcattgtttcttattgttattctatgttctttaatgttagtgttttaagtacttcataagatctgatactgttggatcacaaaggagcaaccaaacctttactcagagctcaagttaggactttgttttttacttttagttgttttcttttcattatttttaagtgtgtgtgtgtgtgtgtgtgtgtgtgtgtgtgtgtgtgtgtgtgtctgtctgtctatttatgggtgtgtgcatataagtgcaggtgcatacagaagtaggtgtaaggtctccctggagctggtatgaaaggtgcttgtgaactgaactgccttgtcctagtcccaggaattggactctgttctctggaacaacagtacactctcttaactgctgagtaatcaatccctccagcccaggtctcagtttctcataagctttacatatatttacttaaagggaagttagaaataataactcaatcgagtcagttctctgcactgtgtgtgtgttctgggtgtttaattcaaggcaataggctcagcagcaagtgccttccttactcagccatcttgctgaggcccataaagggaatttcttaataaaaattttaactttaaaatctgtacctgtagaagcaactcttaagttataagacataaaaaccagtaacaagtgggatgaatattcctcagatgcggtatctgagaaggctctggattataatttggcaatgtgtgccaatagctttaaaagaaattttctatactggtattgttatatttctagtattcttaaaatttgttttctacaagaagatttatacttgacaatgctttatttaactttaatttatgtaatgctgaagaatttgaatacttaagatactgaatgatggctcagcggttaagagcgctgactgctcttccagaggtcctgagttcaattctcagcaaccacatggtggctcagtaccataatgggatctgatgccctcttgtgtgtctgaagacagcgacagtgtactcatatacataaaataaatctttaaatagatattgaatggataattgacagatatagttccagttttatcgaaaatttatgcatgcatggccagtttttatttagctcataaaaaagtaacaaggggtcattacaatgtcattactggttttttatttgttggtgtggtgttatatatgcttacagttgtttttgtctgtgttttttgtaagaatatgaatacacaaggcaaagtgttttgttgtttaaaataaaacaggcttctaaagttacatactgcagatagcttttttgtatggggtttctagcacttgaattctttgcttggcaacttagctgtttgttaagtgtagtagtctccattttaagtataaaagctcaccattaggttgttagtctgtcttggaaattcagcataaattttggaaggagaacatatcattgaaatcataagctttcaatgatgtctttgtagaattttatgttactaacatttttaaaaataatgctaatatgttagtgtttatgtatgtgtgttaatagaaacttacatctataatgttattttgttaatcaagacttcatcgcctgattcgtccaatgaaaattcccctgcaactcctcctgatgagcaaggtcaaggtgatgctcctccacagattgaagatgaggaacctgcatttccacacactgacttggcaaagttagatgatatgatcaacaggtcagttggtttcatttctaaaaccaaggcttgtttgtttttattatagcattatgtgtggtgggtaacataatggcagtgaagaggaactgttgccttaattttcccattatagtcactgccaagtactttacaacccatggttcatgatgggtctaataaaaaggagcaagaacatgctcttatggccttagctgtttgttccaaagtagaactagttatttagttttcctttttaaaagttggtgaaatttctttacaattgacatgttcttgactgactttaataactttagggggggcatgaaacaaaccagatcataaggagtttcttagaatgtccttcatgatgttctgcagggtaagaaaaggttgtaaagaaatgagaagaacatatcaaaaaccccatctgagcattgtccttaccgggcagtgtgagttcaacaagggccgctcaaaaaaactgggcactggatgagctggatggctcagctattaagaacactttaaattcctggcacctgcatggcctcttaacagctgtcacctataattccaaacccaggagtctggtggcctcttctgctctccacacccatacatataaaataaattaattaaaaatgagaatatttttaaaaaaataatgaaaatacaatttcttacaggtactttgctaaactttttggtgtatttttatttaaagtcaaaactattaaatacatgcccacggaaataaaaatcctttcattaaaataaaactgagttggttgtagggtcctacactgttaatctcaacccttacagggtagaggtaggcagatttctgagttcaaggccagcctggtttacatagtgaattctaggacagctagaaccatatagtgagacttggtctggaaaaaaaaacatgcaaacaaacaaatatctgattttcttagtagtaagggtgcattactaagtatagaactatgttgtataataaataaaatagattaatttctctaacccctccctcataacccctagctttattccccctttcacatattccaaaagtttttttaataatcaggagtacatttttcatattatatttctgttttctatcatgtatgtattgctttttctacacatacaaaatcttactgtaattttgcaacttgttttaacttgtaggaaatattcttccatttgactcattttcaaaggaacatttatgctgctactagcagcctgtatatagtaatcacatgcaatgaactattgaaagtatgtatttaagatgatccttgattgttctcagatgacataacaaagttgcattgttatatttcagttttgtctgatggttggtaagatatgcagattagatactaggctgcatgaaaacggttcttgatggaaaaaaagacaaaggatgtttaaaaataaatactgggtagttatttgtttctaatatgttattagaaaaagttgatagattatcaagcataaatcagtctaagcctcctgaaggtttttttctttgtgaggaagttcaaggcctctttaatctgaatcctgaaaacactttcctgtgaagtttttgtaataggcttctgtgatgtctaattgatattttattataggagtttatattaatttttaaaagtctgcttgtagagacaacagatgataattgtaaaaactttatccagtaccaatgttttcctatgtaatgctattttaattaatattttcatagtgaaaaaaataattgtaactagtaactgactatagtacctcttttatttagtgcataaccattaagtctctttattttattaattcctaggcctcgatgggttgttccagttttgccgaaaggggaattagaagtgcttttagaagctgctattgatcttagtaagaaaggtatgtctcagtatcatgcttttctaaatggtgtgcaactagatatattttcactttattcttgaaaactccattttcctgttaaaacacagtaagtgttttaagtaagtatatagtaagcttacaaatagagggttgtcctttttaaaagaatgtgatctcgggagtgctagacataaagtgtatatgaattcatatttctaaagagtaagtccattgtttagatttgcaatcactcagtgatttaaaacatttctcttatgggaattccataatatacacaaaaggttttacaattaaatactctgtatgtgatatatagtacaaatatcagtcaggtttaagtagcttgcagaagtgggaaggggatggtgaatatcctaaggaatttctgatcttgagatgagtcacatgtaaacctataaattacttaagcttaactgaagcaaaggtgcatgactcttaacctttgattctttgaatgaagatgactattttgttgactttttttttttcaatttatatattcattgtggttgggggttgagatacttacacaatcaagaacttgcaagagttgattctttttcatccaccctgtaggtccatgggagcaaactgtttttataagctgagccatatggctagtccagtaatgtgggtttttaaaaaaaataaaattagcatttaaaaaatataaaatacgggcggtggtggtgcaggcctttaatcccagcacttgggaggcagaggcaggtggatttctgagttccaggccagcctgatctatagagtgagttccaggacagccatggctatacagagaaaccctgtctcgaaaataaataaataaataagtgtgtgtgtgtgtgtgtgtgtgtgtgtatacatattttatttatatatatatatatatatatatatatattgtgatttttttctctaaaagaaaaagacttgtaaaagtggttctgtgtttaaaagaaataataaaaacccagtaaagggaatctgatactcagttgtccagaagtaaggttaatgttgaaattgagcaatcttattagattattctcatctatttctggtgctgtagaattctcttagtagaggactatggttatctatggtgctcagtttttaaggcactggaattgttttgggttttcttgagacagggtttttctatgtagccctggctgtcctggaactcactttgtagaccaggctggccttgaactcggaaatccacctgcctctgcctcccaagtgttgggattaaaggcatgcgccaccactgccagcaagatattaattttgaaaataactaatataaattgcttaaaaaaattaatgtcttttttatagtaccttgcttgggttcatggcatttcctggaaaggggaattttactcacattagttactccttctttgtttatcaatcttgaaaagctataaaataagttattcagatgattgttgttttgcactatttaaatgaacattgctagttacagtctaaacattaactgtgtaataaaaacctggtattttagtgacattgaaatctattacattgacattcagcggcttgtatatcttgctcataattatttttggcaccagtttattttagataaagctcaatttaaatatcacccatattgtatgattacaataaaatattttttgtacaaattgagatgttaaagacattctttgtatttgatgacaggttgttctgttgtctttttttaaaatcagatgagatgaaacaaggatataaaaagtgtagggttggtaagatgtcctgatgatctgaattctacccctggaatccgcttacaggtggaaggaataaactgacttcacagttgtcctttgacttccatatgaactccttagcatccatctttccatatatgcatgcatgaacacacataaataatgcatctttaaaaaagaagataaaataggttcttggcttggaagaagaaagatttgtgtagatagtaaaataaaagaagacaaaatgattcatcgtacttacttggtcatttggagaatagtaagaatatgaatgtctgctaagcacatagtttgcaaactaatatttcaaaaattaattatgaaatgtaaaatttaaggcttattttcagaacaaaatggtataaaatacttagagtctctgtcacatgttactgaccatcattttgggtttaagatacagtgtcataatttgtagtattttcagttaattttttattcatttttacttcattaatgattatacctaagatcttgtacatgttaagacttgctgccttcgcaatgagccatatccccagtcctgacttactgttaatattatcacattaaatgtaacttttgcataattattttaaaattttatttagggtgggagggctgaagaaatatccatgcagttcatttatggatgcttgctgctcttggagaagaaacccacccaggtttggttcctagaacccatgactggtggcccacaaccactggtaataccatctcctaagcacctgcattcattcagcatggtataaactcaggtcattacatacacacatacttaaatttttctttaaacagtaattctgagttaaatttcttttctgacatacagaaactttgaaataacaatagtgttatttcattgtgaacatttttttcccagatgtgctctgcaactgctagcttgttatacatgctgttttctgatgacttatgcctttcatcatatagttgagcacaattattttttttctcccctttcttaggccttgatgttaaaagtgaagcatgtcagcgatttttccgagatgggctaacgatctcatttacaaaaatcctgacagatgaagcagtgagtggctggaagtttgaaattcacgtgagttttccatttgacttttacaaagcagattatatagtgatcctttggatgggaagaacaagtgtgtgtgtgtgcgtgagattaacatgagattttagagttaaaaatacatggtttaggctgggcagtggtggtgcacgcctttaatcccagcacttgggaggcagaggcaggcggatttctgagtttgagggcagccagggctacacagagaaaccctgtctcggaaaaccaaaaaataaataaataaattaattaattaaaataaaaacttggtttaacttttctccctggttcttcattgccttgtgaccttaggcaggtcaccgcattttattgaaaacctgctgctatcgattataaaatatgctgctattttatgtattaaaggcaaaatgcccaagaaggagaaaataaaacacagatttgggggcaccagaaagttcagtgttacagaagtgatgagaaatgaactcacatgtctattttaatttagaacttgaatcatgagctactactgttctatagatagagttctatagacttgattcaatttacatttgatcctttttaagtaaagactacttaaagtgatttcaggtccctaatttcaaagagacaaaaacaatcagtaatcgttatttgtaggatgaaattagagtttacttcaacagtgaaaagaagttgtttttggactaatatgctattatgatacaaacctgtttctatgtatgcaaatagccataaacaggtgacgttttgtggtctgaatgggtttttcaattacaactatggggtaaaagtcccacaatctggtttaacataatttcttagatttagagcttggcaatgtagtcttctatcagggtaagtgatacattatttcaattttagaaaaaatgggaatttgtatcttatctgaagataacagcagaatttggcaactcataggacctacttcatttttaagcaagtagctttttgaaagcaaattaattctgtcagtactagtgaatcaactattatctatcagtataaaaaacaaggagctcatttaatattaacagtaattagggttatatctgtttgaaattgcaatgttttcatattattaatcacctttctctcatatataatagagatgcattattaacaatactcatcgcctggtggagctatgtgtggctaagttagcccaagactggtttccacttctagaacttcttgccatggccttaaatcctcattgcaaattccatatctacaatggtacacgtccctgcgagtcagtgtcctcaagtgttcagttgcctgaagatgaactctttgctcgttctccagaccctcgatcaccaaaagtatgttaattattttcaaatttaaatattaagatagttctaccacagaactgtaatattagtctcctagtaacatggcttaacactggtttaattatactcaaaaagacgttctgcattatagtttgaattctttattttgtaccacagctatattttattgtttgtactactatttagtttttctgtgtagtaataattgacatctgacaaccaagtattttttgagtattatatataatatagcactaggagcctttttgcatagtcatagcattttagttcagtgcttatggcttcttaatttttttctccatgttaattaactatacttaattcctgttatcttttagtcaatctgaagatagtcatagttggattaatataacatttcaatagtagtaataacaataatagagaaggacattatgactcattaaaaacctcaggtgtgaatcaataaggccatgatgattttatatattctaaggttgttaaggttgtttgtttgtttgtttgtttgtttgttttttcgagacagggtttctctgtatagccctggctgtcctggaactcactctgtagaccaggctggccttgaactcagaaatccgcctgtctccgcctcccaagtgctgggattaaaggcgtgcgccaccactgcccggctattctaagtttttttaaacttaaaaatagatacatgcgctgggcagtggtggtgtatgcctttaatcccaacacttgggaggcagaggcaggtggatttctgagttcgaggccaccctggtctacagagtgcgttccaggacagccagggctatacggaaaaaccttatctcgaaacccccccccccaaaaaaaaagataaataagttaaattaaaaaaaaacagatacatgctaaactataattagtcttattctagttaccaagacaaggtttctgtgtgtagtcttggctatcctggaactcatagtccaacctggccctaaacttgtagagattcgcctggctctgccttccaagtgctagaatagatagatgcatatgctaccatgctcagcatcttagtgaagaaaattttaaaaatacattacataaaacatgtcctttttttcccttcctttctttttttaatacaagtaatcccaaaagagatctgtaaactttgggcttagggcaaaagagatggctcagtggttaaagagcacttgctgctcttttagaagaagtggattcagttgacaacacccatatgttagctcacagtcgtccttaatttcagtcctaggggatccaaagctcttttacggtctctgggcaccaggcatgcacatgatgcaaatgcatgcagacactcacacattaaaaaaaaaaaagagagagttaatgccttagtaatggccttctaagagcaaagtaaaatgtaggaaaatagtaagcatactaaaattcgtagtgtagatttcttagagaacttagaacttatattcctatgattacatatttttgtatttggtctttaaaaaaatatgctgggcatggtgaggcacagccaggtggtggatctctgtgaggtttgcaagatccaagacagccaaggctataagttttttcaattggaaagttgatttaaaaaaatgataaaatgggaactaaatgtattcatagcatccagtctggttagtactaccacatagttcacattataatttgttttacttttttctttttgtttgtcctgtaatgcaagaagtttatcaaacctatgcctttgctcatggtagtagatgtttaattcctgcaacatacgggttagttttcagtagacaattcacttttaggcttcaagattatttatatggaaaatttaaatacttataaactacaataagaaattgtctcagaagttgttacactagattttctttgatctattattacttaaggtctttttaactttttaaattgtttttcatataagtgtttttaggtattttggaaagccatatactctaaaagtcggatagctgagacagaaacatagtctaacaagtaatactgatatgagcagtgtgtttgttcctttaatctaattcatgcttactatttattgcttctgcttcacagatcaattactatgatcgttttgaagccttttcaagaatgacttaacattaattggctttaatatatcagtcaaaatagtactttgtttatcctaaatgccaagaaagtaaacttgttaattgtattgtagggttggctagtggatctcctcaacaagtttggcactttaaatggattccagatactgcacgatcgttttattaatggatcagcattaaacgttcagataattgcagcccttattaagtaagtaacattttaaagccacatgttaaatatgttattgctgtttttattttggctcaattcagaaatggagtagttggagctggagagatgattgctcagtgcttaagtggctgttctttcagatagtaaacgtgaggtttattccctgtacctatggcaggtagctcaaaactgtctttaacaccagctctaggagaatccagcgtctctggcttctgagggcatctatctgcctatatacctaatccaaatgtgaatacatacacatagaatgtcttaaaaataatacatgtcactcgggaggcagaggcaggtgaatttctgagttcgaggccagcctggtctacaaagtgaattccaggacagccaaggctacacagagaaaccctgtcttgaaaaaaaaatacatgtactatgagaatttactaagttgaggttaagaagtcaagtatttacgggggttttcttttcttatttcagaccatttggacagtgctatgagtttcttactcttcacacagtgaaaaagtactttcttccaataatagaaatggttccacagtttttagaaaacttaactgatgaagagctgaagaaagaagcaaagaatgaagccaaaaatgatgctctttcaatgattattaaatcattgaagaatttagcttcgcgggttcctggacaagaagaaactgtaaaaaacttagaaatatttaggttaaaaatgatacttaggtaagttattcatcttggaaataattacttacatgaatttttagagtcaatttacaactgaatttctcttacagattgttgcaaatttcttctttcaatggaaagatgaatgcactgaatgaggttaataaggtgatttccagtgtgtcatactatacccatcggcatggcagttctgaggatgaagagtggcttacagcagagaggatggctgtgagtaaacaaacacttagtctagaatggctgtcagtaaagttagtaatgctagcattctaaattaaaagttgaaatttgaatgttttggttaatttacagctttgttaataatcttgaaattttaaagtagcatatttatttgatcgctgggtatatctttggtaaatttattgttgaatgtaattattacaagtttgatagtatttgaaacatattgaagaaggggcatgtacatatgaccaattccaactgatggcttaaaagtacaaaatacataagagggcatgtagggcgcaactggaatcttagcactggagaagcagggagattggctacatgtttaaggccagccagggttacatattgagaccctgtctcaaaatatatattagaataagagctactttttatctttattttgagaatttgtttttaaagtgtataattttgtatcattttgtctttaaatacttagaaaattgtttatttcctgtatatattttatgtatgactgctgtaataagttactaattataaaactgatgatatttgagtacatatgtggcaaacaggagccatttgtagcaaaccaatatctttacttccaagaatctcttttgttaataggggaaatgattagaatgtgattttaaaagaaaatatgaagtaattacaagtatagctagctcattgaggcctttggtttagttgacagcaaaaagaaaaatatacaggatatttaaatcagtccctgggttaggaggtcaggtggtagatgtctagttttgtgtacgtcatgtgtctgtcttcattgagaatgctggtcccttagctgtgtgacccatcctaaaacatatagaaaatatcattaaatgtataaaactttttgtgatagtttgacattgctgtatatttgttatattttagaaaagtttctttaacaagttggggaaatttaaacttatattagctaaaaagattcatatttatagcacattttgggcccacctacctttattctaagaaagttgaatactggattacctttttaaaaaaaattcgtgagtcctactttattgttcttgaagttagataaatgacagtcaagatggcttagtctagcacagtattacagaaacaaacaatggaagtataagacttttattcaaattcaagtgccactctctgcaaacgtgtttactgtgctaagaaaatgtatctcttacttagatttcaaagatgcaagcaacaataacatccagtacatggcagtcaattaataaatcaaagtggtttggttttttatttggttttttgagacagggtttctctgtatacccctggctgtcctggaactcactttgtagaccaggctggcctcgaactcagaaatccgcctgcctctgcctcccgagtgaaatcaaagtgttttaaaaagtatcttttaacctaataagaaaaccattgtggggcagaattagtttaaggaaccaaacaccaaaaatggccctctgcccattcttcttaaaccttaagtgattgttgcatttaaataatatttttatgagttaaatgctggaatgtacaatatctttttgatgatttcagtgtttgtaatttatggagatatttattccccaataaattgctttgtcagatatgatagttcccagctttaattccagcacttgggatggatatggaggcattttgaagatcacaaacttaagactagcctatgctacatagcaaaatgccatttcaggagaaaagagcttactataaatttttttaagcaatttttatgaatacaatgcattcttgcatattatcttgtacatatgcttttggctttctatgtattctttaaattatattttagtactttaaaaaggtcttcgtgttttattttgttttgaaacctggtttttaaattacctttaggaatggatacagcagaacaatattttatccatagttttacgagatagccttcatcaaccacagtatgtagagaaactagaaaagattcttcgctttgtcataaaagaaaaagctctgaccttgcaagatcttgataatatctgggcagcacaggtaaggctcttgaaacctcttaaatgcttctggaagaaattcttctagaaacttcctgaaattgtcaataatgcttgaatacttaacagttcatatttggcaaaagttaaagaggcaaaaaataagggaaactaggtgtggttgtgtatatctgcaatctcagcagatgaaagtgtacaagtaggagaatcatgtatcggaaggtaacttaggcttcaaagcgagcgcaagcttctgaccgagaaatcaaggatacaaacagctcagtggtacactgtatttgccttagtaccacaaaataaagtaatatttgttgggaaaataaatatacatctatcattgacctcttaatagacttagcaactcctcagtatagttcactcactcaattccaaaacacttaaaacttttcagaaggattagcaacctttctgaaaaggttttaaaagccacaaactacataaacattgttgaattctaatttacaaagctttggttttttgcttttttcttgttgttgtttttgtttattttatagagatatagaaaatagctttgtttttgagtatttagttccagtttggggaaaaaagtaataacaatgaaagtattagtatattcgataaactaattaaaatttaatatttcctaaagtacatgttaactatgcatatgcagaaatgaaattgtcagattttagcaagaagcaatagttaagaattttacatagagattaaatctttttaattatgtggtgattaaatggtgataatttcctgatggtcattagcagtcagtatagatgatgtttctattgttcacagtttagtgtctatgtgacctttgtttttatttattaataggcagggaaacatgaagccattgtaaagaatgtacatgatctactggccaaattggcatgggatttttctcctgaacaacttgatcatctttttgattgctttaaggtaattattaacgcagcattgttattaccattttatatttagatagaattgattcattagaactacaagttgttattaacccacaaatacttaaaaaactcgtaagacaatttctgatatgaaaggactttatctagtttgaaagactttgccagtgttttctttctacaaacttgattttcattttcatgatagtgctaatagccctaataaagactcttgttcaaaattcaggttattgttttgaatatcttttcccagtctcttttggaagtaggttgaagtatagaaaagtaggaaaggaagattgtgagaaacataagaggtggcaataaaagaaatatcagtacaatggtattctgaggatatatactcaggtaaagcataacttaatttacaaggcagtgccagaccatacagtcatactcacattgattctgtcatgttcttttatatagtgttaacagtctcatcagttactgacattcagtgcatggttaattggttagtgaatttgtgaattaagaacatgacattataagagtgcttaggaagggagggccttttaactattggcattacatcattagtcactaagtattactcctgaaaatagtgattctgactgggaacataagttgccataacactctggaaggttatattgtgtccctgattaaatacaatattctgggaatatcagtatagctcagcagtagaatgcttgcttagcataacaaggctctcaatcagtcccaaacaccaaaagattcttgcatatatgcaccagcttgcatgtccaaaaacaagtgaactgaagtggtttgtaatagctacaaatctctctatagagaggatagataatggatgttcatataatggaatacttcatgggaatgggaataagcaaactggaagcagcatggatgaatttcattgtcagaatactgaaaaagggctgaaactatgtagtaatttctgtatcttgattaaattaacataaacttcagaaatagtcccagatggctcttgagattctattcaccacataagaccaatttgtcttagtatatgccacatgtcttagtcagggtttctattcctgcacaaacatgaccaagaagcaagttggggaggaaagggtttattcagcttacacttccacattgctgttcatcaccaaggaagcaggagctgatgcagaggccatgggagggatgttgcttactggcttgcttcctctggcttgctcagcctgctctcttatagaaccaagactaccagcccagagctggtccctcccacaaggggtctttcccccttgatcactaattgagaaaatgccttgcaactggatctcatggaggcatttcctcaactgaagctcctttctcagtgataactccagctgtgtcaagttgacacacaaaaccagccagtacaattggtttttaatgtaggtagtgcttacatactgcttacatacatacctacactgggtactcttaaaatgaaatcactttacatcttccattttatatttcacagtagggggaaaaatgacctctaccccaggcatatagagtcagtcactaggtataaagcctaaaagtcaatattttcattaagtttctctgatcagtttttttgttgttgttagtttggtttggttttttttgtttgtttgttttttgtttttttgagacagggtttctctgtgtagtcctggctgtcctggaactcactttgtagaccaggctggcctcgaactcagaaatccgcctgcctctgccctctgatcagttttaacacattaaaagttataaatcagatatcttgttgaaatttttacttctttgaagggaacaaattaatgaatgttttctgcatttttaaatacatcatacacatttcacacatgcaaagataaacttttccccataaagacagctgtagtaagcagttattgtgaatgcccttaagttaatagtcattcatccttcatgttgaggtgactcctgaaatagtggtgaagtatgaccagtgacagacttgaaaaaggaaaaagtataaaacagtcattacatcatttgggtcttctttctcccaggataatctcttgatacttccttaataattagttccttaatgattaattgattccccctttggattatcaagagcttgctaaatagcaagcacttttttatagttggggagcatctcactgtatatccttggctgcttggaactcactgtgtataccaggtcgccctcaaactcgagagatctaccacactaccttaaaaatgaagaggagaaaatgaaataagggttttcatttcatttaaatatctttctaggccagttggacaaatgcaagtaaaaagcaacgtgaaaagctccttgagctgattcgtcgtcttgcagaagatgataaagatggtgtgatggcacataaagtattgaaccttctgtggaatctagctcacagtgatgatgtgcctgtagatatcatggatttggctctcagtgctcacatcaaaatactagattatagttgctcccaggtaaggaggtggtgtttggcttggttgtattacttttgtgcccctacagtactaggtagtatggctaaagtacaggataattttaggttattttagcattatctttttaatgattttaagaattgatgtttatttaagcctgcctttcttaggtctctacaataatgttttaagatccatctgagtctctggaagaggaggtacaaacaataggccatttagtgataatgttgtcaaatgtatggtaaaggaatcaaatagatcataaaatattaaggctgagttagaaactttggaaataaatattttctttgctcataaaagataaagaataattagaattttctaggtagtagattctaatgtcagggtgttgcattagcatgttaatgcatgattttattatgagatagaatctttttaagttaaaacaaatctcaaacctagtaaattataatcaaactttactgaatgtatgtgataaattttaggattttactttttagagtttggtagtaaatatgaagttaagatatacctagagcactttaaaaaaattaaactcttagagttacagtatattttatatttatcatgttaatcttataagaaaaaccgactttataattccatggattattggaatttagcttaatttccttatacatttatctttaaatactgtgacttagaattttcccgagtattgatctatataataaaacactgaaattgtttaaggaccgggacacccaaaagatccagtggattgatcgcttcatagaagaacttcgcacaaatgacaaatgggtcattcctgcactgaaacaaattagagaaatttgtagtttgtttggtgaagcacctcaaaatttgaggtaagacttttaaaactagacagtttaaatatttttatttatggtttgttaatttcaatttgtaaaagaaaattttaaagaaagttaatgaagtgccaggaaactaagaagaaaagggctccttttggaacaaaagaatcttttgtcattcctacatcctttgtttcattgatatggaaagtaagccatgattaagtgatcagtactaaaatctaagtgatcttgctgtttgatgctgtgtcacatggtagttttcacaccaaaaaaaaaagattgtttttttaatttttaaagttagtttagaagattaaattgcatggagatttaaatgatagtagatggaatgatagaacactggattttttaattttttaagatttattttatttattatatgtaagagaagaggacatcagatttcattacagatggttgtgagccaccatgtggttgctgggatttgaactcgggactttcagaagagcagtcagtgctcttaactgctgagccatctctctagcccctgaattttttaaatatttcttaagtatactttaggccagcgatggtggtacacacccttaatctaagcattttggaatcagaggtagatagatttttgtggtttccagatcaacctggtttacacaattaggtctaggccagccacgactacagagtgaaaccctatctcaaatggaaaaaaacaaaaacaaagaaactccaaaaatgaaaaataaataacaaaaaacttaggtgttgaaaaaatggtacaatgcttaagaattctaggtagtcttccagaggactaaacttcagatcacaactatttgtaattcaatttttaggagatcccatgccctcttctggcctcagtatgtactgaatatacatggtgcacagacacacgtgtaataaaaataaatatttttaaaagaagaaagaaagcgagttaatggattaaaaaaaaatgtactattttaaggttccaaaatctgtttataagtacaatttgtcctcttattttctgggcatgagttagaatggttgacatagaaaggaaaaattatgtggcatgaaagaaagcttgagtgtagtggaactaatattcataaatgaagtgtgaacaatgaaatcatataatctcgggagtattctttaaataatcatggtttccttgtataatagatgcaggtggaggaaaaggtaatgtttgtcaaagtaatgtattttgagtatgtttggcccagggtacatatgccacttaacctttctgaaatttattaactctcaggtagacatagtattcagcaactcctagaaattaatgaccttgtctatactagaatatgaaagttgtactatctatgaaagttgactgtgaaatttgttgtgtgacaagaacaacttggctgcaaaccaaatgttcccagggaataacttaaacagctagtagtttttaaaatattattactttttttttttttttacttttggggggtaggaactcgtttttgtatggcagtcagagaacaacatgttctcaccttcaaaaatgaaaataatggggatcaagctcaggttttcaagctggcagcaagtgccttttcctgctaagccatctgtttggcttctaataatactaataattaaaaagtaaaaaacattggccagcaattggcaatgctggttctacaaagaagtttggatttttggaattttcaaaaagtcatgtattcttataaaaatgctttgctactgccatattataatagatacaactgattcttgcttttcaagtaataccatttttaatttttaacactaatttcttttaagttgcttaatgtcattaaggaagtaaatgagtaaagctggcttttgagtttttaattagtagctaataatttagtggtgataaacagttgattgcaagagtttaattgcctaattatattgttaagctcttctcgtttcagtcaaagtcagcgaagtccccatgtattttatcgccatgacttaatcaatcaacttcagcacaatcatgccctagttactttggtagcagaaaaccttgcaacttacatggaaagcatgagaatgtatggcagaggtatgtattgtaagataattgaactgtgagaaataacagtgattgccattttctattaggagtaacaattatatttttatttattttttatttcaatcttttttttttacagtctagactctatactcctcccagtccaccctcatgactgttccacattccatacctcctcctctatcccctaacctggtcttcctgagggtgtccccatccttcctatcccctacccagcaggcctccccacttcctggggcctctagtctcttgagggttaagtgcatcttctctgactgaacccagtccaggaagtcctctgctgtatatgtgttgggggcttatatcagctggcatatgctgcctggttggtggtccagtgtctgagagatctcagggctccaggctaattgagactgctggtcctcctacagcttgttaaccacctccttagctttttccattccagcttttccctaattcatccacagggattagcagcttctgtccattggttgagtgtaaatatctgcatctgactctttcagctgcttgttgggtctttcagagaacaatcatgataggttcctttttgtgagcactccatagcctcagtaatggtcaggccttcctttaagctggatcccactttgggcctgtcactggaccttcttttcctcaggctcctctccatttccatccctgtaattttttcagacaggaacagttctgggtcagaggttttgactgggatggcaaccccatccctcacttgatgccctttctactggaggtgggctctataagtttcctctcctcactatagggcatttgatccgaggtccctccctttgagtcctgagagtctctcacctcccagatctctggtacattctaaagcccccgccacccaccgtgttgcctgtttgattctttctgctggccctcagggcttcagtccttttcccccctcccaatacctaatcatggtcccctcttctccctgtccctttctcacccaggtgcctccctccctctctccctcccccctcctttggatttgttctccctcccaagtggggttgagatgtcctcacttgggccctttggcttgttaaccttcttgagttctgtggactgtatcctgggttctgtacattttttggctaatatccacttactagtgagtatcatacatgtccttttgggtctgagttatgtcattcaggatgataatttctagatccctccatttgccatcttgagattgtagacaaagctgcccttgatctcactgaaatctgcttgcttctgcctccaagtactggaactaaaggcatatacaccactatacccagcaccatcttctatattaactttcttaaaggaagatggacttattaaaattcttaccaatatttgcttatgtgttatgactgctagtgctttcatgtgctggtgcctaccaatctttccggagtttttttgtatagacaaaaaaatgtgtaaaccacctttcagttgtcactgaggctttagttcactggtaacattattactttgctgacctcaattgatacttactagaaaagtgacttacctcattcgttgcttttccttgttctcagccatgaagtacaaggtctatatgggttttaaaatactgttattaaatagtttgttagcattttccacttacctggagaaatggctgctttgggacctggaccaaggaattaaggacttcttaatgggaaaagtatgaaagtgatcatagaataaagtttatgttgaaagaatgaaggattttggtgtttataggccaaaactagaacaaaataataaaaataactatatgcattgaataaataacatataaacacataaaagaaaataaaagacccagaggaccttaacaaaacatttaactagataaaaatacagataaaatttaaagtgcctagaaattgttataaggagttaataacaagaaaatctaaatctcaaaactagcagttgagccacaacttgttcatttgtctctacagtcagcttcaccatgagaaaactattctgcagtagtttgactaaggactagtcctccccacacaactcctagtctaggactgcacttggtttcttgcacagcaagctgctagccttcttattcttagtcctttgttacagatgccctcttaaatatgcagatgtgacttcattaccctgcccactcagtatctatgttagttgaaacttaaatccaaacattataagccagcattaaggccctaattactgcaccacagctggctccagtggtccataccaggggaaataaatggccctattttcaaccctgcacatattaagtcagaaatattcttggaaaaactgggtgctatctgcctctgatgcctatctagtgacacagatattgtgcccaaagggtggagagaagccatagagacagagtttccacatttagttatatttgaagaaaccagaacattccatgccaagtaaattgtctacaaagagatggataaagaacgtctaaaaattgtagctcccttttaactgctgtcacatagtgaaatggtatagcaaataagtttccacctagaaggcaaaatgagagcccttctgcgatcctagtctcactgaggactcaaaaattatactacatcacccactcagagctggatatggaacaggttgaaatttcttcagagaaactgtaggtggctagtaagaactttaaaagatgctcaatatcactaatttttaaaatgtgagtcaaaaccatggtaagaaagtatattgtgatagaggacaacacttggtattgttgagactgttcagaaattggatcttcattccttgtgggcttatttattagttagactggtagttcttctaaatattaacagaatttaccatagtatggtccatattcaagtaaaatggaaacaaactttaaaaaacttggaattgaacattaatagcaaacttgttataatagccaaaaaatagaaataataaaaagtgatatgtcacctggcagtggtggcgcatgcctttaatccagcacttgggaggtagaggcaggaggatttctgagttcgaggccatcctggtctatagaatgagttccaggacagccagggctacacagagaaaccctgtttcgaaaaacaaacaaaaaagtggtgcgtccatatagtaacacaactctcttaaaaaacctgaagatttttaaattggtaggttgatgatgattagaacatattttatttgcttgaagtgggagcacacatctttaatctcagcactcaggaggcagatttctgttagtttgcacaggacagccagggctacacagagaaaccttgtcttgaaaaaacaaagtttattaacagatgaactcaattgattttgatgtatttattttattatatgtgagtgtgtgtgtgtacatatatatacacacacacatacatacatacatacacatagagacagagagagacacagacagacagacacacacacacaccatatacatgtatggttcatgaagtagtcagaagagtacatcagatctcctggaagtggagttgcagtttgagacactctgtgttatgctgggaaatgaacccagctcctacaagagcaacaagtagtcttaccgaatgaaccagttccccaatctcagcttaatttttcacactgaattctaaaatggatctcacaacttgatacttaaactgattttgtgttggttatctgccaaccaattttctaagatttctgaattgatcatatatatatttcctccatgggatacctgctacatagacaaggagtggttgtcttccttatttgctagcaaatcaaaaaattgttggaactctttatagtaaaattatcagcttttatttgtttggtgttttgtttttgagacaggatctttctgtgtatccctgcctggcctggaactcaactatatagaccaactgaactcagactcataaagatctgccagccttcaccttctcctccccattgctgaagactaaaattttgcactaccacttcacatttattacaaaagtagtgtcttatttcttgacttttcttgattactgtttgtgtttcattggactatttcaaagctctatgtccaaagtgttaagaattgaacacaaaatggattagggcaggttgctaaaaccagtggggcaaaaatggcatcttgacagcctagggaaactgcatcaatcagctatgtaatcaaagtgagcatcatgaggattgacacagtgccttctgattattaacaccagcagggtatacttctctaatattcttgcccagaatttatagccccagtatatgaagtaggaaaaggattgttctaaagagttttggtagcacatttaatagaccatttcctttgggttgtatgtatagaagggatgtgtattttattaggatattagatgggtttgaaagcaccaattatcaatgtaccaattattagcagatttgcagttgccttatataatgatagaagatcaatgatttttttttttaactgacaagttacttggttgaaatcagcagtggtatgattatccatatatataaaatgcatctttttatttttcctaatttgcagacaatgaagactatgacccacaaactgtgagactgggaagtagatatagtcatgttcaagaagtccaagaacggcttaactttcttaggtgtgtttaatataattagtattgctctctgacgagtatagtgactgattaactgaatatgctgtctttgttgatttttttttccccctttgccacagcttcctttgttgcttaatgctttacagttagtgagtgggttgtataccatccatctcatttttttttaagctgtagatgctggaaatgtttacttttagaggacaattttttagaggacaatatatggattattttatttacattccaaatgttgacactcgctcccctgctcccggtcctcgctcccagagttcctcctccctagaggacaagcttttatacattaatacaaatcagatggagaaccatactatcattagtaccatcgggactaagcaattgagagcaaaattcttttggaccaaagtggtctgagtcctttagtaccttgttctacagtgtctggcaaaggtagtttgaaattaggttattaataacattgtctctaagaggatgaggtaaatgcgtattttcattaatccacattgcaatcttcaaagatttgttccattatatcagcttttagtgagtattcctttaaagatttaaaaagtcctttgtgctcaaaagtttataacaagaggtacatcataataagtcagacaaaagaaaaaaaaaagacaagtgctaattatcagtacttctgaaaattgattgcatttgttgctctgatacaggttctggagaatatttttgtgttccccccttaattgttgacttaattttattgaactcttttggggagaaaataggattgtatgatgattttttttaatttattatatgtacgtatactgtagctgtcttcaggcactccagaagagggcgtcagatcttgttatggatggttgtgagccgccagccatgtggttgctgggatttgaactccagacctttggaagagcagtcgggtgctcttacccactgagccatctcaccagcccctgtatgatgatttttaacttgagaaaaactctcccattttttaagaatattggcagttgtttaaagttgatgcttttcaaccaagtagaaggacctcacattgataaatgttgccttcgttattagtcatagttattaatggcctgttttgtatcccttcggcttactagaactagaaaatggtgcaaacacctttgccatagtttggaattgaagaagctagttatttaattacttaactgggaataatagaagcccaaccagagacaaaagaaccttatttttggtacctcttttattttagcctgtgctaacacactttctattttacctcctatttgattaacaagaaagagtcagatattttacagtaaccagtacaaatgacttgcttgcttcttccttccttccttccttccttccttccttccttccttccttcctttctttctttcgttcttttgttcttttctttgttttagtttgtctttgatttttctagacaggctttccctgtgtagccctggctatcttggaactcagataaaaactgagaaacaagttcaatatatatgattgtggtatcggtattatttcatacataaacgggtaggttgtatttcaggatatatgtcaaataaattttttttatgtttttctaaggtttttattgaaggatggccagctgtggctgtgtgctccacaggcaaaacaaatatggaagtgcttagcagagaatgcggtttatctttgtgatcgtgaagcctgttttaagtggtattccaaattaatgggagacgaacctgacttagatcctgatatcaataaggacttctttgaaagtaatgtgcttcagcttgatccttccctgttaactgaaaatgggatgaagtgttttgagagattcttcaaagctgtgaattgtcgagaaggaaaactagtagcaaaaagaagagcctacatgatggatgatttggaattgataggattagactatctttggagagtaagtcaaaaataggagctctgtcaacattgtacttgatattgtatctgatgcttgtctcaggagtctgggttttatccttatctcaagtttgtgtgttccttactagcattgtttaacattcttttaaatctaaagtataaggttgatctattgcaggctaaagtgtcttttatgatattttatacttctatctttaaaacttaggttggttaaaactgcttctgtttttaacttattttagatgtctgcaaattatatacatacacctaggtgttccatgtggtatttgagtacctaaacttttcaaataagtaaagcttgaagttttggggtgtttgtttgtttgtctgttttataagcagtggaggggcttgaaaggcagtgcatacttaaacgtacattaagccccaggttcagtcttcagcacatattttaatgttacaaacccttctcttaatccaaatttgcacttcagataaaatgagtaggtgccacatatttgaaaagtatagttctaagccagcctgaggttacagatagtgtaagatcctgacttccaaaaataataataccaataatcaaactttacatgatgatgtgaaatgtatagaggaagcctgtgtgtttttgttcattgtctccaggcttcttaatcttgctttcattaaaacctctttgcagggatcagccttgacacatgtcatctaaacactagagtgtggaacatagtttgaaaaccaccaatgtaaataggtgtggattgtaaatattatagaactgaaagaagggagaatttttacactaatctgtattcaaaaagcatctcattttcttctaactagtttaaattcctccttgaaagcctcacactttggtcaaaaccatattttatttgtagtaaattttaaacattgcatttatgccttgatctttttgtctcatttagtcaaccagtatgttgttgaatagtgtattaaaaataactaaggatatgatttgaatgtaaatgcccgatgaaacatttcttgagaaacattattttttttttatgtaggttgtaattcagagtaatgatgatattgcctgccgagctattgatctccttaaagagatatacacaaaccttggtccaaggctgcaggtcaatcaggtgagtatcagtgtgcattaaaacttgtacaagctagccagtgcacgcctttagtcccagcacttgggaggcagaggcaggcggatttctgagttccaggccagcctgatctacaaaggacagccaaggctacacagagaaaacctgtctcggaaaacccaaaaaaaaaaaaaaaaaaaaaaaaaccaaccaccttgtacaagctaggattctaattaatagaactataaacctttcaagattttctctttaatttagacttaactggaaattgttttatttcagctactcaaaaacatatataaaagccaggtatggtggtaatatgcctgtgatcttggtatctaagggcttgggggaggaaaatgtcaggttttaagactattttatttggactatatagtagcactttgcatcaaaatacgtaagtacgtacatacatacataaaatacttacagaatactatttaaatgaatcttgccttgatagttttgaagtggttgggttactttgaatgttgattattatgtattgaaatactaaagactatgctgagtgttttttcaaaactagtacataccctctaaatttctttgttttaatctcatttatccttatttgatattagtttctctttaaacaataaactatctgcttaaaatatgattattgtttagggcaacattgttacgtgttctcatctatctttatttggcacattatatttgtaggtggtgatccatgaagacttcattcagtcttgctttgatcgtttgaaagcctcttatgacacattgtgtgttttggatggtgacaaagacagtattaattgtgcaagacaggaagctgttcgaatggtccgagtgttaactgttctaagagaatatataaatgaatgtgacagtgattatcatgaagaaagaacaattttgcctatgtcaaggtttgtgaataattgataactcggattaatttttagttgcttggtattttcctaacccattgccctattttaaaatgtgtacaagggaaacagaagaaaagaaatttatctttttgaaaatgtatcttaaccattaacaacataagtatcttatggaaatgcttgattatttttgtggtaggatagtttattagggaagaaagcactcataagagaagtaggtcagagattctatagctctttttttccttgaaagtttgtgattattttgttttacttaaatatgttctcactgtgtagcattcagggtggccttaaacttagattatcacagcttctcctgtgcacggattatgtgtccagcatgttatctttttaaaataatagaccttttatttcttcattgtcagtttttactttattaatttttcttttacataaaaaataccatattagccgggcatggtggtgcacacctttaatccgagcacttgggaggcagaggcaggcggatttctgagttccaggacagccagggctacacagagaaaccctgtgtcaaaacaaaacaaaacaaaacaaaaaaactatattgtgtgtgtggccatgtgtgtgctaaggtgcaactgtggagatcagagaataatttgaaggagttggttcttttgccatttggtcatttgattctcagggaccatttgggtcttcaggtttggtagcaaccctctttatatactgagacatttcataagccccaaatttcaatataattgtgtgttatatacacattttcatgtttacaaacatggtgtacccaccatgctcctttgtgaaagccagcaatagactttggatgtcctattctgttactattattattttgtttcgactgttctcctaatgagctaggagctagatgggcagcaaacaccaatcatcctatttttgccacccacacttagaattacaagcacatctagctaaaaagctattatggggctggagatttggacttgggtccttatttttcatgcttgtaaaccaagcactcttaaaccactgatacatcccttcagtttcactttttatactcatttatactgttaaaccttatagcatgccttttagcctaatatttggaaggcataggcggtgggttgggtgggtggtggtccaagtttgagactaccctggtcaatatactaagttctagctcagccaaggctctgtagtgagattctcttacaaagtagaaaaaacaaaacagtgtatagttactttttccttttttaagatttagttttattttctgtgtatgagtgtttgcttactgcatgcatgtgtttcatatgcatgtttggtgcccttgggggtcagaaacaagcattagaactcctgggactagagttatagacacttgagccctgtaagatgagctgccatgtaggtactaagaacctaacctggttcctctgcacgctatctcaaatcaacaacaaactcacttgacaggcaaccagggtagctaaaacataatttcaaagagttgaattgtatttcttttaaggtcttaccatttagtaattcaaatgatatttatgttaagttctttcttgatgatataaattcattttttgtatcatactttcaagataaaatgtcaacataatgtagttttgaatgacttgatgttaagagctttttgggcaattctgggcagtagtgcatgcctctaatctcagcactcaggcagagaatggtggatctctcctagttgaggacagcttggtctgcagagcaagttcaggccagccgaagctacagggtaagaaccagtctcacaaatacagttaagacaaaatttgtaacagcttttttttgttgatgttctcaaggtaaacctttttgtttggttggtttggtttggggttttttggtttttgtttgtttatttgggtacttttttgttttgttttgaatcagagacagggtttctctgtgcagccctggctgtcctggaactcactctgtagaccaggctggccttgaactcagaaatccacctgcctctgcctcccaagtgctgggattaaaggtgtgcgccaccactgcctggctctcaaggtaactcttatcttacacatttataagcatcaacgactagtgatttgggctttacaagtatagaagagaatgaaatgttcctactatttctgtgtcttaattgggagctggttgtatatagttgcttggagttgttcatcctggcctttaattggtaatccttcttccccagcaatgactggaatttctggaatgaagcaccatgcctgatatttgtattaattccttataggtcaatacattattttatatgactatgggcatgaaagtactaacagtggaatatagtcatggtgttttggttgctggggtatttatagttaagaagaataaatattttcagggcactacaaggtcttcaattcacttttatttaataagaacatattcaatgttaaagttccatgtgtattttcttggcagctaaatttggagatttgctaaatgtagtattttccatttcttttccccaccagagctttccgtggtaaacacctctcttttatagttcgatttccaaaccagggcaggcaagtagatgacttggaggtttggtctcatacaaatgataccattggttcagttcgaagatgtatactcaatcgtattaaagccaatgtagctcatacaaaaattgaactctttgtgggtggtgagcttattgatcctggagatgaccgaaagttgattggacaattaaacctaaaagataaatcagtaagtatattaccccctgataattttttaaatagaacctcaccctgtatttcattgttgaacatttgttctgttaatcttaatgtcagatgctaggattataatactaactcagacatgcgttggaatagaatatatcaaaacaagtagttataacagagagtactttttgaatgtacttttgaaaatattagcatctagtttttgtttaattatttaatcatgtaatgattgttttggatgcacatatgtctgcactatatgtgtacctggtgcccttaaaaatcagaaaagggtattggatttcctggaactagagttacagaccactgtgaactgctatgtgggtgctagtaatggaacccagatcccatacaagagcagccactgctcttaatcactgagccacttctccagccccagcatctagttttttaaattcagttgttgacatatcactagattccaagttttgtgttttctgttatttttttccttgtctttgattctaatatgtatcattttcagctaattacagccaaacttacacaaataagctccaatatgccttcaagtcctgatagctcctctgattcctcaactggatctcctggaaatcatggtaatcattacagtgatggccccaatccagaagtggaaagttgtttgcctggagtggtaagtatattcagttgttcaaggcattatacttgctgagaattattgacaatagacaatacataaacgaggattttgttgttgttgaagaacgctttgtttaataaggtaaaatgtctacacaattatccttcagtttgaatgaagccctctgaaacgtaattgtaactcagttaaaatttttcttttttaaagatttatttatttattatatgtaagtacactgtagctgccttcagacactccagaagagggagtcagatctcgttacggatggttttgagccaccatgtggttgctaggatttgaactccagacctttggaagagcagtcgggtgctcttacccactgagccatctcaccagccccctcagttaaaatttaaaccaagagccgggcgtggtggcgcatgagtttaatcccagcccttgggaggcagaggcaggcggatttctgagttggaggccagcctggtctacaaagtgagttccaggacagtcagggctacacagagaaaacctgtcttgaaaaaaaaaattaaaccaaaagttccctgtagttaataactgcatggttatatttacatataattaatccattggaatttaattataacatcttggtataaaaatttaaagaggtactaccactgtcttacatacttgttttataaaatggatccttttaaaacgtcgtatgtaggaaaaaactgtaatatttctcatcatatccccccccaaaaaaaatcaccgacgggaatcccctattgacctctgttttcacttcataagaactttaatgactgcaagtaacaccagctactccagtgtaagaacaaactggttagaaatttagaaagtggcatggtggcagtttcactatatgtaggtgagaaatagtgtaataaaacagcctaaaggtatcacaaatgtggctcagatgatgttttaggcctgtaccataaagaatttgtacaggtaagatgagcaaggataacagaagtaacaggagccaaagtatggagataagcttttaggaagaccttttttgaagcccaggagtaatttttcagctaataatttgtgtcttatattctagataatgtcacttcatcccagatacatctctttcctttggcaagttgcagacttagggagcagcctaaatatgccacctcttagagatggagcaagagtgcttatgaaacttatgccgccaggtaagatgttttcgatgatgacacaatgcatgctaacaataaaatgtatattaacaaattcctcttctaagtgaaccatatattagtggttggtaaactagcctgtaagccaaaatcttctaacaacttatttttatacaacccaatacctaaagaaagtgtctaaatttttcaagggttaaattaaatcagaacaatatctatttggagtattgtgagatggctcaatggataaaggtgtgtgcctgcaaatctgatgaattatagaagagaactgactctcttcaactgtcctctgacctccatacatttgccattcactctcacatacgcacctataaataaatataataaaattgttttaagttttgacaccagattctataaaattttagtatctgtagtctattcagttttgctgtcttataggtatacccattcatttaaatattatttgcaaatttttgttgatcaacagctgaacagcttagtagcagagatcatgtggcccaaaatcctgaaataatgtacacacacacagagactaattgattaacttaacagtttaaaaatcaagctatagtgtccaagtttgaaacagtgaacatttgattaaagtatgtattgctttactaagcagaatgagttgtttttcctaagagctatctccttccaggagtttaaagattatttttaaatatgccaaagtctgttttaagctcttcatagcctctcttctctttctgtttctgttttccctctctgtttctttttgtctgtctctgtctgtttctgtctgtctcttttgcactctctaagacagggtcttactatgtaggttttgctggcctagaatgcacagagatccacttgcctctatctcagtggattaaaggtttgcaccacagtgtgacaggctccttttttctgcattctctcaatgtttgagaatatatatatattcagttttttgagtactgtgatgtctttcagtgaaataaactaggtaatctgaacgtcataaagcagaaaataacttggaggtaaaaactgttgctgttacttacatttcctttggaagtgggttttttgctttgttttgttgttttctttaaatcagtctccaacagctggaaactgttgactggaggctcctggatgagagatggtctcatgtttaggctggctgattaaaaggcactggttggcattttggttctcatttgtttacttttaaatcaacccaagttcggtcatgtattacagaagctcaactgaatgtttaactgaattgtttgctgttttgtgctcttgaaaatgctagaagtgatatagatgtgaattgtgttttatttcagactatgcctctttctcttacagatagtacgacaatagaaaagttaagagctatttgtttggaccatgccaaacttggagaaagcagccttagtccatctcttgactcacttttctttggtccttcagcctcacaagtgctatacctaacagaggttagttttttgtttttggttttcatttttggatttagttcttgtttaaatttgatccttgatgtgctgctatgaagaatgtggataagattattataaggtggttttgaagtggtcattgtcttagcattcttgatggtgaaatggaggttatgttttaaatcccttttaatacaatccttctcttctccctctcccccttttatttgcaggtagtctatgccttgttaatgcccgctggtgcacccttgactgatgattcctcggattttcagtttcacttcttgaaaagtggtggtctgccccttgtcctgagtatgctaaccagaaataacttcctaccaaatgcagatatggaaactcgaaggggtgcctacctcaatgctcttaaaatagccaaactgttactaactgccattggctatggccatgttcgtgctgtggcagaagcttgtcaaccaggtgtagaaggcgtgaatcctatgacatcggtaatacagactttgttttggtttctaaaatatctagtagtagatagtcatttttaaggttaaatttctcaatgattctaaagtctagagtttaattttgactcagtattaaaattttctttccagtatatgtcttgttgatagaaatgttcacttatttctctatatttgtattaaaaatacacacactcgaaaaaccaaaaaaaaaaaaaaatacacacactctaccctggctttcctactactaatttaagagaccatttccttcagtttctttctgaccacttgagttttactacactctaacttactgtgaaaaaaaaagccacataaatgaatttctaacttgtgccaagcagataccagtggtgttaagattttgtaattgatttagccttttgccagtttctgtcccatcttccttggcttaaactttaattatgaaggccttatcattctgtcttcgcctggatctttgatccattttcctgatctcaacatatgctatagtttaatgactagttaaaggcccaactatgcaaatagttgctaaattactgatagaagacaaaagtctttaggagaatgaggcaagaggattagaacatatcaaagccagcctgggctatggaatgagaggaccttctctttaaaaataaaagtcttaagaaattttctttagaaatcacttagatcatattggaggtgaatggcatgttggtgattatgatatgtagttgttatatatacacatatgagagaatactataatatttcaaggaagaacctttttatttttaaaatagtttgcaaaataattcataaatgaaaaaattttaattaaatttgttgggggctttttttgttttgttttgtggttttgtatgtttgtttagtttttgagatagagtttctctgtttagtcctggcttctcctgaaccaggctggccttgaactcagaactcatagagatctacctgcctctgcctcccaagtgttggaattaaagttatgcaccaccacgtccaggtataaatgaagttttatgatactcaagatttgcctagtagcaatcctaaaggtcaatggagatggaaagtaagagggtgtaattaggtaattgacaatagtgaggcagaataagagggagatcttgatctttttaacgataatttatttttattttatgaaattgtggttctgcctgtacttttgtctgagagtgtcatatcccctggagctggaatcacagacttctattgctgagctgtctctccagcccccaataataattgtattatcttagtctgaccactttcatatgttggaaattttctgtaagccagccaggcgtggtggaggcttataattgcaggatctggaaagctaaaacaaaaggaccacaaattcaaggccagcctgggctacataggacaaaaaaaaaaacagataaaaaaacgaaacaaaaggagtgaacttttccataaaaataaaaatgactaagattatatattatttactgtggtccatttcattaggattttttattttatttttatttatttatttattatatgtgtgtatactgtagctgtcttcagatactccagaagaggacatcagatttcattacagatggttgtgagccaccatgtggttgctgggatttgaactcaggacctttggaagagcagtcagtgctcttaaccactgagccatctcaccagccctcattaggattttttaaagtaaattttggcttaagaggaaaaactgattcttatcaggtgtggtggttattacctgttatcccagcacttggaaagccaaagcagaaaggcagcaatgagtttaacacacacacacaccagctttaacgtgagactttgtatctcaccaaatgaggaagagctcttgttaggataaaaagattcttattttaatccaaggcatgactgcttaatgaagtatacaatacaaaaggcaataatatgcttcttcttgtatcttttctataatactttgagaacatggccatttgctagctgtagatactaaggtattgtaattgtgaagtatttgttggcaattgaaagcaaaataaaaatttagtaatagggatatcttaaacatttacagtatagagaaaagttacaactcaaaatcagaagtattcagctactttatctgtttctcattgattaaaacacttagtatacaattacataaaagtactgctatcttttgtatgttttatttttttataattgtaatttttctaattttcaaagtagaacttgataactggagattatgagcagggtctgcctaaggatacacatttaaaaagatatgatttactgcattttgagatgagtttggacttgatctgttcatagaaacatgggttagatgaatctagaataggggattgtagagaaatctgtgccacttgcataccatgttggcagggtggaatactttgcatgtgaatgtggaaagaaaacatcttgggaatgttgatgaacgccataggaatgattgggtcaagttgtatacagaatactcaaataaaatggttaactgtttttcaggtcaaccaagtaactcatgatcaagcagtggtgctacaaagtgcccttcagagcattcctaacccatcatctgaatgcatgcttagaaacgtgtctgttcgccttgctcagcagatttctgatgaggttagtattgtaagagttatatagggggagtgtgtgtgtgtgtgtgtgtgtgtatttatttacaatgttttacctgtcataattgttactatacaattttttaaaagtttttattctgtgtgttttgcctgcatgtaagatgtctgtgcgcagcttgcatgcctggtgcccttggagatcaaagaggacttttggatgctctagaactggaactacagactgttctgagcttccatgtgggtgctgggaattgaacccatatggaagagcagccagttctaaccactgagctgtctctctaacccaaaacaacctttttaaaaattcaatctagatcattgtttaatgccaacttagtattattagtactttattttcaaattttgcataatagcattctttcagagtgtatatacaatatttagtattcacacaaacagtacacaataattgttctgtactttttttttttttttttttttgcagtcaatacttcccttcagttctaatatccaataaccactaatttttttgtcccctatgaaagtttttattttctagaggtgtgtgtgtgtgtgtgtgtggtttttttagttggttgtttttgtttttgttttccgagacagggtttctctgtatagccctggctgtcctggaactcactctgtagaccaggctggaactcagaaatccgcctgcctctgcctcccaagtgctgggattaaaggcatgccccaccacgcccggctattttcttaagttgtattcagttggattgtgtgcttataatccaaacacttgagtggctgaagcagaaggatattacatagaaagcgagcctgcaagacccaatctcaaaaaataaatacttttttaaaaagctattgatgactttgaattgtcaatgttctaaggttcaatagatcattccttttggttaaatattatcccattgtatgctactcatggtggcacatacctttagacctaggacttgggagacagaggtaggcaaatttatgtgagttctaggcctgcctcatctaaatagtgagactgtctgaaaaaaaaaaccaaaatatgcatgcatttgtgtacactcaagggacacatacacataaataagtagatagatggatcatatatcttataaaaacatatataatcccattattaatattctatggtttgtttatatatgttaccaaatatacttggatttttttcccttttagatatgattagaactgctctgaaatttttataccattatttgaacttcctattctctacacctgggaatgcaatgtttgtcatttctgtggtggtcaacactaacagtattctcaagttttaattaatcattattttataggcttcaagatatatgcctgatatttgtgtaattagagctatacaaaaaattatttggacatcaggatgtggaggattacagctggtattcagcccaaatgaagaagtgacaaaaatttatgagaaggtaagaatcatgagaggaatatgcccactatataaatgaatgttaatgttttgctttattttttatgtgtataagtattttacaatgtgtgtacatatatgtaccatgaatgtctggttccctttgagttcagaaaaagggattggatcccctggcagtagagttatgaacagttgaaagccaccatgcagatgctatgcattcgttgatcctggtttctctgttaagagcaagtgctcttgaccgctgaatcaactctccagctcacacttctccattcttaaggaaaacttgagtaggaaggacttcttgatcagtacagtgtcctcattatattgaacactttgttcttattacgattttggtgtttggtatagtgtctctttgatatattcattcggaaaatgaatgaaagcctatttcagtcacattaaaatcacagcatatttggggttaggaaaaaaatttaaagccttactgagcagttttccagagatttttttaattaaatagcacaataacattgtgccagagtagtggttcataaagaagcaatggttagttgttggttcagaagtgtacaactcagaagggtctctaggagcttcttaactacaaagtgctcaatgatgtatataatcagtatatatatatccaatgccttttgggtcatagcaaaatattgacattagacttagttttctattatagttgtttttaaattatttcaaaaaaacctcacaaaacaggtaaaaagaggaaacatgtagtttaatgataagtgaattttaagcactaagcttttgaagtttcatagtattttcttttaagcactttctaaattaacttactaaggattaggtttctttatttattgcactttgcaaacaatattagtttttgttgtttccttcccttcttcctcccttctcttgttctctctgttcccctgcgaggtgtcttcccttacactttcatattacataggtttttcttttaaagcttctttaaataatttgttcccaattattttacagaccaatgcaggcaatgagccagacctcgaagatgaacaggtttgctgtgaagcattggaggtgatgacactgtgtttcgccttgattccaacagccttagatgctctaagtaaagaaaaagcttggcagacatttattattgacttactgttgcactgtcacagcaagtaagtttcttttttatttttaagaaacttgatcttatttttgtaaaatagaatcaaatttatgttggcacaaggtattatagaaaccaaatactctccatggcacattaatgttgaggaaattttcactttataatatttgacctcacctaaatttgtttaattttagtctgcaaaattgaatagaatattggcctcctgtcttgtattcctaggtgtcagctgttattttaatgtgaaattttataagagggttaccataggagtttatgcataaagatcagttaattgaaatccatcatttttttttcattttaagggtatttaatcagtattagtaatgtttcaagctgcttttatacaagcaattcagatttaagacaattcaaatctgtagaaattggcttccaaccttttataatggtctgattctgatcccttttttttattacttttttctttattggatattttctttatttacatttcaaatgttattccctttcctggtttctgctctggaaaccccccccatcccctcccaccttcccctgctcaccaactcacccactctcactttttttttttaagatttattattatacataagtacactgtagctgccttctgacataccagaagaggatgtcagatctcattgtgggtggttgtgagccacgatgtggttgctgggatttgaactcaggaccttcagaaaaacagtcagtgctcttaaccgttgagccatcttaccagtcccgtcccccccactcccacttctggccccggcattcccctacactggggcatagagccttcataggaccaaaggcctcttctcccattgatgtccgactaggccatcctctacattatgtatgcagctggtcatgggtcccaccatgtgtactctttggttggtggtttagttcttggaagctcttggtactgattagttcatattattgttcctcctatggggctgcaaaccccttcaactccttgggtcctttctctagctccttcattggggacactgtgttcagtcccatggatggctgtcagcatccatttctgtatttgtcaggcactctgatcctgatcttataattataaaaactaattaggccagacatggtggcacacatctttaatttcagtactttggaagcagtgacaaggggacctctgggtttgcatctaggctgctctacattacatgttccaagacatccagggctacatagcaaggccatgtctttttaaaaaaagtaaaaaaataaaaaacaaaaaaccaagcacaggtcattggcagtggcagcgacgttggcagcgccaccgtacacacctttagtcccaatacacctatcgctgaagaggcagaggcggttggattttcgtgagttcaagaccagtctcttttaatagagctagtttaggatagccaaggtttcttaaagaaaccctgtctcaaaaacaaaaaaccaccagaaaaatctaattggtactgttaatggctcaggtacaacttacctagtccttgaacaacacattaatatgatacagtggagtatcaagtgagaatgtttaacgatcagaaaagagtgatttccttgaaaacagccattctggcccatctgggtggtagttcctttaattctagcactggggaaagtaggaggcagtggcagacagatctttgagttcgagcccagcctgttctacagagtgagttctaggacagccagagctacacagaggaacttgtgtggggttgtggaagaaaagaaaccctttttcatgtgatcaaacaaatgcagaacagggaaagcttgttacctctattggataatggtgccacagttagacatctgtgtacattataaaaaatagtatgaatcattctagttccatttaatcatcttcaaggaaaattgtataaaacacagtagttctctgtcatgcttttcaaatcaatactacagtataaagaagagttgtagcagtatcctttctatgatagcataattcccactggaccctcttctaaggtacacctggatcaaaattctgtggaagggggactggtaggtgttttaaggtttgatatggggcattttatatctattagagcctgttcagaaaaaggttagaaggtattcctcaaactcttcagtgacagtatgaggtcatagccttgaacatgcattagtaaactcatttacatgttatttttccatgactatttaagtggatgttagttcatgttcctaatgtatcacccccttccccaagagaaaacaatatattaaacataaatcatttccatttcagaactgttcgtcaagtggcacaggaacaattcttcttaatgtgcaccagatgttgcatggggcacaggcctctacttttcttcattacgctgctctttactgttttgggggtaagagatttaaaaatatgtttaccagtgtaattccttcaacaaggaatgatattctggaatttgtggatttagcttgaactagttagggcaatctatacttaataaaacaatagttaactcagggtttttgaaaagggaattcaaagtataaacatattgattcactatactgtattttatcattttcagagcacagccagagagagggctaaacactcaggcgactactttactcttttaagacatcttcttaattacgcctacaacagtaacattaatgtgcccaatgctgaagttcttctaaataatgaaattgattggcttaaaagaattagggtaagttgtagttaatactttgtttatattgttaagaaatagtgcttcatttataaatggttcataatttagaacattttaagcttaaaggggaccaaagaacatacattacattgttgggttttactttatagaatagaatgcattactacttacagaaaacatgtgcttaagatttaatacaagctaagcatggtaccacatgtgtttaagcccagtacttgggaggcagaagtaagcacatttctatgagtttaaggctacatactgagaccttgtcagtgggggtgggaggggttgtcatattgaggttcagcttttctgccttttatttagcaagttatcattttaaagaaattactgcccctccctgcctcggccaaaaaaaggtagtcaaatacactaactttgatcataagttgttgaagaccacatgaaaatttatttctgaggaaatctatagttgtattgattacttttctgtttctgtaatgtgatatcacaacaaaaataagggagagggaatggggtttaagagtccatcatattgccgggcgtagtggcgcacgcctttaatcccagcacttgggaggcacaggcaggcggatttctgagttcgaggccagcctggtctacaaagtgggttccaggacagccagggctatacagagaaaccctgtctcaaaaaacaaacaaacaaaaaaaagagtccatcatatcaagaaaggcatggcagtagaagtagggagctggccattcacattgaaactgaagaatccagaaagaaagaacaggaagtgagttgaaaaatcaaagccagcagacacacccttctagtagctaatgtatttcctccagcaagattccacctcctggaggtttctcaggtgtcccaatcagcactgccatctggggaccaagtgttcaaacatggaatcttattagggaacatttcacacccaaacttgaacagagtttagccttcagattagcacttctagtagtcaaagcacatgtatagaaatttgaaagtttaacttgcttgaaaggaaagcattggaagaattgtctaatatccttctagctttcttgttctgattcctccatttcataagttaataaatatttgatttttgtatccctttgacaggatgatgttaaaaggacaggtgaaacaggtgttgaggagacaatcttagaaggacaccttggggttacaaaggagctactggcttttcagactcctgagaaaaagtttcatattggttgtgaaaagggaggtgctaatctcattaaagtaagttctgtgttcttggttctaaactacatatcctatccttgtaagtattgtcgtttaatatgattgttagcactaggtctttggtgtatttgttatcatttttaatttttgatattataattacattattttctcatgctttcctccctctaatgcccaatatacccttgcttgctcatttccaaaatcacagcttttaaaaatatattttatttaatcttttttttttacactccagattttatccccctcccagtccaccctcttgactgttccacaacccgtacctcgtgtgtccccccaacccccgtccccatctccacgaggatgtccccactccctggggcccccagtctcttgagggttagacgtatctttgaacccagacccagaagtcctctgctgtatatgtgttgggggcttgtatcagctggcatatgctgcctggttggtggtccagtgtctgagagatctcagggctccaggctaattgagactgctggtcctcctacagcttgttaaccatctccttagctttttccattccagcttttccctaattcatccacagggattagcagcttctgtccattggttgagtgtaaatatctgcatctgactctttcagctgcttgttgggtgatttggagggcagtcatgataggtccctttttgtgagcactccatagccttagtaatagtgtcaggcgttggggcctccccttgagctagatcccactttgggcctgtcactagacctccttttcctcagttccttcagttctttcagacaggaacgattcgggtcagagttttgagtgttggatggcaaccccatccctcacttgatgcgctgtctacaagttccctctccctctgagctccctccctttgagtcctgagaatgtgtcacttcccaggtctctgctatattctggggggtgaggggagtctcctacctcctgagtttgcctgtttccattctttctgctggcccacggggcttcagtccttttccctcacccaatacctgatcatgttcccctcttccctttctgtcccctttcccatccaggaccctccttcccttccccctcctatgattgctttcttctccctcccaagtgggattgagatgtcctcacttgtgtccctcagcctgttaaccttactgagttctatagactgtatcctgctgattctgtgctttttttttgggctaatacccacttattaatgagtacataccatgcatgtccttttgggtctgagttacctcactcaggatgatattttctagatccatccatttgcctgcaaaactcaggatgtcctagttcttaatagctgagtagtattccattgtgtaaatgaaccacattttctgtatctattcttctctcatgggacatctgggttgtttccagcttctggctatcacaagcaaggccactatgaacatagtatagaacccatgcccttgtagcatggtggggcatcttttgggtatatgcctaagagtggtatagctggatcttcaggttgatctattgccaattttctgaggaattgaactctgtggcacaagaattccattggctcacgttctaagatcaggaattgataaatggagcctcatgaaactggaaagcttctgtaaggcaaaggacactgtcagaaggacaaatcagcaacctacaggcaaggaaaaaaaatcttcactaaccccacatctgataaagggctaatatccaaaatatatgaagaactcaagaagctaaccaccaaaaagccaaacaacccaatcaaaaaatggagtataaaactaaacaagagaattcacaacggaggaatctcgaatggctgagaagcacctaatgttcaacatccttagtcatcagggaaacacaaatcaaaacaaccctgagattccacctcacaccagtcagaatggctaagatcaaaacctcaggtgacagcagatgttggatgtggagaaagaggaacattcctccattgttggtgggattgcaaactggtacagccactctggaaatcaatctggagattcctcagaaaattggaaatagataaaacctgccttttaagaatttttaccaaggttttacaatgtttgtttagataatataaagcactagttagtgtctttcagtaaccattgcatgtttgtaggtgttatatgtatgtaaaatgtaagtgtaaagtgttacttagtttatgtctttatacctttaaaaaaaaccaagaaactacatgtttggtaaataggtaaaagtagaatatttttattagaaaatccacaaaaaatttctgtgatataagacttaaagacagaaattctaagacaaatatttctctttccagattatgtcactgctaatatttaatcctttctttcaactgtttaggaattaatcgacgacttcatctttcccgcatccaatgtttacctgcagtatatgagaaatggagaactccctgctgagcaggccattcctgtgtgtggttcaccagccacaattaatgctggttttgagttacttgtggcattagctgttggctgtgtgaggaacctcaaacagatagtagattctttgactgaaatgtattacattggtacagcaataactagtaagtacttttaaacatatggttatccttgacatacacagagccagtgactttgatgccctgtattccataaactaggcatggtattaatataatcccagcactggggagggggttataaaaaacatataaaaacaggaggatcttaagttgaatatcatcctcagttacattgatagttccagtccagcttggctatatgagatactgtcttataaacatacaaataggatcatagattggtaggtgagggagcctgcaatgatgtgggttgctgtcttttttttttcttttttaaagattttactttatgtatatgagtacactgtagctaatcttcagacacaccagaagagggcatcagatcccattacagatggttgtgagccaccatgtggttgctgggaactgaactcaggacctctggaagagcactcagtgctcttaaccactgggccacctctccagcccatggattgctgtcttaaatgcatttattaatggagaaatgccatgtgagagccctgcctcctgtgactgctcaggtagtagtgtctgtgttttgtcagcttaagagaacttaaacatcataaaatcacttctgtctttgtttttcagcttgtgaagcacttactgagtgggaatacctgccacccgttggaccccgtccaccaaaaggatttgtggggctgaaaaatgctggtgctacttgttacatgaactctgtgatccagcaactctatatgatcccctctatcaggaatggtattcttgccatagaaggcacaggtagtgatgtagatgatgatatgtctggggatgagaagcaggacaacgaggtaaatttcttttatcacttctgttctctgtgaaactcttgattaacaacattctttcattagataccaagggaataagtacagtcaccagtttccacaggattcccctccaaaagccctcaacccaagatggcaaaatttgccaatatacaagtagtctaaatggaacctacacaaatctattttcatactttaggtcatctgtagattacatcaaatctctcatacagtgtcttatataaaagtctgggcatacttcgtgaacccacagataaatgttagtggatatgaagatttgattgtgttgtgatttccttccttagactgtccaaagtatgtttgaaggttggcacagcctctgccacttgggctacctcttagtggagtgtgtctccattacagcagttacaaagaatccatctctttgaaagtagtgtttgatagaagttgaaatttaactagtttaaatcgacaatggccaaccttttggcttttctgagccatattttggaccaaaatttgtcttgtgccacacttcctttcccttcccttcccccttttttgtttctgtgattttttttttttttttaaggtagtcttgctatgatgtccaggctggcctctgaaggtctccagcttcagttttccaggtgatagggttatagtgtataccaccacactaggctaagtttttcacttttatctgtgtttgctcccttttgcttacacttatattttccctcaagtcttatctcttcctgcttaaaaacaaaactcttgcctacttcaaatactgtttacatgatcttgtgacaaaagtttaagtttcatgaaaagtaaccaaagcagagtaaagcaatgggaaaaaatgtaactggtaacaaccagtaaacgttgatggtgggggggctggtgagatggctcagtaggtaagagcactgactgctcctctgaaggtcctgagttcaattcccagcaaccacatggtggctcacaaccatctgtaatgagatctgactccctcttctgatgtgtctaaagatagctacattgtacttacatataataataataagtctttgggccggagcaagccagaggtcctgagttcaattctcagcaaccacatgatggctcataaccatctgtacagctacagtgcactcatatacataaaataagtctttaagaaaaagttgataaccgtcaaagaagagaatgtagcagtactgaagttggttcttttttgtacccacactgtgtgtctgtgttgtttgttgttttatccacgtttatagtgttagactcccatgagttgtatttttattgtcataagtgtttttagatattttttcttttcttcccttcattcagcaaaattggacttggtctgaagaaagagcttactacctctggggcttctaaaccaactctttcccagacctcctgaacttagatgatccagggattggggactgagtatttttactttctcccaaagcttcatatggggagtttacatccaaaacctggttaggaactttattcctatactcaaggtttcaaatacaagatgtccactgaagtataaatttttctctgtagccctcaaaattttgaaccttggtaattttcatgttataccttctaccactatttgtgtttaacttaaggttctggctatgtttcccaggttgcccattaccttctgggctagccttagtagctgggattcaaggcacatgctcttgatgctcagctttattacttgttttccaaggtcttaaaatgtgcttcctcgccttagctcctatgaatactgcggccatgaacatgaatatacagaaatctcttagaccctgcttctagttcttagcatagtaggtattgtggttgagtttaaagtagaacatctttgaacaaaagctccttaaatctttctgctcgtttttttttcttcaaagcagtgtttctatgtagttctggctgccctacaacttgctgtgtagaccagattggcttcatactcacagaagtctccctcctaagttctaggattaaagacttgccagctttttgtattttaaattttgaattgtgggtttaaggagtcctctgtctattcaggattctacctcctcatcagataagtgattttccctttttcctcccactctgaattcattgcctctcttggcagtatttttatataaaagtttttcattttcttgagatccaacttgtttgtaccttcaacatcatagtaagaaattgttatcagctacaatgtcttaatgattttgccttccaagtttggttttattcttttaactctaacttttaggactttggtacaaattgttttttctatgtaattttaaggagagctcagcttcattttttttataactattaatgtctatattctcacatgaaatggcaggaacaaacactaactgtaaattaaatgtatacaccttttgaaaattaagtgcttggaaacaaagtaaaagtgtatgttcactaactggaatttatctcaacatattttactaaacttctgattagctcattaataatacctttttggtttctagagcaatgttgatcccagggatgatgtgtttggatatcctcaacaatttgaagacaaaccaccactgagtaaaacagaagataggaaagagtacaatattggtgttctaagacaccttcaggttatctttggccatttagctgcttctcgactacagtactatgtgcctagaggattttggaaacagttcaggtaaagtagatggacagtgataaaccacatatcttaataaatagctcatattcctaaaatatgtatcttaagatatctttatgttctagccttgattatgaaaatataagatgcatatacagtagaattatcgtaacatatattccttcctactactttctaaattattttgagacacagatcacagataatagtttcacctataaatacttcattgtgtgtctttgttttaaaacataatgaatctattactgtgctttttaaagatcccttgatattgaatatattcagcatttcaactttcccattatctcatataatttttcccaaatctgaaaccatgtgaaaaccatatagcttaaatagtattttctctcttttttttcctgcatgttctttaaggtgcccagtgagatccagaggcttgatcagattagcatatttttggttttgtgcaggagataggcatggctattagatgggtgatatgcctatatagttttacctccatgaggagttggtacatggcatttttctgcctcttctgatggtagcagcaatcatattattcagcttatacaatgaaattcttccagctgttactctatcaaaggaacaggttaatttagagcagttttgatgatttgaaatccaagattgaacatttgaaggaggaagattcattgattgccttttcataatgatatagaggcccactattgctggattgtgtgtaggagaaaaaccatgaaagaatagacaaggccaccgtgcgatggtggcgcacacctttaatcccagcactttgggggggggggtgcaaagggaggcggatttctgagttccaggacagccaggtatacacagagaaaccctgtctcaaaaaaacaaaaaaaagaatagacaaggccaggcttactgtttttataatattcatttggtgagaacagtctttagcttatatagatggtgagacactgcctcaccggctgttttgctatccatatcatgtttcctatagttttacagtaaatacagtgtgctgctctagaaggttgattggggtgcttggtttttttgctttgtttttttttttttttttgtttttaagtcagtacctactgtgctatagtacttcagtaagaaacactacactctctaggtggtgtacacttgctaggctggggggtggcagcagtggtgccacatgcttttaatccctgcaatcaggagacagagtttgagcccagcctgatctacatagtcagttccggacagctagcgctacacaaagaaatcccatcttttaaaatagagaaaaagaaaaaaagtcactgtactcttcatagcaatatatagtgttttgttacttaaataagtactatttcagggtgcaggggatacagttaagtaatatcatacttgcctagcatgcccaagggccttaactcccatccttagcagtgaaaaacacaactcttccaagggacctctaggcagctgacagaactagatggttgcctatcttcccctgcttctggcagagtgagaaagaattgtttttttatactcccagcaacaagaacaattgcagtttcttatagataccctaactaagcccctacttagtcgacactgggagcttgcctgtaacactttattcaatattatcacccagaaacacccccattcctcttctcagtctatacatcctgttttgcctctctaagacttttctaaatccaaaatatcttcctgttattctaagaattgcacactttctcaccttttatgctgaaatttgtctcttgattatagttttccttcttgtattttgttttgtggcttagattttggtgttttgaaatttgttgttatttgagacttgtagatagcccagcctagccttgaaatcaggattcccttgcctcagctacctaaatactaatattataggtatgtaccacagtgttaggtatttttatctcttcttacatgcttggtgttttctgttccatatagtagttaggtttgtatgattggttctttgcaattatattcagattaaactttggagagagcaagaaagaaaagcacattaatgatgttgtaggcatctaattgcacatgcatgagcatctgttcacttaataactcacgataagaactggtacctcggtgtcttaacaaatgtctctgttgtaaggggtatatgtatttcaaagtgtggtgaattgtgttacagcttgaaagtaaatagagaagactagtgttatttccaatagtgtaacaaataatagatctgattttttgttgttgtttttgatttttgagacagagttcctctgtgtatccctggctgtcctggaactcactttgtagaccaggctggcctggaactcagaaatccgcctgcctctgcctcccaagtgctgggattaagggcatgcgccaccactgcccggcctgaattttttttttagtctatggcatatataaagtacatttgtcataatctcttgggaagaatacacttaggtcctctgtgtgtattattctgtgactacaatgtcacctgtagattccatcagagccttactgaagcaatggctattctcagtttgtgttatatacatatgtaggaatgataattttggaattagtttatctaagtccttagaacactgaaaagagattaaatagaataaattaaatagaataaatcaagcttttcttttttcacatagaaaaatcagcttaatgaatgtacatgtacacattctttttgtctaatccaaaatgtggcaaaatgcttagtgataagatccaccatctcattttaatggcatctacagctgagttcaaaatgcatgtgtatgtcacactatctgaagcaacaacctttctttcttagggctatgctgtttaccaaccataccattagttctgtggcaattctttgccattttaataccacttttactatgggtctcactgtccccctcaatatctggacataaagacttttttgtgtttcctacttgctccataattgccttacccacaactgtaagaaacaaaatgttgtattgtggttgtcacatgttacatgttatattccattcatttctcaggctttggggtgagcctgtcaatcttcgtgaacaacatgatgctttagagttctttaattctttggtggatagtttagatgaagctttaaaagccttagggcatccagctatgctaagtaaagtcttgggaggttcctttgctgatcagaaaatttgccaaggctgcccacataggtaagtgctaatatataatactgtgatatgctaataagaataaaatctttactagtgctaatatgaaaatggaatatgccactattaaactcctacaactgaataagtacagtgaatatcttaatactgtttgatggttttttgtttgttttgttaaataacttgatttcttttggtgtttttaatgtcttactatttcatacttttaattcttttatattttcctaaggaactaagatgacaatttgcataatgactagagatattacttccacgtttgccttttatcttagaatttagttactgtagatacactgagtttagaggatgacaggctacaggtgttatttttttaatgagataatcacttttgaaacaatatcagctattgccatcttttccctacacacctaatatcatcatattaaggtatgtatacatacaacatactgtaaaagttaaggtgaaaacgtcatattttgttgttgttgtgatggtttttatttttattttttttttgagacagggtttctctgtgtagccctggctgtcctggcactcactttgtagaccaggctggcctcgaactcagaaatccgcctgcctctgcctcccgagtgctgggattaaatgtgtgtgccaccaccacccggaggtttttaattttaaaggaacttttagtaaaggggcttttaataactcttgtctgtagcttgtccctaaggcaggaagattacaaaggtttaagaatacctattaaaaatagctaagggactggtgcagtaactagagtcttaagagcactgacagctcttgcaggactagagtttcagttatgagcacataatgttggctcacaaccatgagtaaccttagttttggcagctctgatgacgacctggcctcctcaggcagtaggcatgcatgtggtacagatacataatactcatagttaatagaagacaatctatatccattctctctgtataaaatattaaatatgcattactgactgtcaaatcacaccaacgttctattacagtgctataaggaaatctgttactgtgtgtgtgtgataatttaaaaattggaggcgctagagggaggtccaacttaataagaactggctgttctgccgggcggtggtagcgcacgcctttaatcccagcacttgggaagcagaggcaggtggatttctgagttccaggacagccagggctctacagagaaaccctgtttcaaaaaaagaaacaacaacaacaaaaaccctggctattcttgtagaagacccaggttcaattcccagcacccacctggagacatacaactgtctgtaactccattttcaggagatctgacacctcctcctggcttctctggacactgggcatgtacagtatatgtagagatacatactggcacattcatttttgtaataacataaaataaactagagctcaacagttacaagctcttgctgctctccagagaaccaagtttagttcccatggcacacaaactccaaggaatccaacacccttttctggccttgataggcatacaacacatggcagacacacaaacttacacataaattttaacaataacaaatactttttaattgggggcagtgaggtggttcagctggtagaggcatttggaggttcaagttggcaaagtgtcaggagagaaccaacttgacaaagttgtcctctcaacatgcattgtatatgtaatagcacctgcagccacacacactataaatagtgcattttaaaaaatagttttcagccgggcggtggtggcgcacgcctttgatcccagcacttgggaggcagaggcaggcgaatttctgagttcgaggccagtctggtctacatagtgagttccaggacagccagagctacacagagaaactctgtctcgaaaaacaaaacaaaaaaaattcgttttcggtctggtgagatggctcagcggttaagagcacgactgctcttccagaggtcctgagtccaattctcagaaaccacatggtagctcacaaccgtctgtaatggaatccgatgccctctactgctgtgtctgaagatagctgcagtgtactcacataaataaaaataaataaatcttttttaaaaagaatttgctcactctatatatacatacttaattacttttggtagattggcataattgagcactttccacaggggcccataattattctcaaaacaaatcacaacatggtagactaaaaagagcttaagctcaagtagccctgtctttttgtttgtttggcttggttttgtttttccaagacaggtttttttctatgtattcttgggctgtcctagaactaaaacaggctgaacttgaactcagagatttgcctgcctctgcctcccccagctggcctattttcattcccacttcactcaagtgtggatggtgatagttctcaagtaattttgtcacgaaggcaaaggacagcatgtaatcaaccagcatagtgtaaataactaggaaatgccgtcagtattggtaacatcccattaccttagaggtttcattaactatgtaaataatgaggtgtttagagaactgaagagtgaatccttttctgataacttcttaaataatatctttaggtacgaatgtgaagaatcttttacgactctgaatgtagacattagaaaccaccaaaatcttctggattctttggaacagtatgtcaaaggagacttactagaaggagcaaatgcttatcattgtgaaaaatgcaataaaaaggtatgaattaatctatttagataacaatggtacctcttaactgaaaagctctgggtagtcgatagtttctagtgaagaaaaacagttttctttaagagagagagagagagagagtgtgtgtgtgtattttaaaggaagaaatttaaaaggtaatactagaataaacaaaattgtaaaattgtaatcgcttaatacctttgtttatatgaattaatatgggtacatttgtttctgcctagaaacaaactccagagctgatggaggaaaacatttttcctcttatatccagaattgttttgctgaaattatttttttaaatacagtaaaaaaattttttaccacctgattagattttgtccattggaacttctctcttcaagggagagggacattcatacttaggaatagtaaattatgtttatcttttctgccttccaaaccattttacctctaagtcacctttattgtttggccccacaccacttagagaaggatgaaagtctgtacattgggattatggggtatgaaacaacaccgtctaccactgtaggttttgaggcatgagacaagttcctaaacttagcaggacaccctatcttaaggttcagtagtgccatcttaggaggattgtaaggattaaatatgttatcacctgtataatattaactaccttctaattgcccaataaaaagtaaactattcagtttgtttacagcaaacaaccttagttggaataactataaataacaaacagtggctaaaggcaaaggtagtatagaaactaggcagtaaataatatgtaaaggactaatttttgcaatctgtattaaccggttataggccatttccagttaatatttacatcaacttcacagaaatatcttaagattacaattcaagtaaatcttataaaaacttgatgtgtagtgctttttaagagtttgcttaaggggctggtgagatggcccagcgggtaagagcactgactgctcttccagaggtcccaagttcaaatcccagcaaccacatggtggctcacaatcaactgcaatgagatctgatgccctcttctgttgtgtctgaagacagcgacagtgtacttacatataacaataaataaatctttttttaaaaagtgactttgcttaagaggctagagagaaagctcagccatgaaaagtgcttactgcttttgtaaaggacttggatttagtttccaacaccaatatgtcaggcagttcacagtcatctatggttccagtttcagggactctaatgctcttgtttggtctcagccaccagcacacacttacacataaaattatttactctaagagctacatatagtgatttacaactacagaagaaaagcccaagttccaggttcaggcctgcctaacttcatagtgcactaatctgaagccaactggaactataatatgaggccccctatcccaagggaaaaagatttaagagaaaaaagtttacttggtctcatggtcttgatggttcaagcctgtaacttcaaataggagactgaggcaagaagatcatacattcaagacctgtctgggctacagagcaagttcaaagccagcctgagcttaagagaattagaaatgtagctaaaggatgactgcttgcttaacatgtgtgacaccctgggttaactttcagatttggggatggtagtgtttgcttggattttggtttactttttgcaatggattgtatctattaattttctctattgattttaggttgatactgtaaagcgcttgctaattaaaaaattgcctcctgttcttgctatccaactaaaacgattcgattatgactgggaaagagaatgtgcaatcaagttcaatgattactttgaatttcctcgagagttagacatggaaccttacacagtggcaggtgttgctaaactggagggagataatgtcaacccagaaagtcagctgatacaacagaatgagcagtctgaaagcgagaaagcaggaagcacaaaatacagacttgtgggtgtgcttgtgcacagtggtcaagcaagtggcggacattactattcttacatcattcagaggaatggaggggatggtgaaaaaaatcgttggtataaatttgatgatggagatgtaacggaatgtaaaatggatgacgatgaagaaatgaaaaaccagtgttttgggggagagtacatgggagaagtatttgatcacatgatgaagcgcatgtcgtacaggcgtcagaaaagatggtggaatgcatatatacttttttatgaacgaatggacacaataggtcatgatgatgaggtgataagatacatatcagagattgctatcaccacaaggccccatcagattgtcatgccatccgccattgaaagaagtgttcggaagcagaatgttcagttcatgcacaaccgaatgcagtacagtctggaatattttcagtttatgaaaaagctactgacatgtaatggtgtttacttaaaccctcctccaggtaagtgtcaagagttcgcttcttatagcaaagagtaattcttatctttaagatttattagtaggctgtgtgtgcgtgagtgcgtgtgctgtttttttaagatagggtttctctgtatagctctgaatatcctggaaatcatgctgtcggccagggtggcctcaaactcagagatcacttacctttgcctcccaaatgctggaatcaaaggtgtgcaccaccatcgccctgctatctttattcatatctataaatgttttgcctacatgtatgtctgtgctatatgcttgaattcttgaggaggccagaaaaaggtattagattcccctgggactggagttgctgtgtgggtgctgggaacttacccttggacctcagtaagcccaacaagtgctcttgattgctgagccatctctccagtcttcagtcccctttttttggcaggtgaaggtgtgtgtgtttggttggttttttttttttttttttttttttaagatgtttctttgtcaccctggctgtcctagaactcagaggtctgcctgtctctgcttccggagtgctagaattaaagctgtgtgccaccatgccctacttaaatatataaaattaacattttcattttgaaaggatgtaagttgatgcttttggctaaaattacatttaagatgatttgtgtttgagtactaagtatttattgttatactgtttggagataagtttttgtttgttcaagctgatttttgtttaatgcattagtataaagcattgtatttggctctaatatcagtaataataatttcataagtagtctaagaagagttttaacaaagtgagaatgcaaagtacaaacttgtttgaaaatggggcttgaacagacttttaaaatatgtgcatgtggttttttttgttttttttttttagggcaagatcacctgtctcctgaagcagaagaaatcactatgattagtattcagcttgctgctaggttcctttttactacaggatttcacacaaagaaaatagtccgaggatctgccagtgattggtatcttgttttggatttttatttctgtttaagatttggtggtggtctttgtagagtgctctgtatttttttttcagaatcacaagacttttattcaaacttaagaggcaacatttaaaaagtatatagtaataagaaatcatactaaaatacttggcataaattcaaagggtaaaaatagtatagaggccattataatacctttttagcaattgttatttactcagggccattgatagggttcagtggtgaaagctcttgccaccaaaccttgacaaaactgagcttaagcccagaaccaacatggtagaaggagagaacctgccaggcagtggtggtgtacgcctttaatcccagtactcaggaggtataggcaggtggatttctgagtttgaggccagcctgggatatacagagaaactgtatctcggagagaaaaaaaaaggattcctgccaatagagtccatttccctcgcgtgcgtgcgtgtgtgcgtgcgtgcacgcgcacacacacacacacacacacacacacacacatgtgtaaaaagcctctttacatatccagaagatactatactaaggaaagaagttatttttgtcatttttttggagacaagattactctgtatagatatcagtattttgaaattcactctgtaaaccagactggccttgaactaagattcccaaattctgggattaaagatttagaggattaaaccacctctggctagtagtggatttttaaatacaagcttttgccaattttataattccataagactaggccaatctatatagtatccatctctctcctcctcccctcaatgtccacttcatcctaccccaccccatacacacagggtttactataagaaaggtgaactgaattgatagtctgatagttgtactttgttttgttttaggtatgatgcattgtgtattctcctgcgtcacagcaagaacgtgcggttttggtttgctcacaatgtcctttttaatgtttcaaatcgattctctgagtaccttttggaatgccctagtgcagaagtgagaggtgcatttgcaaagctcatagttttcattgcacatttttccttacaagacgggccttgtccttcaccttttgcatctcctggaccttctagtcaggtaattgtacctttgtttatatatgtatttacaaaaaaaaataaactttcctgaagttgaagagaaacagaatgtgtgttttatgtgtagcacaaattatctgacacctagactgataaagcaacagtgtgtgtagataatgtcttcaaaagataatttcccgccaggctgtggtagcgcatgcctttaatcccagcacttgggagacagaggcaggcggatttctgagttcaaggccagcctggtctacagagtgagttccaggacagccagggctacacagagaaaccctgtttcaaggggtaaaaaaaaggataattcccttttgtgcttgctgacaatgaaaactggagccttgagtatttaggaatgttatctaccactgaagcacaccccagcccaacccacgttgtgtttccatgtgggattttcataacacttcttttgggtggatctttaataaacatttttggtgttaattgcagcaaagtgaaaaatctataatgaattccaaagctgggtgtggtgccacaacagtttgtggtacagacctgtaatttcaactgctagagaattgcaagtcagctcgggccaacttagttgagatggtttcttcaatagtaagaagagatcttggtagataagctcagtggcaaagttcttctctaccattagcatatacaagtcctttgggtcaatctagtgttggtaagcagggtgaatagaattcatgtgatcagtccttccagaaaagtattcttatttcaacatacacataaaataatctttgcactttgttgagaatcagctagtattttctcctttacaggcttatgacaacttaagtttgagtgaccacttactaagagcagtactaaatctcttgcggagggaggtttcagagcatggacgtcatttacagcagtatttcaacttgttcgtaatgtatgccaatttaggtaagaattaaatttttcataatctctgttaaagtatcatgttaaatgatagtcattcagaaggtccaatgatgaaataatgttttttcttttttctttatatgaaactgtctctaaatacagaatatcctttgcccgaacccctgtgcactttataattttttacataatacttctgtggtaaacacaagtgagattctattgtcttaagttttgcttccaaaaagcaatactacatctacctgctttattaatatactcattcccaggcgccatccaattcactaactgaatcagaattaccacagttagtgcaaaaaaaattccatgtttttactgtgaagagtcatcaattttggaataaggtctagaaaagaagtaaaataaattaaaattagaggaaataatgtccattcaattagtgctagcagtataggagagcacttttctcatactaattccaggtttgatttccagcatccctaataattttttaaactaagaattgacttaaattactccttgatctttctaatactacctgctcattcctgttatgttactactagaactgtacctaaatatcatgcacaattgtcttccactgttttattttgttgcaaaagattagattgggggacaatagttgtctaacatggacattttcagcatcaaaggatggggtacgcctttagtttcagtactaagagaggcagacagatctctgagttaatttcaaatatttgtcctttttgttttgttcacaaagttcattccatcctaatgttttctttctctgttttcccccctctctacttgctttctgtctctctttcactgcaggagtggcagagaaaacacagctgctcaaactgagtgtacctgctacctttatgcttgtgtccttagatgaaggtcctggccctccaattaaatatcagtatgctgaattaggcaaattatactcagtagtgtcacagctcatccgctgttgcaatgtctcttcaagaatgcagtcttcgatcaatggtaatctattcttggcaatagttttgagtactctgggtcatatctagaacttgatcaaatttggttctgaaaatacttaaatacaaagtgagggtgtgaaggaaggtccactcttgaaacattttacaatgtttgcagtactgttcctttttcacatgattattggacccttttctgcttgctactggattaaattagtaaaatttttatgttgggataccgagtcattgaaacacactactattcttagtgcttagaaaaattgacatacagctctttttttttttttcctaaaacacatttataggctatgttctgataagtttacattgttattgtggagacacttactggttgttaattgacaaatctgtattgtaggtaatccttctcttccaaatccttttggtgatcctaacttatcacaacctataatgccaattcaacaaaatgtggtagacattttatttgtgagaacaagttatgtgaagaaaattattgaagactgcagtaactctgatgagaccgtcaaattgcttcgcttttgctgctgggagaatcctcagttctcatctactgtcctcagtgaacttctttggcaggttaagaaatcataaccattgttaaatctctatgatttgatttattacccatatgtactttattcactgtgtcttaacctatttctaggttgcatattcttatacttatgaactccggccctatttggatctgcttttacaaatcttactgattgaagactcttggcagactcacaggtggatactttattttttttttatcaggctaattagacttagtcccggctgttacatataatagaaattgaccatccccacatttaacaaaatatataacaaaagcaccctagggttctagtgaatgttcagtgttacaagaaaaaactcaagacaggaatgactaccaagttctcccagattttgtcagtttgtttttgttttttgttttttgtttttttttttttacaatgaggacattgcccaggtttcatacttaatatattaacatcatgtgccaccacgcccggctctgaattttttttttaattaaagaaaactagcaatagactttatacatatgaatttattaataaatccaaggattgttttaggtttagattacattacttttggaactaacctcattacataaatctgtagttatttagtgatagttctggagagcagagcataaagacacatgcttttaattccagtacttgggagataggcagtcagatctctgtgagttcaaggccaatcagggctacaccaagaccttgtttcaaggtggctcagctgaatttaatcccatgtggttgaagaaaagcaagttccctccagctgggtgtgtacgcacacaccacaaacacacccacatgaatgtgtttggggtgttgtggtggtggtagacttttttggttgttggggtgttggggttttggtggttttgttttttagtatcttaataaatacgtactgctaactcattaacattgaacttaacagccagcactcttacacctctcgcctagtgtaagcttctttagtgcacactttctgtaagacaaacttcagtgctatacatgaaggccaattataacagcaaaagaggacacttgtttgtagtttgaaactgaaacaagacaaagtcactttattcaacctctactaggaaattgtgagttctgggcaacttgaatcatttgctaacaaagcacattaagtacttatttttgttttggggtttttgtttgtttgttttttttatgttggacacacaaggtttcgctgtgtatccaaaactgtgctggaacttactctgtagaccagttagacctcacagagatctgcctgtatctgcctctcatgtgctgggattaaaagagtttttaagtattgatttttaagattagccattctagtggctatagagatgactgggtcattaaaaatacttgttcttgtagatgaccaggtttggttccccaacactcacatagtggctaagatacccaccaggcatatatgtactacatgcaggaaaaaacacttctacatataaagtaatagaaatattttaaaatacaaatgttttttatcattgttttaaattactgttataaaaatagcagtaagcaaaaaatcagttttcttgaatccaaaattttctaagtggtcaccattgatacttcttagatgattttaatacagtctagcttctagtatttttcttttaaaaatagcacaagccgggcggtggtggtgcacacctttaatcccagcacttgggaggcagaggcaggcagatttatgagttcaaggccaacctggtctacagagtgagttccaggacagccagagctatacatagaaaccctgtcttgcaaaaaaaagcaaaaacaaaagaaaacaaaatagcatacgattgtatagctttaatggtgtggtagcatatttagaccttcaatcatattattccaagacagaggtaggcaaatccatgtgagttccaagccagtcaaggctatgtagcaagacatagatagatagatagatagatagatcgatctaagttctcttttagcatatgatatgataaaaacataggttggattaaatgtgagaaataccaaaagtagtaagtaaaaacagatgattaacttaagtttgaaaataatcttatactgtagcttttttgttttgttttttgttgttgttgtttttagtttggtaagtaggtcttaagtatttataatgtcctccatgtgtcctacattattagacatgaaggaagcaacacaaagatagtactgattaaagatggtatttggaaaactgttggtattagtgggaagaaagtatgatatgtcaaagtaatattctaacactttatatcagttgacaaaataaaggtaaggttagggtagcttactggcagagcacttctaaaatgggttagaccagccctcagcctctgcactgccacccccaacacaaaattggagaaatagagtttatatgcaatatcttaggtcaaacagcaagaagcctataaccatttagacacccttggttactcctggcaacctgcttgcttctataactgtgcctgttataatcattttgccaaaatacaacatttagcattttgtgtctaattacaaggatcctttgcatacagcatgtataggttcctttctactgctcagtaatacaggtagatgtcattttgtttattggcagctaatgtctaataaaataaacaggccctgggtatggtggcataagcatgtgatctcggcagtttggaggctgaggcagtcatattgagaggtcaagatgattctggtttacataatgaaaccctgtctcaaaagcaaaagacaaaaatgacttaaagcaagttattgtcaactacagtgtcagtgttaacttttaaagtttgttactcttgagttcagaatttgcttctagtgatgtatttaaacaatgcaatttgaacaagtaaagttagtaaggatacagacttgagtcaggctagttggcaactgtatgaccctaggcaagctgtttctatctcctcatctgctcaaaggtttaatagtggtacttactgtctattaggaaacaactgaacccacagacatttacggggtagcatgtaataaacactcaatagataatagcttcttttaatttttagaagttttatcttccatctgaaatgtttttcagaattcataatgcccttaaaggaattccagatgaccgagatgggctgtttgacacaattcagcgttctaagaatcactatcaaaaaagagcataccagtgtataaaatgtatggtagccctctttagcagttgtcctgttgcttaccaaatcctgcaggtaagggtgttttcttatttcatagaaatttaaattggagttaaaagatcctgttttaaaaggctgtagctctgatatactgcttacccagaatgtacaattccccaatatgacaaagaataagaaaggaatgaaaaatagcattaagatactattttaatccaggtattggggcggggtgaggtacacatctgtaatttggacattagaggccaagtcaggggaacaaccacaggtttgacaacaacctgagctatgtaacaattaccagacagccagagttgccatggcaagactatttcaagaataaaaaatatcctcagtttgtgggattatcattttaagttatctatgatacactcccaatcctcttaaatgtacatgattttatttacttttgaagggcaatggagatcttaaaaggaaatggacctgggcagtggagtggcttggagatgaacttgaaagaagaccatacactggcaatcctcagtacacttacaacaattggtctcctccagtgcaaagcaatgaaacatcaaatggttatttcttagagagatcacacagcgctaggatgacacttgcaaaagcttgtgaactctgtcctgaggaggtaaaaaaagccaccagtctacaagaaatagaaatggaagaaagcaaagtaattctttataggccactgactgtattaatgatagtgtcgtttattaggattgctagacttgtgtttgcttttaatatgtagtaatatattgatgatgatgatgatgatgactccatctggagaaattactgtgctgtaactttagaaattatttccaagagaacccgaattatgaatttttaattgttttttaaaccttcatgtgtatgggtggtttatctgtacaccatatgcctgcctggtgcccattgaggcctgaagaaaggatattggatcccttgaaactggacttaacagattgttttgagctgtcatgtaggtgttgaaacttgaacttgggtcctctagaaaacaagaagtgatctttattaaaatataattatatcccccccccctttcagctactcgcacacatcttcttgctctgtctcagatccatggcttctttttctttaaatgttacatgaatctgtattcctaaatctataacaacctgcttagtgtatataaatttatttatatgtttatgactttaggtctaaccatttgatattggataatcaattgggggattcttccctggggaaaatggttttctgctttcagcattccttgtttgcctgttgaagactcatggagcttcctccatccatattaacatgtccattgtttaggcagccatgttgttgagactgcttggatatacctttcttttttttttaagatttatttattatatgtaagtacactgtagctgtcttcagacacaccagaagagggcgtcagatctcattacaaatggttgtgagccaccatgtggttgctgggatttgaactcaggacctttggaagagcagtcagtgctcttaactgctgagccatctcaccagcctggatatacctttcctgacatttctaggcaacatagttcacgcctgatttcctgtccccttggcccttacaatcttctaccccttcagtgtttgggaaggtgccctgagcattagatatagaagttataatcacagtttctaagagttgttactaagttaaccaaatcagcagtaaccttgatgttgcctttttttttaattaggaaccagatgaccaagatgccccagatgagcatgaatcacctccaccagaagatgctcctttataccctcattcccctggatctcaatatcagcaggtaaacaggagtcagatggtggggttaacctctacagtggttctc

SEQ ID NO: 271 - DNA, 119558 bp, mus musculus
tgggggcggagaagcgctgagccttgggcggtgctgagactagtgggagtctgcgctgccgctgctgttgctgccgccgtcgccgccgcctccgacactgccaccgccaccgccaccaccaccggccgtgcgggttttctttctttttctttctgtcttttcttttctttcttgatttgttgggttcgccatattgacgaggctgtggtacccaaggctgcggaagctagagtccgccggtggcggagccgcaagctctcggtaaacggcccattggggccctcctccctgtcccagcgaaccccctccctgcctgcaccggctcccaggcctcgcgggagtcggccgccgccgcctcgccctccagggaggcggccgcctttaccgccccagggcttggggtgggtgacgggagtgaggacaggagcggtagctaagcgagcaggcctggagtggggggacagaggcggcgactaggggaaggtgaaactgccgctgcaggaggaggagcaggaggaggtgacgcaggagaaacgcaccgcccggagcttgtctgagctcagcgcccgagcctgaggggagaagggggaagagggctgcggccggccgagagggaggcggcggccgtggtcaccgctgccctagggcggccagggtgagggccagacccctggtcggtacgcgtcgcgcgtcgcgagcccgcccgccatccgcagcctctcatatttttgtccctcgccagcccccggcttgggatgctcccaggttaggcccggtcccgggatcgagcttttgcatctcgtctcccgcctccgcgtggcccgcttcgtaggagactcccgggttgtgtttggtgagtaccgagcccggcggcgcccagggcctccggctggctggagggctggggaggacggcgcgagggggtgtgtgtgcgtaagcggtcctcccttgggggcctggctgccggggttgggggtcgccccgagccccggccgtcgcgggcgcgcgcgagcctccgtggtgcgcgcggccggcgtcccgcgagcgtgtgtccgtgtccgtgagtgagcgtggcgctgtgtgtgcgtgtgtgttttggactggcagggaaaatggctgacggctccggccctcccccttcctcccccttccctgcctgacgggagtggagaggaggaggaggaggagaaggaggaggatggagactccggcgcgccgtgccgcccctccacccgcgcgggaggtcggtcgggagcgcgcgggggcgcgggcacggcgcgggcgggggcggggacggttggttcgcgcgccccttaacccggcggcggacgccctcggcctgttccacttgacaccgaacgccattactgaggtggagtgatttggagcgggagcgctaggccccggcgacgcctggctatcaggcccgcggacgagttggcctcctcgccgccctcccgcgataacccgcagtcgctcagcggcccagtgccctgagaaggccgagccggttatcgctcccccacacctccctcgccccctccggctgctcacggtgggccaaaggcccggaaggatgttttgatgccgaaatcgcttccaagcgacagtagaccgaccacctttgtatttttagctgttcctgaaggaggaggaaaaaacgaagacgaagaaaggaaatactagtatgtgcaagtttgtaactgataaaaccttgagatgctggtgatgtgaggctgcaggcttgataaatggcttgtttttcattcattgtgaaatatttaagttaaacaggtgcgaagctgggggttttgtttctgtttggatttcttcagagactggaagataagatttttagatacgacgtgcttaaattattttgaaagttctgtagttaacaccgttaattgaattttcacagccacagtttacaggtgtgtgtaattgccacagagggtcgttgattgtaaatgaaggaattgtggggttttggtaatatttttgtttctgttagtaggagaggcactcgaaataatttttttttaaccttaaaacccaccagccttgcatctctctttttttgtataatttgacttatgaagaattattttgggtgtacttacgtgggaactctgtagccagtaataaaagagctcattcgcttcatttattataaggattggttaaccatgactaggtttgacacttgagcttaattaaaaatagatactacaaactcttctttagatccttctagtctactaaatcatcaggctgccattttggcttcagcaaaatgtctttcaattcttagaagatttaggtattaagtatacagacatagcaacatttatttttgcaatgtttaaacttacttgctttgtcatacttgtgactttaaccctttatactttattgttccagtgtttgggtagaatgaaagccagaagtatttggaatttaatgtttcaagtgtgaaaataagaagcaaaagtatgttttgttttctcttactaaaaagtctgtcttttgagctatatgaatgtcttcatgctttttcttacccctcccaccccctacagaagtatgccgtcatcttactgttctgctgttgcttccttttgtttgctgaccttggtagaatcgaagggactatctggaagggttaaggaccagaacagcatggacaagaaatcttaggtttttttaaaatttttctgaaagtaactttgaagagatttcctccttaaatcatggagcatttcctggggatcccttcatttcctgcctatcagtggaatgctccatccagtaggatttaccttgggtcttttgtcttttagcatcttgaaatacatttcctgatactctctagaagagcaatttagtggtgtctcttcaatttcttttttgacataattataattaaagctacttacagatgtttgtcatatgccagtcatttagttattgatgagttagacacatgaaaacataatattcgtttatttttttctatttaatggatggatttttaaagtttttatatttctagaattttattattggaaccagtctttgtttaaagcaggtgagaggaaattacttgaactatatagtgatgtctggggctggaaaaccggctcagtagttacgattagagttcctgcagagaatacaagttggagttctagcatccacatcaggcagcccacagactgtaactccagttccgggggatctgacacccctctgacatgcgcacacacacacacacacactaatttaaaattaacccacatgggctggagaaccaatggctcagtggttaagagcacagactgctcttccagagttcaagtcctagcaaccacatgttggctcacaaacctctgtaataggatctgatgccctcttctggtgtatcagaagacattgacattgtagtcatatacataaaataaataagtaaataattaaaaaataacacatgtatatatatggattagtctttggtcccctatgaagtgaaatattttgtggttgttgaactacttgaattttattttaaaaacacaatacttttattattttgcatattatgtttcttttcttgctgataagttttctgaatcttgaaattgagaaacaagtctagtttccctttcattgttttaggatctgcatctttgagaaccatgttatttgttgctgtcttgtgcttttacaagtgtttgggaaggatttgcttcattcatactctggatgttagactcacttgcaagtggttttgtttatctgatatgggactgaatagaagctatattttaagagtactgtgaatgattctgatactgtatcagttaaaactgtggggctgttgcatattgttatagatcttttatagataaatacggaaatggagctttttctaactgctttccattttcaggataattagcacttatttagtattagttacactgctaatcatttaaacattctcatttattacattatataggtattattgttattataccagtggagggcctgccatctgtcatacttagctagtgggacttaagtttaacttaagtgccatattagagaaatgatactgactactattttaaaagaaatttagaacctttagtttgtttgttgattgtaacagagtagctttagattagttttatttttaaaattatcaaaattgatatttgaaaattagcttgattggccatggaaaatagaacaaataggtgtcttccatacctctactaatatgttcagaataataggttattagttagtgactttatgtctaaaataatactaggcaatttttacattcctgaaataggtttcttaggaattcatattatctcaacatacagtgaaattgtaattccagtttgagaactcagaatttcatttaatttaaaattttactttcagtaaaaaatttaagactaagggtttcttttagcatttttgtagtgttggttgttaatcatggaatgaaaatagccacaacagatgtttggtttatgtgccttgtttccttagggcctcatgattgctaggacagttaagtgctaccaccaagttacatctctatctctatgatcattctttttaaaaaagatttatttactttatgtatatgagtacagtatcactctcttcagacactccagaagagggcatcagattccattacagatggttgtgagccaccatgtggttgctgggatttgaactcaggacctttggaagagcaggtagtgctcttaccctctgagttatctctccagcccatctatgatcattcttaatatcatatcctaaatcctcaaatatctttagtgagtcttagaaaatggaattttattggtttttaaagttcttttgtattatttatgtttctgtgttttgagacaggagctcacaaacctaggctggatacaaactggctgtatagccagaagtgactttaaactgatcttctgcctctgccttccaagtgctggggttgcaggtacttgctggtacatcatctggctctgaattttcttacatagaaaaaaaaaagagagagagagactatgaaattttctgacatgttattggtgctaaaatgactagtatatttttagggaaaagataattggaaagtattctactgtaaaaatgagatatttacctaaaattatacttgatctttgccaaaaggctgagaaatgattaaaatttatatttcaagcacacctatgctaagtcctctacccatcataggtacatatataccttacatgtatattcagcaaatgacttttggttggtgttttcagactggttccctatgaagcacagattggcctcagcctcctaagtacatgagaatatagacctgccatgccacactgagaagtttccaattttattctgggtgattgccctaacagttgtttctctgtctcaactgtgtgtcagaatcatttgtggaacattttcaaagtatttttgtcttggtcttattctatagattaagcccaggacaagagagttattttgcagttcattttaggggaaagggaggatttgcagtcctgtgcattttgtgttttgttagcaatacacttgaacctaattttgtcaatcaatttctgacttgaactcaaatatagggagaagttcagcacttagattgattaggtttatgagacagtgattgcacaggcatgactcaaatgtattatttcacacattcatgagttttgggaaccttctcaattaaggtttctggctccagagttatgtttttaatatgttttaatgcattggctatttttatctatcacaaataattatttggtatttgctgtgtcctaggcattgttctagcaaatactattgtgtaaaaggagaggcgccagattagttatctataaagtcccacctaggctctaattgccatcatttttatgtgtgtcatagaaactgatttaggtagatataagcagtagaccattaaaccaatgggattgtcctattttcagtttctttaaaataacatagtctgaatttattttctctagtgaaggatgtatcaaggatagtgtaaatgaggttttgggtttttttgagacagggtctcaccatgtgtgtaaccttggttggtctgaaacttgatagatggaccaggctggccttaaactcaaagagatccacttgcctctgcctcccagtgctaggataccaagtctgttatgcccagctggatatgagttctttgagcattcttcacatatgggctttaggaattgagtctttactttcctacattgggtgcctttgtattaattcattttgtttagttgctttggttgttgttttcccacagatctgctcatacctgtcagctcttggaagcctgaggcaggaacattgcttgtgaatggaggtgatggacaatgcagggagattctatctcaaaattgtgtgtggtgtgtgtgcttttagggtcttttgggttgttggattctgtctacacaaactcagttctaagtcactcattgatagatccttagccctcagaaaatgtctggcacacccatttggtggacatagtcaattctctgtatttggttacatttatttatgagggggggagttcttgtagaaatcaagaggacaacttgcctttcaccatctgggtctctggaatgaaactcaagatacacctttctttgtccactgagccattttaccagccttcaacaagatttttaaaaaatacttttgctggggctagttccatggtttagaggatttattgcttttctaggggacttggattcagttcctatcacctacatggtgattcacaaccttccataactctagtttcagagaatccaatgctgccttctgatctctcagcatcaggcatgtacatggtgatcatgcatgttggcaaaaaaggaacttcacattaatcagtcattaaaatatttgctattttgatatttcccttcactagttagaggagtcctgacttatgtgagtgagcgggcgggcgagagagagagagaatcaatcacttggttagcctggagcttgctgtgtagtccaggctggcctggaactcagacatgggtcatcccaccccatccatctatcttatgtgtctgttaaatgcacacatggattctgtgcctttgagaccaaaagaaaacattgggtcttttggaactggagttatagttgtaagccacaaggtggcttgctagcaaccaaacctaggtcctctgcaagagcaagtactcttttggtttttcgagacagggtttctctgtgtatccctggctgtcctggaactcactttgcagaccaggctggccttgaactcagaaatccacctgcttctgcttcccaagcgctgggattaaaggcgtgcgccaccactgcccggccaagagcaagtactcttaactgctgagccttgatagttcctttacgatgaattctgcaatgaatctagtcttttgtttattttttgtttttcaagacaaaagagtttctctgtgtaacaatcctggctgtcataaagcttgctttgtagtccagtctccgagatctgcctgcctctgctttcccaatattgggtttaaaggtgtgcatcaccactgtactgctaaacctagtccttctgaacagaaggaaatggcccagtgagatgaagaaacataaccaagatagcatgtataatatagattaccttcttcatgaagttatttccataatgaactaataccagttgttttttaaacaaatacctttgccatcattcatcagttaatggatagttaaggtcagggattttgtcctttactttttattatttgcagtacacttacaacattattgatctccttgaatggcaaaattggggtcctatttgatttgcttgcagtaccagggattgaaaccaggccttggacatgctttagcaagtgttctctttgccactaacctgtatgtatctccaatgccattctttcatcttttatttactttttattttgaaacagagtctcacagacttgctgaggctggttttcattaaattcattttcttttatttttttatattatttttatttatacaaatacactgtagctgtcttcagacacagcagtagagggcatcggatcccattacggatggttgtgagccaccatgtggttgctgggaattgaactcgggacctctggaagagcagtcagtgctcttaactgctgagccatctccccaaccggaagttcattttcttttgactgactaattgtaaagataaatgtcacagggctgatattctgaaagagtttttaaaaagttgcatgtttattggcagggttagctaacccttgaacaaaacaaaaggaaaacttcagctgggcatgcaagcctttaattccagcacttgggaggcagaagcagagaccagtgttctcttgagtttgagccttgctactattctacatagctacatagcaagactttgtctcaaaaaaacaaaacaaaacaaaaaaacaaaaaggccaaaactttttgctcttaagtttttaaaaattagtgtatcttttttttttttacaaagtatttttacaaagtagcaagcctcaaactcaagagaacactggtctctgttttttcttggagacagtgtttctctgtgtagccttggctgtcctggaactcactttgtagaccaggctggcctcaaactcagaaatctgcctgcctctgcctcccgagtgctgggattaaaggtgtgtgccaccacgcccagcagtgtatcatcttgtacaaaatgaatttcattatttctaaatgttattgtgtactttgatcattatacctccttattacctgttcttgcctctgcttttctcatcctttttccaaattgttgccgtccttactttcatgttctatactttataatttagcttatcttctagaggtcagtatttttgttggcttgaaagttccttaatttatttattcactttacatcccaatatcaggttctcctcccagtaccccctcacacagatcttccccccttctctgagaatggggagcccttcctgggtgtcccccatacctgcacaccaggttactgcaggtgcgttctctccctctgaggccaggcaagttggtgcagttagagggacaggatccacaggcaggcaacagattcagggacagcctctgcttcagttgttgggggacctgcatgaagaccaagctgcatttgaaagtgccttaatttttaatttacattgaagtattactgacttgagattgtgggataaataaatgataattgttgccattacttttgttcattacttataccacccaagaaactgaggcaatgaagtgaagtgacttatagccaggatcactgggtcagtaaaatgctcaagaaagagtaggcacagagaaagccttcaagctaggtctgtttgaagccctgctccctctaccaaaccctacttatggcatggccaggttggaccacttctcccaccatatctgttggaatgaattggactgaacctccatacagatgttatcatttatgtgaacttttaacatgatgtaccatgttaatcaaatgttatcaaaggaattgttttccttcagatgattttgagctgttagtcttggatgttaaatctcaacctgtacattctgaatatggaagggaaagacgggggaaaaaaggtagagaaggggattcccattcctgtctttgtgccttgtgttttgctgactggtggcttttgaaagtcaacaaatattggtggttggttacaggtctctttttcttgtctttattctcaatcatatgagcttcttgagtctgtttattactttgacaccagagaacatggcagtagatgtttagacctgtattctaaccttaacagagtggtttgtttctgagcacaatagtgcaaaacgattgggttgcttttctttataataactcaggtcaaaggaaagattaggcaaaccttttctataagaggccagataataatagtttggactttgtgggccaagaggcaaaattgaggacattgaatggtatgttgaaataaaaatgtaactagacacattaagtataatataggtctaatgagaaaaagcaaaacttggtttgggagtataacatagtattttgttggttgattgcaaatatttctgtgttaaatctttcttaatcttgtaggttgatcaaaaaacaaacaaacaaacaaaccaagaggttggatatagtttgtcatcctggttttgcctgacctggtttagagaagtggttcccagacctggagggcttgtccaaaaatttctctgctcattcccagagtttatttcagttagtccgcagaggcttagaatgtgcctctaaaaagttcccagataggaaattaccccaagaaaataattccattaattctaccatatcctacttcattgatctattacagtgtagttctatattgaatattctgctttgtgcttaaagttcaattatatagtaaatgccagttattactggattgtactgtgtattaggaattatacaaggtagtaagaatacaaggttaataatcccagcactcaggaggcagaggcaggtggatttctgagttcgaggccagcctggtctacagagtgagttccaggacagccaaggttatacagagaaaccctgtcttgaaaaaacaaaacaaaacaaaacaaaaagaatacaaggttaaaaaaaaacccagagttgtcccaccctatattaaaatgaatttaaaattagtttccatatttactgcattagaatctttgagccaatacaattttgaaaggaggccagtgatgtaagctaaattggaaaactgcattatcaaatacagtgaaacttcatttgatataaaattttaaaatatcaaagttctctttcaagacaattaagctgtaatttaatatttgatggaaagctttcaggggtgttatactttttttctgattatgaaatgtagtcttttaggtagctagaaataaagacatccatcatcattctgccagtcattagttttagctctttactccacttctgtagataacttttttgttcaaaacttaacataaagttgattttagtatgattttacaactttatttcccactttaaaaaatgtcctattcactttttaacttttatttcccatactctttttttttttaaagacagtttctacttttttgtagtagtagtttgtttttctgagacatagttttatgtataccaggctatgctgtaactcactgtgtaggtgaatgtgaccttaaacctcctacctcctgaatgccgggattataggagtgtattgccatgcacggtttatgcagtgctgagtattaaaccagggctgtactaacaccagacaggtactacaccaactgagctatattcctagcccatagcttctatttgacagttgaacgtaatcaggaattttataaattcctccattctgagaatggagaaacactgttatttagctttgagagatttgaattctttgaaagaggacaaggaagtacacttgaggatggagtagtattttttttaatttgttttctttttgttgttgacttcgagacaggctttcatgtttctggtctcaaactcatgatcttcctgcctcaccttcccaagagctggtagagaatacaggcctgtaccaccatgcctgtctcgttttttccctccttaaagccagtaacttaagtgtaatctcttctggcctccagctccctgtgatctttgatcttcttgcttcagcctcaatcaagagtgctaggattatagtcaggaaccaccaggtctgactggggaaagtggttgtagtgtatagctgaatgaagactaaagaatcttcccatgaatttattttttgtgagagcttccccttcctattatgcattgaagttaattagtcatataaatgtaagctcggggttgttttaatgccctttcttcctgctttccccaaatacttctcaaaatgcttgcaccagatactgtgccagttccataagaaacaaaagtcattttgacagtctgcttttgcaaggttctttctcattctcagacctaattggtcagtagttggtgtagtaagtactccagcccttcataatccctgtctctgcaccccttcctctgtgtattaggtattgtaacaggttaataaggaatgtcttcctttccacctaccataccctcaacaatcccaaagacttagattatagttgtaactgctaagtggtgagactgtatttgatcttggtgaaattgtaaaaaaaaaattcaaacttaaactgattactgccttgctgtgatgattgacttaaattcattcatttatcatcattataggtgtagggagatataaggattgttaatttttttcattagatattttctttatttacatttcaaatgtcccctttcctagtttcccctctgaaaattccctatcccctctcctctcccccttctcccaacccacccactcccattcctgatcctggcattcccctatactggggcatagagccttctcaggaccaagggcctctcctcccattgatggctgactaggccatcttctgctagagccacgagtcccaccatgtgttttctttggttggtggtatagttccaagggggtactggttagttcatattgatgtaaggatcactattaacgtcttccttaaagaccctaggatgctggggtagacagttacctaagagctgtatctggtgcaaggaactggatatttactaagcgtgaggctcttgagctcaattctcagcaccaaaaaacaaccacaaaaagtgtgaaaaatatagtgataggagagattgctcagtttggatttttaaaatgaggcttacaaatcttgaaagatgtcattttgatgctgcctggattggagtaggaaccatcaggtggtgtttcttaaccttgatgttactgattaaatactatttgaccagatatttcctcgaggcatgctgtatacttactaattatctctgatttctacctatagaatttcagtaggacctttctccctattgtgatgacttataatggcttcaggaattggaaaagtgtgtaccaaatgcaaaattgagacctattacttgaaacaatacaatggcagaatgaaagcgtggttttagaggaaaaactagtatagcatagaaagaacactggtgagagtgagtcgggaggagttatgggagatgagacttagtttaaggctaggttacagatactatgttagggcatttaagtttggatttcataataagtgaagggtctttaagtgaaagacagtggtttctgggttttctttttaaagataattctgaggggttggggagataggacagtcattaaagcatgaagacctgagttagttaaatccccagaactcaaagtcaggtacagcaatgaggaaatagagctagatggatcacgccagcccttcctatttggacagttccaggcagatgaagagaccctgtctcaaaacataaggtgggtaatatctaatgaactatacccaaggttttcctaatctgtatacacaaacacagattctaagcatagcatggtagatatactgaagtagaaatgtagcagggaattgaaatagtattataatagttctttttaagtaacaaagattttggcaatgaaataaaagaatgggatcccacagggttctgtctttgtctctgtatggattctagggcaaaacaccttttaacttctcctagctccaattccctcccactaggagctgctgactgctgagacatgttgaaaggtcacagagcagaatctgggttataggactactcacgcaatgtgtacctttacattacagggtgaattatctaaatatatttatcatctttgtcctctacatgtaagaggtccaggacctggcatcagaaagagttaactataggctctccatgttttctttagctgttatcttgctactttaaaaataattgaatctgtaaaaatagatgaataatctatctgtttaaggtagctgtaattttattgcttatttttgtagggtttatttcctttctttttttaaaattttatttctttaatgtatgagtgctctgctgcatatacatccacctgcctgaagagggcacccgatctccctaaagatggttgtgagccaccatgtggttgctgggaattgaactcaggacctttggaagagcagccagtgctcttaactaattagccatctcctaatccccatgtatttgcttttttaaggagccctttttgtttttagtgagaattggggttattcagtggaagggtagagggagaagtggagtttggaatagtttttcaagtaaaagaaaatggaaagggtacaacaaaattgggattgacaaagtgcttgaagaacagagggatgctacagcttgaatatttccttagcctgtttctatacctacatggagtctggagagctttacaaaatccacattcatatgggctaattgtagttggccagtagcttgcagtgtgaatttagggaccatagatttggtagtgtagatgtataatttttgacagaacaacataagccatgattgaataatcattgctgttttgtggtgccaaggattaaacgcatagttcatacattctaggcaagcgtcctattactgaggtatgtccctagtcccaagcttgaagttttctttcatctgaagtctagcttaagcttcaagaacattaatgcagcttaagattggtagcctgctaggaaaaaaaaaataatatttaaggggaaataagtttttctgagtagaagtagaagatgagtgcataggtaaatgcactagcagtgttttttgttcagcatgaattcagagaaaatagtgataccccactttgattactttttaaagggagctagccaaacaagcttattggtttttattgctctttctgtctgtctgtctgtctgtctgtctgtctgtctcttttcccttttttctttttttttttttttttgtttgcttttgttttgggtttttgtttgtttgtttctctgtgtagctctggctatcctggaccactttctctatggtctaggttggctttgaactcacaaagatccaactgcctctacctctcaagtgcttagaaggcttatatattttttcttagcctaacagttttcaaagattgtattgggtgtctcacaaccaggtataactctcctgttctagcaggtcaatcaccctctgacctccataggtatctacgtgtgcgtgcatagaaataataaaaattaagtaagaataactcattgcctatcagtgtaaatgtttttatgaaaaaagactttcccaaaataagaattctcaagaacactggtggtttataatttttccatctctgaaagacagctgggtgtaatattttgtgacaagtgatatctaactaagaaaaaaccttgtgatctctagtaaatagaggatctcatagattccagggaacccccagaccctgcttggagaatcagtaacttactactagactgctatcgacaaagtttagatctttagagtggcatctaatctactataaaactttattttttaactgataatttacctgtatagtcaccagtcaggttattatatagaacatttttagtagtagtctagatggttcccttattactccaaaacatattttgacctttctactacagttatgtgcacatcattaatggataaattaaacattgatacattgatcatttaatttttattgattattatcgatcaatgtatcatttaatttatccattcttcttttggtggacactctgatttcagtgatttttttttttttattttaaactaatacaaatgttgtcacagagcctggcatggtggtacacacctttaatcccagcacttgggaggcatgtggatctctgagtttgaggccagcctggtctacagagtgagtttctggacagctggggctgcacaagagaaatactgtcttgaaaaacaaaaatcaaccaaaaaggtcaaatgtcctcatatggtgaaaatatatattatacagtggaatattagcaataaaaagcaaagtagtggtatatgtttcaactttcatgaactttgaaagcattctgaaatgaaagaaacccgttgtagaaagtagattaagggaggctgtagggagtggggagtggctgcataatggggagtatggtttctttctggtgctggtccagggcttcttgcatactatgtgctactgagctctactcccttagctttggtatggtttttctcttgtgggtcataaaaatattctgtaattttaattgtgcaactctaaatatagaaagacccattcaattgtacggttcagataaattgatttgtattatgacttttgaataatacaatgagataatgtcattaatgggaaacattttgaaattgtttagtttcctttgtcatgtcctttattcttctacatctgttacttaactagtctgggttcaggcaaaaagatatacataaagatagttattaatgatctatctgccttgattaagatatttattgaacaaagtcttggttctgaatcagtcattctgttcaattagtcacctttaaagtgttttgacagcttaacagtggtgaaggcacctttaatccagcactcgggaggcagagataggtagatctcttgagttccaggacagctaaggctacacagagaaaccctgtctggaaaaacaatcaaagtctgttagctagtaactttgagttcatcttacgcagtcatttcgagagtagggtaggtaatacatgttacagaagggtttattgcttgatacatgatttatgtcttaatggtttaaatcaacatttctcatgaatgttggctgataatgtttattgtgctcttatatcctttgcaaggatttaataaattttaggtaaatatatacctttttgttgtaaatagaccccgaactataaataaatctggggtggtttttcgtttctttttttttttgaaagaaaattactaaggtagatagtggtgaatttaactttgtgttatatgtatgtttcaggaagcagaactgtaattaataaaccaatgacaaggtgaaatagcattttgatggtatgaaaattttctatggcagcaaggagttttgcaatgttaatatgtctggggggaagaatagatgtaggcaatttcatttggttatttccaaatcctaaattttctttgagccatccctccccaaatccctataaagttgtggctttatatttatattatatatttatgtatatatttgttttgtttggttttcatgaaacaaaagtttaccttttaaaaaataagtcttttgtctgttgattctgtgatactaagaatagcaggcaaatttgaatggtatgttggtgccaggagcaaatgatatcatagcataacatgtgtacagagtgatgtagtaattgaagtagaagtaagaaagctgttccacatggcatctgatggttttggtatacccatgctaggcttaggaattcaaacctagcagtcacaactacttccaaatctgttatgttatattaataggtttgtttggacttagttacaatatatatatgtatatattttgtttggttttatataactataaataaatttaatttttaattttgtttctggatatatttaaatgacatttgtttaatgtttctctatgtagcactggctgttctggaacttgttttatagacccagctggccccgaactcagcaatctacctgtgcctcctgagtgctttaattaaaggggtgtgttaccacgcccagattccctatgcgatatttataatagggagtttttaaaagattctctaaatctagaaccagaattagccaacttgagccagcttattagcattgatagaaacctagtgtgtatgtgtttgtgtgtgtgtgtgtgtgtgtgtgtgtgtgtaatcaagtgaattagaactacaattggatacttatcactaactcacttctctaataaatgggaaaaatacatttgtacctcaaagtgtggtttgtttgtattttctttcattcaacagataattgtgtagaactgcataattttgatgtcatcttgttactggcttctttaatttccctgctattaatttttttttttagagccaggacaaactctgataggaatattatgacactatgaattgtattgcaaagggtaacttttttttaacttgaaaatcagttttcacaaaggacaatgtaactattaattataatagagttttgggctaatgtaacataatattaagagttgtattatataaagatgttgaaattgtgtatttcacaaatcatccatagtaattgtggcaatgtatatcaaaatcagaaaatcttgataatgtatataatttggagatccccactcccactcccagccagtctagggatcatattcttaaggagcctttgaaggttcaaaaataagaattagcaagagttaataataatctaatcagcattttggaaaaatatatttactgggtcccttttgcatgttcctggcacttgtacatcctctcattaaagttttctaataatctctggaggtgttagccacctggagagagcaagatgatacttggaaattgaacttgtgatcctgttatattgcactatgtattgctgcaagaagaacaacctatgttctgcaaaatcagcttggaaaaataatgggactcatgagaaacagtgaaattaagagcagtttggttacccaaaggtgtcttactttataattagtaacagttaaaagttctaatagatgtagtgacatatgcctttaggtctagcacttgagaggcaagaggtgggtggatttatgagtttaatgccagcctagtctgcaaagccggttccaggacagccagggctacagagaaaaaattctttatgtctcaaaaaaccaaaacaacaacaaaactaacacataaacagaaaatgtcctcaattcctgatagtataagaccctttaaaggttaatagaagggaaggggtgtttagaagggttaaagttactgagttagaatatgaggttaaagtacatacaaaaattaggtaaaactgcaagaaaaatattcttagaacatgtggctagacaaagccaagaagagtgtgggacaataaacttatggctacaaaatagtatgattaaggaaggctggcaacaaccacaattatgttttatgaatttgacaactaggtacctcataaatagaatcatatggcatttttgtatcctattgtaactggcttatttcatattttattttataaaataatacactcattttcttgcatgtcacagcttataaaaatcttttttgaaacagtcttactacacaagctagccattgctagcctggaactttgtagagtaggctagcctcaagctgagagatctgcctgtctctgtccccagagtgctgggattaaaggtatgtgccaccattcttggtaaaattacctttctttaaaagcaacacacaggggttctaatttctccccattcttattaccacctcccccatcttcattaaagcttaggcatttggctggctctttaatttttacttttggtgctagagattgagtttagtgcctatacagtgcttacattctcccattgtgctacaacccaagccttccctcaaagtttgtaattttaattaaatttggtttgtctgttcctttgttgctcatgctattaggaaaatccattgtcaaatcctagactgttgaaatttgccgtttatgctttaaatcagtgaagagtagacaaaataatattttcataccaaaattttctgtttcaaggtgttggtttgattatagaaatttcttggtctggatctttacataatttcatcacagatcttttctctctctctctctctctctctctctctctctctctctctctcggtttttttgagacagggtttctctgtatagccctgggtgtcctggaacttactatgtagaccaggctggcctcgaattcagaaatccacctgcctctgcctcccaagtgctgggatcaaaggcgtgcgccaccacttcctggcagatcttttctttttcattaccccatgttgatgtgtgacacacattgctctgataatctgttcttggtttttttggttttattttgttttgttttttgtcttttgttttttgtttgttttggtttttttgctcttagagcttttcagattgctatctaacactctgtaaatttgctgactgtagtgaatttttaattttatttatactcgtcaagtccagacctttgacttggctcttgggttttgctttatattgtcctttttatatttttattgacagtccacctttaaaggatagaatcacattttcctttcctagtatcatgctttcctttaattttttgaagatacataaaagagctgttttgaagccttgcttagttgggcatctggactctgaaggttttttccccgtaggtagaccacatgttcctgtttgttttgttttcttttttttaatttatttttttgtttgttttttgtttttatttttttctttttcctgtttgttttcatgtattttaatttctaatgtaaaaatggacccttcatacaatgtagtacattgggcaatgatttttttactggcccaacacatctaggactttgtttgtttggtttatttatgtaataactagctgaacaattttaatctttcctgtaatttttggaatctctgcggtctctgttgtgtgttccaataagcagtgtatgtgtcttgtctttgcctgcccactcttccactcaaatattagcttttactaattacctactgattgctctattgttttacataatgctttgggttatatataaaattacccagtctggttcctgatccaattaagttctcattttccagggataatcctttgtgctggttcttggggctttggttttgacccaggatggttgtttgcagctctatttctctggttcttttggtaaactaagctgggtggtttttattggcttttatggagctaccagaatcttaattgaaataaagccagtttaccataaagaacttagattttttttttttgtttttacattccccctggtggaacctttatacctcttcagaactgaagaatcagactgcaggtgggttctcttatagttgaagcccctacttcttagctgtgtggaggcagcatcgaccctgtgacttttagcccatcttctgccttgggatcttgaacctgtggataaattggattaagagctattaggactgtagtattcttggcttgctgcccttgaagtagaactttgccccataaatagggcctagatggaacaaaagagcccagtcttcctgcagtcttccagaagtgcttgtaatgaaaatcttaccaaaaatagaaagctacagttaatttgatgaattcagttgtattggagtagtaggttatacagtttactctttacaaagaaaaattccctccaaaagttgtgatggggtttgaggtcttttgtttgcggataaggatgggatgtaaataataagagtgtagatttcttacaattatggaatctgaaattcaaggtctaggtgttgataggtttgcttggtttttttttctttttaggaatgtgtgtgtcagtctgtgttgtgtgtgtacctgtgtgtgttggagaacgtgtgctgtctttgttagatgagtagtgtgtcttaaacattacaagtcagttatgcttaatgtcctcagtatagatgctttggaatatacttaaggcattagccagttaaggtcagtttgccccattctaggatttaaccaagtagcagctaacttcttgataacacttgccttgaagttagttccagaagaaaattgaaattacttgatacagctaaactggtatactggctacagtacattctttaagttgaatatagcaatgaagcttcagcttttccctttttacctgtcatttacatagtcatgctttcttgacttgattcactggtgatgatactaaacttgaatagtttatgcttgctatatctaaaataaaatattctcttttctcttttacttacaggttatgcaatggtctctgcaagatgttttattcttgaattggaaccttttacgactgacaaatgctggtactttatctcctataagtggactataatttcttttcttaagacaactacataagcagacaaaattgcaaagatctgccctgtgtcgagtatgacagccacgactcgtggctctccagttggagggaatgacaaccagggccaagcccctgatggacagtctcagccccccctccaacagaatcaggtaagaaattaaagatacaagttaaagccacattgctatgtctccttaactcttaagtgctaagtaaggaaatgtgatagaattgccaagtaaccataaagtgaatattttaagaaaagtagtaaatgcaggttttcagtagcaaaatacttaggtgctgaaatcaacattgttttctgattttttttcagatgtcttacattcttacattatcagtcttcaataaaaggaatgaattaagcttggtatcaatcctgggagaaaccattgtataatttagtgtagcatatgggaccaagaaaattataattctattttgtatgccaaatacataaaatcattaattgtcaatctaaaatatgagtatgtactgaagtattattactggtgtttaaatttcaccttttcactatactagctttatgactaggtaaattatataatctctaatcctgtttcttcatttatatgatagtgataccagtaatggaacttcatagcattgtttaaggatcaagtaaaataagggggaatggaaagatgggggttaacacccagagtgaggctttcccttctaagggaaatggggcgggggagacttatgtgaggaggtactggaaggagaggaagggctgatgttgcattgtaaagtgaataaataagttaatttaataataataaaaatatcttggcacagatactggtgtcagtatttgcttgccctaaagctcttaaggcaatattgtattatcgttcaatttacataaggtttctagttctgattcctgttcccccattagaagattttagtaggaagattttactagttaaaagaccttgatttttgtaagcaagttttctatatggatcagtcttttgtttttgtttttctgagtcaggaactcttaatgtagctctagctgtcttggaactcactatgtagaccaggttggcattgagcttgcagaggttctcctgcctctgcctctcaagtgctggcattaaagatgtttgccattatgcccagcttagattcatcttttttttaagagattttttttccttgtttgtttgtgtttgtttttagtcttttggtcagttttgtgcacttcatctagagtgccaactttatttagatgcagttgtttacaataccgtttgtgctctttgggtgcagggatggaacttccttgtatatgctaagtgtgtgctgtaactcagagctgctccacaccccagatcctgtaatattctttccattccttttttttttttaaagtcttggtggcttgtggcagtgtgtcttttctttcatctctggtactgctaatttgtattgtattttctctcctaattagtcttttctaggggttttaccaatttaatgccccctcaaaaaagcttctggggcttggataataaaccccataagcatacaacatgcttttactctcatctgcttgttcttcactgtctttggatttggtttccttccttccattctttcgttcttccttttttacttttctttttgttttttgggtttcttgtttgtttgtttgtttgagacaggatctcactgtatagccttgactgtccttgaactcgctctgtagaccagtctggtcttaaactcacagggagatccaccttcttttgcttcctgagtgctgggattaaaggcttgagccaccaccacctggcttggatttgattttcttgttttcatctcctgaaattcatttcagccttttctaatatacacagttttatactttgaagaattaaattgaataacacaaagagtaataagatttgtgataatgtaactcctacagtggtgttatccgtaaactaattgaaattgtgtatgcacttagtaacagacatgctgcttacagaggtacacatttttgtagtgtttgggtaaattttaaagcaaaagtgttattgtagattacttttatctgtggcttggtgttagtttcttgctattcagttattatatgttatcaattctatcattactcttatagaaaagaattttttccctttctgactccccttcctctcccagttgagagaaatgagcaagcccgatactctcatccaaatgtggcaactttgttaattcattttcttttacagttctcatttttaagacatagaacttagggctataaatttgaaggccagtattttaagtttctttaagtatagtcaaagggctgttggatagtaatgattatttttaaaccaggagctagtagtttctgctttattacctgcattgtgcatggattctaacctcttttgcagtgtttatggctttgcaggactttcagtgaaaaaaaaatcccagttgttaacataatactcattttgaaacacattctctcactatgcagctttcgctggcctggaaaactctatgtaaaccagactggtgtcagtctcaggactcatatctctgtttcccaaattctgagattaaaagcacatgttaacttttattttcaaatctacttcatttttttagaggtcttagatttgtgacattaatattatatatctattaggtattatatgcacagtgtttgctaagatggctggtatttttaaaaccaaagaacaaaaacaaattacatttttgcttatagaatccctctgtttaccttagaatttctcattgtttcttattgttattctatgttctttaatgttagtgttttaagtacttcataagatctgatactgttggatcacaaaggagcaaccaaacctttactcagagctcaagttaggactttgttttttacttttagttgttttcttttcattatttttaagtgtgtgtgtgtgtgtgtgtgtgtgtgtgtgtgtgtgtgtgtgtgtctgtctgtctatttatgggtgtgtgcatataagtgcaggtgcatacagaagtaggtgtaaggtctccctggagctggtatgaaaggtgcttgtgaactgaactgccttgtcctagtcccaggaattggactctgttctctggaacaacagtacactctcttaactgctgagtaatcaatccctccagcccaggtctcagtttctcataagctttacatatatttacttaaagggaagttagaaataataactcaatcgagtcagttctctgcactgtgtgtgtgttctgggtgtttaattcaaggcaataggctcagcagcaagtgccttccttactcagccatcttgctgaggcccataaagggaatttcttaataaaaattttaactttaaaatctgtacctgtagaagcaactcttaagttataagacataaaaaccagtaacaagtgggatgaatattcctcagatgcggtatctgagaaggctctggattataatttggcaatgtgtgccaatagctttaaaagaaattttctatactggtattgttatatttctagtattcttaaaatttgttttctacaagaagatttatacttgacaatgctttatttaactttaatttatgtaatgctgaagaatttgaatacttaagatactgaatgatggctcagcggttaagagcgctgactgctcttccagaggtcctgagttcaattctcagcaaccacatggtggctcagtaccataatgggatctgatgccctcttgtgtgtctgaagacagcgacagtgtactcatatacataaaataaatctttaaatagatattgaatggataattgacagatatagttccagttttatcgaaaatttatgcatgcatggccagtttttatttagctcataaaaaagtaacaaggggtcattacaatgtcattactggttttttatttgttggtgtggtgttatatatgcttacagttgtttttgtctgtgttttttgtaagaatatgaatacacaaggcaaagtgttttgttgtttaaaataaaacaggcttctaaagttacatactgcagatagcttttttgtatggggtttctagcacttgaattctttgcttggcaacttagctgtttgttaagtgtagtagtctccattttaagtataaaagctcaccattaggttgttagtctgtcttggaaattcagcataaattttggaaggagaacatatcattgaaatcataagctttcaatgatgtctttgtagaattttatgttactaacatttttaaaaataatgctaatatgttagtgtttatgtatgtgtgttaatagaaacttacatctataatgttattttgttaatcaagacttcatcgcctgattcgtccaatgaaaattcccctgcaactcctcctgatgagcaaggtcaaggtgatgctcctccacagattgaagatgaggaacctgcatttccacacactgacttggcaaagttagatgatatgatcaacaggtcagttggtttcatttctaaaaccaaggcttgtttgtttttattatagcattatgtgtggtgggtaacataatggcagtgaagaggaactgttgccttaattttcccattatagtcactgccaagtactttacaacccatggttcatgatgggtctaataaaaaggagcaagaacatgctcttatggccttagctgtttgttccaaagtagaactagttatttagttttcctttttaaaagttggtgaaatttctttacaattgacatgttcttgactgactttaataactttagggggggcatgaaacaaaccagatcataaggagtttcttagaatgtccttcatgatgttctgcagggtaagaaaaggttgtaaagaaatgagaagaacatatcaaaaaccccatctgagcattgtccttaccgggcagtgtgagttcaacaagggccgctcaaaaaaactgggcactggatgagctggatggctcagctattaagaacactttaaattcctggcacctgcatggcctcttaacagctgtcacctataattccaaacccaggagtctggtggcctcttctgctctccacacccatacatataaaataaattaattaaaaatgagaatatttttaaaaaaataatgaaaatacaatttcttacaggtactttgctaaactttttggtgtatttttatttaaagtcaaaactattaaatacatgcccacggaaataaaaatcctttcattaaaataaaactgagttggttgtagggtcctacactgttaatctcaacccttacagggtagaggtaggcagatttctgagttcaaggccagcctggtttacatagtgaattctaggacagctagaaccatatagtgagacttggtctggaaaaaaaaacatgcaaacaaacaaatatctgattttcttagtagtaagggtgcattactaagtatagaactatgttgtataataaataaaatagattaatttctctaacccctccctcataacccctagctttattccccctttcacatattccaaaagtttttttaataatcaggagtacatttttcatattatatttctgttttctatcatgtatgtattgctttttctacacatacaaaatcttactgtaattttgcaacttgttttaacttgtaggaaatattcttccatttgactcattttcaaaggaacatttatgctgctactagcagcctgtatatagtaatcacatgcaatgaactattgaaagtatgtatttaagatgatccttgattgttctcagatgacataacaaagttgcattgttatatttcagttttgtctgatggttggtaagatatgcagattagatactaggctgcatgaaaacggttcttgatggaaaaaaagacaaaggatgtttaaaaataaatactgggtagttatttgtttctaatatgttattagaaaaagttgatagattatcaagcataaatcagtctaagcctcctgaaggtttttttctttgtgaggaagttcaaggcctctttaatctgaatcctgaaaacactttcctgtgaagtttttgtaataggcttctgtgatgtctaattgatattttattataggagtttatattaatttttaaaagtctgcttgtagagacaacagatgataattgtaaaaactttatccagtaccaatgttttcctatgtaatgctattttaattaatattttcatagtgaaaaaaataattgtaactagtaactgactatagtacctcttttatttagtgcataaccattaagtctctttattttattaattcctaggcctcgatgggttgttccagttttgccgaaaggggaattagaagtgcttttagaagctgctattgatcttagtaagaaaggtatgtctcagtatcatgcttttctaaatggtgtgcaactagatatattttcactttattcttgaaaactccattttcctgttaaaacacagtaagtgttttaagtaagtatatagtaagcttacaaatagagggttgtcctttttaaaagaatgtgatctcgggagtgctagacataaagtgtatatgaattcatatttctaaagagtaagtccattgtttagatttgcaatcactcagtgatttaaaacatttctcttatgggaattccataatatacacaaaaggttttacaattaaatactctgtatgtgatatatagtacaaatatcagtcaggtttaagtagcttgcagaagtgggaaggggatggtgaatatcctaaggaatttctgatcttgagatgagtcacatgtaaacctataaattacttaagcttaactgaagcaaaggtgcatgactcttaacctttgattctttgaatgaagatgactattttgttgactttttttttttcaatttatatattcattgtggttgggggttgagatacttacacaatcaagaacttgcaagagttgattctttttcatccaccctgtaggtccatgggagcaaactgtttttataagctgagccatatggctagtccagtaatgtgggtttttaaaaaaaataaaattagcatttaaaaaatataaaatacgggcggtggtggtgcaggcctttaatcccagcacttgggaggcagaggcaggtggatttctgagttccaggccagcctgatctatagagtgagttccaggacagccatggctatacagagaaaccctgtctcgaaaataaataaataaataagtgtgtgtgtgtgtgtgtgtgtgtgtgtatacatattttatttatatatatatatatatatatatatatattgtgatttttttctctaaaagaaaaagacttgtaaaagtggttctgtgtttaaaagaaataataaaaacccagtaaagggaatctgatactcagttgtccagaagtaaggttaatgttgaaattgagcaatcttattagattattctcatctatttctggtgctgtagaattctcttagtagaggactatggttatctatggtgctcagtttttaaggcactggaattgttttgggttttcttgagacagggtttttctatgtagccctggctgtcctggaactcactttgtagaccaggctggccttgaactcggaaatccacctgcctctgcctcccaagtgttgggattaaaggcatgcgccaccactgccagcaagatattaattttgaaaataactaatataaattgcttaaaaaaattaatgtcttttttatagtaccttgcttgggttcatggcatttcctggaaaggggaattttactcacattagttactccttctttgtttatcaatcttgaaaagctataaaataagttattcagatgattgttgttttgcactatttaaatgaacattgctagttacagtctaaacattaactgtgtaataaaaacctggtattttagtgacattgaaatctattacattgacattcagcggcttgtatatcttgctcataattatttttggcaccagtttattttagataaagctcaatttaaatatcacccatattgtatgattacaataaaatattttttgtacaaattgagatgttaaagacattctttgtatttgatgacaggttgttctgttgtctttttttaaaatcagatgagatgaaacaaggatataaaaagtgtagggttggtaagatgtcctgatgatctgaattctacccctggaatccgcttacaggtggaaggaataaactgacttcacagttgtcctttgacttccatatgaactccttagcatccatctttccatatatgcatgcatgaacacacataaataatgcatctttaaaaaagaagataaaataggttcttggcttggaagaagaaagatttgtgtagatagtaaaataaaagaagacaaaatgattcatcgtacttacttggtcatttggagaatagtaagaatatgaatgtctgctaagcacatagtttgcaaactaatatttcaaaaattaattatgaaatgtaaaatttaaggcttattttcagaacaaaatggtataaaatacttagagtctctgtcacatgttactgaccatcattttgggtttaagatacagtgtcataatttgtagtattttcagttaattttttattcatttttacttcattaatgattatacctaagatcttgtacatgttaagacttgctgccttcgcaatgagccatatccccagtcctgacttactgttaatattatcacattaaatgtaacttttgcataattattttaaaattttatttagggtgggagggctgaagaaatatccatgcagttcatttatggatgcttgctgctcttggagaagaaacccacccaggtttggttcctagaacccatgactggtggcccacaaccactggtaataccatctcctaagcacctgcattcattcagcatggtataaactcaggtcattacatacacacatacttaaatttttctttaaacagtaattctgagttaaatttcttttctgacatacagaaactttgaaataacaatagtgttatttcattgtgaacatttttttcccagatgtgctctgcaactgctagcttgttatacatgctgttttctgatgacttatgcctttcatcatatagttgagcacaattattttttttctcccctttcttaggccttgatgttaaaagtgaagcatgtcagcgatttttccgagatgggctaacgatctcatttacaaaaatcctgacagatgaagcagtgagtggctggaagtttgaaattcacgtgagttttccatttgacttttacaaagcagattatatagtgatcctttggatgggaagaacaagtgtgtgtgtgtgcgtgagattaacatgagattttagagttaaaaatacatggtttaggctgggcagtggtggtgcacgcctttaatcccagcacttgggaggcagaggcaggcggatttctgagtttgagggcagccagggctacacagagaaaccctgtctcggaaaaccaaaaaataaataaataaattaattaattaaaataaaaacttggtttaacttttctccctggttcttcattgccttgtgaccttaggcaggtcaccgcattttattgaaaacctgctgctatcgattataaaatatgctgctattttatgtattaaaggcaaaatgcccaagaaggagaaaataaaacacagatttgggggcaccagaaagttcagtgttacagaagtgatgagaaatgaactcacatgtctattttaatttagaacttgaatcatgagctactactgttctatagatagagttctatagacttgattcaatttacatttgatcctttttaagtaaagactacttaaagtgatttcaggtccctaatttcaaagagacaaaaacaatcagtaatcgttatttgtaggatgaaattagagtttacttcaacagtgaaaagaagttgtttttggactaatatgctattatgatacaaacctgtttctatgtatgcaaatagccataaacaggtgacgttttgtggtctgaatgggtttttcaattacaactatggggtaaaagtcccacaatctggtttaacataatttcttagatttagagcttggcaatgtagtcttctatcagggtaagtgatacattatttcaattttagaaaaaatgggaatttgtatcttatctgaagataacagcagaatttggcaactcataggacctacttcatttttaagcaagtagctttttgaaagcaaattaattctgtcagtactagtgaatcaactattatctatcagtataaaaaacaaggagctcatttaatattaacagtaattagggttatatctgtttgaaattgcaatgttttcatattattaatcacctttctctcatatataatagagatgcattattaacaatactcatcgcctggtggagctatgtgtggctaagttagcccaagactggtttccacttctagaacttcttgccatggccttaaatcctcattgcaaattccatatctacaatggtacacgtccctgcgagtcagtgtcctcaagtgttcagttgcctgaagatgaactctttgctcgttctccagaccctcgatcaccaaaagtatgttaattattttcaaatttaaatattaagatagttctaccacagaactgtaatattagtctcctagtaacatggcttaacactggtttaattatactcaaaaagacgttctgcattatagtttgaattctttattttgtaccacagctatattttattgtttgtactactatttagtttttctgtgtagtaataattgacatctgacaaccaagtattttttgagtattatatataatatagcactaggagcctttttgcatagtcatagcattttagttcagtgcttatggcttcttaatttttttctccatgttaattaactatacttaattcctgttatcttttagtcaatctgaagatagtcatagttggattaatataacatttcaatagtagtaataacaataatagagaaggacattatgactcattaaaaacctcaggtgtgaatcaataaggccatgatgattttatatattctaaggttgttaaggttgtttgtttgtttgtttgtttgtttgttttttcgagacagggtttctctgtatagccctggctgtcctggaactcactctgtagaccaggctggccttgaactcagaaatccgcctgtctccgcctcccaagtgctgggattaaaggcgtgcgccaccactgcccggctattctaagtttttttaaacttaaaaatagatacatgcgctgggcagtggtggtgtatgcctttaatcccaacacttgggaggcagaggcaggtggatttctgagttcgaggccaccctggtctacagagtgcgttccaggacagccagggctatacggaaaaaccttatctcgaaacccccccccccaaaaaaaaagataaataagttaaattaaaaaaaaacagatacatgctaaactataattagtcttattctagttaccaagacaaggtttctgtgtgtagtcttggctatcctggaactcatagtccaacctggccctaaacttgtagagattcgcctggctctgccttccaagtgctagaatagatagatgcatatgctaccatgctcagcatcttagtgaagaaaattttaaaaatacattacataaaacatgtcctttttttcccttcctttctttttttaatacaagtaatcccaaaagagatctgtaaactttgggcttagggcaaaagagatggctcagtggttaaagagcacttgctgctcttttagaagaagtggattcagttgacaacacccatatgttagctcacagtcgtccttaatttcagtcctaggggatccaaagctcttttacggtctctgggcaccaggcatgcacatgatgcaaatgcatgcagacactcacacattaaaaaaaaaaaagagagagttaatgccttagtaatggccttctaagagcaaagtaaaatgtaggaaaatagtaagcatactaaaattcgtagtgtagatttcttagagaacttagaacttatattcctatgattacatatttttgtatttggtctttaaaaaaatatgctgggcatggtgaggcacagccaggtggtggatctctgtgaggtttgcaagatccaagacagccaaggctataagttttttcaattggaaagttgatttaaaaaaatgataaaatgggaactaaatgtattcatagcatccagtctggttagtactaccacatagttcacattataatttgttttacttttttctttttgtttgtcctgtaatgcaagaagtttatcaaacctatgcctttgctcatggtagtagatgtttaattcctgcaacatacgggttagttttcagtagacaattcacttttaggcttcaagattatttatatggaaaatttaaatacttataaactacaataagaaattgtctcagaagttgttacactagattttctttgatctattattacttaaggtctttttaactttttaaattgtttttcatataagtgtttttaggtattttggaaagccatatactctaaaagtcggatagctgagacagaaacatagtctaacaagtaatactgatatgagcagtgtgtttgttcctttaatctaattcatgcttactatttattgcttctgcttcacagatcaattactatgatcgttttgaagccttttcaagaatgacttaacattaattggctttaatatatcagtcaaaatagtactttgtttatcctaaatgccaagaaagtaaacttgttaattgtattgtagggttggctagtggatctcctcaacaagtttggcactttaaatggattccagatactgcacgatcgttttattaatggatcagcattaaacgttcagataattgcagcccttattaagtaagtaacattttaaagccacatgttaaatatgttattgctgtttttattttggctcaattcagaaatggagtagttggagctggagagatgattgctcagtgcttaagtggctgttctttcagatagtaaacgtgaggtttattccctgtacctatggcaggtagctcaaaactgtctttaacaccagctctaggagaatccagcgtctctggcttctgagggcatctatctgcctatatacctaatccaaatgtgaatacatacacatagaatgtcttaaaaataatacatgtcactcgggaggcagaggcaggtgaatttctgagttcgaggccagcctggtctacaaagtgaattccaggacagccaaggctacacagagaaaccctgtcttgaaaaaaaaatacatgtactatgagaatttactaagttgaggttaagaagtcaagtatttacgggggttttcttttcttatttcagaccatttggacagtgctatgagtttcttactcttcacacagtgaaaaagtactttcttccaataatagaaatggttccacagtttttagaaaacttaactgatgaagagctgaagaaagaagcaaagaatgaagccaaaaatgatgctctttcaatgattattaaatcattgaagaatttagcttcgcgggttcctggacaagaagaaactgtaaaaaacttagaaatatttaggttaaaaatgatacttaggtaagttattcatcttggaaataattacttacatgaatttttagagtcaatttacaactgaatttctcttacagattgttgcaaatttcttctttcaatggaaagatgaatgcactgaatgaggttaataaggtgatttccagtgtgtcatactatacccatcggcatggcagttctgaggatgaagagtggcttacagcagagaggatggctgtgagtaaacaaacacttagtctagaatggctgtcagtaaagttagtaatgctagcattctaaattaaaagttgaaatttgaatgttttggttaatttacagctttgttaataatcttgaaattttaaagtagcatatttatttgatcgctgggtatatctttggtaaatttattgttgaatgtaattattacaagtttgatagtatttgaaacatattgaagaaggggcatgtacatatgaccaattccaactgatggcttaaaagtacaaaatacataagagggcatgtagggcgcaactggaatcttagcactggagaagcagggagattggctacatgtttaaggccagccagggttacatattgagaccctgtctcaaaatatatattagaataagagctactttttatctttattttgagaatttgtttttaaagtgtataattttgtatcattttgtctttaaatacttagaaaattgtttatttcctgtatatattttatgtatgactgctgtaataagttactaattataaaactgatgatatttgagtacatatgtggcaaacaggagccatttgtagcaaaccaatatctttacttccaagaatctcttttgttaataggggaaatgattagaatgtgattttaaaagaaaatatgaagtaattacaagtatagctagctcattgaggcctttggtttagttgacagcaaaaagaaaaatatacaggatatttaaatcagtccctgggttaggaggtcaggtggtagatgtctagttttgtgtacgtcatgtgtctgtcttcattgagaatgctggtcccttagctgtgtgacccatcctaaaacatatagaaaatatcattaaatgtataaaactttttgtgatagtttgacattgctgtatatttgttatattttagaaaagtttctttaacaagttggggaaatttaaacttatattagctaaaaagattcatatttatagcacattttgggcccacctacctttattctaagaaagttgaatactggattacctttttaaaaaaaattcgtgagtcctactttattgttcttgaagttagataaatgacagtcaagatggcttagtctagcacagtattacagaaacaaacaatggaagtataagacttttattcaaattcaagtgccactctctgcaaacgtgtttactgtgctaagaaaatgtatctcttacttagatttcaaagatgcaagcaacaataacatccagtacatggcagtcaattaataaatcaaagtggtttggttttttatttggttttttgagacagggtttctctgtatacccctggctgtcctggaactcactttgtagaccaggctggcctcgaactcagaaatccgcctgcctctgcctcccgagtgaaatcaaagtgttttaaaaagtatcttttaacctaataagaaaaccattgtggggcagaattagtttaaggaaccaaacaccaaaaatggccctctgcccattcttcttaaaccttaagtgattgttgcatttaaataatatttttatgagttaaatgctggaatgtacaatatctttttgatgatttcagtgtttgtaatttatggagatatttattccccaataaattgctttgtcagatatgatagttcccagctttaattccagcacttgggatggatatggaggcattttgaagatcacaaacttaagactagcctatgctacatagcaaaatgccatttcaggagaaaagagcttactataaatttttttaagcaatttttatgaatacaatgcattcttgcatattatcttgtacatatgcttttggctttctatgtattctttaaattatattttagtactttaaaaaggtcttcgtgttttattttgttttgaaacctggtttttaaattacctttaggaatggatacagcagaacaatattttatccatagttttacgagatagccttcatcaaccacagtatgtagagaaactagaaaagattcttcgctttgtcataaaagaaaaagctctgaccttgcaagatcttgataatatctgggcagcacaggtaaggctcttgaaacctcttaaatgcttctggaagaaattcttctagaaacttcctgaaattgtcaataatgcttgaatacttaacagttcatatttggcaaaagttaaagaggcaaaaaataagggaaactaggtgtggttgtgtatatctgcaatctcagcagatgaaagtgtacaagtaggagaatcatgtatcggaaggtaacttaggcttcaaagcgagcgcaagcttctgaccgagaaatcaaggatacaaacagctcagtggtacactgtatttgccttagtaccacaaaataaagtaatatttgttgggaaaataaatatacatctatcattgacctcttaatagacttagcaactcctcagtatagttcactcactcaattccaaaacacttaaaacttttcagaaggattagcaacctttctgaaaaggttttaaaagccacaaactacataaacattgttgaattctaatttacaaagctttggttttttgcttttttcttgttgttgtttttgtttattttatagagatatagaaaatagctttgtttttgagtatttagttccagtttggggaaaaaagtaataacaatgaaagtattagtatattcgataaactaattaaaatttaatatttcctaaagtacatgttaactatgcatatgcagaaatgaaattgtcagattttagcaagaagcaatagttaagaattttacatagagattaaatctttttaattatgtggtgattaaatggtgataatttcctgatggtcattagcagtcagtatagatgatgtttctattgttcacagtttagtgtctatgtgacctttgtttttatttattaataggcagggaaacatgaagccattgtaaagaatgtacatgatctactggccaaattggcatgggatttttctcctgaacaacttgatcatctttttgattgctttaaggtaattattaacgcagcattgttattaccattttatatttagatagaattgattcattagaactacaagttgttattaacccacaaatacttaaaaaactcgtaagacaatttctgatatgaaaggactttatctagtttgaaagactttgccagtgttttctttctacaaacttgattttcattttcatgatagtgctaatagccctaataaagactcttgttcaaaattcaggttattgttttgaatatcttttcccagtctcttttggaagtaggttgaagtatagaaaagtaggaaaggaagattgtgagaaacataagaggtggcaataaaagaaatatcagtacaatggtattctgaggatatatactcaggtaaagcataacttaatttacaaggcagtgccagaccatacagtcatactcacattgattctgtcatgttcttttatatagtgttaacagtctcatcagttactgacattcagtgcatggttaattggttagtgaatttgtgaattaagaacatgacattataagagtgcttaggaagggagggccttttaactattggcattacatcattagtcactaagtattactcctgaaaatagtgattctgactgggaacataagttgccataacactctggaaggttatattgtgtccctgattaaatacaatattctgggaatatcagtatagctcagcagtagaatgcttgcttagcataacaaggctctcaatcagtcccaaacaccaaaagattcttgcatatatgcaccagcttgcatgtccaaaaacaagtgaactgaagtggtttgtaatagctacaaatctctctatagagaggatagataatggatgttcatataatggaatacttcatgggaatgggaataagcaaactggaagcagcatggatgaatttcattgtcagaatactgaaaaagggctgaaactatgtagtaatttctgtatcttgattaaattaacataaacttcagaaatagtcccagatggctcttgagattctattcaccacataagaccaatttgtcttagtatatgccacatgtcttagtcagggtttctattcctgcacaaacatgaccaagaagcaagttggggaggaaagggtttattcagcttacacttccacattgctgttcatcaccaaggaagcaggagctgatgcagaggccatgggagggatgttgcttactggcttgcttcctctggcttgctcagcctgctctcttatagaaccaagactaccagcccagagctggtccctcccacaaggggtctttcccccttgatcactaattgagaaaatgccttgcaactggatctcatggaggcatttcctcaactgaagctcctttctcagtgataactccagctgtgtcaagttgacacacaaaaccagccagtacaattggtttttaatgtaggtagtgcttacatactgcttacatacatacctacactgggtactcttaaaatgaaatcactttacatcttccattttatatttcacagtagggggaaaaatgacctctaccccaggcatatagagtcagtcactaggtataaagcctaaaagtcaatattttcattaagtttctctgatcagtttttttgttgttgttagtttggtttggttttttttgtttgtttgttttttgtttttttgagacagggtttctctgtgtagtcctggctgtcctggaactcactttgtagaccaggctggcctcgaactcagaaatccgcctgcctctgccctctgatcagttttaacacattaaaagttataaatcagatatcttgttgaaatttttacttctttgaagggaacaaattaatgaatgttttctgcatttttaaatacatcatacacatttcacacatgcaaagataaacttttccccataaagacagctgtagtaagcagttattgtgaatgcccttaagttaatagtcattcatccttcatgttgaggtgactcctgaaatagtggtgaagtatgaccagtgacagacttgaaaaaggaaaaagtataaaacagtcattacatcatttgggtcttctttctcccaggataatctcttgatacttccttaataattagttccttaatgattaattgattccccctttggattatcaagagcttgctaaatagcaagcacttttttatagttggggagcatctcactgtatatccttggctgcttggaactcactgtgtataccaggtcgccctcaaactcgagagatctaccacactaccttaaaaatgaagaggagaaaatgaaataagggttttcatttcatttaaatatctttctaggccagttggacaaatgcaagtaaaaagcaacgtgaaaagctccttgagctgattcgtcgtcttgcagaagatgataaagatggtgtgatggcacataaagtattgaaccttctgtggaatctagctcacagtgatgatgtgcctgtagatatcatggatttggctctcagtgctcacatcaaaatactagattatagttgctcccaggtaaggaggtggtgtttggcttggttgtattacttttgtgcccctacagtactaggtagtatggctaaagtacaggataattttaggttattttagcattatctttttaatgattttaagaattgatgtttatttaagcctgcctttcttaggtctctacaataatgttttaagatccatctgagtctctggaagaggaggtacaaacaataggccatttagtgataatgttgtcaaatgtatggtaaaggaatcaaatagatcataaaatattaaggctgagttagaaactttggaaataaatattttctttgctcataaaagataaagaataattagaattttctaggtagtagattctaatgtcagggtgttgcattagcatgttaatgcatgattttattatgagatagaatctttttaagttaaaacaaatctcaaacctagtaaattataatcaaactttactgaatgtatgtgataaattttaggattttactttttagagtttggtagtaaatatgaagttaagatatacctagagcactttaaaaaaattaaactcttagagttacagtatattttatatttatcatgttaatcttataagaaaaaccgactttataattccatggattattggaatttagcttaatttccttatacatttatctttaaatactgtgacttagaattttcccgagtattgatctatataataaaacactgaaattgtttaaggaccgggacacccaaaagatccagtggattgatcgcttcatagaagaacttcgcacaaatgacaaatgggtcattcctgcactgaaacaaattagagaaatttgtagtttgtttggtgaagcacctcaaaatttgaggtaagacttttaaaactagacagtttaaatatttttatttatggtttgttaatttcaatttgtaaaagaaaattttaaagaaagttaatgaagtgccaggaaactaagaagaaaagggctccttttggaacaaaagaatcttttgtcattcctacatcctttgtttcattgatatggaaagtaagccatgattaagtgatcagtactaaaatctaagtgatcttgctgtttgatgctgtgtcacatggtagttttcacaccaaaaaaaaaagattgtttttttaatttttaaagttagtttagaagattaaattgcatggagatttaaatgatagtagatggaatgatagaacactggattttttaattttttaagatttattttatttattatatgtaagagaagaggacatcagatttcattacagatggttgtgagccaccatgtggttgctgggatttgaactcgggactttcagaagagcagtcagtgctcttaactgctgagccatctctctagcccctgaattttttaaatatttcttaagtatactttaggccagcgatggtggtacacacccttaatctaagcattttggaatcagaggtagatagatttttgtggtttccagatcaacctggtttacacaattaggtctaggccagccacgactacagagtgaaaccctatctcaaatggaaaaaaacaaaaacaaagaaactccaaaaatgaaaaataaataacaaaaaacttaggtgttgaaaaaatggtacaatgcttaagaattctaggtagtcttccagaggactaaacttcagatcacaactatttgtaattcaatttttaggagatcccatgccctcttctggcctcagtatgtactgaatatacatggtgcacagacacacgtgtaataaaaataaatatttttaaaagaagaaagaaagcgagttaatggattaaaaaaaaatgtactattttaaggttccaaaatctgtttataagtacaatttgtcctcttattttctgggcatgagttagaatggttgacatagaaaggaaaaattatgtggcatgaaagaaagcttgagtgtagtggaactaatattcataaatgaagtgtgaacaatgaaatcatataatctcgggagtattctttaaataatcatggtttccttgtataatagatgcaggtggaggaaaaggtaatgtttgtcaaagtaatgtattttgagtatgtttggcccagggtacatatgccacttaacctttctgaaatttattaactctcaggtagacatagtattcagcaactcctagaaattaatgaccttgtctatactagaatatgaaagttgtactatctatgaaagttgactgtgaaatttgttgtgtgacaagaacaacttggctgcaaaccaaatgttcccagggaataacttaaacagctagtagtttttaaaatattattactttttttttttttttacttttggggggtaggaactcgtttttgtatggcagtcagagaacaacatgttctcaccttcaaaaatgaaaataatggggatcaagctcaggttttcaagctggcagcaagtgccttttcctgctaagccatctgtttggcttctaataatactaataattaaaaagtaaaaaacattggccagcaattggcaatgctggttctacaaagaagtttggatttttggaattttcaaaaagtcatgtattcttataaaaatgctttgctactgccatattataatagatacaactgattcttgcttttcaagtaataccatttttaatttttaacactaatttcttttaagttgcttaatgtcattaaggaagtaaatgagtaaagctggcttttgagtttttaattagtagctaataatttagtggtgataaacagttgattgcaagagtttaattgcctaattatattgttaagctcttctcgtttcagtcaaagtcagcgaagtccccatgtattttatcgccatgacttaatcaatcaacttcagcacaatcatgccctagttactttggtagcagaaaaccttgcaacttacatggaaagcatgagaatgtatggcagaggtatgtattgtaagataattgaactgtgagaaataacagtgattgccattttctattaggagtaacaattatatttttatttattttttatttcaatcttttttttttacagtctagactctatactcctcccagtccaccctcatgactgttccacattccatacctcctcctctatcccctaacctggtcttcctgagggtgtccccatccttcctatcccctacccagcaggcctccccacttcctggggcctctagtctcttgagggttaagtgcatcttctctgactgaacccagtccaggaagtcctctgctgtatatgtgttgggggcttatatcagctggcatatgctgcctggttggtggtccagtgtctgagagatctcagggctccaggctaattgagactgctggtcctcctacagcttgttaaccacctccttagctttttccattccagcttttccctaattcatccacagggattagcagcttctgtccattggttgagtgtaaatatctgcatctgactctttcagctgcttgttgggtctttcagagaacaatcatgataggttcctttttgtgagcactccatagcctcagtaatggtcaggccttcctttaagctggatcccactttgggcctgtcactggaccttcttttcctcaggctcctctccatttccatccctgtaattttttcagacaggaacagttctgggtcagaggttttgactgggatggcaaccccatccctcacttgatgccctttctactggaggtgggctctataagtttcctctcctcactatagggcatttgatccgaggtccctccctttgagtcctgagagtctctcacctcccagatctctggtacattctaaagcccccgccacccaccgtgttgcctgtttgattctttctgctggccctcagggcttcagtccttttcccccctcccaatacctaatcatggtcccctcttctccctgtccctttctcacccaggtgcctccctccctctctccctcccccctcctttggatttgttctccctcccaagtggggttgagatgtcctcacttgggccctttggcttgttaaccttcttgagttctgtggactgtatcctgggttctgtacattttttggctaatatccacttactagtgagtatcatacatgtccttttgggtctgagttatgtcattcaggatgataatttctagatccctccatttgccatcttgagattgtagacaaagctgcccttgatctcactgaaatctgcttgcttctgcctccaagtactggaactaaaggcatatacaccactatacccagcaccatcttctatattaactttcttaaaggaagatggacttattaaaattcttaccaatatttgcttatgtgttatgactgctagtgctttcatgtgctggtgcctaccaatctttccggagtttttttgtatagacaaaaaaatgtgtaaaccacctttcagttgtcactgaggctttagttcactggtaacattattactttgctgacctcaattgatacttactagaaaagtgacttacctcattcgttgcttttccttgttctcagccatgaagtacaaggtctatatgggttttaaaatactgttattaaatagtttgttagcattttccacttacctggagaaatggctgctttgggacctggaccaaggaattaaggacttcttaatgggaaaagtatgaaagtgatcatagaataaagtttatgttgaaagaatgaaggattttggtgtttataggccaaaactagaacaaaataataaaaataactatatgcattgaataaataacatataaacacataaaagaaaataaaagacccagaggaccttaacaaaacatttaactagataaaaatacagataaaatttaaagtgcctagaaattgttataaggagttaataacaagaaaatctaaatctcaaaactagcagttgagccacaacttgttcatttgtctctacagtcagcttcaccatgagaaaactattctgcagtagtttgactaaggactagtcctccccacacaactcctagtctaggactgcacttggtttcttgcacagcaagctgctagccttcttattcttagtcctttgttacagatgccctcttaaatatgcagatgtgacttcattaccctgcccactcagtatctatgttagttgaaacttaaatccaaacattataagccagcattaaggccctaattactgcaccacagctggctccagtggtccataccaggggaaataaatggccctattttcaaccctgcacatattaagtcagaaatattcttggaaaaactgggtgctatctgcctctgatgcctatctagtgacacagatattgtgcccaaagggtggagagaagccatagagacagagtttccacatttagttatatttgaagaaaccagaacattccatgccaagtaaattgtctacaaagagatggataaagaacgtctaaaaattgtagctcccttttaactgctgtcacatagtgaaatggtatagcaaataagtttccacctagaaggcaaaatgagagcccttctgcgatcctagtctcactgaggactcaaaaattatactacatcacccactcagagctggatatggaacaggttgaaatttcttcagagaaactgtaggtggctagtaagaactttaaaagatgctcaatatcactaatttttaaaatgtgagtcaaaaccatggtaagaaagtatattgtgatagaggacaacacttggtattgttgagactgttcagaaattggatcttcattccttgtgggcttatttattagttagactggtagttcttctaaatattaacagaatttaccatagtatggtccatattcaagtaaaatggaaacaaactttaaaaaacttggaattgaacattaatagcaaacttgttataatagccaaaaaatagaaataataaaaagtgatatgtcacctggcagtggtggcgcatgcctttaatccagcacttgggaggtagaggcaggaggatttctgagttcgaggccatcctggtctatagaatgagttccaggacagccagggctacacagagaaaccctgtttcgaaaaacaaacaaaaaagtggtgcgtccatatagtaacacaactctcttaaaaaacctgaagatttttaaattggtaggttgatgatgattagaacatattttatttgcttgaagtgggagcacacatctttaatctcagcactcaggaggcagatttctgttagtttgcacaggacagccagggctacacagagaaaccttgtcttgaaaaaacaaagtttattaacagatgaactcaattgattttgatgtatttattttattatatgtgagtgtgtgtgtgtacatatatatacacacacacatacatacatacatacacatagagacagagagagacacagacagacagacacacacacacaccatatacatgtatggttcatgaagtagtcagaagagtacatcagatctcctggaagtggagttgcagtttgagacactctgtgttatgctgggaaatgaacccagctcctacaagagcaacaagtagtcttaccgaatgaaccagttccccaatctcagcttaatttttcacactgaattctaaaatggatctcacaacttgatacttaaactgattttgtgttggttatctgccaaccaattttctaagatttctgaattgatcatatatatatttcctccatgggatacctgctacatagacaaggagtggttgtcttccttatttgctagcaaatcaaaaaattgttggaactctttatagtaaaattatcagcttttatttgtttggtgttttgtttttgagacaggatctttctgtgtatccctgcctggcctggaactcaactatatagaccaactgaactcagactcataaagatctgccagccttcaccttctcctccccattgctgaagactaaaattttgcactaccacttcacatttattacaaaagtagtgtcttatttcttgacttttcttgattactgtttgtgtttcattggactatttcaaagctctatgtccaaagtgttaagaattgaacacaaaatggattagggcaggttgctaaaaccagtggggcaaaaatggcatcttgacagcctagggaaactgcatcaatcagctatgtaatcaaagtgagcatcatgaggattgacacagtgccttctgattattaacaccagcagggtatacttctctaatattcttgcccagaatttatagccccagtatatgaagtaggaaaaggattgttctaaagagttttggtagcacatttaatagaccatttcctttgggttgtatgtatagaagggatgtgtattttattaggatattagatgggtttgaaagcaccaattatcaatgtaccaattattagcagatttgcagttgccttatataatgatagaagatcaatgatttttttttttaactgacaagttacttggttgaaatcagcagtggtatgattatccatatatataaaatgcatctttttatttttcctaatttgcagacaatgaagactatgacccacaaactgtgagactgggaagtagatatagtcatgttcaagaagtccaagaacggcttaactttcttaggtgtgtttaatataattagtattgctctctgacgagtatagtgactgattaactgaatatgctgtctttgttgatttttttttccccctttgccacagcttcctttgttgcttaatgctttacagttagtgagtgggttgtataccatccatctcatttttttttaagctgtagatgctggaaatgtttacttttagaggacaattttttagaggacaatatatggattattttatttacattccaaatgttgacactcgctcccctgctcccggtcctcgctcccagagttcctcctccctagaggacaagcttttatacattaatacaaatcagatggagaaccatactatcattagtaccatcgggactaagcaattgagagcaaaattcttttggaccaaagtggtctgagtcctttagtaccttgttctacagtgtctggcaaaggtagtttgaaattaggttattaataacattgtctctaagaggatgaggtaaatgcgtattttcattaatccacattgcaatcttcaaagatttgttccattatatcagcttttagtgagtattcctttaaagatttaaaaagtcctttgtgctcaaaagtttataacaagaggtacatcataataagtcagacaaaagaaaaaaaaaagacaagtgctaattatcagtacttctgaaaattgattgcatttgttgctctgatacaggttctggagaatatttttgtgttccccccttaattgttgacttaattttattgaactcttttggggagaaaataggattgtatgatgattttttttaatttattatatgtacgtatactgtagctgtcttcaggcactccagaagagggcgtcagatcttgttatggatggttgtgagccgccagccatgtggttgctgggatttgaactccagacctttggaagagcagtcgggtgctcttacccactgagccatctcaccagcccctgtatgatgatttttaacttgagaaaaactctcccattttttaagaatattggcagttgtttaaagttgatgcttttcaaccaagtagaaggacctcacattgataaatgttgccttcgttattagtcatagttattaatggcctgttttgtatcccttcggcttactagaactagaaaatggtgcaaacacctttgccatagtttggaattgaagaagctagttatttaattacttaactgggaataatagaagcccaaccagagacaaaagaaccttatttttggtacctcttttattttagcctgtgctaacacactttctattttacctcctatttgattaacaagaaagagtcagatattttacagtaaccagtacaaatgacttgcttgcttcttccttccttccttccttccttccttccttccttccttccttcctttctttctttcgttcttttgttcttttctttgttttagtttgtctttgatttttctagacaggctttccctgtgtagccctggctatcttggaactcagataaaaactgagaaacaagttcaatatatatgattgtggtatcggtattatttcatacataaacgggtaggttgtatttcaggatatatgtcaaataaattttttttatgtttttctaaggtttttattgaaggatggccagctgtggctgtgtgctccacaggcaaaacaaatatggaagtgcttagcagagaatgcggtttatctttgtgatcgtgaagcctgttttaagtggtattccaaattaatgggagacgaacctgacttagatcctgatatcaataaggacttctttgaaagtaatgtgcttcagcttgatccttccctgttaactgaaaatgggatgaagtgttttgagagattcttcaaagctgtgaattgtcgagaaggaaaactagtagcaaaaagaagagcctacatgatggatgatttggaattgataggattagactatctttggagagtaagtcaaaaataggagctctgtcaacattgtacttgatattgtatctgatgcttgtctcaggagtctgggttttatccttatctcaagtttgtgtgttccttactagcattgtttaacattcttttaaatctaaagtataaggttgatctattgcaggctaaagtgtcttttatgatattttatacttctatctttaaaacttaggttggttaaaactgcttctgtttttaacttattttagatgtctgcaaattatatacatacacctaggtgttccatgtggtatttgagtacctaaacttttcaaataagtaaagcttgaagttttggggtgtttgtttgtttgtctgttttataagcagtggaggggcttgaaaggcagtgcatacttaaacgtacattaagccccaggttcagtcttcagcacatattttaatgttacaaacccttctcttaatccaaatttgcacttcagataaaatgagtaggtgccacatatttgaaaagtatagttctaagccagcctgaggttacagatagtgtaagatcctgacttccaaaaataataataccaataatcaaactttacatgatgatgtgaaatgtatagaggaagcctgtgtgtttttgttcattgtctccaggcttcttaatcttgctttcattaaaacctctttgcagggatcagccttgacacatgtcatctaaacactagagtgtggaacatagtttgaaaaccaccaatgtaaataggtgtggattgtaaatattatagaactgaaagaagggagaatttttacactaatctgtattcaaaaagcatctcattttcttctaactagtttaaattcctccttgaaagcctcacactttggtcaaaaccatattttatttgtagtaaattttaaacattgcatttatgccttgatctttttgtctcatttagtcaaccagtatgttgttgaatagtgtattaaaaataactaaggatatgatttgaatgtaaatgcccgatgaaacatttcttgagaaacattattttttttttatgtaggttgtaattcagagtaatgatgatattgcctgccgagctattgatctccttaaagagatatacacaaaccttggtccaaggctgcaggtcaatcaggtgagtatcagtgtgcattaaaacttgtacaagctagccagtgcacgcctttagtcccagcacttgggaggcagaggcaggcggatttctgagttccaggccagcctgatctacaaaggacagccaaggctacacagagaaaacctgtctcggaaaacccaaaaaaaaaaaaaaaaaaaaaaaaaccaaccaccttgtacaagctaggattctaattaatagaactataaacctttcaagattttctctttaatttagacttaactggaaattgttttatttcagctactcaaaaacatatataaaagccaggtatggtggtaatatgcctgtgatcttggtatctaagggcttgggggaggaaaatgtcaggttttaagactattttatttggactatatagtagcactttgcatcaaaatacgtaagtacgtacatacatacataaaatacttacagaatactatttaaatgaatcttgccttgatagttttgaagtggttgggttactttgaatgttgattattatgtattgaaatactaaagactatgctgagtgttttttcaaaactagtacataccctctaaatttctttgttttaatctcatttatccttatttgatattagtttctctttaaacaataaactatctgcttaaaatatgattattgtttagggcaacattgttacgtgttctcatctatctttatttggcacattatatttgtaggtggtgatccatgaagacttcattcagtcttgctttgatcgtttgaaagcctcttatgacacattgtgtgttttggatggtgacaaagacagtattaattgtgcaagacaggaagctgttcgaatggtccgagtgttaactgttctaagagaatatataaatgaatgtgacagtgattatcatgaagaaagaacaattttgcctatgtcaaggtttgtgaataattgataactcggattaatttttagttgcttggtattttcctaacccattgccctattttaaaatgtgtacaagggaaacagaagaaaagaaatttatctttttgaaaatgtatcttaaccattaacaacataagtatcttatggaaatgcttgattatttttgtggtaggatagtttattagggaagaaagcactcataagagaagtaggtcagagattctatagctctttttttccttgaaagtttgtgattattttgttttacttaaatatgttctcactgtgtagcattcagggtggccttaaacttagattatcacagcttctcctgtgcacggattatgtgtccagcatgttatctttttaaaataatagaccttttatttcttcattgtcagtttttactttattaatttttcttttacataaaaaataccatattagccgggcatggtggtgcacacctttaatccgagcacttgggaggcagaggcaggcggatttctgagttccaggacagccagggctacacagagaaaccctgtgtcaaaacaaaacaaaacaaaacaaaaaaactatattgtgtgtgtggccatgtgtgtgctaaggtgcaactgtggagatcagagaataatttgaaggagttggttcttttgccatttggtcatttgattctcagggaccatttgggtcttcaggtttggtagcaaccctctttatatactgagacatttcataagccccaaatttcaatataattgtgtgttatatacacattttcatgtttacaaacatggtgtacccaccatgctcctttgtgaaagccagcaatagactttggatgtcctattctgttactattattattttgtttcgactgttctcctaatgagctaggagctagatgggcagcaaacaccaatcatcctatttttgccacccacacttagaattacaagcacatctagctaaaaagctattatggggctggagatttggacttgggtccttatttttcatgcttgtaaaccaagcactcttaaaccactgatacatcccttcagtttcactttttatactcatttatactgttaaaccttatagcatgccttttagcctaatatttggaaggcataggcggtgggttgggtgggtggtggtccaagtttgagactaccctggtcaatatactaagttctagctcagccaaggctctgtagtgagattctcttacaaagtagaaaaaacaaaacagtgtatagttactttttccttttttaagatttagttttattttctgtgtatgagtgtttgcttactgcatgcatgtgtttcatatgcatgtttggtgcccttgggggtcagaaacaagcattagaactcctgggactagagttatagacacttgagccctgtaagatgagctgccatgtaggtactaagaacctaacctggttcctctgcacgctatctcaaatcaacaacaaactcacttgacaggcaaccagggtagctaaaacataatttcaaagagttgaattgtatttcttttaaggtcttaccatttagtaattcaaatgatatttatgttaagttctttcttgatgatataaattcattttttgtatcatactttcaagataaaatgtcaacataatgtagttttgaatgacttgatgttaagagctttttgggcaattctgggcagtagtgcatgcctctaatctcagcactcaggcagagaatggtggatctctcctagttgaggacagcttggtctgcagagcaagttcaggccagccgaagctacagggtaagaaccagtctcacaaatacagttaagacaaaatttgtaacagcttttttttgttgatgttctcaaggtaaacctttttgtttggttggtttggtttggggttttttggtttttgtttgtttatttgggtacttttttgttttgttttgaatcagagacagggtttctctgtgcagccctggctgtcctggaactcactctgtagaccaggctggccttgaactcagaaatccacctgcctctgcctcccaagtgctgggattaaaggtgtgcgccaccactgcctggctctcaaggtaactcttatcttacacatttataagcatcaacgactagtgatttgggctttacaagtatagaagagaatgaaatgttcctactatttctgtgtcttaattgggagctggttgtatatagttgcttggagttgttcatcctggcctttaattggtaatccttcttccccagcaatgactggaatttctggaatgaagcaccatgcctgatatttgtattaattccttataggtcaatacattattttatatgactatgggcatgaaagtactaacagtggaatatagtcatggtgttttggttgctggggtatttatagttaagaagaataaatattttcagggcactacaaggtcttcaattcacttttatttaataagaacatattcaatgttaaagttccatgtgtattttcttggcagctaaatttggagatttgctaaatgtagtattttccatttcttttccccaccagagctttccgtggtaaacacctctcttttatagttcgatttccaaaccagggcaggcaagtagatgacttggaggtttggtctcatacaaatgataccattggttcagttcgaagatgtatactcaatcgtattaaagccaatgtagctcatacaaaaattgaactctttgtgggtggtgagcttattgatcctggagatgaccgaaagttgattggacaattaaacctaaaagataaatcagtaagtatattaccccctgataattttttaaatagaacctcaccctgtatttcattgttgaacatttgttctgttaatcttaatgtcagatgctaggattataatactaactcagacatgcgttggaatagaatatatcaaaacaagtagttataacagagagtactttttgaatgtacttttgaaaatattagcatctagtttttgtttaattatttaatcatgtaatgattgttttggatgcacatatgtctgcactatatgtgtacctggtgcccttaaaaatcagaaaagggtattggatttcctggaactagagttacagaccactgtgaactgctatgtgggtgctagtaatggaacccagatcccatacaagagcagccactgctcttaatcactgagccacttctccagccccagcatctagttttttaaattcagttgttgacatatcactagattccaagttttgtgttttctgttatttttttccttgtctttgattctaatatgtatcattttcagctaattacagccaaacttacacaaataagctccaatatgccttcaagtcctgatagctcctctgattcctcaactggatctcctggaaatcatggtaatcattacagtgatggccccaatccagaagtggaaagttgtttgcctggagtggtaagtatattcagttgttcaaggcattatacttgctgagaattattgacaatagacaatacataaacgaggattttgttgttgttgaagaacgctttgtttaataaggtaaaatgtctacacaattatccttcagtttgaatgaagccctctgaaacgtaattgtaactcagttaaaatttttcttttttaaagatttatttatttattatatgtaagtacactgtagctgccttcagacactccagaagagggagtcagatctcgttacggatggttttgagccaccatgtggttgctaggatttgaactccagacctttggaagagcagtcgggtgctcttacccactgagccatctcaccagccccctcagttaaaatttaaaccaagagccgggcgtggtggcgcatgagtttaatcccagcccttgggaggcagaggcaggcggatttctgagttggaggccagcctggtctacaaagtgagttccaggacagtcagggctacacagagaaaacctgtcttgaaaaaaaaaattaaaccaaaagttccctgtagttaataactgcatggttatatttacatataattaatccattggaatttaattataacatcttggtataaaaatttaaagaggtactaccactgtcttacatacttgttttataaaatggatccttttaaaacgtcgtatgtaggaaaaaactgtaatatttctcatcatatccccccccaaaaaaaatcaccgacgggaatcccctattgacctctgttttcacttcataagaactttaatgactgcaagtaacaccagctactccagtgtaagaacaaactggttagaaatttagaaagtggcatggtggcagtttcactatatgtaggtgagaaatagtgtaataaaacagcctaaaggtatcacaaatgtggctcagatgatgttttaggcctgtaccataaagaatttgtacaggtaagatgagcaaggataacagaagtaacaggagccaaagtatggagataagcttttaggaagaccttttttgaagcccaggagtaatttttcagctaataatttgtgtcttatattctagataatgtcacttcatcccagatacatctctttcctttggcaagttgcagacttagggagcagcctaaatatgccacctcttagagatggagcaagagtgcttatgaaacttatgccgccaggtaagatgttttcgatgatgacacaatgcatgctaacaataaaatgtatattaacaaattcctcttctaagtgaaccatatattagtggttggtaaactagcctgtaagccaaaatcttctaacaacttatttttatacaacccaatacctaaagaaagtgtctaaatttttcaagggttaaattaaatcagaacaatatctatttggagtattgtgagatggctcaatggataaaggtgtgtgcctgcaaatctgatgaattatagaagagaactgactctcttcaactgtcctctgacctccatacatttgccattcactctcacatacgcacctataaataaatataataaaattgttttaagttttgacaccagattctataaaattttagtatctgtagtctattcagttttgctgtcttataggtatacccattcatttaaatattatttgcaaatttttgttgatcaacagctgaacagcttagtagcagagatcatgtggcccaaaatcctgaaataatgtacacacacacagagactaattgattaacttaacagtttaaaaatcaagctatagtgtccaagtttgaaacagtgaacatttgattaaagtatgtattgctttactaagcagaatgagttgtttttcctaagagctatctccttccaggagtttaaagattatttttaaatatgccaaagtctgttttaagctcttcatagcctctcttctctttctgtttctgttttccctctctgtttctttttgtctgtctctgtctgtttctgtctgtctcttttgcactctctaagacagggtcttactatgtaggttttgctggcctagaatgcacagagatccacttgcctctatctcagtggattaaaggtttgcaccacagtgtgacaggctccttttttctgcattctctcaatgtttgagaatatatatatattcagttttttgagtactgtgatgtctttcagtgaaataaactaggtaatctgaacgtcataaagcagaaaataacttggaggtaaaaactgttgctgttacttacatttcctttggaagtgggttttttgctttgttttgttgttttctttaaatcagtctccaacagctggaaactgttgactggaggctcctggatgagagatggtctcatgtttaggctggctgattaaaaggcactggttggcattttggttctcatttgtttacttttaaatcaacccaagttcggtcatgtattacagaagctcaactgaatgtttaactgaattgtttgctgttttgtgctcttgaaaatgctagaagtgatatagatgtgaattgtgttttatttcagactatgcctctttctcttacagatagtacgacaatagaaaagttaagagctatttgtttggaccatgccaaacttggagaaagcagccttagtccatctcttgactcacttttctttggtccttcagcctcacaagtgctatacctaacagaggttagttttttgtttttggttttcatttttggatttagttcttgtttaaatttgatccttgatgtgctgctatgaagaatgtggataagattattataaggtggttttgaagtggtcattgtcttagcattcttgatggtgaaatggaggttatgttttaaatcccttttaatacaatccttctcttctccctctcccccttttatttgcaggtagtctatgccttgttaatgcccgctggtgcacccttgactgatgattcctcggattttcagtttcacttcttgaaaagtggtggtctgccccttgtcctgagtatgctaaccagaaataacttcctaccaaatgcagatatggaaactcgaaggggtgcctacctcaatgctcttaaaatagccaaactgttactaactgccattggctatggccatgttcgtgctgtggcagaagcttgtcaaccaggtgtagaaggcgtgaatcctatgacatcggtaatacagactttgttttggtttctaaaatatctagtagtagatagtcatttttaaggttaaatttctcaatgattctaaagtctagagtttaattttgactcagtattaaaattttctttccagtatatgtcttgttgatagaaatgttcacttatttctctatatttgtattaaaaatacacacactcgaaaaaccaaaaaaaaaaaaaaatacacacactctaccctggctttcctactactaatttaagagaccatttccttcagtttctttctgaccacttgagttttactacactctaacttactgtgaaaaaaaaagccacataaatgaatttctaacttgtgccaagcagataccagtggtgttaagattttgtaattgatttagccttttgccagtttctgtcccatcttccttggcttaaactttaattatgaaggccttatcattctgtcttcgcctggatctttgatccattttcctgatctcaacatatgctatagtttaatgactagttaaaggcccaactatgcaaatagttgctaaattactgatagaagacaaaagtctttaggagaatgaggcaagaggattagaacatatcaaagccagcctgggctatggaatgagaggaccttctctttaaaaataaaagtcttaagaaattttctttagaaatcacttagatcatattggaggtgaatggcatgttggtgattatgatatgtagttgttatatatacacatatgagagaatactataatatttcaaggaagaacctttttatttttaaaatagtttgcaaaataattcataaatgaaaaaattttaattaaatttgttgggggctttttttgttttgttttgtggttttgtatgtttgtttagtttttgagatagagtttctctgtttagtcctggcttctcctgaaccaggctggccttgaactcagaactcatagagatctacctgcctctgcctcccaagtgttggaattaaagttatgcaccaccacgtccaggtataaatgaagttttatgatactcaagatttgcctagtagcaatcctaaaggtcaatggagatggaaagtaagagggtgtaattaggtaattgacaatagtgaggcagaataagagggagatcttgatctttttaacgataatttatttttattttatgaaattgtggttctgcctgtacttttgtctgagagtgtcatatcccctggagctggaatcacagacttctattgctgagctgtctctccagcccccaataataattgtattatcttagtctgaccactttcatatgttggaaattttctgtaagccagccaggcgtggtggaggcttataattgcaggatctggaaagctaaaacaaaaggaccacaaattcaaggccagcctgggctacataggacaaaaaaaaaaacagataaaaaaacgaaacaaaaggagtgaacttttccataaaaataaaaatgactaagattatatattatttactgtggtccatttcattaggattttttattttatttttatttatttatttattatatgtgtgtatactgtagctgtcttcagatactccagaagaggacatcagatttcattacagatggttgtgagccaccatgtggttgctgggatttgaactcaggacctttggaagagcagtcagtgctcttaaccactgagccatctcaccagccctcattaggattttttaaagtaaattttggcttaagaggaaaaactgattcttatcaggtgtggtggttattacctgttatcccagcacttggaaagccaaagcagaaaggcagcaatgagtttaacacacacacacaccagctttaacgtgagactttgtatctcaccaaatgaggaagagctcttgttaggataaaaagattcttattttaatccaaggcatgactgcttaatgaagtatacaatacaaaaggcaataatatgcttcttcttgtatcttttctataatactttgagaacatggccatttgctagctgtagatactaaggtattgtaattgtgaagtatttgttggcaattgaaagcaaaataaaaatttagtaatagggatatcttaaacatttacagtatagagaaaagttacaactcaaaatcagaagtattcagctactttatctgtttctcattgattaaaacacttagtatacaattacataaaagtactgctatcttttgtatgttttatttttttataattgtaatttttctaattttcaaagtagaacttgataactggagattatgagcagggtctgcctaaggatacacatttaaaaagatatgatttactgcattttgagatgagtttggacttgatctgttcatagaaacatgggttagatgaatctagaataggggattgtagagaaatctgtgccacttgcataccatgttggcagggtggaatactttgcatgtgaatgtggaaagaaaacatcttgggaatgttgatgaacgccataggaatgattgggtcaagttgtatacagaatactcaaataaaatggttaactgtttttcaggtcaaccaagtaactcatgatcaagcagtggtgctacaaagtgcccttcagagcattcctaacccatcatctgaatgcatgcttagaaacgtgtctgttcgccttgctcagcagatttctgatgaggttagtattgtaagagttatatagggggagtgtgtgtgtgtgtgtgtgtgtgtatttatttacaatgttttacctgtcataattgttactatacaattttttaaaagtttttattctgtgtgttttgcctgcatgtaagatgtctgtgcgcagcttgcatgcctggtgcccttggagatcaaagaggacttttggatgctctagaactggaactacagactgttctgagcttccatgtgggtgctgggaattgaacccatatggaagagcagccagttctaaccactgagctgtctctctaacccaaaacaacctttttaaaaattcaatctagatcattgtttaatgccaacttagtattattagtactttattttcaaattttgcataatagcattctttcagagtgtatatacaatatttagtattcacacaaacagtacacaataattgttctgtactttttttttttttttttttttgcagtcaatacttcccttcagttctaatatccaataaccactaatttttttgtcccctatgaaagtttttattttctagaggtgtgtgtgtgtgtgtgtgtggtttttttagttggttgtttttgtttttgttttccgagacagggtttctctgtatagccctggctgtcctggaactcactctgtagaccaggctggaactcagaaatccgcctgcctctgcctcccaagtgctgggattaaaggcatgccccaccacgcccggctattttcttaagttgtattcagttggattgtgtgcttataatccaaacacttgagtggctgaagcagaaggatattacatagaaagcgagcctgcaagacccaatctcaaaaaataaatacttttttaaaaagctattgatgactttgaattgtcaatgttctaaggttcaatagatcattccttttggttaaatattatcccattgtatgctactcatggtggcacatacctttagacctaggacttgggagacagaggtaggcaaatttatgtgagttctaggcctgcctcatctaaatagtgagactgtctgaaaaaaaaaaccaaaatatgcatgcatttgtgtacactcaagggacacatacacataaataagtagatagatggatcatatatcttataaaaacatatataatcccattattaatattctatggtttgtttatatatgttaccaaatatacttggatttttttcccttttagatatgattagaactgctctgaaatttttataccattatttgaacttcctattctctacacctgggaatgcaatgtttgtcatttctgtggtggtcaacactaacagtattctcaagttttaattaatcattattttataggcttcaagatatatgcctgatatttgtgtaattagagctatacaaaaaattatttggacatcaggatgtggaggattacagctggtattcagcccaaatgaagaagtgacaaaaatttatgagaaggtaagaatcatgagaggaatatgcccactatataaatgaatgttaatgttttgctttattttttatgtgtataagtattttacaatgtgtgtacatatatgtaccatgaatgtctggttccctttgagttcagaaaaagggattggatcccctggcagtagagttatgaacagttgaaagccaccatgcagatgctatgcattcgttgatcctggtttctctgttaagagcaagtgctcttgaccgctgaatcaactctccagctcacacttctccattcttaaggaaaacttgagtaggaaggacttcttgatcagtacagtgtcctcattatattgaacactttgttcttattacgattttggtgtttggtatagtgtctctttgatatattcattcggaaaatgaatgaaagcctatttcagtcacattaaaatcacagcatatttggggttaggaaaaaaatttaaagccttactgagcagttttccagagatttttttaattaaatagcacaataacattgtgccagagtagtggttcataaagaagcaatggttagttgttggttcagaagtgtacaactcagaagggtctctaggagcttcttaactacaaagtgctcaatgatgtatataatcagtatatatatatccaatgccttttgggtcatagcaaaatattgacattagacttagttttctattatagttgtttttaaattatttcaaaaaaacctcacaaaacaggtaaaaagaggaaacatgtagtttaatgataagtgaattttaagcactaagcttttgaagtttcatagtattttcttttaagcactttctaaattaacttactaaggattaggtttctttatttattgcactttgcaaacaatattagtttttgttgtttccttcccttcttcctcccttctcttgttctctctgttcccctgcgaggtgtcttcccttacactttcatattacataggtttttcttttaaagcttctttaaataatttgttcccaattattttacagaccaatgcaggcaatgagccagacctcgaagatgaacaggtttgctgtgaagcattggaggtgatgacactgtgtttcgccttgattccaacagccttagatgctctaagtaaagaaaaagcttggcagacatttattattgacttactgttgcactgtcacagcaagtaagtttcttttttatttttaagaaacttgatcttatttttgtaaaatagaatcaaatttatgttggcacaaggtattatagaaaccaaatactctccatggcacattaatgttgaggaaattttcactttataatatttgacctcacctaaatttgtttaattttagtctgcaaaattgaatagaatattggcctcctgtcttgtattcctaggtgtcagctgttattttaatgtgaaattttataagagggttaccataggagtttatgcataaagatcagttaattgaaatccatcatttttttttcattttaagggtatttaatcagtattagtaatgtttcaagctgcttttatacaagcaattcagatttaagacaattcaaatctgtagaaattggcttccaaccttttataatggtctgattctgatcccttttttttattacttttttctttattggatattttctttatttacatttcaaatgttattccctttcctggtttctgctctggaaaccccccccatcccctcccaccttcccctgctcaccaactcacccactctcactttttttttttaagatttattattatacataagtacactgtagctgccttctgacataccagaagaggatgtcagatctcattgtgggtggttgtgagccacgatgtggttgctgggatttgaactcaggaccttcagaaaaacagtcagtgctcttaaccgttgagccatcttaccagtcccgtcccccccactcccacttctggccccggcattcccctacactggggcatagagccttcataggaccaaaggcctcttctcccattgatgtccgactaggccatcctctacattatgtatgcagctggtcatgggtcccaccatgtgtactctttggttggtggtttagttcttggaagctcttggtactgattagttcatattattgttcctcctatggggctgcaaaccccttcaactccttgggtcctttctctagctccttcattggggacactgtgttcagtcccatggatggctgtcagcatccatttctgtatttgtcaggcactctgatcctgatcttataattataaaaactaattaggccagacatggtggcacacatctttaatttcagtactttggaagcagtgacaaggggacctctgggtttgcatctaggctgctctacattacatgttccaagacatccagggctacatagcaaggccatgtctttttaaaaaaagtaaaaaaataaaaaacaaaaaaccaagcacaggtcattggcagtggcagcgacgttggcagcgccaccgtacacacctttagtcccaatacacctatcgctgaagaggcagaggcggttggattttcgtgagttcaagaccagtctcttttaatagagctagtttaggatagccaaggtttcttaaagaaaccctgtctcaaaaacaaaaaaccaccagaaaaatctaattggtactgttaatggctcaggtacaacttacctagtccttgaacaacacattaatatgatacagtggagtatcaagtgagaatgtttaacgatcagaaaagagtgatttccttgaaaacagccattctggcccatctgggtggtagttcctttaattctagcactggggaaagtaggaggcagtggcagacagatctttgagttcgagcccagcctgttctacagagtgagttctaggacagccagagctacacagaggaacttgtgtggggttgtggaagaaaagaaaccctttttcatgtgatcaaacaaatgcagaacagggaaagcttgttacctctattggataatggtgccacagttagacatctgtgtacattataaaaaatagtatgaatcattctagttccatttaatcatcttcaaggaaaattgtataaaacacagtagttctctgtcatgcttttcaaatcaatactacagtataaagaagagttgtagcagtatcctttctatgatagcataattcccactggaccctcttctaaggtacacctggatcaaaattctgtggaagggggactggtaggtgttttaaggtttgatatggggcattttatatctattagagcctgttcagaaaaaggttagaaggtattcctcaaactcttcagtgacagtatgaggtcatagccttgaacatgcattagtaaactcatttacatgttatttttccatgactatttaagtggatgttagttcatgttcctaatgtatcacccccttccccaagagaaaacaatatattaaacataaatcatttccatttcagaactgttcgtcaagtggcacaggaacaattcttcttaatgtgcaccagatgttgcatggggcacaggcctctacttttcttcattacgctgctctttactgttttgggggtaagagatttaaaaatatgtttaccagtgtaattccttcaacaaggaatgatattctggaatttgtggatttagcttgaactagttagggcaatctatacttaataaaacaatagttaactcagggtttttgaaaagggaattcaaagtataaacatattgattcactatactgtattttatcattttcagagcacagccagagagagggctaaacactcaggcgactactttactcttttaagacatcttcttaattacgcctacaacagtaacattaatgtgcccaatgctgaagttcttctaaataatgaaattgattggcttaaaagaattagggtaagttgtagttaatactttgtttatattgttaagaaatagtgcttcatttataaatggttcataatttagaacattttaagcttaaaggggaccaaagaacatacattacattgttgggttttactttatagaatagaatgcattactacttacagaaaacatgtgcttaagatttaatacaagctaagcatggtaccacatgtgtttaagcccagtacttgggaggcagaagtaagcacatttctatgagtttaaggctacatactgagaccttgtcagtgggggtgggaggggttgtcatattgaggttcagcttttctgccttttatttagcaagttatcattttaaagaaattactgcccctccctgcctcggccaaaaaaaggtagtcaaatacactaactttgatcataagttgttgaagaccacatgaaaatttatttctgaggaaatctatagttgtattgattacttttctgtttctgtaatgtgatatcacaacaaaaataagggagagggaatggggtttaagagtccatcatattgccgggcgtagtggcgcacgcctttaatcccagcacttgggaggcacaggcaggcggatttctgagttcgaggccagcctggtctacaaagtgggttccaggacagccagggctatacagagaaaccctgtctcaaaaaacaaacaaacaaaaaaaagagtccatcatatcaagaaaggcatggcagtagaagtagggagctggccattcacattgaaactgaagaatccagaaagaaagaacaggaagtgagttgaaaaatcaaagccagcagacacacccttctagtagctaatgtatttcctccagcaagattccacctcctggaggtttctcaggtgtcccaatcagcactgccatctggggaccaagtgttcaaacatggaatcttattagggaacatttcacacccaaacttgaacagagtttagccttcagattagcacttctagtagtcaaagcacatgtatagaaatttgaaagtttaacttgcttgaaaggaaagcattggaagaattgtctaatatccttctagctttcttgttctgattcctccatttcataagttaataaatatttgatttttgtatccctttgacaggatgatgttaaaaggacaggtgaaacaggtgttgaggagacaatcttagaaggacaccttggggttacaaaggagctactggcttttcagactcctgagaaaaagtttcatattggttgtgaaaagggaggtgctaatctcattaaagtaagttctgtgttcttggttctaaactacatatcctatccttgtaagtattgtcgtttaatatgattgttagcactaggtctttggtgtatttgttatcatttttaatttttgatattataattacattattttctcatgctttcctccctctaatgcccaatatacccttgcttgctcatttccaaaatcacagcttttaaaaatatattttatttaatcttttttttttacactccagattttatccccctcccagtccaccctcttgactgttccacaacccgtacctcgtgtgtccccccaacccccgtccccatctccacgaggatgtccccactccctggggcccccagtctcttgagggttagacgtatctttgaacccagacccagaagtcctctgctgtatatgtgttgggggcttgtatcagctggcatatgctgcctggttggtggtccagtgtctgagagatctcagggctccaggctaattgagactgctggtcctcctacagcttgttaaccatctccttagctttttccattccagcttttccctaattcatccacagggattagcagcttctgtccattggttgagtgtaaatatctgcatctgactctttcagctgcttgttgggtgatttggagggcagtcatgataggtccctttttgtgagcactccatagccttagtaatagtgtcaggcgttggggcctccccttgagctagatcccactttgggcctgtcactagacctccttttcctcagttccttcagttctttcagacaggaacgattcgggtcagagttttgagtgttggatggcaaccccatccctcacttgatgcgctgtctacaagttccctctccctctgagctccctccctttgagtcctgagaatgtgtcacttcccaggtctctgctatattctggggggtgaggggagtctcctacctcctgagtttgcctgtttccattctttctgctggcccacggggcttcagtccttttccctcacccaatacctgatcatgttcccctcttccctttctgtcccctttcccatccaggaccctccttcccttccccctcctatgattgctttcttctccctcccaagtgggattgagatgtcctcacttgtgtccctcagcctgttaaccttactgagttctatagactgtatcctgctgattctgtgctttttttttgggctaatacccacttattaatgagtacataccatgcatgtccttttgggtctgagttacctcactcaggatgatattttctagatccatccatttgcctgcaaaactcaggatgtcctagttcttaatagctgagtagtattccattgtgtaaatgaaccacattttctgtatctattcttctctcatgggacatctgggttgtttccagcttctggctatcacaagcaaggccactatgaacatagtatagaacccatgcccttgtagcatggtggggcatcttttgggtatatgcctaagagtggtatagctggatcttcaggttgatctattgccaattttctgaggaattgaactctgtggcacaagaattccattggctcacgttctaagatcaggaattgataaatggagcctcatgaaactggaaagcttctgtaaggcaaaggacactgtcagaaggacaaatcagcaacctacaggcaaggaaaaaaaatcttcactaaccccacatctgataaagggctaatatccaaaatatatgaagaactcaagaagctaaccaccaaaaagccaaacaacccaatcaaaaaatggagtataaaactaaacaagagaattcacaacggaggaatctcgaatggctgagaagcacctaatgttcaacatccttagtcatcagggaaacacaaatcaaaacaaccctgagattccacctcacaccagtcagaatggctaagatcaaaacctcaggtgacagcagatgttggatgtggagaaagaggaacattcctccattgttggtgggattgcaaactggtacagccactctggaaatcaatctggagattcctcagaaaattggaaatagataaaacctgccttttaagaatttttaccaaggttttacaatgtttgtttagataatataaagcactagttagtgtctttcagtaaccattgcatgtttgtaggtgttatatgtatgtaaaatgtaagtgtaaagtgttacttagtttatgtctttatacctttaaaaaaaaccaagaaactacatgtttggtaaataggtaaaagtagaatatttttattagaaaatccacaaaaaatttctgtgatataagacttaaagacagaaattctaagacaaatatttctctttccagattatgtcactgctaatatttaatcctttctttcaactgtttaggaattaatcgacgacttcatctttcccgcatccaatgtttacctgcagtatatgagaaatggagaactccctgctgagcaggccattcctgtgtgtggttcaccagccacaattaatgctggttttgagttacttgtggcattagctgttggctgtgtgaggaacctcaaacagatagtagattctttgactgaaatgtattacattggtacagcaataactagtaagtacttttaaacatatggttatccttgacatacacagagccagtgactttgatgccctgtattccataaactaggcatggtattaatataatcccagcactggggagggggttataaaaaacatataaaaacaggaggatcttaagttgaatatcatcctcagttacattgatagttccagtccagcttggctatatgagatactgtcttataaacatacaaataggatcatagattggtaggtgagggagcctgcaatgatgtgggttgctgtcttttttttttcttttttaaagattttactttatgtatatgagtacactgtagctaatcttcagacacaccagaagagggcatcagatcccattacagatggttgtgagccaccatgtggttgctgggaactgaactcaggacctctggaagagcactcagtgctcttaaccactgggccacctctccagcccatggattgctgtcttaaatgcatttattaatggagaaatgccatgtgagagccctgcctcctgtgactgctcaggtagtagtgtctgtgttttgtcagcttaagagaacttaaacatcataaaatcacttctgtctttgtttttcagcttgtgaagcacttactgagtgggaatacctgccacccgttggaccccgtccaccaaaaggatttgtggggctgaaaaatgctggtgctacttgttacatgaactctgtgatccagcaactctatatgatcccctctatcaggaatggtattcttgccatagaaggcacaggtagtgatgtagatgatgatatgtctggggatgagaagcaggacaacgaggtaaatttcttttatcacttctgttctctgtgaaactcttgattaacaacattctttcattagataccaagggaataagtacagtcaccagtttccacaggattcccctccaaaagccctcaacccaagatggcaaaatttgccaatatacaagtagtctaaatggaacctacacaaatctattttcatactttaggtcatctgtagattacatcaaatctctcatacagtgtcttatataaaagtctgggcatacttcgtgaacccacagataaatgttagtggatatgaagatttgattgtgttgtgatttccttccttagactgtccaaagtatgtttgaaggttggcacagcctctgccacttgggctacctcttagtggagtgtgtctccattacagcagttacaaagaatccatctctttgaaagtagtgtttgatagaagttgaaatttaactagtttaaatcgacaatggccaaccttttggcttttctgagccatattttggaccaaaatttgtcttgtgccacacttcctttcccttcccttcccccttttttgtttctgtgattttttttttttttttaaggtagtcttgctatgatgtccaggctggcctctgaaggtctccagcttcagttttccaggtgatagggttatagtgtataccaccacactaggctaagtttttcacttttatctgtgtttgctcccttttgcttacacttatattttccctcaagtcttatctcttcctgcttaaaaacaaaactcttgcctacttcaaatactgtttacatgatcttgtgacaaaagtttaagtttcatgaaaagtaaccaaagcagagtaaagcaatgggaaaaaatgtaactggtaacaaccagtaaacgttgatggtgggggggctggtgagatggctcagtaggtaagagcactgactgctcctctgaaggtcctgagttcaattcccagcaaccacatggtggctcacaaccatctgtaatgagatctgactccctcttctgatgtgtctaaagatagctacattgtacttacatataataataataagtctttgggccggagcaagccagaggtcctgagttcaattctcagcaaccacatgatggctcataaccatctgtacagctacagtgcactcatatacataaaataagtctttaagaaaaagttgataaccgtcaaagaagagaatgtagcagtactgaagttggttcttttttgtacccacactgtgtgtctgtgttgtttgttgttttatccacgtttatagtgttagactcccatgagttgtatttttattgtcataagtgtttttagatattttttcttttcttcccttcattcagcaaaattggacttggtctgaagaaagagcttactacctctggggcttctaaaccaactctttcccagacctcctgaacttagatgatccagggattggggactgagtatttttactttctcccaaagcttcatatggggagtttacatccaaaacctggttaggaactttattcctatactcaaggtttcaaatacaagatgtccactgaagtataaatttttctctgtagccctcaaaattttgaaccttggtaattttcatgttataccttctaccactatttgtgtttaacttaaggttctggctatgtttcccaggttgcccattaccttctgggctagccttagtagctgggattcaaggcacatgctcttgatgctcagctttattacttgttttccaaggtcttaaaatgtgcttcctcgccttagctcctatgaatactgcggccatgaacatgaatatacagaaatctcttagaccctgcttctagttcttagcatagtaggtattgtggttgagtttaaagtagaacatctttgaacaaaagctccttaaatctttctgctcgtttttttttcttcaaagcagtgtttctatgtagttctggctgccctacaacttgctgtgtagaccagattggcttcatactcacagaagtctccctcctaagttctaggattaaagacttgccagctttttgtattttaaattttgaattgtgggtttaaggagtcctctgtctattcaggattctacctcctcatcagataagtgattttccctttttcctcccactctgaattcattgcctctcttggcagtatttttatataaaagtttttcattttcttgagatccaacttgtttgtaccttcaacatcatagtaagaaattgttatcagctacaatgtcttaatgattttgccttccaagtttggttttattcttttaactctaacttttaggactttggtacaaattgttttttctatgtaattttaaggagagctcagcttcattttttttataactattaatgtctatattctcacatgaaatggcaggaacaaacactaactgtaaattaaatgtatacaccttttgaaaattaagtgcttggaaacaaagtaaaagtgtatgttcactaactggaatttatctcaacatattttactaaacttctgattagctcattaataatacctttttggtttctagagcaatgttgatcccagggatgatgtgtttggatatcctcaacaatttgaagacaaaccaccactgagtaaaacagaagataggaaagagtacaatattggtgttctaagacaccttcaggttatctttggccatttagctgcttctcgactacagtactatgtgcctagaggattttggaaacagttcaggtaaagtagatggacagtgataaaccacatatcttaataaatagctcatattcctaaaatatgtatcttaagatatctttatgttctagccttgattatgaaaatataagatgcatatacagtagaattatcgtaacatatattccttcctactactttctaaattattttgagacacagatcacagataatagtttcacctataaatacttcattgtgtgtctttgttttaaaacataatgaatctattactgtgctttttaaagatcccttgatattgaatatattcagcatttcaactttcccattatctcatataatttttcccaaatctgaaaccatgtgaaaaccatatagcttaaatagtattttctctcttttttttcctgcatgttctttaaggtgcccagtgagatccagaggcttgatcagattagcatatttttggttttgtgcaggagataggcatggctattagatgggtgatatgcctatatagttttacctccatgaggagttggtacatggcatttttctgcctcttctgatggtagcagcaatcatattattcagcttatacaatgaaattcttccagctgttactctatcaaaggaacaggttaatttagagcagttttgatgatttgaaatccaagattgaacatttgaaggaggaagattcattgattgccttttcataatgatatagaggcccactattgctggattgtgtgtaggagaaaaaccatgaaagaatagacaaggccaccgtgcgatggtggcgcacacctttaatcccagcactttgggggggggggtgcaaagggaggcggatttctgagttccaggacagccaggtatacacagagaaaccctgtctcaaaaaaacaaaaaaaagaatagacaaggccaggcttactgtttttataatattcatttggtgagaacagtctttagcttatatagatggtgagacactgcctcaccggctgttttgctatccatatcatgtttcctatagttttacagtaaatacagtgtgctgctctagaaggttgattggggtgcttggtttttttgctttgtttttttttttttttttgtttttaagtcagtacctactgtgctatagtacttcagtaagaaacactacactctctaggtggtgtacacttgctaggctggggggtggcagcagtggtgccacatgcttttaatccctgcaatcaggagacagagtttgagcccagcctgatctacatagtcagttccggacagctagcgctacacaaagaaatcccatcttttaaaatagagaaaaagaaaaaaagtcactgtactcttcatagcaatatatagtgttttgttacttaaataagtactatttcagggtgcaggggatacagttaagtaatatcatacttgcctagcatgcccaagggccttaactcccatccttagcagtgaaaaacacaactcttccaagggacctctaggcagctgacagaactagatggttgcctatcttcccctgcttctggcagagtgagaaagaattgtttttttatactcccagcaacaagaacaattgcagtttcttatagataccctaactaagcccctacttagtcgacactgggagcttgcctgtaacactttattcaatattatcacccagaaacacccccattcctcttctcagtctatacatcctgttttgcctctctaagacttttctaaatccaaaatatcttcctgttattctaagaattgcacactttctcaccttttatgctgaaatttgtctcttgattatagttttccttcttgtattttgttttgtggcttagattttggtgttttgaaatttgttgttatttgagacttgtagatagcccagcctagccttgaaatcaggattcccttgcctcagctacctaaatactaatattataggtatgtaccacagtgttaggtatttttatctcttcttacatgcttggtgttttctgttccatatagtagttaggtttgtatgattggttctttgcaattatattcagattaaactttggagagagcaagaaagaaaagcacattaatgatgttgtaggcatctaattgcacatgcatgagcatctgttcacttaataactcacgataagaactggtacctcggtgtcttaacaaatgtctctgttgtaaggggtatatgtatttcaaagtgtggtgaattgtgttacagcttgaaagtaaatagagaagactagtgttatttccaatagtgtaacaaataatagatctgattttttgttgttgtttttgatttttgagacagagttcctctgtgtatccctggctgtcctggaactcactttgtagaccaggctggcctggaactcagaaatccgcctgcctctgcctcccaagtgctgggattaagggcatgcgccaccactgcccggcctgaattttttttttagtctatggcatatataaagtacatttgtcataatctcttgggaagaatacacttaggtcctctgtgtgtattattctgtgactacaatgtcacctgtagattccatcagagccttactgaagcaatggctattctcagtttgtgttatatacatatgtaggaatgataattttggaattagtttatctaagtccttagaacactgaaaagagattaaatagaataaattaaatagaataaatcaagcttttcttttttcacatagaaaaatcagcttaatgaatgtacatgtacacattctttttgtctaatccaaaatgtggcaaaatgcttagtgataagatccaccatctcattttaatggcatctacagctgagttcaaaatgcatgtgtatgtcacactatctgaagcaacaacctttctttcttagggctatgctgtttaccaaccataccattagttctgtggcaattctttgccattttaataccacttttactatgggtctcactgtccccctcaatatctggacataaagacttttttgtgtttcctacttgctccataattgccttacccacaactgtaagaaacaaaatgttgtattgtggttgtcacatgttacatgttatattccattcatttctcaggctttggggtgagcctgtcaatcttcgtgaacaacatgatgctttagagttctttaattctttggtggatagtttagatgaagctttaaaagccttagggcatccagctatgctaagtaaagtcttgggaggttcctttgctgatcagaaaatttgccaaggctgcccacataggtaagtgctaatatataatactgtgatatgctaataagaataaaatctttactagtgctaatatgaaaatggaatatgccactattaaactcctacaactgaataagtacagtgaatatcttaatactgtttgatggttttttgtttgttttgttaaataacttgatttcttttggtgtttttaatgtcttactatttcatacttttaattcttttatattttcctaaggaactaagatgacaatttgcataatgactagagatattacttccacgtttgccttttatcttagaatttagttactgtagatacactgagtttagaggatgacaggctacaggtgttatttttttaatgagataatcacttttgaaacaatatcagctattgccatcttttccctacacacctaatatcatcatattaaggtatgtatacatacaacatactgtaaaagttaaggtgaaaacgtcatattttgttgttgttgtgatggtttttatttttattttttttttgagacagggtttctctgtgtagccctggctgtcctggcactcactttgtagaccaggctggcctcgaactcagaaatccgcctgcctctgcctcccgagtgctgggattaaatgtgtgtgccaccaccacccggaggtttttaattttaaaggaacttttagtaaaggggcttttaataactcttgtctgtagcttgtccctaaggcaggaagattacaaaggtttaagaatacctattaaaaatagctaagggactggtgcagtaactagagtcttaagagcactgacagctcttgcaggactagagtttcagttatgagcacataatgttggctcacaaccatgagtaaccttagttttggcagctctgatgacgacctggcctcctcaggcagtaggcatgcatgtggtacagatacataatactcatagttaatagaagacaatctatatccattctctctgtataaaatattaaatatgcattactgactgtcaaatcacaccaacgttctattacagtgctataaggaaatctgttactgtgtgtgtgtgataatttaaaaattggaggcgctagagggaggtccaacttaataagaactggctgttctgccgggcggtggtagcgcacgcctttaatcccagcacttgggaagcagaggcaggtggatttctgagttccaggacagccagggctctacagagaaaccctgtttcaaaaaaagaaacaacaacaacaaaaaccctggctattcttgtagaagacccaggttcaattcccagcacccacctggagacatacaactgtctgtaactccattttcaggagatctgacacctcctcctggcttctctggacactgggcatgtacagtatatgtagagatacatactggcacattcatttttgtaataacataaaataaactagagctcaacagttacaagctcttgctgctctccagagaaccaagtttagttcccatggcacacaaactccaaggaatccaacacccttttctggccttgataggcatacaacacatggcagacacacaaacttacacataaattttaacaataacaaatactttttaattgggggcagtgaggtggttcagctggtagaggcatttggaggttcaagttggcaaagtgtcaggagagaaccaacttgacaaagttgtcctctcaacatgcattgtatatgtaatagcacctgcagccacacacactataaatagtgcattttaaaaaatagttttcagccgggcggtggtggcgcacgcctttgatcccagcacttgggaggcagaggcaggcgaatttctgagttcgaggccagtctggtctacatagtgagttccaggacagccagagctacacagagaaactctgtctcgaaaaacaaaacaaaaaaaattcgttttcggtctggtgagatggctcagcggttaagagcacgactgctcttccagaggtcctgagtccaattctcagaaaccacatggtagctcacaaccgtctgtaatggaatccgatgccctctactgctgtgtctgaagatagctgcagtgtactcacataaataaaaataaataaatcttttttaaaaagaatttgctcactctatatatacatacttaattacttttggtagattggcataattgagcactttccacaggggcccataattattctcaaaacaaatcacaacatggtagactaaaaagagcttaagctcaagtagccctgtctttttgtttgtttggcttggttttgtttttccaagacaggtttttttctatgtattcttgggctgtcctagaactaaaacaggctgaacttgaactcagagatttgcctgcctctgcctcccccagctggcctattttcattcccacttcactcaagtgtggatggtgatagttctcaagtaattttgtcacgaaggcaaaggacagcatgtaatcaaccagcatagtgtaaataactaggaaatgccgtcagtattggtaacatcccattaccttagaggtttcattaactatgtaaataatgaggtgtttagagaactgaagagtgaatccttttctgataacttcttaaataatatctttaggtacgaatgtgaagaatcttttacgactctgaatgtagacattagaaaccaccaaaatcttctggattctttggaacagtatgtcaaaggagacttactagaaggagcaaatgcttatcattgtgaaaaatgcaataaaaaggtatgaattaatctatttagataacaatggtacctcttaactgaaaagctctgggtagtcgatagtttctagtgaagaaaaacagttttctttaagagagagagagagagagagtgtgtgtgtgtattttaaaggaagaaatttaaaaggtaatactagaataaacaaaattgtaaaattgtaatcgcttaatacctttgtttatatgaattaatatgggtacatttgtttctgcctagaaacaaactccagagctgatggaggaaaacatttttcctcttatatccagaattgttttgctgaaattatttttttaaatacagtaaaaaaattttttaccacctgattagattttgtccattggaacttctctcttcaagggagagggacattcatacttaggaatagtaaattatgtttatcttttctgccttccaaaccattttacctctaagtcacctttattgtttggccccacaccacttagagaaggatgaaagtctgtacattgggattatggggtatgaaacaacaccgtctaccactgtaggttttgaggcatgagacaagttcctaaacttagcaggacaccctatcttaaggttcagtagtgccatcttaggaggattgtaaggattaaatatgttatcacctgtataatattaactaccttctaattgcccaataaaaagtaaactattcagtttgtttacagcaaacaaccttagttggaataactataaataacaaacagtggctaaaggcaaaggtagtatagaaactaggcagtaaataatatgtaaaggactaatttttgcaatctgtattaaccggttataggccatttccagttaatatttacatcaacttcacagaaatatcttaagattacaattcaagtaaatcttataaaaacttgatgtgtagtgctttttaagagtttgcttaaggggctggtgagatggcccagcgggtaagagcactgactgctcttccagaggtcccaagttcaaatcccagcaaccacatggtggctcacaatcaactgcaatgagatctgatgccctcttctgttgtgtctgaagacagcgacagtgtacttacatataacaataaataaatctttttttaaaaagtgactttgcttaagaggctagagagaaagctcagccatgaaaagtgcttactgcttttgtaaaggacttggatttagtttccaacaccaatatgtcaggcagttcacagtcatctatggttccagtttcagggactctaatgctcttgtttggtctcagccaccagcacacacttacacataaaattatttactctaagagctacatatagtgatttacaactacagaagaaaagcccaagttccaggttcaggcctgcctaacttcatagtgcactaatctgaagccaactggaactataatatgaggccccctatcccaagggaaaaagatttaagagaaaaaagtttacttggtctcatggtcttgatggttcaagcctgtaacttcaaataggagactgaggcaagaagatcatacattcaagacctgtctgggctacagagcaagttcaaagccagcctgagcttaagagaattagaaatgtagctaaaggatgactgcttgcttaacatgtgtgacaccctgggttaactttcagatttggggatggtagtgtttgcttggattttggtttactttttgcaatggattgtatctattaattttctctattgattttaggttgatactgtaaagcgcttgctaattaaaaaattgcctcctgttcttgctatccaactaaaacgattcgattatgactgggaaagagaatgtgcaatcaagttcaatgattactttgaatttcctcgagagttagacatggaaccttacacagtggcaggtgttgctaaactggagggagataatgtcaacccagaaagtcagctgatacaacagaatgagcagtctgaaagcgagaaagcaggaagcacaaaatacagacttgtgggtgtgcttgtgcacagtggtcaagcaagtggcggacattactattcttacatcattcagaggaatggaggggatggtgaaaaaaatcgttggtataaatttgatgatggagatgtaacggaatgtaaaatggatgacgatgaagaaatgaaaaaccagtgttttgggggagagtacatgggagaagtatttgatcacatgatgaagcgcatgtcgtacaggcgtcagaaaagatggtggaatgcatatatacttttttatgaacgaatggacacaataggtcatgatgatgaggtgataagatacatatcagagattgctatcaccacaaggccccatcagattgtcatgccatccgccattgaaagaagtgttcggaagcagaatgttcagttcatgcacaaccgaatgcagtacagtctggaatattttcagtttatgaaaaagctactgacatgtaatggtgtttacttaaaccctcctccaggtaagtgtcaagagttcgcttcttatagcaaagagtaattcttatctttaagatttattagtaggctgtgtgtgcgtgagtgcgtgtgctgtttttttaagatagggtttctctgtatagctctgaatatcctggaaatcatgctgtcggccagggtggcctcaaactcagagatcacttacctttgcctcccaaatgctggaatcaaaggtgtgcaccaccatcgccctgctatctttattcatatctataaatgttttgcctacatgtatgtctgtgctatatgcttgaattcttgaggaggccagaaaaaggtattagattcccctgggactggagttgctgtgtgggtgctgggaacttacccttggacctcagtaagcccaacaagtgctcttgattgctgagccatctctccagtcttcagtcccctttttttggcaggtgaaggtgtgtgtgtttggttggttttttttttttttttttttttttaagatgtttctttgtcaccctggctgtcctagaactcagaggtctgcctgtctctgcttccggagtgctagaattaaagctgtgtgccaccatgccctacttaaatatataaaattaacattttcattttgaaaggatgtaagttgatgcttttggctaaaattacatttaagatgatttgtgtttgagtactaagtatttattgttatactgtttggagataagtttttgtttgttcaagctgatttttgtttaatgcattagtataaagcattgtatttggctctaatatcagtaataataatttcataagtagtctaagaagagttttaacaaagtgagaatgcaaagtacaaacttgtttgaaaatggggcttgaacagacttttaaaatatgtgcatgtggttttttttgttttttttttttagggcaagatcacctgtctcctgaagcagaagaaatcactatgattagtattcagcttgctgctaggttcctttttactacaggatttcacacaaagaaaatagtccgaggatctgccagtgattggtatcttgttttggatttttatttctgtttaagatttggtggtggtctttgtagagtgctctgtatttttttttcagaatcacaagacttttattcaaacttaagaggcaacatttaaaaagtatatagtaataagaaatcatactaaaatacttggcataaattcaaagggtaaaaatagtatagaggccattataatacctttttagcaattgttatttactcagggccattgatagggttcagtggtgaaagctcttgccaccaaaccttgacaaaactgagcttaagcccagaaccaacatggtagaaggagagaacctgccaggcagtggtggtgtacgcctttaatcccagtactcaggaggtataggcaggtggatttctgagtttgaggccagcctgggatatacagagaaactgtatctcggagagaaaaaaaaaggattcctgccaatagagtccatttccctcgcgtgcgtgcgtgtgtgcgtgcgtgcacgcgcacacacacacacacacacacacacacacacatgtgtaaaaagcctctttacatatccagaagatactatactaaggaaagaagttatttttgtcatttttttggagacaagattactctgtatagatatcagtattttgaaattcactctgtaaaccagactggccttgaactaagattcccaaattctgggattaaagatttagaggattaaaccacctctggctagtagtggatttttaaatacaagcttttgccaattttataattccataagactaggccaatctatatagtatccatctctctcctcctcccctcaatgtccacttcatcctaccccaccccatacacacagggtttactataagaaaggtgaactgaattgatagtctgatagttgtactttgttttgttttaggtatgatgcattgtgtattctcctgcgtcacagcaagaacgtgcggttttggtttgctcacaatgtcctttttaatgtttcaaatcgattctctgagtaccttttggaatgccctagtgcagaagtgagaggtgcatttgcaaagctcatagttttcattgcacatttttccttacaagacgggccttgtccttcaccttttgcatctcctggaccttctagtcaggtaattgtacctttgtttatatatgtatttacaaaaaaaaataaactttcctgaagttgaagagaaacagaatgtgtgttttatgtgtagcacaaattatctgacacctagactgataaagcaacagtgtgtgtagataatgtcttcaaaagataatttcccgccaggctgtggtagcgcatgcctttaatcccagcacttgggagacagaggcaggcggatttctgagttcaaggccagcctggtctacagagtgagttccaggacagccagggctacacagagaaaccctgtttcaaggggtaaaaaaaaggataattcccttttgtgcttgctgacaatgaaaactggagccttgagtatttaggaatgttatctaccactgaagcacaccccagcccaacccacgttgtgtttccatgtgggattttcataacacttcttttgggtggatctttaataaacatttttggtgttaattgcagcaaagtgaaaaatctataatgaattccaaagctgggtgtggtgccacaacagtttgtggtacagacctgtaatttcaactgctagagaattgcaagtcagctcgggccaacttagttgagatggtttcttcaatagtaagaagagatcttggtagataagctcagtggcaaagttcttctctaccattagcatatacaagtcctttgggtcaatctagtgttggtaagcagggtgaatagaattcatgtgatcagtccttccagaaaagtattcttatttcaacatacacataaaataatctttgcactttgttgagaatcagctagtattttctcctttacaggcttatgacaacttaagtttgagtgaccacttactaagagcagtactaaatctcttgcggagggaggtttcagagcatggacgtcatttacagcagtatttcaacttgttcgtaatgtatgccaatttaggtaagaattaaatttttcataatctctgttaaagtatcatgttaaatgatagtcattcagaaggtccaatgatgaaataatgttttttcttttttctttatatgaaactgtctctaaatacagaatatcctttgcccgaacccctgtgcactttataattttttacataatacttctgtggtaaacacaagtgagattctattgtcttaagttttgcttccaaaaagcaatactacatctacctgctttattaatatactcattcccaggcgccatccaattcactaactgaatcagaattaccacagttagtgcaaaaaaaattccatgtttttactgtgaagagtcatcaattttggaataaggtctagaaaagaagtaaaataaattaaaattagaggaaataatgtccattcaattagtgctagcagtataggagagcacttttctcatactaattccaggtttgatttccagcatccctaataattttttaaactaagaattgacttaaattactccttgatctttctaatactacctgctcattcctgttatgttactactagaactgtacctaaatatcatgcacaattgtcttccactgttttattttgttgcaaaagattagattgggggacaatagttgtctaacatggacattttcagcatcaaaggatggggtacgcctttagtttcagtactaagagaggcagacagatctctgagttaatttcaaatatttgtcctttttgttttgttcacaaagttcattccatcctaatgttttctttctctgttttcccccctctctacttgctttctgtctctctttcactgcaggagtggcagagaaaacacagctgctcaaactgagtgtacctgctacctttatgcttgtgtccttagatgaaggtcctggccctccaattaaatatcagtatgctgaattaggcaaattatactcagtagtgtcacagctcatccgctgttgcaatgtctcttcaagaatgcagtcttcgatcaatggtaatctattcttggcaatagttttgagtactctgggtcatatctagaacttgatcaaatttggttctgaaaatacttaaatacaaagtgagggtgtgaaggaaggtccactcttgaaacattttacaatgtttgcagtactgttcctttttcacatgattattggacccttttctgcttgctactggattaaattagtaaaatttttatgttgggataccgagtcattgaaacacactactattcttagtgcttagaaaaattgacatacagctctttttttttttttcctaaaacacatttataggctatgttctgataagtttacattgttattgtggagacacttactggttgttaattgacaaatctgtattgtaggtaatccttctcttccaaatccttttggtgatcctaacttatcacaacctataatgccaattcaacaaaatgtggtagacattttatttgtgagaacaagttatgtgaagaaaattattgaagactgcagtaactctgatgagaccgtcaaattgcttcgcttttgctgctgggagaatcctcagttctcatctactgtcctcagtgaacttctttggcaggttaagaaatcataaccattgttaaatctctatgatttgatttattacccatatgtactttattcactgtgtcttaacctatttctaggttgcatattcttatacttatgaactccggccctatttggatctgcttttacaaatcttactgattgaagactcttggcagactcacaggtggatactttattttttttttatcaggctaattagacttagtcccggctgttacatataatagaaattgaccatccccacatttaacaaaatatataacaaaagcaccctagggttctagtgaatgttcagtgttacaagaaaaaactcaagacaggaatgactaccaagttctcccagattttgtcagtttgtttttgttttttgttttttgtttttttttttttacaatgaggacattgcccaggtttcatacttaatatattaacatcatgtgccaccacgcccggctctgaattttttttttaattaaagaaaactagcaatagactttatacatatgaatttattaataaatccaaggattgttttaggtttagattacattacttttggaactaacctcattacataaatctgtagttatttagtgatagttctggagagcagagcataaagacacatgcttttaattccagtacttgggagataggcagtcagatctctgtgagttcaaggccaatcagggctacaccaagaccttgtttcaaggtggctcagctgaatttaatcccatgtggttgaagaaaagcaagttccctccagctgggtgtgtacgcacacaccacaaacacacccacatgaatgtgtttggggtgttgtggtggtggtagacttttttggttgttggggtgttggggttttggtggttttgttttttagtatcttaataaatacgtactgctaactcattaacattgaacttaacagccagcactcttacacctctcgcctagtgtaagcttctttagtgcacactttctgtaagacaaacttcagtgctatacatgaaggccaattataacagcaaaagaggacacttgtttgtagtttgaaactgaaacaagacaaagtcactttattcaacctctactaggaaattgtgagttctgggcaacttgaatcatttgctaacaaagcacattaagtacttatttttgttttggggtttttgtttgtttgttttttttatgttggacacacaaggtttcgctgtgtatccaaaactgtgctggaacttactctgtagaccagttagacctcacagagatctgcctgtatctgcctctcatgtgctgggattaaaagagtttttaagtattgatttttaagattagccattctagtggctatagagatgactgggtcattaaaaatacttgttcttgtagatgaccaggtttggttccccaacactcacatagtggctaagatacccaccaggcatatatgtactacatgcaggaaaaaacacttctacatataaagtaatagaaatattttaaaatacaaatgttttttatcattgttttaaattactgttataaaaatagcagtaagcaaaaaatcagttttcttgaatccaaaattttctaagtggtcaccattgatacttcttagatgattttaatacagtctagcttctagtatttttcttttaaaaatagcacaagccgggcggtggtggtgcacacctttaatcccagcacttgggaggcagaggcaggcagatttatgagttcaaggccaacctggtctacagagtgagttccaggacagccagagctatacatagaaaccctgtcttgcaaaaaaaagcaaaaacaaaagaaaacaaaatagcatacgattgtatagctttaatggtgtggtagcatatttagaccttcaatcatattattccaagacagaggtaggcaaatccatgtgagttccaagccagtcaaggctatgtagcaagacatagatagatagatagatagatagatcgatctaagttctcttttagcatatgatatgataaaaacataggttggattaaatgtgagaaataccaaaagtagtaagtaaaaacagatgattaacttaagtttgaaaataatcttatactgtagcttttttgttttgttttttgttgttgttgtttttagtttggtaagtaggtcttaagtatttataatgtcctccatgtgtcctacattattagacatgaaggaagcaacacaaagatagtactgattaaagatggtatttggaaaactgttggtattagtgggaagaaagtatgatatgtcaaagtaatattctaacactttatatcagttgacaaaataaaggtaaggttagggtagcttactggcagagcacttctaaaatgggttagaccagccctcagcctctgcactgccacccccaacacaaaattggagaaatagagtttatatgcaatatcttaggtcaaacagcaagaagcctataaccatttagacacccttggttactcctggcaacctgcttgcttctataactgtgcctgttataatcattttgccaaaatacaacatttagcattttgtgtctaattacaaggatcctttgcatacagcatgtataggttcctttctactgctcagtaatacaggtagatgtcattttgtttattggcagctaatgtctaataaaataaacaggccctgggtatggtggcataagcatgtgatctcggcagtttggaggctgaggcagtcatattgagaggtcaagatgattctggtttacataatgaaaccctgtctcaaaagcaaaagacaaaaatgacttaaagcaagttattgtcaactacagtgtcagtgttaacttttaaagtttgttactcttgagttcagaatttgcttctagtgatgtatttaaacaatgcaatttgaacaagtaaagttagtaaggatacagacttgagtcaggctagttggcaactgtatgaccctaggcaagctgtttctatctcctcatctgctcaaaggtttaatagtggtacttactgtctattaggaaacaactgaacccacagacatttacggggtagcatgtaataaacactcaatagataatagcttcttttaatttttagaagttttatcttccatctgaaatgtttttcagaattcataatgcccttaaaggaattccagatgaccgagatgggctgtttgacacaattcagcgttctaagaatcactatcaaaaaagagcataccagtgtataaaatgtatggtagccctctttagcagttgtcctgttgcttaccaaatcctgcaggtaagggtgttttcttatttcatagaaatttaaattggagttaaaagatcctgttttaaaaggctgtagctctgatatactgcttacccagaatgtacaattccccaatatgacaaagaataagaaaggaatgaaaaatagcattaagatactattttaatccaggtattggggcggggtgaggtacacatctgtaatttggacattagaggccaagtcaggggaacaaccacaggtttgacaacaacctgagctatgtaacaattaccagacagccagagttgccatggcaagactatttcaagaataaaaaatatcctcagtttgtgggattatcattttaagttatctatgatacactcccaatcctcttaaatgtacatgattttatttacttttgaagggcaatggagatcttaaaaggaaatggacctgggcagtggagtggcttggagatgaacttgaaagaagaccatacactggcaatcctcagtacacttacaacaattggtctcctccagtgcaaagcaatgaaacatcaaatggttatttcttagagagatcacacagcgctaggatgacacttgcaaaagcttgtgaactctgtcctgaggaggtaaaaaaagccaccagtctacaagaaatagaaatggaagaaagcaaagtaattctttataggccactgactgtattaatgatagtgtcgtttattaggattgctagacttgtgtttgcttttaatatgtagtaatatattgatgatgatgatgatgatgactccatctggagaaattactgtgctgtaactttagaaattatttccaagagaacccgaattatgaatttttaattgttttttaaaccttcatgtgtatgggtggtttatctgtacaccatatgcctgcctggtgcccattgaggcctgaagaaaggatattggatcccttgaaactggacttaacagattgttttgagctgtcatgtaggtgttgaaacttgaacttgggtcctctagaaaacaagaagtgatctttattaaaatataattatatcccccccccctttcagctactcgcacacatcttcttgctctgtctcagatccatggcttctttttctttaaatgttacatgaatctgtattcctaaatctataacaacctgcttagtgtatataaatttatttatatgtttatgactttaggtctaaccatttgatattggataatcaattgggggattcttccctggggaaaatggttttctgctttcagcattccttgtttgcctgttgaagactcatggagcttcctccatccatattaacatgtccattgtttaggcagccatgttgttgagactgcttggatatacctttcttttttttttaagatttatttattatatgtaagtacactgtagctgtcttcagacacaccagaagagggcgtcagatctcattacaaatggttgtgagccaccatgtggttgctgggatttgaactcaggacctttggaagagcagtcagtgctcttaactgctgagccatctcaccagcctggatatacctttcctgacatttctaggcaacatagttcacgcctgatttcctgtccccttggcccttacaatcttctaccccttcagtgtttgggaaggtgccctgagcattagatatagaagttataatcacagtttctaagagttgttactaagttaaccaaatcagcagtaaccttgatgttgcctttttttttaattaggaaccagatgaccaagatgccccagatgagcatgaatcacctccaccagaagatgctcctttataccctcattcccctggatctcaatatcagcaggtaaacaggagtcagatggtggggttaacctctacagtggttctcaaccttaatgctgcaaccctttaatacagttcctcgttttgtgcccccccaacaataaaattactttcattgctacttcataactgtaattttatactgagtcataatgtaaatatgaaatatgcagactatctgatgatacccctgtaaaaaggtcacttaacactccccacccccacaaagattgagaaatcctgctctagaaccagtttcatacttgactataaaagaaggctttttgccatgactgtggactaactttgggggcatgatcagaagaatgggttggagtgaggtcgtggtacaaatttgaatttgccccaggaatatggttccctttccaaataggctttttttttttttttttttggtttttcgagacagggtttctctgtatagccctggctatcctggaactcactctgtagaccaggctggcctcgaactcagaaatctgcctgcctctgcctcccgagtgctgggatttaaggcatgcaccaccaccgcccagctaggtatgtcttgtactactagtatagagtgagtaaaactgtcaatataaaatgataatcattggggctggagaggggttaagagcaccgactgcttttcagaaggtcccgagttcaaattccagcaaccacatggtggctcaataccatccttaatgagatgtgacttccttttctggaatgtctgaagacagctacgatatacttacatataataaataaataaatttaaaaaatgataatcattgcttagtgtgaaggattataatgacatttcttgttagactatgtctgcaagtaaattctaaaaacaactaaggtaattctcaaattaattacctacaaaataattacctggaataatattctgaatgggaactttcctaaaatgtagatgtgaccaagccaaatgttttcaggggtgatagtgcacaaatggaaattagctttctggcattgtacagagtgctaaaattcaagagtgtatgacttgcctttaatcccagtacttgagagacagaagtgggcagatctctgagtttgagaccctgtcctttaaaggggtggtggttaagggcaatagtggcatacacctttagtcccagcacttaggaggcagtggcaagcggatctcttttgaagtttgaagacagccagggccacacagagaaaccctgtctggaaaaaaaattggggatgggagtgagatctgctgctgaaggtggccttacgttttagggcataaatgaaaccacagggaatagtgtgtggagcctaaaatcttggcatgccttgtggggatataaagaccaccacctaaccatatgaagttcaggtatttaaaaagataaaaaaaaagttattgtgatatatctgtaattctcctgctgggagaagcagacagaacctagttgacatagtgagtctttctgtttttctttcctttttttttttctctctcatttttgagacagtttctcttgtctaacagctctcaatgtcctggaactcactttgtagacaaggctagcctcgaactcagaaaatacgcctgcctctacctcctgaatcctacgattaaaagcatgcaccccatgcttgggaacacggtttcaaggccagcacaagtagtacatatcttttaaaaaaaaataagttaggaatcatgacagtaattaccttgctcagtcccaagaaggctcatacattaatctagccttgtgatttcagtggaatctagccttgtgatttcagtgcaatagttaatattaatagttctgtctacatagcaattgcacctatggtcaatcagatttatgctgtgagagagagttcatgtaggctagccctcacatcattctttttttgatgagtaagacaagaatagtaatggggttttgtttgcttgcttgcttgtttttcgagacagggttttctctgtgtagtcctggctgtcctggaactcactttgtagaccaggctggccttgaacttagaaatccacctgcctctgctgggattaaacgcgtgtgtcaccacacctggcttagtaatgaggtattttaatttgtcaggcttacacctacatttttggagctgggctggcaaaatgtgtcagtgggtaaagaaaggtacttgctatacaagttccacctgagctcagaccccaggatctttatggtagaaggagaaaaacagctccttcaagcaatcactttggacaaagatttatacatccctatccagtcatgtgttctttatgattccgaggtttgtatttgcctataagaagacttttcagttgatgttgtaagtcctaagagtaaaagaaatgtttctgttcccaccaattttaactgtttaattatatattgtgcaagtgagtatcagagacttgggtgtcagatcctcctatagctagaattatgccagtttaagccacctggtatgggtgctaggaacccatttgtggttccctgtctgaccagtacctagtcttacctttgatccatttctccagctatggaaaatttgtaatacacaggtttcttttccctttcagaataaccatgtgcatggacagccatatacaggcccagcagcacatcacatgaacaaccctcagagaactggccaacgagcacaagaaaattatgaaggcggtgaagaagtgtcccctcctcagaccaaggatcagtgaaatgcacatattaactggttccatcaagactgtgcacccaggccttacagtccaacttttttctgtgtctggctaatatttcaaactagaaaaactattcctaatcaacatggagtggagagtttattcattgtcttatctgcagaaatttgctgtcaatatataacccgcctgcagtggaaagtgtatagtgttttgtaataaatggcctgatgctaatgtgtaaatggcaaaggtgtatatagtatattaatgtttgactgttaattcttaagcaagaatttttttttcttcatgagactcacagatctacaaaactacattaattttcttgttatacctactgctctctgcagccagtgttgcctaccttgtggcagttggatcacctcctttacaaaaacaaaaagtaaatcaacatcaacaaaacagcccattcattcatgtcacaccaatagtttcctgttcattgtttgccacttggagtcaattttactatgagcaatgtaaggctgattacctttgatttatttgattgatgtggaaaattggtgatgtactatgtttctagtctttctcattgcctttttattctgatgttaggttaatcactttgaagctatagatatgctgtaacatttagcatggcttcacacaagttagtgtagccagtgaagaaatattaccataatgactgcagttgtcctgacatgacacctgcattgctcggagctttccttcttaaaccctagattataaaatacagactgagggagaactgtggcaaggaagcggttctcagttacacgcgtgttcttctcatgtttgacagtgtgatctctgggtagaataaagaacacttaaacttatcgacttggtaatgggaattttgaaagatttaaaacaaatacacaaaaatttgctatgccagtatgctggctggagcctagtagactgtatttgatgtgcttgtttcgttctttgctagagcttactaagtgactctttttcaaactgtccttccttctgctggatcccagtgctgtggaagtcctcagaatcccacagtctttggagtacctctgcaccaaggtctctggctgattctctgctcagtcataattttacttgaaagcaaaaattgtccaagctccttttccattccaaaaattttaacattcaaagcagggtctaatttaagaaattactggtagttaatacaattaaggaattaaattttagaataaacaatttgaataaagataaaggaatcagttaaagctgtgtttcaaagaaaattggtgatttgaatatgtgtaatttttttggaacctgtctaaaaccaaatacccctgcaaacagataaaacctaccctatttaaatattttgctgttttattttatagaaattattttgctgaatttgcaaatagaatttgatttaagaagaactttttgtcctgtggtatgtttgggggttttgataaccttctctgtctgcctgtctctctttttttgaggactgcatatttctggaaagctgatttctatgcatagcatgtgtagacataaccagcaatgaagattttagtctcattaagtttttgtgcacagaaagatgggggtctttggctctttactaaagacttggagaaccggatgttgatgctgtaaaagttccctaacaatcaatcttgtactttttgtatgtttttatatacatgtgtatttaatgagcacaagcttggttgtattttttacgattcagttgataggaaaatgttttaaggctatagttggcattgatcaaagcagaagcaaaattgagcattgttattttgtgatttaaaaggggcagtatttaagataaaggtttaggtatcttatttgcagtattccacagttctgcttctagacttcctgtaattttagcgacctttgacagcagattctgtttacatcagaatttgcttttgtttcggttttttggagcctggggatccagaacctgaagtactccaggcgagcgctctaccattgagctgcgcctccagcctgaattgaagtttgagcaaagtacagtgtttgcaactccaactggaagttttttaaagttcttcaagtagtaaagtaggttagctttgtttggatgagtaactggtactagttatgttatcttaccatctgacatgcgactttggtattttctgcttcttaaggaaattatgaaatatgtaaaacttagtgacttcctaggtaagaagaaaacttgacattttcaaaggctgtgaatttttcttggagggattctacccccggcccccagtagttgctttaagtgtataagcccaccagttccagatgataggggattatggagtcatggttcccctcatttgaggaagagtgggcctgtgttgtgaccaggagtgagggaaggtgaacagagttatttttgtttgtttgtgcaaattattttctatattaactctttaagcattaatgtataaccggaaattttaagatgcatgttattgtaagcgcaacatagtggtgattttgaggtctttctctaaaacataagtggcacattttaaatttcaagtcttaaagtgcctgaaagttatttgattctctcaactaatttcttttgagccatatgtttcctcctttaaatgtttgttgcagaatcactagtcttcgtttgaagtactcccacatttctaaatggcatgattgctctattgaagacagtagaatctgttaacgtaagactgaagagattttattgtgcaactgtgtaaactggggctttgcccagtcggatctaagtatttttgtgtacaacttggtaaacaccatattgctgctgtttctaaaccctccacctaccgaattctcatgttcagcatcgcagaggcagaaatacaagcataatcatatatgggctttgtttcttttcattgatttttcttagtgatgatttcccagcctttttttttttttttgtctcttagctataattatacagacctagaattattcaaatgttttctattttcatgattaacttttattagtggacaataacaacttaagtctttaatcctcatattggttaaaaacatgaggagccttttttatttgaattacttttgtaaaagaaagcaacagtctgaatattcaggtgactactttggcatagttcgggtttttattagtatttttccaggttatgttttcccatgaactattttactttgttaattttgtgcttaatttggtggctatatcctgccttatttagaattttagaaaattgcctttttgcgataagtgcccagtttttatttctagtttgaaggtacgaggacatacagactgctgataaaagaaaccagcacccctttgccccagcttatgtgttaccaacaaaaccattctcagtactggtttcattgtagggcccaaccagaattggtcctgcatctacatgagtgttgcatatttgaaaagggtttgggtgtgataaatcactacagaagtgctgaatgtattaagacctcgctgccgattgtatttctaacgattattttgtgtttgcagaagtatgtagcacttgtcctccaagctttcaggtgtaagggggaaaggtgaaccacattttaaagtcactaatgagtgcaattttttttttttttggaattggggttcccaaaaggaaatttcaccgcccaaatctcacatacttcttagccttttacaagccaacagattgacataaagattgtccgcagttcgtaagatctagcacatatacaaaaataaaactttataaattaaatttgggtttttctttcatttattaacatagggttttcccctatatcggtagggttggcatgcctatattgctagggttggcatgcagggcatcgaatggatttggcaagtgccatgtcactcagccacttttggcccttgaattttttaagggacatgtttttaataggtcgtttactttggttcttgattttaaatctgaaaagtccctgttttgaggggttattaatgtgaatttttcactttagcgtgtcatctgaaatgctgaaattccttttcagtgtccgaaaagtacatttggcttctgcagcagagcctgttgatgcttccctacggaatactgctaaagaaaggcatcccacatagccctcacatttacttatgtttactgaaacagccaacctctgtagctcaagctggtctggaattcactgtaatcagggtgacctcaaactgaccttttgtcacagcctcccaaatgctaggtttacagctgattttcctgttcatccttcttgccccactttttaagcagaataagggaaaagtgtagtagtataaactatgtgcctatgaacctaccacttaggaagatcaggagttcacggtcatcatctacttaaatgtaggctaaaagccctacctcaaaactaaaagccaaatcaaatacgaaattcttcccttttagcaaactaatttagtggcccacttatgtttaaatttaagaaccagttgagtatcccttagctaaatatgtgggacaagaagtgctcaacatcagaaggctagggagttacttgcatatatgagatgtcttgggaatgagaccctaatgtagacaaagtcatgtggcatgcacagtctgagtagttccatattgtgttggtcccttgcttttgacttttaggtattttggattggtttttcaaagcagagtttgtgtgtagcccttgattttactggaattctttagaccaggctggccttgcactcatagagatctgcctgcctttgtctcccaagtgctggaattaaaagtatgtgccaccaccacctggctgggtttctatggttttgttttgttagtgtgatgtgctgggcatcgaaccaagggcctttcacatactaggcaagctagcattctatcactaagccatcttaagcctagaaatacagccattacaaaacatttcaaacactttgcgggggggatttttttcaagacagggtttctctgtatattatagccttggctgtcctggaactcacttttagaccagactggcctagaattcagaaatccgcctgcctctgcctctgcctcccaagtgctgggattaaaggtgtgagtcaccaccacccggcgaaaattttgctaaagatttatgtatttattctatgtaagtacactgtagctgtcttcagacactccagaagagggagtcagatctcattatggatggttgtgagccaccatgtggttgctgggatttgaactcaggacctttggaagaacagtcgggtgctcttaacctgctgagccatctcaccagcccccttcaaacacatttttaaaagattcccttcgaatgtatgaaatttagggaatcatttcagctgaggtacagttgtgcctaactgctccttaataacttcaaaacatagtctcaccaagtcagagataccagtgaggaggggaaaccacttttagggacatttgatgtgaacccatttggttgcttgtcttacagctgtgtttgcatccatttctttcctagccattggcacattgaataagctcaggagagattttggatgagtattctgatgctctagctaggcccagagaaaaggagaaactaaattcataaaggtacagaattgcaagctgggaaaaaaggctctgtccatgcaatgctgccagtaagcgttaggacctgagctcaattgccgaacctacataaaaactcaggtatgagtcacccatacttgtaatctcagcattagggaggtagaagtaggcagagactcctggctagtgccagagaccctgtttcaataaaaagatggtaggagcctgcatgttgatacatacattttaatgctagcactgaggaagcagaagtaggtggatttctatgatgttgggaccagaatggtctacaaagtgagtcccaggaaagccagaactatgtaatactctcaaaaagcaaagatggcatttattacagtatatgatggtggatggggtgaatgcatgccactgtaatgacctcatggaggtaaaagaacaactagaacttgtggaagtgggttcttccctttacaccgtgtgggtcttagaactgaattcaagtggtcagacttggcagcaggtgctttttaatgctctgagccatcttgcaccatttaagtgttttaaagtacagaatggactaaaagaaagctgagtgggtgtggtaataaagttataagtacacatactacgggctggcgagatggctcaacaagtaagagcactgactgcccttccaaaggtcctgagttcaaatcccagcaaccacatggtggctcacaaccatccgtaatgagatctgacgccctcttctggagtgtctgaagacagctacagtgtattagaataaataaatctttttttaaaaaagtacacatacaaagctagaacccaaaaaaaaccaaataccatgtcacctgaatccctactaaatagtgaggcccggcatgaagttagtttaaaaacagttaaaggtgggaactggagagatggctcaagttgaaacacctactgctcttgcagaggaccctagtttggttgccaaggccacttggtcaggctattctcacccaagagaagaaaagcacaaggagactctaggagtctgaagtttttattgagccacactaatgcatccgggccatgcactttgttttttaagacaggatttctctgtgtggtcctggctgtcctggaacctggtctatagaccaggctggcctcaaactcagagatccaccaagcaaagtttttttgtttatctttttaaagatttattatatgtaagcacactgtagctgtcttcagacacttcttgctacggcccaaagattgattgattgattgattttaaagatttatcactttatctaagtacactgtaactgtcttcagatgcaccagaagaggacgtcagatctcattacagatggttgtgagccaccgtgtggttgctgagatttgaactcaggacctctggaagaacagtcagtgctctttaaccactaagccatctctctagcccccgaagcaagcaaaagttttataaaagtaaaagccacagttttggtacaccctgttgaagtagtttcaatagctgttagcaagcatgacaggatatgaacttttcataagaatagagcacagttgtgttaccatagtgtttttgtttgatcaggagcagaaacccttgcagttacacaagcaaaacaatacaggttagcaaaagttcctgtacatgcatgagggtcaggctggcttcaggtttaacccgaagtctggccagtatctatctagcaaatatattttcccacttcatacattcatagcttcatgagcactaggcacataatatggtatgcatacatacatgcaggcaaaacactcaaatattttttaaaagttaaaggccagagagatggctttagcaggtgaaggtgcttgctaccaaacctagaaacctgagttctgccctcaggacccacaaaatgaggacgaaccaacttacccaatgagttgtcatctgacctcacatgtctctacacacaaataaattgtgattgattcattgtgtttttttaaagtgggtcttaatatgtagaatttatttttttgttttgtttgaggcagggtttctctgtgtagtcctggctgccctgggactcactctgtagaccaggctggcctcgaactcagaaatctgcctgcctctgcctcccgagtgctgggatttaaggcatgcaccaccaccgcccagctaggtatgtcttgtactactagtatagagtgagtaaaactgtcaatataaaatgataatcattggggctggagaggggttaagagcaccgactgcttttcagaaggtcccgagttcaaattccagcaaccacatggtggctcaataccatccttaatgagatgtgacttccttttctggaatgtctgaagacagctacgatatacttacatataataaataaataaatttaaaaaatgataatcattgcttagtgtgaaggattataatgacatttcttgttagactatgtctgcaagtaaattctaaaaacaactaaggtaattctcaaattaattacctacaaaataattacctggaataatattctgaatgggaactttcctaaaatgtagatgtgaccaagccaaatgttttcaggggtgatagtgcacaaatggaaattagctttctggcattgtacagagtgctaaaattcaagagtgtatgacttgcctttaatcccagtacttgagagacagaagtgggcagatctctgagtttgagaccctgtcctttaaaggggtggtggttaagggcaatagtggcatacacctttagtcccagcacttaggaggcagtggcaagcggatctcttttgaagtttgaagacagccagggccacacagagaaaccctgtctggaaaaaaaattggggatgggagtgagatctgctgctgaaggtggccttacgttttagggcataaatgaaaccacagggaatagtgtgtggagcctaaaatcttggcatgccttgtggggatataaagaccaccacctaaccatatgaagttcaggtatttaaaaagataaaaaaaaaagttattgtgatatatctgtaattctcctgctgggagaagcagacagaacctagttgacatagtgagtctttctgtttttctttccttttttttttctctctcatttttgagacagtttctcttgtctaacagctctcaatgtcctggaactcactttgtagacaaggctagcctcgaactcagaaaatacgcctgcctctacctcctgaatcctacgattaaaagcatgcaccccatgcttgggaacacggtttcaaggccagcacaagtagtacatatcttttaaaaaaaaataagttaggaatcatgacagtaattaccttgctcagtcccaagaaggctcatacattaatctagccttgtgatttcagtggaatctagccttgtgatttcagtgcaatagttaatattaatagttctgtctacatagcaattgcacctatggtcaatcagatttatgctgtgagagagagttcatgtaggctagccctcacatcattctttttttgatgagtaagacaagaatagtaatggggttttgtttgcttgcttgcttgtttttcgagacagggttttctctgtgtagtcctggctgtcctggaactcactttgtagaccaggctggccttgaacttagaaatccacctgcctctgctgggattaaacgcgtgtgtcaccacacctggcttagtaatgaggtattttaatttgtcaggcttacacctacatttttggagctgggctggcaaaatgtgtcagtgggtaaagaaaggtacttgctatacaagttccacctgagctcagaccccaggatctttatggtagaaggagaaaaacagctccttcaagcaatcactttggacaaagatttatacatccctatccagtcatgtgttctttatgattccgaggtttgtatttgcctataagaagacttttcagttgatgttgtaagtcctaagagtaaaagaaatgtttctgttcccaccaattttaactgtttaattatatattgtgcaagtgagtatcagagacttgggtgtcagatcctcctatagctagaattatgccagtttaagccacctggtatgggtgctaggaacccatttgtggttccctgtctgaccagtacctagtcttacctttgatccatttctccagctatggaaaatttgtaatacacaggtttcttttccctttcagaataaccatgtgcatggacagccatatacaggcccagcagcacatcacatgaacaaccctcagagaactggccaacgagcacaagaaaattatgaaggcggtgaagaagtgtcccctcctcagaccaaggatcagtgaaatgcacatattaactggttccatcaagactgtgcacccaggccttacagtccaacttttttctgtgtctggctaatatttcaaactagaaaaactattcctaatcaacatggagtggagagtttattcattgtcttatctgcagaaatttgctgtcaatatataacccgcctgcagtggaaagtgtatagtgttttgtaataaatggcctgatgctaatgtgtaaatggcaaaggtgtatatagtatattaatgtttgactgttaattcttaagcaagaatttttttttcttcatgagactcacagatctacaaaactacattaattttcttgttatacctactgctctctgcagccagtgttgcctaccttgtggcagttggatcacctcctttacaaaaacaaaaagtaaatcaacatcaacaaaacagcccattcattcatgtcacaccaatagtttcctgttcattgtttgccacttggagtcaattttactatgagcaatgtaaggctgattacctttgatttatttgattgatgtggaaaattggtgatgtactatgtttctagtctttctcattgcctttttattctgatgttaggttaatcactttgaagctatagatatgctgtaacatttagcatggcttcacacaagttagtgtagccagtgaagaaatattaccataatgactgcagttgtcctgacatgacacctgcattgctcggagctttccttcttaaaccctagattataaaatacagactgagggagaactgtggcaaggaagcggttctcagttacacgcgtgttcttctcatgtttgacagtgtgatctctgggtagaataaagaacacttaaacttatcgacttggtaatgggaattttgaaagatttaaaacaaatacacaaaaatttgctatgccagtatgctggctggagcctagtagactgtatttgatgtgcttgtttcgttctttgctagagcttactaagtgactctttttcaaactgtccttccttctgctggatcccagtgctgtggaagtcctcagaatcccacagtctttggagtacctctgcaccaaggtctctggctgattctctgctcagtcataattttacttgaaagcaaaaattgtccaagctccttttccattccaaaaattttaacattcaaagcagggtctaatttaagaaattactggtagttaatacaattaaggaattaaattttagaataaacaatttgaataaagataaaggaatcagttaaagctgtgtttcaaagaaaattggtgatttgaatatgtgtaatttttttggaacctgtctaaaaccaaatacccctgcaaacagataaaacctaccctatttaaatattttgctgttttattttatagaaattattttgctgaatttgcaaatagaatttgatttaagaagaactttttgtcctgtggtatgtttgggggttttgataaccttctctgtctgcctgtctctctttttttgaggactgcatatttctggaaagctgatttctatgcatagcatgtgtagacataaccagcaatgaagattttagtctcattaagtttttgtgcacagaaagatgggggtctttggctctttactaaagacttggagaaccggatgttgatgctgtaaaagttccctaacaatcaatcttgtactttttgtatgtttttatatacatgtgtatttaatgagcacaagcttggttgtattttttacgattcagttgataggaaaatgttttaaggctatagttggcattgatcaaagcagaagcaaaattgagcattgttattttgtgatttaaaaggggcagtatttaagataaaggtttaggtatcttatttgcagtattccacagttctgcttctagacttcctgtaattttagcgacctttgacagcagattctgtttacatcagaatttgcttttgtttcggttttttggagcctggggatccagaacctgaagtactccaggcgagcgctctaccattgagctgcgcctccagcctgaattgaagtttgagcaaagtacagtgtttgcaactccaactggaagttttttaaagttcttcaagtagtaaagtaggttagctttgtttggatgagtaactggtactagttatgttatcttaccatctgacatgcgactttggtattttctgcttcttaaggaaattatgaaatatgtaaaacttagtgacttcctaggtaagaagaaaacttgacattttcaaaggctgtgaatttttcttggagggattctacccccggcccccagtagttgctttaagtgtataagcccaccagttccagatgataggggattatggagtcatggttcccctcatttgaggaagagtgggcctgtgttgtgaccaggagtgagggaaggtgaacagagttatttttgtttgtttgtgcaaattattttctatattaactctttaagcattaatgtataaccggaaattttaagatgcatgttattgtaagcgcaacatagtggtgattttgaggtctttctctaaaacataagtggcacattttaaatttcaagtcttaaagtgcctgaaagttatttgattctctcaactaatttcttttgagccatatgtttcctcctttaaatgtttgttgcagaatcactagtcttcgtttgaagtactcccacatttctaaatggcatgattgctctattgaagacagtagaatctgttaacgtaagactgaagagattttattgtgcaactgtgtaaactggggctttgcccagtcggatctaagtatttttgtgtacaacttggtaaacaccatattgctgctgtttctaaaccctccacctaccgaattctcatgttcagcatcgcagaggcagaaatacaagcataatcatatatgggctttgtttcttttcattgatttttcttagtgatgatttcccagccttttttttttttttgtctcttagctataattatacagacctagaattattcaaatgttttctattttcatgattaacttttattagtggacaataacaacttaagtctttaatcctcatattggttaaaaacatgaggagccttttttatttgaattacttttgtaaaagaaagcaacagtctgaatattcaggtgactactttggcatagttcgggtttttattagtatttttccaggttatgttttcccatgaactattttactttgttaattttgtgcttaatttggtggctatatcctgccttatttagaattttagaaaattgcctttttgcgataagtgcccagtttttatttctagtttgaaggtacgaggacatacagactgctgataaaagaaaccagcacccctttgccccagcttatgtgttaccaacaaaaccattctcagtactggtttcattgtagggcccaaccagaattggtcctgcatctacatgagtgttgcatatttgaaaagggtttgggtgtgataaatcactacagaagtgctgaatgtattaagacctcgctgccgattgtatttctaacgattattttgtgtttgcagaagtatgtagcacttgtcctccaagctttcaggtgtaagggggaaaggtgaaccacattttaaagtcactaatgagtgcaattttttttttttttggaattggggttcccaaaaggaaatttcaccgcccaaatctcacatacttcttagccttttacaagccaacagattgacataaagattgtccgcagttcgtaagatctagcacatatacaaaaataaaactttataaattaaatttgggtttttctttcatttattaacatagggttttcccctatatcggtagggttggcatgcctatattgctagggttggcatgcagggcatcgaatggatttggcaagtgccatgtcactcagccacttttggcccttgaattttttaagggacatgtttttaataggtcgtttactttggttcttgattttaaatctgaaaagtccctgttttgaggggttattaatgtgaatttttcactttagcgtgtcatctgaaatgctgaaattccttttcagtgtccgaaaagtacatttggcttctgcagcagagcctgttgatgcttccctacggaatactgctaaagaaaggcatcccacatagccctcacatttacttatgtttactgaaacagccaacctctgtagctcaagctggtctggaattcactgtaatcagggtgacctcaaactgaccttttgtcacagcctcccaaatgctaggtttacagctgattttcctgttcatccttcttgccccactttttaagcagaataagggaaaagtgtagtagtataaactatgtgcctatgaacctaccacttaggaagatcaggagttcacggtcatcatctacttaaatgtaggctaaaagccctacctcaaaactaaaagccaaatcaaatacgaaattcttccctttttgcaaactaatttagtggcccacttatgtttaaatttaagaaccagttgagtatcccttagctaaatatgtgggacaagaagtgctcaacatcagaaggctagggagttacttgcatatatgagatgtcttgggaatgagaccctaatgtagacaaagtcatgtggcatgcacagtctgagtagttccatattgtgttggtcccttgcttttgacttttaggtattttggattggtttttcaaagcagagtttgtgtgtagcccttgattttactggaattctttagaccaggctggccttgcactcatagagatctgcctgcctttgtctcccaagtgctggaattaaaagtatgtgccaccaccacctggctgggtttctatggttttgttttgttagtgtgatgtgctgggcatcgaaccaagggcctttcacatactaggcaagctagcattctatcactaagccatcttaagcctagaaatacagccattacaaaacatttcaaacactttgcgggggggatttttttcaagacagggtttctctgtatattatagccttggctgtcctggaactcacttttagaccagactggcctagaattcagaaatccgcctgcctctgcctctgcctcccaagtgctgggattaaaggtgtgagtcaccaccacccggcgaaaattttgctaaagatttatgtatttattctatgtaagtacactgtagctgtcttcagacactccagaagagggagtcagatctcattatggatggttgtgagccaccatgtggttgctgggatttgaactcaggacctttggaagaacagtcgggtgctcttaacctgctgagccatctcaccagcccccttcaaacacatttttaaaagattcccttcgaatgtatgaaatttagggaatcatttcagctgaggtacagttgtgcctaactgctccttaataacttcaaaacatagtctcaccaagtcagagataccagtgaggaggggaaaccacttttagggacatttgatgtgaacccatttggttgcttgtcttacagctgtgtttgcatccatttctttcctagccattggcacattgaataagctcaggagagattttggatgagtattctgatgctctagctaggcccagagaaaaggagaaactaaattcataaaggtacagaattgcaagctgggaaaaaaggctctgtccatgcaatgctgccagtaagcgttaggacctgagctcaattgccgaacctacataaaaactcaggtatgagtcacccatacttgtaatctcagcattagggaggtagaagtaggcagagactcctggctagtgccagagaccctgtttcaataaaaagatggtaggagcctgcatgttgatacatacattttaatgctagcactgaggaagcagaagtaggtggatttctatgatgttgggaccagcctggtctacaaagtgagtcccaggaaagccagaactatgtaatactctcaaaaagcaaagatggcatttattacagtatatgatggtggatggggtgaatgcatgccactgtaatgacctcatggaggtaaaagaacaactagaacttgtggaagtgggttcttccctttacaccgtgtgggtcttagaactgaattcaagtggtcagacttggcagcaggtgctttttaatgctctgagccatcttgcaccatttaagtgttttaaagtacagaatggactaaaagaaagctgagtgggtgtggtaataaagttataagtacacatactacgggctggcgagatggctcaacaagtaagagcactgactgcccttccaaaggtcctgagttcaaatcccagcaaccacatggtggctcacaaccatccgtaatgagatctgacgccctcttctggagtgtctgaagacagctacagtgtattagaataaataaatctttttttaaaaaagtacacatacaaagctagaacccaaaaaaaaccaaataccatgtcacctgaatccctactaaatagtgaggcccggcatgaagttagtttaaaaacagttaaaggtgggaactggagagatggctcaagttgaaacacctactgctcttgcagaggaccctagtttggttgccaaggccacttggtcaggctattctcacccaagagaagaaaagcacaaggagactctaggagtctgaagtttttattgagccacactaatgcatccgggccatgcactttgttttttaagacaggatttctctgtgtggtcctggctgtcctggaacctggtctatagaccaggctggcctcaaactcagagatccaccaagcaaagtttttttgtttatctttttaaagatttattatatgtaagcacactgtagctgtcttcagacacttcttgctacggcccaaagattgattgattgattgattttaaagatttatcactttatctaagtacactgtaactgtcttcagatgcaccagaagaggacgtcagatctcattacagatggttgtgagccaccgtgtggttgctgagatttgaactcaggacctctggaagaacagtcagtgctctttaaccactaagccatctctctagcccccgaagcaagcaaaagttttataaaagtaaaagccacagttttggtacaccctgttgaagtagtttcaatagctgttagcaagcatgacaggatatgaacttttcataagaatagagcacagttgtgttaccatagtgtttttgtttgatcaggagcagaaacccttgcagttacacaagcaaaacaatacaggttagcaaaagttcctgtacatgcatgagggtcaggctggcttcaggtttaacccgaagtctggccagtatctatctagcaaatatattttcccacttcatacattcatagcttcatgagcactaggcacataatatggtatgcatacatacatgcaggcaaaacactcaaatattttttaaaagttaaaggccagagagatggctttagcaggtgaaggtgcttgctaccaaacctagaaacctgagttctgccctcaggacccacaaaatgaggacgaaccaacttacccaatgagttgtcatctgacctcacatgtctctacacacaaataaattgtgattgattcattgtgtttttttaaagtgggtcttaatatgtagaatttatttttttgttttgtttgaggcagggtttctctgtgtagtcctggctgccctgggactcactctgtagaccaggctggcctcgaactcagaaatctgcctgcctctgcctcccgagtgctgggatttaaggcatgcaccaccaccgcccagctaggtatgtcttgtactactagtatagagtgagtaaaactgtcaatataaaatgataatcattggggctggagaggggttaagagcaccgactgcttttcagaaggtcccgagttcaaattccagcaaccacatggtggctcaataccatccttaatgagatgtgacttccttttctggaatgtctgaagacagctacgatatacttacatataataaataaataaatttaaaaaatgataatcattgcttagtgtgaaggattataatgacatttcttgttagactatgtctgcaagtaaattctaaaaacaactaaggtaattctcaaattaattacctacaaaataattacctggaataatattctgaatgggaactttcctaaaatgtagatgtgaccaagccaaatgttttcaggggtgatagtgcacaaatggaaattagctttctggcattgtacagagtgctaaaattcaagagtgtatgacttgcctttaatcccagtacttgagagacagaagtgggcagatctctgagtttgagaccctgtcctttaaaggggtggtggttaagggcaatagtggcatacacctttagtcccagcacttaggaggcagtggcaagcggatctcttttgaagtttgaagacagccagggccacacagagaaaccctgtctggaaaaaaaattggggatgggagtgagatctgctgctgaaggtggccttacgttttagggcataaatgaaaccacagggaatagtgtgtggagcctaaaatcttggcatgccttgtggggatataaagaccaccacctaaccatatgaagttcaggtatttaaaaagataaaaaaaaaagttattgtgatatatctgtaattctcctgctgggagaagcagacagaacctagttgacatagtgagtctttctgtttttctttccttttttttttctctctcatttttgagacagtttctcttgtctaacagctctcaatgtcctggaactcactttgtagacaaggctagcctcgaactcagaaaatacgcctgcctctacctcctgaatcctacgattaaaagcatgcaccccatgcttgggaacacggtttcaaggccagcacaagtagtacatatcttttaaaaaaaaataagttaggaatcatgacagtaattaccttgctcagtcccaagaaggctcatacattaatctagccttgtgatttcagtggaatctagccttgtgatttcagtgcaatagttaatattaatagttctgtctacatagcaattgcacctatggtcaatcagatttatgctgtgagagagagttcatgtaggctagccctcacatcattctttttttgatgagtaagacaagaatagtaatggggttttgtttgcttgcttgcttgtttttcgagacagggttttctctgtgtagtcctggctgtcctggaactcactttgtagaccaggctggccttgaacttagaaatccacctgcctctgctgggattaaacgcgtgtgtcaccacacctggcttagtaatgaggtattttaatttgtcaggcttacacctacatttttggagctgggctggcaaaatgtgtcagtgggtaaagaaaggtacttgctatacaagttccacctgagctcagaccccaggatctttatggtagaaggagaaaaacagctccttcaagcaatcactttggacaaagatttatacatccctatccagtcatgtgttctttatgattccgaggtttgtatttgcctataagaagacttttcagttgatgttgtaagtcctaagagtaaaagaaatgtttctgttcccaccaattttaactgtttaattatatattgtgcaagtgagtatcagagacttgggtgtcagatcctcctatagctagaattatgccagtttaagccacctggtatgggtgctaggaacccatttgtggttccctgtctgaccagtacctagtcttacctttgatccatttctccagctatggaaaatttgtaatacacaggtttcttttccctttcagaataaccatgtgcatggacagccatatacaggcccagcagcacatcacatgaacaaccctcagagaactggccaacgagcacaagaaaattatgaaggcggtgaagaagtgtcccctcctcagaccaaggatcagtgaaatgcacatattaactggttccatcaagactgtgcacccaggccttacagtccaacttttttctgtgtctggctaatatttcaaactagaaaaactattcctaatcaacatggagtggagagtttattcattgtcttatctgcagaaatttgctgtcaatatataacccgcctgcagtggaaagtgtatagtgttttgtaataaatggcctgatgctaatgtgtaaatggcaaaggtgtatatagtatattaatgtttgactgttaattcttaagcaagaatttttttttcttcatgagactcacagatctacaaaactacattaattttcttgttatacctactgctctctgcagccagtgttgcctaccttgtggcagttggatcacctcctttacaaaaacaaaaagtaaatcaacatcaacaaaacagcccattcattcatgtcacaccaatagtttcctgttcattgtttgccacttggagtcaattttactatgagcaatgtaaggctgattacctttgatttatttgattgatgtggaaaattggtgatgtactatgtttctagtctttctcattgcctttttattctgatgttaggttaatcactttgaagctatagatatgctgtaacatttagcatggcttcacacaagttagtgtagccagtgaagaaatattaccataatgactgcagttgtcctgacatgacacctgcattgctcggagctttccttcttaaaccctagattataaaatacagactgagggagaactgtggcaaggaagcggttctcagttacacgcgtgttcttctcatgtttgacagtgtgatctctgggtagaataaagaacacttaaacttatcgacttggtaatgggaattttgaaagatttaaaacaaatacacaaaaatttgctatgccagtatgctggctggagcctagtagactgtatttgatgtgcttgtttcgttctttgctagagcttactaagtgactctttttcaaactgtccttccttctgctggatcccagtgctgtggaagtcctcagaatcccacagtctttggagtacctctgcaccaaggtctctggctgattctctgctcagtcataattttacttgaaagcaaaaattgtccaagctccttttccattccaaaaattttaacattcaaagcagggtctaatttaagaaattactggtagttaatacaattaaggaattaaattttagaataaacaatttgaataaagataaaggaatcagttaaagctgtgtttcaaagaaaattggtgatttgaatatgtgtaatttttttggaacctgtctaaaaccaaatacccctg

SEQ ID NO: 272 - DNA, 543 bp, mus musculus; identical to SEQ ID NO: 95

SEQ ID NO: 273 - DNA, 358 bp, mus musculus; identical to SEQ ID NO: 97

SEQ ID NO: 274 - DNA, 358 bp, mus musculus; identical to SEQ ID NO: 97

SEQ ID NO: 275 - DNA, 4889 bp, mus musculus
tggattacgtcgctctcacgtgaccaagagctgacgtgtgcagaagtccttcttgtcctggtcgttgttcccgtctgagtaccagctccctattaccctgagggcgggcgagtgcagccgagaaaagaaggaggcggaaaagaaattgtcccagatccctgcaggtcagtgcctgggatattccataaagtgggggtggtggagggtagagggcggaggccgtcgcaggtccggagccgccgccgtcgtctctcccacttgctgccctctttccaagatattaagtcccgcccgcagcccatttcgatgctgcagaacagtgagtagaggggtgtttgggcaggcgtccagaattccggagatgggaatctgctgggagcggaggcccgcaatccggaaagggagctgtggcctgggtgttggcccctggtccaccaggactctgccggaggggaagaactggacattgggtccgtggtggggtacaatgtgatgtgtcagccggaccctgagccggctatcgggcgggaaacctttaccaaccaggcctccgaattaggaaagagtttcgttctctggggactggtccgtccaccaagcactcagtagcggctgtttcccgtctttctgcttgtggccgtgtcttccttaccatggctctgtggctagtgggtccaagcctctcccgggtggccagtctttccgtaggttgcggtacaacgccaggcaagagaagaggaaggaaattaaccagatcggtgaaggtcgagttgagggtaagaccatctggggaccctaggagcggcgggggtagaaaaggggagggggactagaaacggtaatctaggtttagattggagtctaaatatgttcccacactccccgaactgtggagaaatggcgtgttctctctctctctctctctctctctctctctctctctctctctctctctctctctctctccttccctccctccctccctccctccctccctccctctctctctctctgtgtctctctctgactctgtgtgtatgaatgtgctcttgggggtgggggcggtgggcaggatgacagaaggaaaacctatcagatagtttgttcataatccttctctctcaacagcacttagtgtccatgttttccatctgtcatcctgcaggtctgctgtagcaggtggcactgcttgaaccaagggaggaactttcccccggatcagtagaggtcggtgtgggcgtgggggcagcctggaatgggggaggggttagaaatcagcttgggtttggccaggctcactcaatcctactttgtttccttgtgtccacccatttcagactagggagggggggcacagcatgtgcgtgttttggatggcacagtgaggtttaaccaaaatctgacgccctagatggtaaattaggaaagcatcaaatacacactggatgcgtcaaaccctcgggtttttatttttcttcttcttcttccacttcttctggtatccctgcagatcagaaagactgttgggcgtggcataacccacaggaaaggaagaaggggcaagctgctgttttaaggaggtcagtgcaagggtgcttatcccatggggtaccccaggagcttgtgatgaacgagagcctggaaatacttatggatgccattgcctttatgcttaggggcaagagtaaactggcaatggggtgggggagggagaggtgcgtagggggagagtgaaatgagggagatagaggtttttgtcaacaacctatgttccctatccagcattcgattactactttcttgccctactgggcaattatctgcatggagcagcacaaagagaagagaaagccaaaccctcttttcttccattttctaggtttacctctgtaagcaattactgtggccttgaagtgacttgaagaagatcactctccacaggactgcactcaggcccgaaggcctcttcccttatcttgagtgactactctatttcttggtccctgccgttgccagggacgattgcatgggctacgccaggaaagtaggctgggtgactgcaggtctggtgattggggctggagcctgctattgcatttacagattgacccgaggaagaaagcagaacaaggagaaaatggctgagggtggctctggtgatgtggatgatgctggggactgttctggggccaggtataatgactggtctgatgatgatgatgacagtaacgagagcaagagtatagtttggtacccaccttgggcccggattggcactgaagcagggaccagagccagagccagggcaagagccagggctaccagggctcgaagagctgtacagaaaagggcttctcctaattcagacgatactgttttgtcacctcaagagttacagaaagtactttgtttggttgagatgtctgaaaagccttatattcttgaagcagctttaattgctctgggtaataatgctgcttatgcatttaatagagatattattcgagatttgggtggtctcccaattgttgcaaagattctcaatacacgagatcccattgttaaggaaaaggctttaattgtcctaaataacttgagcgtgaatgccgaaaatcagcgcaggcttaaggtatacatgaatcaagtgtgtgatgacacagtcacttcccgattgaattcctctgtgcagctggctggactcagattgcttaccaatatgactgttactaacgagtatcagcatatccttgctaattccatttcagacttctttcgtttattttcagcggggaatgaagaaaccaaacttcaggttctgaagctccttttgaatctggctgaaaatccagccatgactagagaactgctcagggctcaggtgccatcttcactgggctccctctttaataagaaggagtacaaagaggttattcttaaacttctgatcatttttgagaatatcaatgacaatttcaaatgggaagagaacgagcctgctcagaatcactttagtgagggctccctttttttcttcttaaaagaatttcaagtgtgtgctgataaagttctaggaatcgagagccgtcatgatttccaggtgcgagtcaaggttggaaagtttgtggccaaactgactgaaaggatgttcccaaagagtcaggaataacttggtggctttgtagtgtagcagcagcagcacaccttgtaaactattctttttctccacgttgtttatatggcaaaggaaccctttcagctgccaattttgaatgatgaatatcatactgtatcaccgatgttgatatttaaccaagtttgtcttcaggtataagtttaatgaatgtacatcactacttgtcctgaaacatgtcgcattttattttgctgcccacattgaaacatttttctgttccctccctataagtgacagcgaatcaattcatcctaagtaggcccctttctgtcattatcattgattttatttgtgcatcttcaataaagttttatgttaatgctggaaagaaacaacagaagaagaaaggaactagtctgtcttttggtttataatctagttgtagagacaagaaacatacaaataaaaaaaaccacccaaaacacccccacaaaactcaagattatttagagcatacattctgatagatgtgtgccttcaggacaaagagggggcaaaggatttggtggctgactccataagtcaggttaaagcttcagggaggacagagccatcgaaagggagccctgaatggggtagagaagttagttgcattccatgagaccagagtcaaggggaaatgatgtgagaaagacattaagttaggggactttatggtagtcaaaacagcagccttcgagtgtggggactagcactaaataaatgtttattaaatctagaaaaccatgggaaacgcattgcaggaggcttcttgaatgtatttttaactagaaaagaactgggctcagtataaatgtcctccccacacaatgtgttatcaaggagagtgtagcaaaatggatactttccaactctggtggtgggcatttggcaatacagatcggtaagccttaaaagaggtaaaccttttatcctaaggggagaactgcataattggccagagagcattatgtgcaaggccgctcttgtcagcactgtcttacagtagtaacatggggaacaccttcagtgtccgacattctgaattgactaaataaagaatgtcgacgctgtgtgagaaatgtgctgatggagctcagtattgctagaaaaaaagataatcatcgcacattgttaagtgagcaaggtaagttagatatttagaatatgattacatattgtgtgtgtgagtgtgtgtggttaaatcatgtttaaaatgacactaaaatctatggaattatatatacccaataagtactaagagttatatttggatgaaagataatgagtggtacttactttttgtacttatattcatctatgtttccttgtttatcaaagaatgttggttctctcaggaaaggtttggaaaacggcaagtactggagggcagcagctgattcatttgaatgtgtactgagtagaaaacctttaggcccaaactcaggtggtttgaagtttcctcttcagaatgatagaggatggtgctgataaggctgtttgggaggtttatatgagagaatttaggcaaagtctctacattattctggcatatagcagcagttacttaagaaatgtgagtacctttaagtacccagaatgtagtttcgatgggttttggttgacttttgttttgctggggcattctgctatgtttcagtgtcatttaataaataataataataacaacaataataaaggttaacatttattaagt

SEQ ID NO: 276 - DNA, 54935 bp, mus musculus
agtgcgtcccggcggatgtaggtagctatgtagtcgcttcgtgagggaccggagagaggagtgggtaccgaaaggtgacagtaatttgctagtcatggcccttcatcttgtcctacatcccaagctcccggcaagcccctaaattacagtcgccgccattgcctctgctccctgcggcggactgccgacggcgtttgcctgcctcctttctgtgtgggaaggcgccgccggagagaacgcacctaagaaaactgccttggattcaagcagaacaggtcagtaagaaggagggcattgcttggggttgtggttgcgggttccatgattggtgcgggattggtgacctgattttagggggcgagtgttgggaagacagactagggaggatgagaaaaagctatctacgtttccagaaactcgcttcatcacgtttgggaagggagatggatgcaatggcatcatctactggggagatggcgtacttgtcagagaaaggactaccaccactgatgaacgcagttgtctgaggagccttgagaatcaggaaggagatacacaaaggggttatagatgtgggaacattaaatcttgtgttgggtgtattcgaagattgcacattcttatctgaccattaattaaccatatcttactcagtgcgatttcatttgatttggggctatcacacattcatttgtgtggatagattttgtgccaagtttgcatttctccacgtttcagggcggcagatcaaaaggggaggggagaagataaacaaaactgacctgatttctgtactgtgggagaaagctgcaagactaggtagggttctagaataatttctacatctcctcttttccagccttccagaaatgccctccgcgttaccccaactatgttgcagaatgtgataggtttgtgtgggtgggtgggggataatcataagaatgtgtaagaaaattgaaaatgatacttttcattatttccccagcttcctgttattgtcaggcgtttcatccctactgctaccagtacgaccaactgtgcagagatgatttagttgtcccttcatggaaatgatcaggctttaagaatatagcagaggaacgtggagatttgggggtgtcatggggggatgacaaaaagaaagggaatcagagaattctttaccaaacaagtatctgtatccagcaagcatttattccgtaattactgtttcctaaattatactcagtagtgctgttctcatgtttgtggatttccattgatagacacatccggagggttgtataacttggctgttgtgaatgtttgtaaaataactgaatgtgaagctaggagataatgagaaggcaattgtccagattcgaggattagtgtgaagacagacaaggatcactgagactagaatgtcacacccttctgttttgtcagtttctcgatgacctctagctggtctgtggattcacttaggagtcttggtctaactctagagatagatgcaggatgggaacatcttcctttaatcccctctttcctgtcctgctctaacacttcattatcaaccgatttttcaactaagggattaccgaaacagtcactcaagaagacaatggagggccccaagggaggaggaggaagaggaggaggaacagctttgaagctggttaatggaaggagaggaagaccaggaagggaaaagctagacaagcttctctgagaaggcaagaataagggccaggaaccaaggtctgtatcccaagagctgagtttctctgtcctctttatctatctataggtttgccagatctgctgcagggcttgtcgccagtggaaacagagaaaggaggaaacaatcccttggcaagagcgcaggttagtatgaacgtggggactcctcgagtaagacctatagtatggaacagtaaagatttggttggctccagcctaggtcagcagatagcctcggaattttgcagcctctcgtgtccatccagctttcctattctttctgcccttattggtgtctgcaaagacaaattggtagcacatgaaggtatagacagtgggtgaactgaaaggaggagttggctccttgtctccttcttccccatagagcactgaatttccatacttaactatgtctctgtgcttatcagcatgagaagaaagcaaattggaagagacttaaagccccatttccttcctccacccctaggtccaacttcagtgacagatctgatggccttggagtggctgaagaccaccaccctccacaggcctgcgccccagcacagctatcctttatcttgagtgagcttcctcaacatgctgtctatatgattggcagaaactgtagttggaaaggggctgaatgactactggactttatatgaaaacacctacttggggctgactttcgggcaaggctgagacaggggcatatttatattaagctttgcctttctctcgaaccatgattggctctaaaactaaaaggaaagctagagaagagtctggggcttcctcaaaacctggaaccaatagccctgccaatgctaaaggaaaagccaagaatcagaccactaaagccgttaaggcagaaccaaaagaagaatgggggaaccaggctgaggctagggatgaagcagtggccaggacacagccagccatttccactgagcccaagactgtgacctggaaagtaaaaaaaaagaaagataagactaatgctagagtcatggctcaggctaagacagaactcccggcagggcctgctttagtgcctcacaccaagtcagatgctctgcctacatctgtggtcattactgtaaccaagtctgaagtcaagattgacactggaattgaggcatctctcaagggcgctgccaaggctactgataagcgcagtattaagcagaagcctgagataaagaaagaggtctgtgtcaaatccagggctggggacaaagctaaagaggtctgtgtcaaatccagtgctggagacaaagctaaagaggtctgtgtcaaatccagggctggggacaaagctaaagaggtctgtgtcaaatccagggctggggacaaagctagtattgtcatcaacaccactgatgaggatgaagattatgtgtgttcctggttttggactggagaagagcctagtgtagggtcctggttctggcctaaagaagaaaatcctcttcaagtttatcagcccccaccaaaggttgaagaagaacctgaacccccagatacattcgactatgctttaaaaaaaaaagctgcagcatggttaaggggcaggtttattgtcctggtccccattgaggaaccgcagccatctttacctccagatgggaactggactctggttgcaaccttaattgaaactcccctgggtattcgacctttgaccaagatcccaccttatgggggaccttacttccagactttagccgatttaaaaaaccaaatccgggaaaaagagaagtatggacccaatccaaatacctgccgctgtaaatcccgcacctttagtttagagcctgttgactttgataagctcgttgccctacttaagttaacgagggatccgtttattcatgagatagctacaatgataatggggatcagtcctgcttacccatttactcaagatattgttcacgatgttggtattactgttatgattgaaaattttgtcaataatccaaatgctaagaaataccctagaactttaaatataaatgccaaccctgatgcccccgaagaagtgaaagagaccgaagcacatgtaaataaagtttgtagggacatactctgttgtcctttgaactgctctgtgcaagtggaggagctaaagctgttagtgagcttgagtgtgaaatttgattatcaccacgtggttatctattatgttcgttatttcatctcactgttaaacaaaggaagtgtcaaaatcaagtttcagattttaagagtccttttgtgcttgtcaaaaaatcaagcgaatacaagagaactgatcagtgctgaagtaatgtcctcactggtcgctctctttcacaagaatgagtcaaaagctaatattcttcatatcattgaaatatttgagaatataaatttccaattcaaaaaaagggcaaaactgtttactaaggaaatgttcactaaatctgaacttatttccatattccgggaggcaaaagagtttgaccagaaactccaagacttaacagaccacagtgaccctgatgtgagagataaagttatccgattaatactcaaactctgaatagctgtatattctcacaaagccttgaacatttttgtctttccaatataaatcgaatgcttattataattataaatttgataacttatgctctctgtgttgagggaggccattttatggatgctagtcatcttgaaagattgaatacttgctggtttttattgtgctatataatataaattaaggtattttggtatttctgtaatgtaacccagtactgaacctattcgttctaaataagctatatttctgtgcattatattgatataagtgtattttcgtattccatttacgtgtttttaataaagttgcatgctaaacacaatgaaaacattgttccagttctttagttgaaatgtagtcagagatgaacaatgtaaatatagccaaaattgtcgtctgtccatttactgatggtgggggttggcacaaacaaacaggttcacaaattggcagatctttcagtttcaccatgttcagggaatacagtcaaccagtctgtgaccaagaagacaggactatgcttctggctgctggaagttgtagatgccaggttttcaatggaggaacaatactgaatccggacagacttaggaggaggagcgtacagatgccttcacgtcactcttgagtccaagaacttgtgcttagcttgcacatcagctgtcccactaggatcccctgaagttttttatcccagagagattttctggttctcagcctattcagttcaattatggtcagttgtgggaagtgcacttctaaagggacacaggcacactgtttccttattagccccctccctatccaagaatgtcagatttactacatccaatgaggttttctaagtctcagagaagcgcttgggatcacctacagaaactgatactgatatcacctcttctacttgcgtgcttgctggttctcatccttgcttttttgttttagccaatacttttggtaatttgtatgtactcttgattgcagcctctcctttgttctgattcttaagtgtcagagcatggctgtatgtgtgacacacccacagaatatcagagtcctttaggactgcttggttagaaacaatctccatactacctctcctgcttattttcactttactgtttgaagccctgtttattctacctcagcctcctgttatagagcaaagctaggctcagagaagaggctaatggtgtagaacaacaggttgggatctaataccacctttgtctcctctactaactacccagatcctttgttgctgtttttctcagtttactgcccagaattgggaatgacagaataacatattatctctggaagaagtgtgtgtgtgtgtgtgtgtgtgtgtgttttcatccagacaaacagctgagattgtgacctaccttttgcagatttttcatgcattgagagaaggtctaaaaaatatcaacatgctggaatagattttaagttttaacagctaatcctggtttaatttctatggaggtcagatgtgaatttatttttcatatttctagtaataaaaatgaataatttatccatatttgtaatttaggtgtgtgtgggggggggagcagtgggttttttttcatgcaatgtaccactttagaagatttttgaagttctgtgtaactgtttttaattcacagatctcccctagcctagaataccagctgtgagcacttctctcagtggagatcttcatagtgcaatcggaccaaatcctctggaaacattctgtatctcaaatgccccgtggagtacactcttacccaggtaatggcttcgagttttccaatagcagctaaggacgagggtgagttggggatttgtatataatggtgccaaagcaagaaatcaaatcttcctgcctgaatggtaattttaagagtcaaaatcatctcccatagtttctgacatgtcattattttgtacccttaaattgttcccacagttgggctatcagtcggagtccccagtttcctcctagtgaaacttaataaccatttattagctttccccccataatctccctagccttttatagcaataattctactctcaacttgtttaagtccaaccttttctggctgtatgtatgtggagatgataaggcattgcctttctgtcgctggtttatttcacataacatagtaatctccagttctagtattgttaggaatggcagaatagcatgcttttgtgactgaataatattttcttctgtatttgaaatatgactttatccattcatccgatttttggatacgtaggttccgccccttccttcttaactattgtgaattacggtcctgcgttgagtatgggagtacagactgctcctcagctgtagtgtagatgtattgctcttttgctgatttaatttactctggaagtatatggaatactgggattcctagatcatatgggcgtttaggatcccccattactgttttccatagtgcgaatattcatttgcattcccatgagcaaagtaaactattttttttctccagggccttataataagcacttcttagtctttggtaatagccatgcttgtgggtataaggtggcttctcattgtgtttgtaattattgctaaaaggaaatggggtggagtgttttttcatatctctgttgtccatttatttatctatcatattttggtaaatacctattcaattatattattaatttttaaatgtaattattgggacacttttctaatgagtttttgcagctcctgatatagtccagatatccaacccctaccagatgtatgaattgcaagtatttctaccatttattagacggtcttgtctgtttctgcactctggggtctcctttactgtgcagaaactttagtttgatgtgaccccattttattttttgcttttatttcttgagcttttatgattctgtcaaaaattcccggttagttccaatgccctaaaacatcttctaaagtttactttgagtagtttcatagttttaggtcttacatttaattctttaatacattttgttttttttttttaaataactggtagaagatagttgatttttataatttttaagatattcttctgccttggctatcaatttcccagcatctttttttttttgtggtttttcaagacagggtttctctgtgtagccctggctgtcctggaactcactttgtagaccaggctggccttgaagtcagaaatccacctgtctctgcctcccgagttctgggattaaaggcgtgtgccaccaccacccggctcccagcatcattttttacaaaaactgtcctttttctattatgtcttcatagcaacttcgttggaaaacagctgattgtatatgcataggcttatttctagatcattacttgcagtaggtctgggtgtacattttatgtcatgccaaactattttttaaaaatcactttagctttgcaattagctttgaagtcaggaaatacagcgcctgcctcctactttgttcttttattcagcatatatttggtttcttcgaggtttttgtgcgtctgggtgagatcccagtgtagccctgagcctttttcaaggtaagcttttaagtacaaagaccatgccctgggtaggcatatttcagttaacaagagcagttagtcagaaagcaagggtaatacatatagagactttcccagaactatggactttgctggacttggcttttgttttaattttggctggtgatgctgtctccatgctgagttttgtgggctgaatggtatttccaacatggagtcagttgtgctaagcatcctactaaggtttggagccctattacattctccacaagtcttagtgaatatgtcaaatcatggactcaccctgctctaaagaagtatagttgatcctaaggaccattaagtttactgaactgatacataattggtcgtattgtttaagatgcaagggcctgccattaatctgatcagaatgagaattcaaggttcagccagtgctggtaatggaatagttagccaggggatcaagaggacagacactgggaccaatttgacttatgtcattgtctctttctctttctgagattttttccaacatggcaagatttatttctatttattccatattaagtagcatagaaaggaccggtttttccataagccatacatagtcttcctttgtatgtccagtctcagaagagaacacttggtctgagcaactcagaaagtttgtggacccctgctgtgtagcctggtcaaggtcagtcatcagagtcccaccagttatttcctggagaataatctttccctctggtgtccttcatctacctgtgggtttgagctgtccattttttttttatctaccatggaatctcaggcagcactgggtcgggtatgtcttcggaatatcaataggtcccactggtcttagggctatttgttagacaaccaggtcaacagcccagcagtagaagacagtacttcataggggaaaacaaatagccactcgcagggctgtttggtatatatacaggtctgtatatatggtggtggactttcttttcctcatctgagagcttgggttagatctgtattgctctctgggctgaggtacctgtcttggacccagatcttttcagttaaagtaagtactgcagcttccacattcttagttccatctttcatcttgtgacagtcacggatgagcatctgcaggttgtcatcaggcaagaaggtattgatagcgtgattttcttaaaactatattctagggtgaggcaggaatagggcctgataggggttcacacaggcactagacagctaagcattctggtgttcctcagaggagggtctcagccacatcctgggggtactctgagcataagatcctaattcagagttaacttttttgcttgtttgtttttttccattagaccaacagcaaccaccactgctcttaagacaggtggaccatcctgtggctgcattgttcaaccatttgaacaggtatgttacagggcgtttccatggacccaaagtttgggttaaaacctcttttatcttttgtttcatggacagatgataaggttttgagatatctgggagtgttagagctagacccaaagtcagaattgcttataaagcctcaaatgttatgtgtttaatctcggtccagattagggctccgtgcccccaggttgtgctggtgtatagagacattgcctctggtatccaaaagcagcaataggagttggggtctgaaggatggcagcagtccttttgcctcctctcagctggtagccaagataggcagacgctaatatacaaagctaggctttctctgctgatttctgtaagccaaggtttgtaactcttcacagcagtccctcagcagcccttttataatctgttttcccaggaaacctctgatagaagggcaagaattcagctcttagtctctcatcaaacaggggtggcaaaattttaagtcttcagggacaactgtccaggtatattgcctgctttactctccctctgggtctgtcatttaaaagcaaatatgggttgactcacctctgccaatgagagaccaaagaatgcatctctcaggtccaagacagtatatatctgtttctctggagaaatctgactcaggaaaatgagaggtcccaggtttcttcacaggtaggcaaggtatattccagggtgactgacagaacaccaagatgcctgtctttccacccaggcaatacagaggcagtttcccctttttgtttccaaggtccctggatattgtttaatctgaatggttctgagattgatccctggtgtcttgaggtctggtctctggggatctccatggaacctccagaaattgtgtagagtaaccactagagaagactgggctttaagccactaggatgtctttattagctgacaggcaactgcactgggtatttaggatcccagtataacactgggtggttaagaacacagggttctcctgcacgccctttgagttcagttctgagcactttgtcgccaccttctggccatgactggcattgcatgttacttacacacacaaaaaaagccattcaaatctcagctctcagtcacttggagtcagcacctacatttttcttttcaagaactctactttttttaagtttaattttgaactgaagagaaaaaaagttttatagtgacttgtctactgaatatagaatattttgtgaacaggatgggtctttaagaggaaagtaattgttctttcctgctttggctgtctgtttctaaaagtagggagttgaagtttcatgctgttgtactgtattcttctcatgttagagcccttgatacttcctttatatattttatatatcttgacacttaatgttatatttcttgtgggatagcatggaccttcctggcttcttttggtgctttgatttaaagtctttttgtatacttagaagtgaggtagatttttgataaggaacaagtatagtaactataaactcgtatagtagctcttgtcttttgattggatcattgaattttcgtatgttcaaggcagtgctgacaaggtaagcctttggtgcagccattttatgacttgctttctattttcgttgtggttcctctctttttccatcacggtgttgctctatagttgggatttattcagtttttaattccttgtttatttttgttctgtatgcatttttttatttgcggatagcttgagacttaaaacatagtgattataagaaggtatttttcagtagtgtcaatttagcatggccatgatggtgacaatggaaaccgcagagcacgagcaagaggaattcatgtgaaaactacacttaggttccagttttccattttcaatttttgatatagcatttgatatttttctatattgtctatccctagcacgtatggttatcttttaaatcattttcttttactggagatacacattatttatttaccattcttacagattagagcattttgaattcatttttataatttgatactgggttttttgtttccagtttttaaaattaaattttcacacacgtacttactgtgtactaactacgccccaccctctctttctactaaccctgtgtaccactccacttccttagaaatctttcgaacgtttatgtctactagttttattttgtgactcactaagtttaatcagcatcatctgtgtgaccatgggtgtggagctatctgctggaccctagtgggcttcttggtcaccatacaactggagacagtgactccacttctcgcagagtctatcagcgagcccctcactcacccgtgactgattctgagggctagtcttgtgtaggtaccagttcaggtaaacacagttgtttccattcatgactacaatggttgtgctgaacctagaggatgacatttcacagtcctgtaccttatctgctatttcttactgctacccagttcatcttccaaaatgttctctgagtcttagaaggtatgaggtaaatgtcttatttagggctggtccctcaaatgtcactttactctgcaaagagaaccgtttgtgattaaggctgatgatattttttactacaggtataaacatgcctatttagaaggcaatgtgattctgtatcaatttagttaaataacagtaataagttcctaccttagacatatgacgtcctcgggtatgggttcttaattggatttagtatacagggcatgccctcctatacatgggcctcagatccaatcataaggaatcataatgttttatgccttcccataatctcattttgctcataaatgtttctttttctgtccagattgaagaaattctgtagcatttcttgtgtggtgggtctggcggaaatacatcttctcaccttatgtttgtgtcaggggccagccctggcggggagtgggggggttcttttttgaggcagtggagggggaacagtgttggtggagggtaagactttgtcttacgaaatagttagggttgctattaataataataaaaagtataataataaaaagtttacttacctaagtcttacgttaatctgctactgtagctgatgcagtctctggcacttagcatatcttccttgaacagcaaaggattaaataaatagcctttgtactatctcagcaagagctgctcagctctaactttcagcctgctagtctcaggaagaaaaaagggacacttaaaatgattataacccatggaaggagttacagagacaaagtttggagctaagacaaaaggatggactacccagaggctgccccacccgggggtccatcccataattagccaccaaacacagacaccattgcatacactagcaagattttgctgaaaggaccctgatatagctgtctcttgtgagactatgccagtgcctggcaaacacagaagtggatgctcacagtcagctataggatggatcacagggctccccaatggaggagctagagaaagtacccaaggagctaaagggatctgcaaccctataggtggaacaacaatatgaactaaccagtacccccagagctcgtgtctctagctgcatatgtagcagaagatggcctacttggccatcattgggaagagaggccccttgttctattaaactttatatgccccagtacaggggaacggtagggccaggaagcgggagtgagtgggtaggggagccaggcagggggagaatatagggaacttttgggatagcatttgaaatgtaaatgaagaaaatagctaataaaaaattttaaaaaaagaaaaataagaaaaatgattatagcatttattactaagttgtaaagtttcctatgaaagctaactaagggcaaaggcagaaagatcctaagcagggaagaggaaaagttctctaaggggcaaaaattctaggaaaggaaaagattcttccaggaggggaaaagagaaacaattctactctaagtggggaaaggcaaaaaattcttctctctctcctttgtcttcagtacttatacatctttcagaatacatgatctcatgttacagtgttcatcacaaggtcacacagaaaatcaaatcataaattgaaatagaagtttacaacagagaatgttgacatgcatatccgttaggagtaattatctggctaagcatccatcacctgtcacagctccacaggttcactgaagggttaaaaccataactaagttattcgtgaagttttgtctagataaaccgagtcaatattttattttctgtcctagcacctataataaatggttagtttcctttttatgccctttggttaattgttttgcaaccccttggaatgtgctgtgagtaggagaaagtctgcttaccaagagcagttaactggggacactcgggagactggcagagttctcattgcagttttgactatcagaaaaggactaataacagtcccagtataaaagagtttaataatcactgataaaattttaggaattccctaccatgcgtggtggcacacgcctttaatctcagcacttgggaggcagaggcaggcggatttctgagttcgaggccagcctggtctacagagtaagttccaggacagtcagggctacacagagaaaccctgtctcgaaaaaccaaaacaaaaaaaaattaggaattcttataggatcatcattaaaacttaagaagtcatctatttgtctatatagcatcactacaagacagtacatcttcatggatctgctccaaaggggtgtgctattatttagtgatatatatatatacatatacacacacacacacatgtatgtatgtataataacaacaggaaaagcatattaatagcaggaatctttcctaaaatgaatcacttacagccttgcttaaaaagggcatacctttcacagattatataataatcttaagcaggacatctcaggaagatcacatgctagttattagcttgtcccattatggctcctgacatgtttggacataactttaatctctccttcatttcgaaggatagcttagctaggctagtagtcttgttgacaggtgttttgtttttttggttttggttttggttttttgattttttatagacagggtttctctgtgtagccctggctgtcctggaactcactctgtagaccaggttggcctcgaactcagaaatccgcctgcctcttcctcccaagtgctggcattaaaggaatgtgccaccactgccaggcttgacagtttttcttttcttttttttttttttttttttttttttggtttttttgagacagggtttctctgtgtagccctggcagtcctggaactcactttgtaaaccagacagactggcctcgaacacagaaatcctcctgcctctgcctcacaagtgctggaattaaaggcgtgctccaccactcccggcttgacagtttttcagtactataaaaatatattaccacgggggctggcgagatagctcagcaattaagagcagtgactgctcttccagagttcctgagttcaattcccagcaaccacatggtggctcacaaccatctgtaatgggatctgatgccctcttctggtgtgtctgaagacagctacagtgtactcatatacataaaaataaatcttaaaaaaatgtattacccaccacattatctgcttacatgtatggattcttctaaaatgtgtcgctagacaaattggcacacctgtgtgtgtgtgtgtgtgtatgtgtgtgtgtgtgcatgtgtgtattttgtctgcatcatttagaatcttttatttatctttcacttgaaggagcttgattttaagatggttttgggtaattaacagagttaactctggatagtaagtagcctttggcttccctgcctttgggtattgtatctatccttctatgtagatttgggaagtttctgttactatttgtttgaataagtttaatacatagtgtcattctcaagacctacttgaatgtcattattccaaataatggctttacaatgtcttagtgttctgtcagtccagcactgttctcattcctctctactggttttcttctctacgttttcattccaactgtgtattttaagtagcccgtcttcatgctaatgaattcctccttctgtttaagctatcctgctattggtgccttctgtctgatttttaattttactaactgtattttgcaagtcaagactttctctctgccgattctgaattgcttccatctcttatgttctcactggagtcttgacatgtttctgtgtgttttcttcctgtcattgagtttccttaaaacaggtcttttgaattctccatctgagactctgcagatattgtttgctttatagttggtttctcgcatcttatgcttaaccattagatgaggtcacagttttctgaaagttctttttatccaagttttaaaaggagcatctgtgtgtgtacacgcgcgcgcacacatacagacacacacactgtaagttaacatgtgtgttacagaaaaagtatacaaaagacaaaacaaaatcctcaaaactcataatgagtttagttgagcatgtccttgttagcatatgatgatatctgcacattaaaaaatgggtatgtattcctgccatcataatctgactttatgtctttttagatatcctaagcaagctgtttattttctctgagcctatagttacttccatcatgtcagcacattatactgctgagcaccagtgtgtttttggtattttagcagaaaagggtagtcctagctcaagtttgttctaaatccgtggttgttggattgtttagaatgaactggagaatgaatgaaccaaccagaattagaagtctgtccccacaatattccttcaggagccagagtacgctcagatggcatgtgcacaggcgctgcgggattctgccctgcttagagcataattactatgcaaggagtgtcccagtctcttgtgcaggaactacaatgacttggcacctagctccctttctgtgtccccatgggaaagttactctgtctctgttgtattgtctaaggctagagaagaaatgcagttggcaaccatgtggccactattgtcaacattgcttggtctcactcacagcccgcaagccactgagttctgcacagcataggagtagaactcagacctatagtactatatgggctgcttactgcttactgtaatcagccacaggttatgtttgtcagagtggaaatagttggtgggtctcaagtctctttctaacaccagagtgggtgtaggacctctggcttatgaatacaggttctgaggatttgtcccattaggtttccctaacctagtactgaattacagggcaaactatttagcttactttcctgctctacctgctacagggaggaatagttcccattgctgtcacccagggttagaggaagagtggtggaagtagtctcttggttgcctaggctgatgctaagctgagatgcactcaagtatcacagctgcaagagctgcacagttttacgcatgcactccaggcccctgctttggttgtctttaatgcaagatgaagtccaagtctgttctacttgatgcccatatgcctagaggctccatgtgtgtgagtgcatacctggagagggtggtctttgacatctgcctagtgcatggtcccactgttgtgggctcagcattggactccaaggcaaatatgtgtacttacattgtctgtagaagatagagtcttgcttcttattcagctatccagtgttggaagatgaatattgggagccaggagtaccactgtggtccctcagttggcttccttagctcttgtgagagaggtttgtttgtgaatagctgtcctatctggctggctagcgggaggtcataattagatcactaattatggaggatcttaatagccattttgtttagctttcatccattaattttttgatgaccacccccttagtatgtagtagaatctcactgtggttctaatttgaacttcctgagtcttaattgtcactgtctagtgcgttgaggggtcccaagtgagggtcgcattaactaggacacaggggatgcacagtgatagcacaccaatgcacactttattcaaagtttcagcatcttctatacagaaagcaaaagaaggatttcccatagtttctcattcccaccaggtgttgtttacctagcaatagcttatcttggttcaaggtgacccaaacctccttacagactgagaaatctgtctgcagtgtgatgtctagttaaactataaacaaagttactttctcatgaaaaaaggatcgtgaaggcctcttccttcatgaaggctctgcagcttacttggcaaaacaccaggattctctgctgagaaagtatgtggactctttgtcccattatgctgggattctcagctatccttcagtcaccttgcagatagtaagctaggagctgtcacctcatgccacttctctagacttaatggtgttaaacacctttgtgtgcatattgagtattttcatatgttctttgtaatgaaggtcatttcgtttatttcttttttgaaagaggatctcacagccagggatggctttgaattcactatgaagctgggggtgaccttgaacttctggttctcctgcctcactcacttcccaactgtgaagatcacaggcatgaactatactatccctgatttagcttctctgtccatttaaaaagtggattgttgcctttgttgttgctacattgtaggagttctttatatacccgagatataagctctgcacaccatagtacactcacacttggaggtcagaggacccgttggtcgcttctctcccttcactgtgtctgtcctaaggatcaaagtcaggttattcaggctttgcggcagacacccttattcactgagctatttcacaggcccctgaaggtttccatgttaatgagtcaaattcctctattttttaaaatcaatcactgtataattgggcatcatgtctatgaatttattaccaaatctaagtcacaagggtttacaactgtgttttcttttaagagctgcatagtttgataacctatattttaattgttgatctagttgttgaactagtttttatatggtgtgttgaaggaggtatatgacttcattcttttatacttggagatctgcgtattctaccacaatatgttgaacagactcttctttcttccttcagtagacttgaaaccctgactaaaccaactggcagtggatagatatgtttgtttctggattctgattttttttccccatttgtctctgtctagccttaatgtcaatattgagtgtttagttaccatagatttatagtaagtttttatgtgttttttgtttctttgttttgtttgtctttttgagacaggagtcttatggtacccaggtgagcctcaaacttgctgtgtatctgaggccccttagaattactgacccagctgcatctacctcctgattgttgtaaatataggcatgcactatattttgaaatcagtaaaggaacatgctccaattttgttctgttatttcaagaatgtctttattattttgaatcaattttatgaaaatttaatgatctgttttttaaaaacatttatcttgcacaggtcttatgcaagctacatgatggctgtgagttcatatgtacaagatcaagacagacaaaaatcccagcatggaaaggggatgtgggcatgaagtcccatcactagctgaagagttgttggtaattgctagctgctgggagaggaagagttttctggtccctgatacatgactgccctctggtggatggcctacatccaagactacataggctgcagaaatttattttttgtcaatttctttttaaagcctatttttttaaattgaaaatagattcttctctcatacaatacatgccaaccacagtttcccctccttccacccccctcagcttcccttccctcctctcttctccagatctccttcatttcttttcagaaaagagcaggccttcatgagacaacagccaaagaggacgaaataagatacaataagacaaggtgaaagcccccatttcaagactaaataaagcaaccaaatgggaggaaatagaatcagagagacaccctgtctcaccattaggattctcacaaaaacatctagctaccagccataatatatatgcaaggacctgatgcagacccacgcaggccctgtgccttccttgtcagtctgtgtgaaccctgcttattgattcagtggatcatgctctcccggtgttctccatattctctgactcttacaatcccccctttctgtggtccctgagctctgaggggtaggacccgatggagaactctagtttacactctcttctcactctggtctctgtacccgttcccatctgctgctggaggaagcctctctgatgacagcgtgataaggtagtcagtgatctatgagtatagcagaataacattaggaaagggacctgatggagatagatatgtgtaaaacaatacatcttggtcatatcccctgacaccttcccttttccaccaccccaagctcccgaacacattcccttcccacattcatgtcctttcctcttaatgtatcctactgaatctaattagtgttgcttgctggaatgttgactgctatagcgagtctttggtaggttatcaaagctagagtgagttcatgattgcaacagccatgtcctgtccacacatcatttcacagggcttctcaccatcagctgagtcttccactcttttgccctatcttcttagatgttccctgagcctcaggaggttgatatagatgccacgtttagaagtgtcacatagtctcagcattgtgattagttatgactctgcatatcctgctgcctactatggaaaggagcttctctggacaatgttaaaagcagttgtaatcagtggttatagattgaaatatttagaaggcattttgacaactgtcttagttagggttttactgctgtgaacagacaccatgaccaaggcaacacttattaggacaacatttaattggggctggcttacaggttcagaggttcagtctgttatcatcaaggtgggagcatggcagcacccaggcaggcatggtgcaggaggagctgagagttctacatcttcatctcaaggcttctaacataatcctggctttcagataaggttcttatagcccacgcccacactgacacacctactccaacaggctcacaccttctaacagtgccacttcctgggctgagcatatacaaaccatcacaacaacattatatcatttagccaaataacagttgcaggttccacccaggatcgcagtcacagcagacataaaatcatttcttgtcgagcaggcttcaaatccaatcagaaagcaattggttatcccccattcccttcatgccattattacattatgtgcacagcttgcctgacagattggtgttataatatttagggatcactgaaggatataatcagctttttgtttacatatgaagatcattgggaacttgtaagattattcagcaggtaaaagcacttgccttgaaaccctaaagacacgactttgatcctttgaacctatagtggaaagagagaatcaaccaactcctgaaatgttgttttctgacctccaggcctgtgccaggcattcctgcactcatgtacacataccatacacacatacatcatacatgcaggatgatgataaagaagattaaagaaaaggaatcattaggattttgatacaaattaccttgaaactatagattgaagatatcactatctatataataatgtttccagtctatgactacagaacatttttccatttaagtttttagaatgtagtcccttttattaggcagactctcactaaatagcttagcctggtctggagctctacatagcccagctgatcttaacttgtgttctgatttctcagtgccctgaaagatagatctataggcatgcacttctagtcactttttgcaattaaaaattacatttcagatcatttattactagtatatagaaatataactgataattatgagttgagtgtataacctgtaattttgttgaattaatttactgactttgatagttttcttgtgggttctctaagaattggtattatgtaggaccatgtcatatcatctgtaaatgaaagtgctttttctcctttcttctcccatctactttagaaacaaagtctcatgatgtagcctagactgccccagagcttctgatcctcctgctccaccgtctgagggctgggattgtagggatgtgccattacatggtgctatggattgaacccagcccttcctgaatgctaagctaagcaagtactgtaccaactgagccacatcccagctccttcttccttctgtttccttgtgtgtgtgtgtgtgtgtgtgtgtgtgtgtgtgtgtgtgcacgcgcacgcacacaaacatgcaaacatgcttgtgtttttttcatacacctcagaggccagaagagggcatcaaatcccttggagctagagttgaaggtgtttgtgagccagctgatatgagtcctgggaatcaatctgtgctgagccatctctccagtcctgcctctttctgttattacttgcctacatttttttcttatctactttccctggctagaatgtccagtacagtggtgaagaacagtggtgaaaaacgagtcattgtcttgctcctcactttcctgtgaacagtttttagttgttttttttaactacttaatgtgttagatgtgagttttcatgtatgccgtatcatgttaatgaagttcctttctatgcccaaatgtatgggcaggttttattatgaaagggtatcacatatcaattgctcaattgccttttgtttttacatcaatggacatgatccattaagtggaggtttattactgttgatgtagttcatagtctctcctagttcatttcctgatgcaagaacagaatggcacagattgggtacatttttaacaatagaatttatatgtcttgtggttctgaaggttagaaattcaaatgaaggaaaaaaatggaattggccataactttcttgcttcatgataacatggaggaaggacaagtggccctgaacctaggctagtctcccaactcttccccaagccccctaactacaagaattacaaacatgtgtgtccttccatgtctggcttaaggttcaacttctttttaaatttaatatattttaattttgtgtatgtatggatgtatatggatgtgtatatgtgagtaaagccacccaaagaggccagaagagggaagccatcatcctagattcatccgttgtcactgtagaccttcagttagatttcaacctctgaaattaagttcatggagacttattttagaagactattggggttgagggtttttgttgttgttgttgttgttgttgttgttgtttgatatagtgccctatatatgttaagtctgactttttaagaacctatttctatttttagctatatatatatttgtatgcaagaatatatacttctatatttatatttaggatatctttgctgagctcatttatagatattttattcacttttgggtatggtatttgcagagaatatcctgtgggagttggttctctttgtcaatcatattgagtcctgaggcttgaactcaggttgtcaacctaactgctaagccatttcactgtctttccctgtcttacactgtaaccccattctctctatactttcttccttttctcttgggaaaatatacatattttttccaatggaaggacaaaaagtattttaccaactccgccctgatatactttttgagctactccctaactgtgtatcccaacagtaaagttgtccttgtgatttctttcttatcttttagtcttgccacggttttaaatcaggcttctgttctacatgaaattcatgttacaacatttttcagggccatagaaaattctgcaatcttcgtgtgataaattaggacctcggagccttttgtttagtggggttttatttcaatgagataacatagttgaaggaacttcatgttctccaaagcatcttacacgagaacttgctaaagattactgaacctgtgaccaaatcaaaaaaaaaaaaatcatgttactagataaaggctctttattcttcatttttctgaacggatatttcttgtgaattaaaactctagcataaaaaacagattgagtgcccgtgtcttgcattggtgtgtaaatcctagggcgagaaagaagcaagatggaaaggctccaagatggcacccttttcccttgagactcctggtaaactcatggtcattctctactgtgtcacaaacctttctcttccctgcgcctccactgacatggatttagaattgagttacacttttattttacacaaacgagctctactgtgtgaaaactaatttttttttcttttaggaattgtggtcagatacaacagaccttcatccaaattttccttcaggtgtcaaggtagattaaatcaggcacattccaagagggtataaaaacttgtttttctgatgtaacaagtgtttcctgaacaaagcaagaaaactttccaacaacgtaaaagtggcttgaaagagtaaagcaaagtggcttcctagagagtttttggtggctaggggattggtccaggattagtttcggttggttggttggttggtggtggttggtggtttttttcccttgcttttggtttgaacttttcttcgatgcctaacaagagcaccctgatttcttctcagtgtgtccatatgtgaaagaaacagttatcagcttgtccatatgtgagacagtgtacaggagagtgattaaggtcagaacacattgtatgcatgtaagacatgtcgaaaaagaatttaaagtattatttttaaaaagcggatgaaccttagaagttctcagtaggtaggtaggtctcgaaagacggagctatgctctttgtcataagattgtagaatatctgccccatttgccagctttaagtacagcgtgtgcacagagtttattgtgaccaaagcaacatactaagttctgctgatggctgcatactagcatattgatctaaaaagctgaataacagaatagcctagatttacaaggagtcaataaaccaattatatggatatattgaacaattgcaatctttcttccaagagtaacttggcttgatgactagtataatcattaattagtataatcattttcctttagcacttctgagaataaaaagtaatgtttgatgtaaaaataataggagatatatatacacacacacacacacacacatatatatatatatatatacacacacacacacatacatacatacatatacacatacacacattcatatagacattggttggtagttagatttttttattttcttttttactttttttaatcacatttttacttatattattttgtgcacatgtttgtgtgtatgggtgtgctcctgatacaatgtatatttagaggtagagaataatttgtgggagttactcttaagagatgtaatatggtgaggagagtgcctggcaggcccatgctaaggtgtccccttaataaacatacctggtataaaggggagcctgtaggggaagagaggggagtatggtcctggagaactggtagaggcagacaaatgggatcagaagcacagaggacagaaaagggtagagagggactggctgggaatgcatgggtacagagagcaagtgagcgagccaactggggtggcaagcagttcttttgtatcctgctcacacctggccgcaagtaaagtggctggtgatgaagtaaggtgttgttaggtccctgagaggagcctagtggaatcatctgtaacccaagagttactctttccttttgtcttgtgggtcccagcaattgaacttaatgtcaacaggcctgttggtaggtgtttttacacacacacacacacacacacacacacacacacacacaaccatctggctggtcctactttcttatctttctcctcccctcccctcccctcccctcccctcccctcccctctcctctcctctcccttcccctccctccctccctccctccctttctctctctatcttgaaagataaggtttcattctgcggccctgactggtcttgctttataggcatgcaccggtattcttagcacagaattgttaggtaataactcttattaccagttgataaatggatgactaacacaattgaaaactgggtaaatgattttaatagatattcctctaaagaaagtacacattacaaccaacaaatcagggaagggtgcttaacagtcgtctttaggcacataaaatctaaacaacagtgctgcaacctccgtggctttgggattgacctgactgagcaactgggagtgaagacagacacagaaaacctaggataaggtgagccctgggttcttttggagacacgccagcagatgcttatcatatataactgacagaggaggtatgtttattatatacagttgaacaaggaagtgtgttaactaatctcactccataagggggcctctgtaggggagtggtctcaggttatggtcacctggcaagaagcagcttgggtaatactttctgtatacacagtcaacatcagtacttgttactcccctgaacctgactctaggaaggccttgccattgctttgtgccttaggtactggggtccatggcatgtcaacagtatacactgactgaagacttcatccactcaccacaccacaaaccagtttataccaacttacattttttaataaatgagaaacattggcaagaatgtggagaaatcagaacagttatccatcactagtgagaatataaaagtgtacagcaaatatgcaaaataattcatttcttttttgcatattaataacctttcaatgctccaattatatgtttgcagtttgggagccatactaggtctctatttgttttaataacatcaaactatatgctaatggactcttttttattagatatttactttatttacatttcaaatgttgttccctttcctggtttcccctccgaaaacaccctatctcctcaccctggtatccatcactagtgggaatataaaagggtacagcaaatatgcaaaatagttcatttccttagtatactgctttcagccctcatttcttttggcctttgagacagggtctgtcttagtcagggtttctattcctgcacaaacatcatgaccaagaagcaagttggagaggaaagggtttattcagcttacacttccatagtgctgttcatcactgaaagaagtcaggactggaactcaagcaggtccagggagcaggagctgatgcagaggccatggaagggtgtttcttactggcttgcttcccctggcttgctcagcgtgctctcttatagaaccaagactaccagcccagagatgacaccacccacaaggggacctccccacttgatcactaattgagaaaatgccttgcagctggatctcatggaggcatttcctcagctgaagctcctttctctctgataactccagcctgtgtcaagttgacacccaaaaccagccagtacagggtctcatatagttttgtctgactttgaactcaactatgctatctctgcactcctgatcttcctgcctttatctcccagatgctggaatgattggcacctgcccccacacccagccttcctttctcattctttagttttctcccaagaagtgaacctagagatagatgttaatatcttaactatatagtactaagatggaattaacaccagcttagttttagtagttacaggactcttcatccttttctgagtagtctcccccaccctcgttgatgctttacttgtcaagagttcatgaaaaaagttcaattcatacatgctgtgaatccagtcacatacatttatgaatttggtggttaaaatgtccaggaaaagaaagtagaaataacaaagccaagatattgtaacttctggatttaaaaaactaaacaaacaaaaaaaaatgactgtaacaaagcactttatatttacagaagaaagtgagctgaaagtgcatagtaaaggctacagatacagtgtaattatgaacatactacagtatctctaagactgattacatacacaataatggtcaggaaagattatatatactatcttagtaatggtttctattgctgtggcaaaaccccctggccatcagcaacttgggaaggaaagggttgatttcaccttagagcttgttacccatcattgaaggaagtcagggcaggcacactaggtagaaagtgatgcagataccatggaagggttctcccataattgtgcttctacattctgcttcttcccttggggtgtccagacgctgctgcacactgggctggaaggaagaagcagaacctagaatgggtggggtctgtaggctcccaatcaggcttagagtgccaggaaagaaggccttctccgaggagtttagtgttacagctctcttaaatagtattcagtgaaacatactgtgtacatacactatatttggggtgaatcaagggctatacatatgaagtttcttagggtgaagtttcattggctgaggctaaaggttctaggaatacttcatttgcatggagaagcattccaggaatctcagctgcttgttgagcaggttatctggagaggggaagctgaagctgcaatttcgccaaagactttgtgatgttccttgggtaaaagattgggggaggggggtggttgggctcccagatcaggcagagaagaggaagccccactaaaatatgggagtcttccatattgcacagagctcaggaaagataacgggacgtgctagactacaaccttagtagtgaggtgtaatactttttgcttgctcctcatggcttgctcagcctgctttcttacaactaccaggatctcctgctcagtagtgccatcacccacggtaagctgggctctcctgcatcaacaccaatcttgtagggacattttctctccctaaatgactcttaagttgtgtctagttgtcatagttgtgtaggcagcacaattatcatcttatttagtttaagtataatttatggtcataacaaagtgataagagtgcttactgtaaaatttcttagaatttatcctggctgttcagacttccctgttgttaagcaatatatggctgtacttcttctggagattcctagtctgtgcacacaggctctcatactattcaaacgttatcatgttctagtacagctgcgccactgcgtgacaaatactgtacgttattattaacaccagtctctgctgtactttggaatattccctttgttatgcacttcgatttttaaaaattgtggtagtactcacatggctttaaatttgccacttgtcttagtcagggtttctattcctgcacaaacatcatgaccaagaagcaagttggggaggaaagggtttattcggcttacatttccatactgctgttcatcaccaaggaagtcaggactggaactcaagcaggtcaggaagcaggagctgatgcagaggccatggagctatgttccttactggcttgcctcacctggcttgctcagcttgctctcttataaaacccaagactaccagcccagagatggttccacccacaaggggcctttcccccttgatcactaattgagaagatgccttacagctggatctcatggaggcatttcctcaactgaagctcctttctctgtggtaactccagctgtgtcaagttgacacaaaactagccagtacaattgaccccttgttaacttgacacacaaacacatcactagtaagcctcaacccttacaatcttattcatccccaaggtctaaataactttaaaagtcccacagtctttacatattcttaaattttcaatctctttaaaatatccatctcttttaaaatccaaagtctttttacaattaaaagtctcttaactgtgggctccactaaaacagtttcttccttcaagagggaaaatatcagggtacagtcacaatcaaaagcaaaaatcaatctccaaccgtccaatgtctgggatccaactcacgatcttctgggctcctccaagggcttgggtcacttctccagccctgcactttgtagcacacgcgtcatcctctaggctccagatgcctgtactccactgctgctgctgctcttggtggttatctcatggtactggcatctccaaaacactgcatggccccttcagtcctagggcttcaattgcaactgaggctgcaccttcaccaatgaccttccatggcttctcacagtgctgagcctcagctgctctgcgtgaccccttcatgccttcaaaaccagtaccacctgggtgacccttacacattaccaagtcccgctgcagcaggagtacaaccttggccatctctggaacacagcctctttgtgctttcagaaaactcttcccagaagatgtcacctcaaatgatgctggtctcttcttaatcaccgctaatttcttagctcctgctaaccagcatcaatagtcccagtaatgcaaagtttttgctttagtagttctggtatcttattaatcacagctgattcttcagccccagctaaccagaactacagaatcttcacaatcaacacagcaatggccctgaaaagagtccttaattttccctctgcaatttcacaaaccagacctccattttctgcactgttctcaacattatcttccaagctcctacacaacatctgacagagctcttaacaacggatggatcttcaagcccaaagttccaaagtccttccacagtcctccccaaaacatagtcaggttgtcacaggaataccccactatgctggtaccaatttgtcttagtcagggtttctattcctgcacaaacatcatgaccaagaagcaagttggggaggaaagggtttattcggcttacacttccatgctgctgttcatcaccaaaggaagtcaggactggaactcaagcaggtcaggaagcaggagctgatgcagaggccaaggagggatgttctttactggcttgcttcccctggcttgctctcttataaaacccaagactaccagcccagagatggtcccacccacaaggggccattcccccttgatcactaattgagaagatgccttacagctggatctcatggaggcattgcctcaactgaagctcctttctctgtggtaactccagctgtgtcaagttgacacaaaactagccagtacaccactttactcactttaactacaccttccaatagcattaaggacaccttgctatgcaaagatcaccattattttaaaaatcattgaacatctaaactgaaccacttacccattataaaaataagccctattagtctttgcagttagcttctagcaagcactattctgttttctgtgtctatgaatttgactttcctagttacttcatatacgtgaactattacaatatctgcccttttgtgttgcatccccataccataatattttcagattcattcttgttacgtgagtcacaatttcttttctttttcaaggctgaataatattacattgtatgtatatgccacatttatctatctctccacaaatggacattttggtatctaacttgtgcttatcatgaaaaatgctgctaaggacattggttatataaatgtttgtttgcatctgtcattttaggtgaatttagaagtacaaccgctatagtatatgaaattatgtgtttagtttagaaaacctcttgttcttcattgaagctacactattaaatgtccccctaagtaattcacaagtgtcctaatttccccgtatgcttgccaacatctgttattttctgtgctgatataagatgatcggtccttaatgtggtttgaatttgtatttccctaatatttagtgatgctgagtaacttttcctgtaattgttagtcattttctttgggaaaatgcacaagtactttatatcctttttacaatgaaaattttactgaaaacttctcattctatatcctaaatgttattagtcacttaccatttttatgatttttaattttttcctatttgatgagctgcttctcttttgtggcagtgtatttggagataccaaagtttggatgcagttgaacttgtatttttcatagtttttctatattttggtatcagcttccaaggaagcactcccattactgctggctacctttgctctgtgttttcatttatcagattttagttcttatgtgtttgatttatttgtgttcattttggcataaggttgaaatttctccaattgtcttagttagggttttactgctgtgaacagacaccatgatcaaggcaactcttacaaggacgacatttaattggagctggcttgcaggttcagaggttcagtccattatcatcaagacaggaggagcatgacaacatgcaggcagacatggctcttgcccttcagttaactgtctctgaaatgtctcatagagccatgcagacttatccttcacctatttgcttgtaattctaaatgtattcaagatgaagatgaagattagcaatcacaatatctttgtcaaacatttgagcatgtatttagggctttattttggactctccagtgtatatcattggttgatacttctctttctcttcatgttatttcatattgtttctcttactatagttagaaagttagctttgaaattagaaaatgctaatcttccttttgttctttcccaagattgctttgtctgtttgagggtcgcttgaaattaatatatgaattttgggataagatttttttctatataaatcattagattcaaataaactgattttgtgcattgttttgcatatattttaatatatacaaagcattcgttgacatcttactatagttttctaatcactgcacacagaatgacttttcattcatttatgtctttaattttcttcagcagtgctttctagttttctgtgtatatgtctctggcttccttaagtatatgtgtgaagattctaatctttctatgctgttgtcatttaaattttttagcagatgccacattgcctatatatggccatgacacagctttggaggttttctttctttgttttgtttttgtgtgcacaggtgatgtgtgtgagtggcagtgcgcatgtgccgtgatgcatgtggaggtcaggggacacctttcaccagtcagttctcaccttgctcttttgcagcaggctctgttatttgcaggcacttctctctcacttcccatctgactttaggatcacagatgcatgccacacttctggccttttatactctttgcatggggactggggcttgaacacctgtcaccaggcttgaatagcaagtgcttttatccactgagccatctccaaacccatggcacatcttgtatgttgaaaatgtgttagtgttgcttattaactttgactggttttctataaactcttgggtttattttttcacaggtcatctgtatgaagattattttatttattccatcctaagttatatgactttcatttgtttttcttgtttaattgctgtgtctgtgacttgagataccatgttgaatagaagtgggaaacatgcatatccttgactattcttgctttagggagaacctttcagactttgattttgttttatgagtttgctgtggacttttcacatgtggccttcctttatcatgttggaaaggtttccttttgtttctagttagtcttttttctgtaagaaagtatgttgacatagaagtataagcaactgaggaaagctggaagcaggagaggcggccttccccaggacgccaattggttgtctagtaccaaacagtcagccctgaaatcgcacatccaagccacatcataaagactgaataggttatatttaggaatatatgtatgtgtatatatgcatgcaataatagtgggaaagagactataaatttgaaggagagtggggagtggtatgtgggagggattggagggaggaaaggaagaaagaaatataagtatgttataatctcaaaaataaaaaagaagcatcttttctggattccccattatctaaagacgattatttgtcttttgagaaactttttttaatgtttatcctcacagcagagcagggtattgtcaataatctttctgccttatacttctatttttccctacataaaattaagtatattacaatttcttaactgcaatatgattttccaggtgatgagtttagcaagaattttacaacgctttgtaccatggggaggtgggggataggaaaacaatttaaaatggctgtatacatccctattctgactccaccatgtaataaaaagacattcaaccccctaaagaatattgtttttatagatttgttatgtctacataaattgattagtgtttctgtttcttgatttttaatagggtatattacattgattctgtgtttttaattgcctttatacttgagggataaaattcatttggccatggagcttcattctttaggctgataaattctgttaatattctgttgagtaattttgcattagtattcatagaaaatagcttttccttcttggggtacctcgtctgaattttctacctggctaataatagtagtcttatgaaatgatttagatagcattcttcacctgctttttctttacagtcttgtggaggacttgtgttaatacttaatataaatattagcagtttatccttcaaatatttaggattctttcttgaaggggaaacacaaagtttctactgatccccgactgtcctggaactcctcactgtataaataaagctatccttgaactcatagagatccacccacttctgccaagtgctctggggttaaaggcatgcaccaccatgccaagtcttaattaattttttttatgagtttggggttactgatttaatatccttactagctataggtctatgtagattttctagtacttcattattctgtcttcataagttgtatttatagaaatatatattatctggttgtctaatttgattacatttaatttcacacagtactcatattttttttatttctgtggaagtaattgtcaagtccaaaagaaattcaggacatatggctctctgcggtacctgcgagcataccagagtgcatggtggcctcgaggcccactcagtgccagtggtttttcttggttcttctcacctcaccccttaccctaaatttctcccgtgcatgggctttccttcccgcagcatctcattcctctataaccctgccattttggctacatgctctcttggttctctctcttgccttcctctctaggtcctcctctctgtctcctctcatggcctggtctagtctgctggtcatgtttagtctactactttccctgctctggactcttccacaggcctctggctgtactttccttcatatttacaataaaaacctaacactcaaccatatctggaagcaacaatgtcctcacattatacagcagcatttctaatttgatttatgactgttaaatttagtcacttttttcttgttttagtcaatctatctaaagatatgtaatttttccaaattctgtttttcattgattcgttttctattttgactctccccatctcctctgtgatgtttattgtctgtctctctccttctgctagctgtggttaacattgttccttttctaattctattacatatacacactttattattgacttgaaatcatttcaaactaatgcatgtatgttcctcgccgttactgaattatttatttctttttttaaaacaatttttttaaagatttatttatttgttatatgtaagtacactgtagctgtcttcagacactccagaagagggactcagatctccttacggatggttgtgagccatctgagcccactgagccatctcaccagccccgaattatttatttcttattgcttgatagttttatccatgtatgccatgaattttagttattttcagcaccacattctcctccgtccctccacctcctgcttcacagaagctttccttcttcctagcaagtcccctccctgctttcatggcttctttttctcagtgttttattaatttgtagctctgctcaatcattcttaatatgctcccttctagttttctaacacaaaatatgcacacaaatctataattttactgttaaacaatgccttacttatattgtaaggatttgggtgctttatttttattatcattcttttcaaaataccgattttttataaaatgtcctaacttgtttttgattaatttatttaaaagctatattcattttatttatccttttatttaattatactgtattctgaaaacattaaatgaatgttgtttttgatctcttaaatatgttaacatattttatggttcataatataatctattttgatgtgtttctcaagagattgagcataatgtatgtctggctttttctagaagaaatactatatagatatcatttaaatcaatttgactgtaagtactgttcagttcaactataattttttgttctttgagacagggtgccactatatagttctgactgactcagtgagtttgctgtgagtctatgtctcctaggaatgtcagaagctactcccataaagtctcatcaacatgacaacctaaacatgaactaagcaaagacaacagtaaatatgctaacatgggcaggagaaagcccaagaggcgacagccatatataaggaactataggcaacagaggatgctgagagtgggagaaacagtctacaccaaggaagaacacactgattgtttatcctatacccattgtcaacccaatggaaacatcatgcaagtgtctttatgtagactacacaggttgtatttaaatatttataaatatatatcatttgtcataaagcatgtgaaatacctatgaaggagtacagtatcacttgaaatgggatatgatattcatatacatgtttatatgtaataacagttaatggaaaaaggagaccatgaatttaaaatagagcaaggaagtatgtactacagagtttggatggaggaaaggaagggggaaaatgatgcattaatgaaatatagaaaaaggaaataatatgaaaaaccaatgggtctaagagctggttctttgaaaagataacaagactgatagaaccttgggccactaaccaaaagagaggaactgaattaacagaatcagaaatgaacaggaaaacattatacagacaccaaataaactcagaatattataaggaaatgctttaaaaaaaaaccattgtattccatgaaattgaaaaacctaaaggaaatggataaattctagattcagaaaagccactgaaattaaaccaaaaataagtcaacaacctatacagaccctagcaaatgagaagattggaaaagtaataaaaagtctgctaggaaaaaagtagaggtccagacttagatgggtttgtatgagaatttatctaccagacatttctaaagatctttacctagtagtaaattactcaaaatgatagaagcagaaggagcagagcactctatacccaaacaagggtaaagacataacaaaaaagaaaacactgaccactttccctgttgaacacaagttttaaatgcagcagccagaagagagcactgggtgtcctcctcttattggtcttgataagaagcttgatttaaaaaaaaacaaacaaacaaaccttgagctcaagttttctcacctaggctggaagccaacaagccctaaaaatcctcctgtccccccagccccccagagctaggatttccatgtttttaagggttttctgtgtgtgcgaggatctaagttcttgtcctgattgtagaacaagcactgttaactcaccagtccctaaagtaggttctagtaaacaacatagttccatcttcgtttgttttcatgtatgctgaaataatctaacttttaattagagtattcagaactttcacatgtaaaatgggatctggagaaatggctcagtagttaatatactgcttcctgtagaggacttgagtttggtttgcagcacccacatcaggtggcccacagccccctgtaactcctgctctagggatcaaaactcttcttctaacctgctggacacttgtcctcatgtgcagatacccacatacacaaatacacacgattaaaaattttaaatctatagaattaatattgagatgtttggattagtacttgtctcatttgttatttacggatgcttccatgattttactttcatggtttttctcttcctttgtgccttttctgtttttagtttagcatttacaatattccatgtactattttagcatcttaattatacttttatggaatttgtatggttattctaaaatttgttattaaatattttatatctcatttaaagtaaatctgtactgtactgtttcatagtactccacatgctttcgaatagtgttcaagttctccctcctatccactataatactgtttgaattcatataaaatattcattagcaataattttggaatacattttaattgttatttagtacaagcttatctatcaatcaactattaaaaagaaaatatattaaaatttaatttacccattcttcaacaatcttcattttctcatatataaatccacatttctaacttatgtaattttccattgttctgaagaatttactctaacattttttgtaagacaagcttaccagcattaggttctgccagtttttttttcctgaaaaaagtatttcacatctacacaagaaatatcattttctggatacaatatttcaggttggaattggtgtgttctcttccttaatattttatatattttagtatacttgcttaaagattgtagtttccaaaccaaaacccttgtaattcttatttttaatcctataagtacttgttcattaacaaattaatcgatagcattaacaatcccctcgaactatgttctcccttgtgtttttccctggtgaggtattggagggctcattggataaagtgcttgctgtgcaagcatgaggacctgagtccacatctccagaatccttgtaattctagacatagtagtgtgtgtcccagaactccaacagcaagcctcgaggcagagccaggagaacccctaagaggttgtcatcgaactagtacacacagtagttaaccagaagagcttctcttatgaatgaggtggaaggtaagaactgacattagaggctgttctctgacctccacctgcatgcccaagccatgcgcgtgtacacacacacacacacacacacacacacacacacacagagagagagagagagagagagagagagagagagagagagtcagaaagagaacagtataggagaggagaagaaggggatataactacgcttgatgaggatataaagaaaagggaacccttatacatggttgttgagaaagtaaatgaccatcaatgggtatgtacctcttgtgtgacagattcctggggagatgggaacagataggaactgagaactgatcaaagtatggataccagtgaagtccatcttgatgagccaattcgttttattggtgttattttcaggaatgtgggtgagggattacttacaggagcagaaatgaccaaaaggcagctgaatcaccaaagcccaccctaacataggtaatgtcttactaaacatggaaacttggagcacaataaacagcctgtgggcagcacaacaggctggagagtgttctttccgggcagctcggctaacctgagcctcttctgagtagcctgggtgtgttggtcagggtttctattcctgcacaaagcatcatgactaagaagcaagttgggggcaaggggcacgctggagagatggctcagtggttaagagcactgactgctctgctagaggtcctgagttcaattcccagcaaccacatggtggctcacaaccatctgtaattggatctgatacactcttctggtgtgtctgaagacagctacagtgtactcacatacataaaataaatctttttttaaaaaaagattggtaaaagaaaataaagcagccaggcgttggtggcacacacctttaatcccagcacttgggaggcagaggcacgctgatttctgagttcaaggccagcctgatctacagagtgagttccaggacagccagggctacacagagaaaccctgtcttgaaaaaaatggggaggaaagggtttattcagtttacatttccacgttgctgttcatcaccaaatgaagttaggactggaactcaagcaggtcaggaagcaggagctgatgcagaggccatggagggatgttacttactggcttacttcccctggcttgctcagcctgctctcttagagaacccaagactaccagcctagagatggcatcacccacaaggggccctcccacccttgatccttacagctggatcccatggaggcatttcctcaaggaaggctcctttctctgtgataacttgagcctgtgtcaacttgacacccaaaaccaaccagtacactgggtgttctttgattcctctacctctttcaaacagctcaacttctgtctcatttaaatgacttgtctagtctgagactgtctctcagcaggcctagcagcttgggagtgggggctagagctagtggagctggtgagtatcagggacttcccagatcctttgaattgtcttctgcctgaagcttctcttcaggatggaatgattcacatgcccacctctgaaaatccaattggtttatctcctttaacatcctgtgtcttaaggagctctcctacaagacagtttaatctcagaggaattgctacaaacaatatccagagcaaatgaagtcagtatgcttatcagcacttattggagcactatgtgaaatagccagtggatttagaaacaaatgtagcctaacaagtcatgagtgaacaaagactacactattcagcactttgtgagaagataatcctttcatttgagacagcatggatggagctggaggacgttattgctgaaacgggaagaaagaaacagttaaaggaaggtggataatgtatgtctacacttacatgtagactttaataaagctcaactcacacatgatgtgcaataatggctacaagtctgaggttataaatatttggttagataggagaaataagctgaagggatcaattgttctggtaactatagctgataacaatatatcatacgcttgaaagtgctaaaagaatgaattgtaagcctagtttgaattggaaaaagacgagtttttgaaatttaactcaatttaactattctacagttgtatatacctcaaggtaaaatgctgtatatgataagtagacttttttatcagtgaaataaaacggagccatgtgtgttcatatacactgcattcccagtacttgtaaggcaagaggaccataaggaacataagtttgaagacagcccaagttacataggtaggtactgtcttaaagaaaggaagacagacagacagacagacagacagacagacagggaggaaaaggaaaaaggaaaaaggagaaaggaaaggaaaggaaaggaaaggaaaggaaaggaaaggaaaggaaaggaaaggaaaggaaaggaaaggaaaggaaaaaggaaaacaatcaaataagaagccccagatgaaatgcaaacatttgcatcaaatgtgaactgaccatgagctgagcttacagtgaatgaaggcgtctcatccatcttttgtcccttctgttttagttggcatacatacatacacaaagttttaaaatagagaaaagtaggcagattgctggaaaacaatttaaatttttaaaagaaaacagcacaggcatgggccaccttccccgtgaagagctaaggacaggagctcgctggggtcggcctggagagaacacaagatagacactcatcaccctgaagatcctcattgttggcaaggccagctcgctattgaaattcacacatgatgcttttggttcagaacctatagcaacaataggtattgactttaaagtgaaaaagaattacagtagaaggaactaaggccaaacttacaatatgggaaacgctggtcaaattaactctcagccattatagtggtacacaatgtgttgcatttgtttgtaacatcacaagaagaggcaactttgttaaactggatagttagttaaatgaaatagaaatattccatacaagaaaggatatagttaacatgctgactggaagtaaaattgatgaagaacaacttgaggttgatagaaatgaaggctggaaatctgcacaaaagcattccatgttattcatagaggcaaggctgaaaacttgtgactcttcagtgtgccgttaagaaaattgtggagaagatctgttagacacctgggctgtgaaaaagtgaagatcagaacgaagaagtcaagctgtcacacgggagagagccgtggaagaggggccggtggtgatgactgttttgtgttacaaactcggggaattcgatctcttgcatagttaatcagcgccatctctgtgtatacacaatactcttaactgctatttagagaccttgcagtttgcacataattgttttcatcatggcaatgcatatttgcaagaaaacccactcaataacttgcccagatgaaatgttatggtaagcatgccatctgtagtttttcttttatgtaacataaaataggtatactttcctgagtgtatttggtttatgatttacatttattgtgtcattttttaaaatatccatctgtctagtgtgttttgctaaaggtctgctttggttttctttttatttaaatgccctgatcaactactgtgttacttgctattagaacaagaaggggggctggggggatacatgtcatcatgcctatctagtttcctttaaggaatagcaaggagcacaattcacagcttttctaagatgctagagattcttggtagtatgaagtaccagtctaggccagttcataatttaattactatctgttttgatgatgcctccaaagtaggattgatactactaaagtattgctatgctaaagcagtttggtatttttttttactgcagttattagctcagttaagctgagctttagtcctgtgatgtacaacttggattcatgatccctaatggaaaggtttagttacttgtcatataacagagtgacaataaggctttccctcatttgggttttagaataacatgaatggtgttttgtaactcataatatttttacttctaaaaccagcatcttttttcacaggtattgatattgtcaaggtgccttaactgtggctcacataatgtttatgactgtatcttatgccttctctagacagctactcattgttttgttttgttttttaaaaaagctatttctatgtatggaagatgaaggagaataactctaaatgatcatttgagaaagggatattgcttctggattctgacatgaggaaaaatgctattcgctattccaatgatcatttactctaacaagtacctagtatgtcccagtcagtgttcattgctgtgaagagacagcatgtccacggaaactcttatgaaaggaaatatttaattagggcttgcttacattttcagaggcttagttcattttcatcttagcagggagcatggcaacatgcaggcacatatgcagaaggatctgcaggcaacaggaagagtgagtgccactaggcctgactgagcttctgaaacctcaaagcctatccccagtgacacatttcctccaacaatgcacatccactccaataaggctatacctcctaatctttctcaagtagtatcactccctaatggccaagcattcaaatgtataagcctatgggagctattcctattcaaaccaccacattacactccctggccctcatatgcttgaagccatatcataatgcaaatatacgttcggtccaacttcaaaagtccccataacttaaaacagtctcaaaactgtttaaaagtccaaaattcaaagtcacttctaaaacttcatagcatctcttaactgtaacccccccccccataaaatcaaaatcaaaaagcagatcacatacttccaacatataatagcacaggatatagatattaccattccaaaaggaaggcaagggaacatagtgaggaaatactggaccaaagcaagactgaaagcttgcttgcacctccatgtctaatgtcaaagcgctcttcaggtctccaagtcctttctgctttgttgaatgcacttcttcctcttggactggtcgacactctgatagaagctctccttggcaggtatcccatgacactggcatctcagctccaacatcttggggtctccaacacaatccagacttcactttcacagcttcactcagtggcctttctgggcctccatgcagggacacccctgacatatgcctgaactcaacagcttttgctagctatggagggaggttccataaccccttacctccaaagccagaactacatggctgtggctgccacattctgctgtttgctggggctggaacttggccccctcattcaattacatctacatcagatttctattattgatggtttcctttactgcttaagtttttctttaacaccttttcccaagtcggagctcagcagagtgggaccttatcctgaggtcaccactcacttaaatccatttaacaccaggcttttctttaaactattttatttccttgagcaccggtgctcccttctcctcaaattgtactttttagtattttgccttgcttgttttcattattcatctgcataatctcttctgccaatgtcattaattcaaaactcttcaatttagcctcaggcatatttttcagacaggggaagaaagcagccatattctttgccaaaatattacaagaatgttctttagtcctcttactactattcttttcctctgagacctcttgagccaggcccccacatttccatatcatcctcactaccactgtgctccatgcttctgcgacaatggcccattaaagccccacttaaagtgttcagttgcttttctagtgcaaagtccatattccaccaacaagcagcatggccaggcctgtcacagcagtacccaagtccctggtatcaactcctgtcttagtcaattcaatgcttgattgttgtgaagagacagcaagacagcatgatcgtggcaactcataaagaaagcatttattcagggcttgcttacagctccagaggtttagtcaagtattgtcatggcagggatcatgacagcatgcaggcagacatggtactggagaagaagctctgagtcctatatgcagatttgccggcagcaggaagagtgagtaccattgggcctggtttgggcttctaaaacctcaaagctcacacccagtagcccacttcctccaacaaggccacatttcctccaactaaggccacacctcttattccccgtcctaatgactacaccttcaaattgctgagcctatggaggccattcctattcagaccaccacataatagtttatgaaaaccaacctatatgatcctattactatctccaaatgtgtccaacaaaatgattttgctgaaaacatttaaagggtgtttcttactctgaaacttaaaagaaacttaaaaggttaacatctcttttcaaactttacgctatggtaaaagtaatatgatttacataaacaacaaaaaataacccaggatgtcagaagctttgagtagtcaataaattgagtatattatgtatcagaccttgttcctatttcctagaaatctattatagaagtaaaacaaaataccctcttcatagaacttttaggggtggaggaaacaacagaattataaatatataatattgaatggtgataactgatacagagaaaaatgttatagcatataaggatagtgggtgttagaacgtaggaataatatttttggtgggatagtcagggaagttctctttaagaaagtaaaaaatgaaatgaaatgaaatgaagaggtaaggcatgctgcagagagtagtctctccctgagaaagaacaaatgaacttcttgggttatttttaaaaacagtgtcataactggtgtggcaaaaatgagacatcagtgactagcgaatggtagaactgattgcttagcacgtagaaaagtccccagtactataaaaaaaagaagaagaagaagaaagaggcaaaggaacggttaacagagctggttgtagcctgtgaaagaagagccaaaccatgtgagatagagatccactgtgaaaaggagtttgtactttttaaagtcttgtcgcaaaccattaggttttgacaaatggatcgttgtaatgtgacatgacttttttttcaaggatgatccttgctactatttgagaaaaacttgtggtagtttgaatgagtttgacccccatcggcccagagggagtggaattattaggctcccagtgactattagcctgctttgaggtctctgatgctcaagtcacacccggtgtgtcacgcgctttctgctccctgctgatctgcatgtagaactcagctccctttttcagcaccatgtgtacctgcatgctaccatacttccagctatgatgatactggactgaacctcggaaaccataagccagcctcaattaaatgaaaccaaacatcccacaacatttccccctttttgactacactaaaagttgtgttgtacacagtttaacctttacaacagaaaccattatcagtcccacaaacttaaccgccccaatgtctttctgaagaaccattgatgccatgatcctacataactgcagtcctgaacatctgtcttcatcagcagtccatttcagcatcaaggtttttaaactataagtctggtgaatgatttgtagttcttccactgatttgtggagttgtctccatgcagggggcatcagctttctttgtctctcccttccttgtgtcatgcctatcatgtggaaatttctcctacttggatcagatcgttatcaatttggatggagcccatagactttcatcacctttcaacatctagacaaaacctcttccttgacgtaacacattacctgacttccattctgatgtgaaaacagctttaaagtacacaggttgatttaattcagcaggggtttgttgttgttgttgtttttacaatccagtgtctttcagctaatcttattcccccctttcaaagtacattagatctttatgaatccacacataaactagatacttaagcacttgaattctatgcccagctgcatgcgagctgggcttcttacccattatcaatgagctgtctatcttgatcctcaatttcattggggtccataggcatttcctattcgcctaatccctctgtctcttgcttctcaagcctttgcattattgaagctaattttgcctgtcacacagattttcgcaaccttttttgagaggaaaaatataaagattgcaattgaaagtagggagaggttttctccagtagttaaaactgcaatgagtaccgagatgactttttcaagtaacgtttctatcccctcaatccctacccttgctctcagggatctgaaatggagtttcccatgtttaaatgtaggaagagtctgtctatatacttaaaactgtcttttggggttgcttactgtgatttgctgtctcaatcgcttctgcattgttccttgctctgagcttcaagttcttgctgcattgatccagagtgtccccaatctctcttggtgtccagttgaacttaaataactgatgtttcttctggagatgatcccaggccaatttctactcttggctttctgtcagatgtctcctgtcctctacagcttttctgtcagatgtcctttgctttcagcaatgttggcaggatttcttcttctccaatcacattaagtttttcttccaaatatgttaagtgccagatgtaaacatatttttattctcctggtcttctctgaggcttactgccccagtctgctaatttagacctagtcctgcaagcttctagcctatgtataatcttacttaggcctagaatatttttagcttctgagacttactgctaggatgtttgcagcaaaagagataagaggaatagaacagtaggtatggaatgatataggaataggggaatttcattttcaaagtgggagacagtttagatatacatgtttaattgctgataagactgttttggtagagaggagtctatttcaaaattatttttacattgacaagttttacattgacagcagaagttagtggaaaggatggaaatatccatatatcttatatacctgtgtgcatattcttccacagctgccaacaacaataatgcaattgttccaagtggtgaatctatgctaatacaccactatcacccaaatttcacattaggactcactacactttgtgggtttggaaagatatataatgtagtggcatgtatctgccatcataatatcatacaaaatacttcactgctctatataaactacttccattcatttttctctaactcagctcctgaaaccacttaaaaatttttgttgttttgtggttttattttattttagtgacaaggcctaagtatgtatacttagctggcatggaacttgctttgtagcaggttggcctagaatttgaagcagccctcttgcttctgctgatattacagaaatgtatcactatgcctggaaaaaagtctttttttcttgaagtattggaaatagaactgagggctccttgtatgctaggaaagcattctagtgattgaagtattctcgcagccctaagcactaccttttttcagtctccatagttttaccatttccaaatgtctagtaattggattgaaatagcatattgtctttgaaggcgggggccactcctgtgacaggtatgtgaatgtcttagtgttctattgctgtaaagagagacccatgaccatagcaaattttataaaagaaagcatgtaactgtagcttactaatagtttcaggggtttacttcataagtatcatggtggagaggatggtagcacacagtcagacatggtactggagaggagctgagagttttatatccaaatcttcaggcagtaaagagaatcactgtgcctggcttgggcttctaaaacctcatagccaacccccagtggcatacttcctccaacaaagctacatctaccccaacaagaccacacctcctaatcctttcaaacaatgccactccctaagcactgaaatatctgagcttaccagggccattgtcattcagtgaaggttagagtgcaactggcatagttagttttcttcctccaccatgtgggtttcaggtatggaatctaagcccttaacttcacaagcaaatgtctttacttgctaatattttgctggcctacatgttgtttttaaaaattggattagttcaagagagttagtgtggatctactgtgtggattccagatttaaatttctttctttgtatgtgtctatgtttgaggacagtaagagtgtaggacgagaaactagaaggcagatatgagagaaaggaaaggtttagggggaattaaaaacagggtaatatgatacatgggacatggaaacgggaaggggagttgaggatctcgtctgtgaacggtgaggagaaatgatatgagcatttcctgaccaaggattgtaagaaagagaattccttctcttctcctttcctttcccattttccttgctgaatacagccattaggaggtgttctcatgaagaagcagaaggtcatggttagttaataagaaaccccccaaaaaggactgtagactcctcatactttgtattttgagaagtaatttggcattctattaatttatattattttctttaattgtgtacacttataacttcgtatccatacagagctatcctcctccgttcctgtaattgtacacttttcaaggagtatttcccgggtttggaatttcagtgagttttttccatgattcttgcagctgctgctgccattcttagctttactgccaggcacttaagtgcctccatctgttcccttgtattttccaaacaacgttccctatgcagagtctagatgatgtcagaactaaatagtagtccaaacgttaaggcacattggagaagagggtgttttcctttgtttagggtccactttatccttatgtcagtagcgtagcaaagtgcctgaaagtttatttggaaatagttgtttctgggattacatagaaatcggcctttttgtgaccgatgtatagctgaggacttttgttggaaatgggacaaagaagattcctaagcccagagctactatgagaacagctgcgtttcccgaggataaagcattgttcattggctgaggacattgttcctggctctgttttcccttggtaagaagtgattcttcacaccattttccttcttattcccctactctttctgctactttgagatagagaatcatactatgtagccctggctggccgggcatttagtatgtagggcaggctaaccttaaacactaaatgtgtggtgatcctactgcctctgtctcaggctctaggattccagggtgtgcaccaccacacctggttgctgaagcatatagcttgacataacctgcaaatattcttatatgtggcttcttcaaattctgtaaatggaccctgtctcaagtagtagaaacagcaattcttttcctccactagaagtagatatttcttgggcctgtttcaccagttacttcaagaaacttggtcctgactagggaggttcagtttcctgtgtaccacatattagcttttcatcactataagaaagtagtcaaggtagtcaacttataaagagaagcgttttcttttggctcacagttttggaggttttagttcacaaccaagtgaatgtagcacatacacagcacagcacacacatagcagaacaaaacttctcaccttggtggccacctatcaaaagaaacagaaagggaatacagagacccttgcgggataggcataattcaaacggtagcaggaagttcctgaagcacatgggaagaaaagcaatgcattgtaagaacacacagaatttggatcaacctattctagaagagagtttgctgaagaacgtttgtttacctgaggaacatggaggtcagtagagaggcacgttagcctaaatctacaaaagcagattcatgagaggtgcaagaggagatgttgtgagccataatagcaataggcatatgctactgtgcgagttcatgagcacacgtgagaggtgacgtgacatggggaggggaaaggtgtggaagacactcccaagtactcatggctgcctctttatcccagggttgatgcttgggatttgattctgaaagttatatttcaggaacaagtcagtgttacgtagacacaagaggagatactgaatagtcgaacaatactttgttcccttatgctggaccagaatgcagttttggaggaagaaaatcatgtcttgcgatcataatataggtcaacatcttctacatagtatttgatctaatttcaagatgatatttaaccaatatatcaatacagactaataaaacacattaaaaaccttcccatagggccttttcaatcaataattgttagccacttattggctttattttgtaaatgaattgacaagagattatccaacagatatttcaactattgctaaaaccactcctatcagcaagtaaattggtgaaaagatattggtagttggggctctgttgcttatatatacatcgccagcccctctgagatctaaaacagaattataaggttgaggacgccttgggctgcatggtaaacctcaggtcagctggggaatttgatgagagcaatttcccagtaccatctttaaacagtattgtgaatatagctggctggtagattgcttcttgaacatactcaagggcctaagttgaatgcttagcagcaccacagcaacaaaaagggacattaaacctccacaaatatgagcaaattttatattggtgttattttagttatactgtgaaacagaagattggtgttaatgctggtgaaaactgagatacaaagtggcctgtcctggacattgacgtacagaaaagacacttagaaggagtgaacattatgaataaagatggtgtgtgtgtgtgtgtgtgtgtgtgtgtgtgtgtatacgtatacatacacttcctgctatcacaattgctataaatgtagtggcttaaaatgagactagcatatcatatcacagcactggatgcaaaaaaggtcttactaccctaaatcaaacagatccttaacttcggggcttactaaggaagaaactttcttctgcatagtttcttcagacttcctgcattccatgggtcctggattctttccatctttgaggccaacagtgtccactatggtttcgtttggtttgaccagtgctgctttcctgagatgcaaactcttaatgcctcagcctggcatacctaataagtacctttgcagtcacaacggctagattgacccaggataattttgtacagaattccactattaacaacctcacttctacctcaaacctcagttttccttggccaaataacatctttatgtatcatgggttgttattctgtgaaacactgggtaggtgcttaaataaatctctaaatgggcaagcgcaatagccttagtttgtgcttaatgacactcccctttttttccccagagaggtattgctacttagaatcacacaacacacacacacacacacacacacacacacacacaccaacacaccaaccaccaccaccaccatacacacaaacggacacgcacaaacatgggggaacgcaggcacacacaccccaaccaccacacacacacacacacacacacacactgtggcacaaagaattgactgttggcccaaacctgtggttgatttactaggccagaaggtgtagtttggttttccttttggaagaggggcaatggtggggaatgtaatggaggccccactttggattccatagagacaggagtgccctcccttcatggttgcatgaaccagtaaaagaaaacatgggagaatcaacaggaacctactggctggctggctgttgctaggtcacctgtcccctctcaggctgcagtacaagcagtccccctccccttccattggcgtcatatgaggaggcagaggagggggaagcaaagagggagtacagggaggggcaggcactgtccagcctcgttctgaaatacagatgtatcaaggttctcactcagtatccctccgctgctcccccctgctccctaactgcagaccttctcctccctatagtccccccctccccaaaaccctcatagactctagatcttagccatcccacacactgttgtggcgccaaaaaaaaagtggtggtggtctctggttagggtgaacaggggtctgcagacgcctaaccggtgcaacccacccctccaagaggagtggggctgtctggccccgcccactccgagtcggaactacagtgggttcgggagggggcgtagagccccgtgcgcagtatccctccgcccccttcccgacaccctccaggcgagctggcttgccgcagtctacgcagcccctgcctgtttggtgcagaggcgtggggacaggacacatctctgccattccactcgcgcgcaaagcgttaaagaccagtgagaggatccgccgaggacagagaacacccaggaataggagtcggacgtgggggagcccagggacctgggccgtgcgcctggccaggcaagtgggggtgtgtcgagggctctgggcggtcgcgcactgcaaacaactgcctggccctgacagtccagtggaggcaaagaggtcgcagctgctccctggagtgtgcgcggtgcccggagaccccagaccgtggtggggaggaggcgggaacccctgcggagccccaggcaccagggttgaatggagctgctgctgggtgtgatgatctgcagactagcacagcctactgaccgcctggcagttggctttctgagcgcccatacccggccctccgtaatctctgggccctataagggttatggggtaggcggctgctgttgaaatggcgatgcgggggtggggggggcatctgggagcccacaggtccgaggaaggcggctgcaagagaaatggccggccatactggagtgggggtgggggctaaagcccacaggtgtgggtgtggggcaagtgtccagcattggggccagctcagctggtgggtggtgagtcgcctcagctattaggttctgaactggttcctgagaggggccctggtaccctgcatcctgggtgctgtcactccccacaggcttctgattgatggaaagtgacctgtctgcatggtaggtctggcatattctggcaagccacggtgagcatctatagaccagaagcttgagaaaagaggaacaggaaaatggcgtggatttctggaggtgtgtagtaatggggatgggcaccagacagtgagtggagatgcaaaaagggtggggtgactggccagaacaggtgggatatccattagtgtctcctaatctcatttctcacaaccttgtaggtaccttccacactgcctttcccctccctcccaaatctggggtctgaaaagatggtttggggatgatgacggagtcataaatccaaggaccacttcagaacctggtttctagaatgtgctgcgcccttcccccattttttgctgcgcaaggaagggaaatatggccacctagtggcggatcttcaacattgcagaagggactaaaggatgacatcaggaagtgggtgttacctcaggagccctacagccaggctaaataaatctagaatgttccagcagtaggaccctaaatgctgaaagacacatgatctggttcatatccttggtgacattcataacatgatcagctgctaccatcatataagtgccatacattttcatctttgtccacagccctgctttaaggctggtcagttcttcaagcaagggaagaaggcttcaaggcgactgtctcaaatctctggagattggtgagactc

SEQ ID NO: 277 - DNA, 59699 bp, mus musculus
agtgcgtcccggcggatgtaggtagctatgtagtcgcttcgtgagggaccggagagaggagtgggtaccgaaaggtgacagtaatttgctagtcatggcccttcatcttgtcctacatcccaagctcccggcaagcccctaaattacagtcgccgccattgcctctgctccctgcggcggactgccgacggcgtttgcctgcctcctttctgtgtgggaaggcgccgccggagagaacgcacctaagaaaactgccttggattcaagcagaacaggtcagtaagaaggagggcattgcttggggttgtggttgcgggttccatgattggtgcgggattggtgacctgattttagggggcgagtgttgggaagacagactagggaggatgagaaaaagctatctacgtttccagaaactcgcttcatcacgtttgggaagggagatggatgcaatggcatcatctactggggagatggcgtacttgtcagagaaaggactaccaccactgatgaacgcagttgtctgaggagccttgagaatcaggaaggagatacacaaaggggttatagatgtgggaacattaaatcttgtgttgggtgtattcgaagattgcacattcttatctgaccattaattaaccatatcttactcagtgcgatttcatttgatttggggctatcacacattcatttgtgtggatagattttgtgccaagtttgcatttctccacgtttcagggcggcagatcaaaaggggaggggagaagataaacaaaactgacctgatttctgtactgtgggagaaagctgcaagactaggtagggttctagaataatttctacatctcctcttttccagccttccagaaatgccctccgcgttaccccaactatgttgcagaatgtgataggtttgtgtgggtgggtgggggataatcataagaatgtgtaagaaaattgaaaatgatacttttcattatttccccagcttcctgttattgtcaggcgtttcatccctactgctaccagtacgaccaactgtgcagagatgatttagttgtcccttcatggaaatgatcaggctttaagaatatagcagaggaacgtggagatttgggggtgtcatggggggatgacaaaaagaaagggaatcagagaattctttaccaaacaagtatctgtatccagcaagcatttattccgtaattactgtttcctaaattatactcagtagtgctgttctcatgtttgtggatttccattgatagacacatccggagggttgtataacttggctgttgtgaatgtttgtaaaataactgaatgtgaagctaggagataatgagaaggcaattgtccagattcgaggattagtgtgaagacagacaaggatcactgagactagaatgtcacacccttctgttttgtcagtttctcgatgacctctagctggtctgtggattcacttaggagtcttggtctaactctagagatagatgcaggatgggaacatcttcctttaatcccctctttcctgtcctgctctaacacttcattatcaaccgatttttcaactaagggattaccgaaacagtcactcaagaagacaatggagggccccaagggaggaggaggaagaggaggaggaacagctttgaagctggttaatggaaggagaggaagaccaggaagggaaaagctagacaagcttctctgagaaggcaagaataagggccaggaaccaaggtctgtatcccaagagctgagtttctctgtcctctttatctatctataggtttgccagatctgctgcagggcttgtcgccagtggaaacagagaaaggaggaaacaatcccttggcaagagcgcaggttagtatgaacgtggggactcctcgagtaagacctatagtatggaacagtaaagatttggttggctccagcctaggtcagcagatagcctcggaattttgcagcctctcgtgtccatccagctttcctattctttctgcccttattggtgtctgcaaagacaaattggtagcacatgaaggtatagacagtgggtgaactgaaaggaggagttggctccttgtctccttcttccccatagagcactgaatttccatacttaactatgtctctgtgcttatcagcatgagaagaaagcaaattggaagagacttaaagccccatttccttcctccacccctaggtccaacttcagtgacagatctgatggccttggagtggctgaagaccaccaccctccacaggcctgcgccccagcacagctatcctttatcttgagtgagcttcctcaacatgctgtctatatgattggcagaaactgtagttggaaaggggctgaatgactactggactttatatgaaaacacctacttggggctgactttcgggcaaggctgagacaggggcatatttatattaagctttgcctttctctcgaaccatgattggctctaaaactaaaaggaaagctagagaagagtctggggcttcctcaaaacctggaaccaatagccctgccaatgctaaaggaaaagccaagaatcagaccactaaagccgttaaggcagaaccaaaagaagaatgggggaaccaggctgaggctagggatgaagcagtggccaggacacagccagccatttccactgagcccaagactgtgacctggaaagtaaaaaaaaagaaagataagactaatgctagagtcatggctcaggctaagacagaactcccggcagggcctgctttagtgcctcacaccaagtcagatgctctgcctacatctgtggtcattactgtaaccaagtctgaagtcaagattgacactggaattgaggcatctctcaagggcgctgccaaggctactgataagcgcagtattaagcagaagcctgagataaagaaagaggtctgtgtcaaatccagggctggggacaaagctaaagaggtctgtgtcaaatccagtgctggagacaaagctaaagaggtctgtgtcaaatccagggctggggacaaagctaaagaggtctgtgtcaaatccagggctggggacaaagctagtattgtcatcaacaccactgatgaggatgaagattatgtgtgttcctggttttggactggagaagagcctagtgtagggtcctggttctggcctaaagaagaaaatcctcttcaagtttatcagcccccaccaaaggttgaagaagaacctgaacccccagatacattcgactatgctttaaaaaaaaaagctgcagcatggttaaggggcaggtttattgtcctggtccccattgaggaaccgcagccatctttacctccagatgggaactggactctggttgcaaccttaattgaaactcccctgggtattcgacctttgaccaagatcccaccttatgggggaccttacttccagactttagccgatttaaaaaaccaaatccgggaaaaagagaagtatggacccaatccaaatacctgccgctgtaaatcccgcacctttagtttagagcctgttgactttgataagctcgttgccctacttaagttaacgagggatccgtttattcatgagatagctacaatgataatggggatcagtcctgcttacccatttactcaagatattgttcacgatgttggtattactgttatgattgaaaattttgtcaataatccaaatgctaagaaataccctagaactttaaatataaatgccaaccctgatgcccccgaagaagtgaaagagaccgaagcacatgtaaataaagtttgtagggacatactctgttgtcctttgaactgctctgtgcaagtggaggagctaaagctgttagtgagcttgagtgtgaaatttgattatcaccacgtggttatctattatgttcgttatttcatctcactgttaaacaaaggaagtgtcaaaatcaagtttcagattttaagagtccttttgtgcttgtcaaaaaatcaagcgaatacaagagaactgatcagtgctgaagtaatgtcctcactggtcgctctctttcacaagaatgagtcaaaagctaatattcttcatatcattgaaatatttgagaatataaatttccaattcaaaaaaagggcaaaactgtttactaaggaaatgttcactaaatctgaacttatttccatattccgggaggcaaaagagtttgaccagaaactccaagacttaacagaccacagtgaccctgatgtgagagataaagttatccgattaatactcaaactctgaatagctgtatattctcacaaagccttgaacatttttgtctttccaatataaatcgaatgcttattataattataaatttgataacttatgctctctgtgttgagggaggccattttatggatgctagtcatcttgaaagattgaatacttgctggtttttattgtgctatataatataaattaaggtattttggtatttctgtaatgtaacccagtactgaacctattcgttctaaataagctatatttctgtgcattatattgatataagtgtattttcgtattccatttacgtgtttttaataaagttgcatgctaaacacaatgaaaacattgttccagttctttagttgaaatgtagtcagagatgaacaatgtaaatatagccaaaattgtcgtctgtccatttactgatggtgggggttggcacaaacaaacaggttcacaaattggcagatctttcagtttcaccatgttcagggaatacagtcaaccagtctgtgaccaagaagacaggactatgcttctggctgctggaagttgtagatgccaggttttcaatggaggaacaatactgaatccggacagacttaggaggaggagcgtacagatgccttcacgtcactcttgagtccaagaacttgtgcttagcttgcacatcagctgtcccactaggatcccctgaagttttttatcccagagagattttctggttctcagcctattcagttcaattatggtcagttgtgggaagtgcacttctaaagggacacaggcacactgtttccttattagccccctccctatccaagaatgtcagatttactacatccaatgaggttttctaagtctcagagaagcgcttgggatcacctacagaaactgatactgatatcacctcttctacttgcgtgcttgctggttctcatccttgcttttttgttttagccaatacttttggtaatttgtatgtactcttgattgcagcctctcctttgttctgattcttaagtgtcagagcatggctgtatgtgtgacacacccacagaatatcagagtcctttaggactgcttggttagaaacaatctccatactacctctcctgcttattttcactttactgtttgaagccctgtttattctacctcagcctcctgttatagagcaaagctaggctcagagaagaggctaatggtgtagaacaacaggttgggatctaataccacctttgtctcctctactaactacccagatcctttgttgctgtttttctcagtttactgcccagaattgggaatgacagaataacatattatctctggaagaagtgtgtgtgtgtgtgtgtgtgtgtgtgttttcatccagacaaacagctgagattgtgacctaccttttgcagatttttcatgcattgagagaaggtctaaaaaatatcaacatgctggaatagattttaagttttaacagctaatcctggtttaatttctatggaggtcagatgtgaatttatttttcatatttctagtaataaaaatgaataatttatccatatttgtaatttaggtgtgtgtgggggggggagcagtgggttttttttcatgcaatgtaccactttagaagatttttgaagttctgtgtaactgtttttaattcacagatctcccctagcctagaataccagctgtgagcacttctctcagtggagatcttcatagtgcaatcggaccaaatcctctggaaacattctgtatctcaaatgccccgtggagtacactcttacccaggtaatggcttcgagttttccaatagcagctaaggacgagggtgagttggggatttgtatataatggtgccaaagcaagaaatcaaatcttcctgcctgaatggtaattttaagagtcaaaatcatctcccatagtttctgacatgtcattattttgtacccttaaattgttcccacagttgggctatcagtcggagtccccagtttcctcctagtgaaacttaataaccatttattagctttccccccataatctccctagccttttatagcaataattctactctcaacttgtttaagtccaaccttttctggctgtatgtatgtggagatgataaggcattgcctttctgtcgctggtttatttcacataacatagtaatctccagttctagtattgttaggaatggcagaatagcatgcttttgtgactgaataatattttcttctgtatttgaaatatgactttatccattcatccgatttttggatacgtaggttccgccccttccttcttaactattgtgaattacggtcctgcgttgagtatgggagtacagactgctcctcagctgtagtgtagatgtattgctcttttgctgatttaatttactctggaagtatatggaatactgggattcctagatcatatgggcgtttaggatcccccattactgttttccatagtgcgaatattcatttgcattcccatgagcaaagtaaactattttttttctccagggccttataataagcacttcttagtctttggtaatagccatgcttgtgggtataaggtggcttctcattgtgtttgtaattattgctaaaaggaaatggggtggagtgttttttcatatctctgttgtccatttatttatctatcatattttggtaaatacctattcaattatattattaatttttaaatgtaattattgggacacttttctaatgagtttttgcagctcctgatatagtccagatatccaacccctaccagatgtatgaattgcaagtatttctaccatttattagacggtcttgtctgtttctgcactctggggtctcctttactgtgcagaaactttagtttgatgtgaccccattttattttttgcttttatttcttgagcttttatgattctgtcaaaaattcccggttagttccaatgccctaaaacatcttctaaagtttactttgagtagtttcatagttttaggtcttacatttaattctttaatacattttgttttttttttttaaataactggtagaagatagttgatttttataatttttaagatattcttctgccttggctatcaatttcccagcatctttttttttttgtggtttttcaagacagggtttctctgtgtagccctggctgtcctggaactcactttgtagaccaggctggccttgaagtcagaaatccacctgtctctgcctcccgagttctgggattaaaggcgtgtgccaccaccacccggctcccagcatcattttttacaaaaactgtcctttttctattatgtcttcatagcaacttcgttggaaaacagctgattgtatatgcataggcttatttctagatcattacttgcagtaggtctgggtgtacattttatgtcatgccaaactattttttaaaaatcactttagctttgcaattagctttgaagtcaggaaatacagcgcctgcctcctactttgttcttttattcagcatatatttggtttcttcgaggtttttgtgcgtctgggtgagatcccagtgtagccctgagcctttttcaaggtaagcttttaagtacaaagaccatgccctgggtaggcatatttcagttaacaagagcagttagtcagaaagcaagggtaatacatatagagactttcccagaactatggactttgctggacttggcttttgttttaattttggctggtgatgctgtctccatgctgagttttgtgggctgaatggtatttccaacatggagtcagttgtgctaagcatcctactaaggtttggagccctattacattctccacaagtcttagtgaatatgtcaaatcatggactcaccctgctctaaagaagtatagttgatcctaaggaccattaagtttactgaactgatacataattggtcgtattgtttaagatgcaagggcctgccattaatctgatcagaatgagaattcaaggttcagccagtgctggtaatggaatagttagccaggggatcaagaggacagacactgggaccaatttgacttatgtcattgtctctttctctttctgagattttttccaacatggcaagatttatttctatttattccatattaagtagcatagaaaggaccggtttttccataagccatacatagtcttcctttgtatgtccagtctcagaagagaacacttggtctgagcaactcagaaagtttgtggacccctgctgtgtagcctggtcaaggtcagtcatcagagtcccaccagttatttcctggagaataatctttccctctggtgtccttcatctacctgtgggtttgagctgtccattttttttttatctaccatggaatctcaggcagcactgggtcgggtatgtcttcggaatatcaataggtcccactggtcttagggctatttgttagacaaccaggtcaacagcccagcagtagaagacagtacttcataggggaaaacaaatagccactcgcagggctgtttggtatatatacaggtctgtatatatggtggtggactttcttttcctcatctgagagcttgggttagatctgtattgctctctgggctgaggtacctgtcttggacccagatcttttcagttaaagtaagtactgcagcttccacattcttagttccatctttcatcttgtgacagtcacggatgagcatctgcaggttgtcatcaggcaagaaggtattgatagcgtgattttcttaaaactatattctagggtgaggcaggaatagggcctgataggggttcacacaggcactagacagctaagcattctggtgttcctcagaggagggtctcagccacatcctgggggtactctgagcataagatcctaattcagagttaacttttttgcttgtttgtttttttccattagaccaacagcaaccaccactgctcttaagacaggtggaccatcctgtggctgcattgttcaaccatttgaacaggtatgttacagggcgtttccatggacccaaagtttgggttaaaacctcttttatcttttgtttcatggacagatgataaggttttgagatatctgggagtgttagagctagacccaaagtcagaattgcttataaagcctcaaatgttatgtgtttaatctcggtccagattagggctccgtgcccccaggttgtgctggtgtatagagacattgcctctggtatccaaaagcagcaataggagttggggtctgaaggatggcagcagtccttttgcctcctctcagctggtagccaagataggcagacgctaatatacaaagctaggctttctctgctgatttctgtaagccaaggtttgtaactcttcacagcagtccctcagcagcccttttataatctgttttcccaggaaacctctgatagaagggcaagaattcagctcttagtctctcatcaaacaggggtggcaaaattttaagtcttcagggacaactgtccaggtatattgcctgctttactctccctctgggtctgtcatttaaaagcaaatatgggttgactcacctctgccaatgagagaccaaagaatgcatctctcaggtccaagacagtatatatctgtttctctggagaaatctgactcaggaaaatgagaggtcccaggtttcttcacaggtaggcaaggtatattccagggtgactgacagaacaccaagatgcctgtctttccacccaggcaatacagaggcagtttcccctttttgtttccaaggtccctggatattgtttaatctgaatggttctgagattgatccctggtgtcttgaggtctggtctctggggatctccatggaacctccagaaattgtgtagagtaaccactagagaagactgggctttaagccactaggatgtctttattagctgacaggcaactgcactgggtatttaggatcccagtataacactgggtggttaagaacacagggttctcctgcacgccctttgagttcagttctgagcactttgtcgccaccttctggccatgactggcattgcatgttacttacacacacaaaaaaagccattcaaatctcagctctcagtcacttggagtcagcacctacatttttcttttcaagaactctactttttttaagtttaattttgaactgaagagaaaaaaagttttatagtgacttgtctactgaatatagaatattttgtgaacaggatgggtctttaagaggaaagtaattgttctttcctgctttggctgtctgtttctaaaagtagggagttgaagtttcatgctgttgtactgtattcttctcatgttagagcccttgatacttcctttatatattttatatatcttgacacttaatgttatatttcttgtgggatagcatggaccttcctggcttcttttggtgctttgatttaaagtctttttgtatacttagaagtgaggtagatttttgataaggaacaagtatagtaactataaactcgtatagtagctcttgtcttttgattggatcattgaattttcgtatgttcaaggcagtgctgacaaggtaagcctttggtgcagccattttatgacttgctttctattttcgttgtggttcctctctttttccatcacggtgttgctctatagttgggatttattcagtttttaattccttgtttatttttgttctgtatgcatttttttatttgcggatagcttgagacttaaaacatagtgattataagaaggtatttttcagtagtgtcaatttagcatggccatgatggtgacaatggaaaccgcagagcacgagcaagaggaattcatgtgaaaactacacttaggttccagttttccattttcaatttttgatatagcatttgatatttttctatattgtctatccctagcacgtatggttatcttttaaatcattttcttttactggagatacacattatttatttaccattcttacagattagagcattttgaattcatttttataatttgatactgggttttttgtttccagtttttaaaattaaattttcacacacgtacttactgtgtactaactacgccccaccctctctttctactaaccctgtgtaccactccacttccttagaaatctttcgaacgtttatgtctactagttttattttgtgactcactaagtttaatcagcatcatctgtgtgaccatgggtgtggagctatctgctggaccctagtgggcttcttggtcaccatacaactggagacagtgactccacttctcgcagagtctatcagcgagcccctcactcacccgtgactgattctgagggctagtcttgtgtaggtaccagttcaggtaaacacagttgtttccattcatgactacaatggttgtgctgaacctagaggatgacatttcacagtcctgtaccttatctgctatttcttactgctacccagttcatcttccaaaatgttctctgagtcttagaaggtatgaggtaaatgtcttatttagggctggtccctcaaatgtcactttactctgcaaagagaaccgtttgtgattaaggctgatgatattttttactacaggtataaacatgcctatttagaaggcaatgtgattctgtatcaatttagttaaataacagtaataagttcctaccttagacatatgacgtcctcgggtatgggttcttaattggatttagtatacagggcatgccctcctatacatgggcctcagatccaatcataaggaatcataatgttttatgccttcccataatctcattttgctcataaatgtttctttttctgtccagattgaagaaattctgtagcatttcttgtgtggtgggtctggcggaaatacatcttctcaccttatgtttgtgtcaggggccagccctggcggggagtgggggggttcttttttgaggcagtggagggggaacagtgttggtggagggtaagactttgtcttacgaaatagttagggttgctattaataataataaaaagtataataataaaaagtttacttacctaagtcttacgttaatctgctactgtagctgatgcagtctctggcacttagcatatcttccttgaacagcaaaggattaaataaatagcctttgtactatctcagcaagagctgctcagctctaactttcagcctgctagtctcaggaagaaaaaagggacacttaaaatgattataacccatggaaggagttacagagacaaagtttggagctaagacaaaaggatggactacccagaggctgccccacccgggggtccatcccataattagccaccaaacacagacaccattgcatacactagcaagattttgctgaaaggaccctgatatagctgtctcttgtgagactatgccagtgcctggcaaacacagaagtggatgctcacagtcagctataggatggatcacagggctccccaatggaggagctagagaaagtacccaaggagctaaagggatctgcaaccctataggtggaacaacaatatgaactaaccagtacccccagagctcgtgtctctagctgcatatgtagcagaagatggcctacttggccatcattgggaagagaggccccttgttctattaaactttatatgccccagtacaggggaacggtagggccaggaagcgggagtgagtgggtaggggagccaggcagggggagaatatagggaacttttgggatagcatttgaaatgtaaatgaagaaaatagctaataaaaaattttaaaaaaagaaaaataagaaaaatgattatagcatttattactaagttgtaaagtttcctatgaaagctaactaagggcaaaggcagaaagatcctaagcagggaagaggaaaagttctctaaggggcaaaaattctaggaaaggaaaagattcttccaggaggggaaaagagaaacaattctactctaagtggggaaaggcaaaaaattcttctctctctcctttgtcttcagtacttatacatctttcagaatacatgatctcatgttacagtgttcatcacaaggtcacacagaaaatcaaatcataaattgaaatagaagtttacaacagagaatgttgacatgcatatccgttaggagtaattatctggctaagcatccatcacctgtcacagctccacaggttcactgaagggttaaaaccataactaagttattcgtgaagttttgtctagataaaccgagtcaatattttattttctgtcctagcacctataataaatggttagtttcctttttatgccctttggttaattgttttgcaaccccttggaatgtgctgtgagtaggagaaagtctgcttaccaagagcagttaactggggacactcgggagactggcagagttctcattgcagttttgactatcagaaaaggactaataacagtcccagtataaaagagtttaataatcactgataaaattttaggaattccctaccatgcgtggtggcacacgcctttaatctcagcacttgggaggcagaggcaggcggatttctgagttcgaggccagcctggtctacagagtaagttccaggacagtcagggctacacagagaaaccctgtctcgaaaaaccaaaacaaaaaaaaattaggaattcttataggatcatcattaaaacttaagaagtcatctatttgtctatatagcatcactacaagacagtacatcttcatggatctgctccaaaggggtgtgctattatttagtgatatatatatatacatatacacacacacacacatgtatgtatgtataataacaacaggaaaagcatattaatagcaggaatctttcctaaaatgaatcacttacagccttgcttaaaaagggcatacctttcacagattatataataatcttaagcaggacatctcaggaagatcacatgctagttattagcttgtcccattatggctcctgacatgtttggacataactttaatctctccttcatttcgaaggatagcttagctaggctagtagtcttgttgacaggtgttttgtttttttggttttggttttggttttttgattttttatagacagggtttctctgtgtagccctggctgtcctggaactcactctgtagaccaggttggcctcgaactcagaaatccgcctgcctcttcctcccaagtgctggcattaaaggaatgtgccaccactgccaggcttgacagtttttcttttcttttttttttttttttttttttttttggtttttttgagacagggtttctctgtgtagccctggcagtcctggaactcactttgtaaaccagacagactggcctcgaacacagaaatcctcctgcctctgcctcacaagtgctggaattaaaggcgtgctccaccactcccggcttgacagtttttcagtactataaaaatatattaccacgggggctggcgagatagctcagcaattaagagcagtgactgctcttccagagttcctgagttcaattcccagcaaccacatggtggctcacaaccatctgtaatgggatctgatgccctcttctggtgtgtctgaagacagctacagtgtactcatatacataaaaataaatcttaaaaaaatgtattacccaccacattatctgcttacatgtatggattcttctaaaatgtgtcgctagacaaattggcacacctgtgtgtgtgtgtgtgtgtatgtgtgtgtgtgtgcatgtgtgtattttgtctgcatcatttagaatcttttatttatctttcacttgaaggagcttgattttaagatggttttgggtaattaacagagttaactctggatagtaagtagcctttggcttccctgcctttgggtattgtatctatccttctatgtagatttgggaagtttctgttactatttgtttgaataagtttaatacatagtgtcattctcaagacctacttgaatgtcattattccaaataatggctttacaatgtcttagtgttctgtcagtccagcactgttctcattcctctctactggttttcttctctacgttttcattccaactgtgtattttaagtagcccgtcttcatgctaatgaattcctccttctgtttaagctatcctgctattggtgccttctgtctgatttttaattttactaactgtattttgcaagtcaagactttctctctgccgattctgaattgcttccatctcttatgttctcactggagtcttgacatgtttctgtgtgttttcttcctgtcattgagtttccttaaaacaggtcttttgaattctccatctgagactctgcagatattgtttgctttatagttggtttctcgcatcttatgcttaaccattagatgaggtcacagttttctgaaagttctttttatccaagttttaaaaggagcatctgtgtgtgtacacgcgcgcgcacacatacagacacacacactgtaagttaacatgtgtgttacagaaaaagtatacaaaagacaaaacaaaatcctcaaaactcataatgagtttagttgagcatgtccttgttagcatatgatgatatctgcacattaaaaaatgggtatgtattcctgccatcataatctgactttatgtctttttagatatcctaagcaagctgtttattttctctgagcctatagttacttccatcatgtcagcacattatactgctgagcaccagtgtgtttttggtattttagcagaaaagggtagtcctagctcaagtttgttctaaatccgtggttgttggattgtttagaatgaactggagaatgaatgaaccaaccagaattagaagtctgtccccacaatattccttcaggagccagagtacgctcagatggcatgtgcacaggcgctgcgggattctgccctgcttagagcataattactatgcaaggagtgtcccagtctcttgtgcaggaactacaatgacttggcacctagctccctttctgtgtccccatgggaaagttactctgtctctgttgtattgtctaaggctagagaagaaatgcagttggcaaccatgtggccactattgtcaacattgcttggtctcactcacagcccgcaagccactgagttctgcacagcataggagtagaactcagacctatagtactatatgggctgcttactgcttactgtaatcagccacaggttatgtttgtcagagtggaaatagttggtgggtctcaagtctctttctaacaccagagtgggtgtaggacctctggcttatgaatacaggttctgaggatttgtcccattaggtttccctaacctagtactgaattacagggcaaactatttagcttactttcctgctctacctgctacagggaggaatagttcccattgctgtcacccagggttagaggaagagtggtggaagtagtctcttggttgcctaggctgatgctaagctgagatgcactcaagtatcacagctgcaagagctgcacagttttacgcatgcactccaggcccctgctttggttgtctttaatgcaagatgaagtccaagtctgttctacttgatgcccatatgcctagaggctccatgtgtgtgagtgcatacctggagagggtggtctttgacatctgcctagtgcatggtcccactgttgtgggctcagcattggactccaaggcaaatatgtgtacttacattgtctgtagaagatagagtcttgcttcttattcagctatccagtgttggaagatgaatattgggagccaggagtaccactgtggtccctcagttggcttccttagctcttgtgagagaggtttgtttgtgaatagctgtcctatctggctggctagcgggaggtcataattagatcactaattatggaggatcttaatagccattttgtttagctttcatccattaattttttgatgaccacccccttagtatgtagtagaatctcactgtggttctaatttgaacttcctgagtcttaattgtcactgtctagtgcgttgaggggtcccaagtgagggtcgcattaactaggacacaggggatgcacagtgatagcacaccaatgcacactttattcaaagtttcagcatcttctatacagaaagcaaaagaaggatttcccatagtttctcattcccaccaggtgttgtttacctagcaatagcttatcttggttcaaggtgacccaaacctccttacagactgagaaatctgtctgcagtgtgatgtctagttaaactataaacaaagttactttctcatgaaaaaaggatcgtgaaggcctcttccttcatgaaggctctgcagcttacttggcaaaacaccaggattctctgctgagaaagtatgtggactctttgtcccattatgctgggattctcagctatccttcagtcaccttgcagatagtaagctaggagctgtcacctcatgccacttctctagacttaatggtgttaaacacctttgtgtgcatattgagtattttcatatgttctttgtaatgaaggtcatttcgtttatttcttttttgaaagaggatctcacagccagggatggctttgaattcactatgaagctgggggtgaccttgaacttctggttctcctgcctcactcacttcccaactgtgaagatcacaggcatgaactatactatccctgatttagcttctctgtccatttaaaaagtggattgttgcctttgttgttgctacattgtaggagttctttatatacccgagatataagctctgcacaccatagtacactcacacttggaggtcagaggacccgttggtcgcttctctcccttcactgtgtctgtcctaaggatcaaagtcaggttattcaggctttgcggcagacacccttattcactgagctatttcacaggcccctgaaggtttccatgttaatgagtcaaattcctctattttttaaaatcaatcactgtataattgggcatcatgtctatgaatttattaccaaatctaagtcacaagggtttacaactgtgttttcttttaagagctgcatagtttgataacctatattttaattgttgatctagttgttgaactagtttttatatggtgtgttgaaggaggtatatgacttcattcttttatacttggagatctgcgtattctaccacaatatgttgaacagactcttctttcttccttcagtagacttgaaaccctgactaaaccaactggcagtggatagatatgtttgtttctggattctgattttttttccccatttgtctctgtctagccttaatgtcaatattgagtgtttagttaccatagatttatagtaagtttttatgtgttttttgtttctttgttttgtttgtctttttgagacaggagtcttatggtacccaggtgagcctcaaacttgctgtgtatctgaggccccttagaattactgacccagctgcatctacctcctgattgttgtaaatataggcatgcactatattttgaaatcagtaaaggaacatgctccaattttgttctgttatttcaagaatgtctttattattttgaatcaattttatgaaaatttaatgatctgttttttaaaaacatttatcttgcacaggtcttatgcaagctacatgatggctgtgagttcatatgtacaagatcaagacagacaaaaatcccagcatggaaaggggatgtgggcatgaagtcccatcactagctgaagagttgttggtaattgctagctgctgggagaggaagagttttctggtccctgatacatgactgccctctggtggatggcctacatccaagactacataggctgcagaaatttattttttgtcaatttctttttaaagcctatttttttaaattgaaaatagattcttctctcatacaatacatgccaaccacagtttcccctccttccacccccctcagcttcccttccctcctctcttctccagatctccttcatttcttttcagaaaagagcaggccttcatgagacaacagccaaagaggacgaaataagatacaataagacaaggtgaaagcccccatttcaagactaaataaagcaaccaaatgggaggaaatagaatcagagagacaccctgtctcaccattaggattctcacaaaaacatctagctaccagccataatatatatgcaaggacctgatgcagacccacgcaggccctgtgccttccttgtcagtctgtgtgaaccctgcttattgattcagtggatcatgctctcccggtgttctccatattctctgactcttacaatcccccctttctgtggtccctgagctctgaggggtaggacccgatggagaactctagtttacactctcttctcactctggtctctgtacccgttcccatctgctgctggaggaagcctctctgatgacagcgtgataaggtagtcagtgatctatgagtatagcagaataacattaggaaagggacctgatggagatagatatgtgtaaaacaatacatcttggtcatatcccctgacaccttcccttttccaccaccccaagctcccgaacacattcccttcccacattcatgtcctttcctcttaatgtatcctactgaatctaattagtgttgcttgctggaatgttgactgctatagcgagtctttggtaggttatcaaagctagagtgagttcatgattgcaacagccatgtcctgtccacacatcatttcacagggcttctcaccatcagctgagtcttccactcttttgccctatcttcttagatgttccctgagcctcaggaggttgatatagatgccacgtttagaagtgtcacatagtctcagcattgtgattagttatgactctgcatatcctgctgcctactatggaaaggagcttctctggacaatgttaaaagcagttgtaatcagtggttatagattgaaatatttagaaggcattttgacaactgtcttagttagggttttactgctgtgaacagacaccatgaccaaggcaacacttattaggacaacatttaattggggctggcttacaggttcagaggttcagtctgttatcatcaaggtgggagcatggcagcacccaggcaggcatggtgcaggaggagctgagagttctacatcttcatctcaaggcttctaacataatcctggctttcagataaggttcttatagcccacgcccacactgacacacctactccaacaggctcacaccttctaacagtgccacttcctgggctgagcatatacaaaccatcacaacaacattatatcatttagccaaataacagttgcaggttccacccaggatcgcagtcacagcagacataaaatcatttcttgtcgagcaggcttcaaatccaatcagaaagcaattggttatcccccattcccttcatgccattattacattatgtgcacagcttgcctgacagattggtgttataatatttagggatcactgaaggatataatcagctttttgtttacatatgaagatcattgggaacttgtaagattattcagcaggtaaaagcacttgccttgaaaccctaaagacacgactttgatcctttgaacctatagtggaaagagagaatcaaccaactcctgaaatgttgttttctgacctccaggcctgtgccaggcattcctgcactcatgtacacataccatacacacatacatcatacatgcaggatgatgataaagaagattaaagaaaaggaatcattaggattttgatacaaattaccttgaaactatagattgaagatatcactatctatataataatgtttccagtctatgactacagaacatttttccatttaagtttttagaatgtagtcccttttattaggcagactctcactaaatagcttagcctggtctggagctctacatagcccagctgatcttaacttgtgttctgatttctcagtgccctgaaagatagatctataggcatgcacttctagtcactttttgcaattaaaaattacatttcagatcatttattactagtatatagaaatataactgataattatgagttgagtgtataacctgtaattttgttgaattaatttactgactttgatagttttcttgtgggttctctaagaattggtattatgtaggaccatgtcatatcatctgtaaatgaaagtgctttttctcctttcttctcccatctactttagaaacaaagtctcatgatgtagcctagactgccccagagcttctgatcctcctgctccaccgtctgagggctgggattgtagggatgtgccattacatggtgctatggattgaacccagcccttcctgaatgctaagctaagcaagtactgtaccaactgagccacatcccagctccttcttccttctgtttccttgtgtgtgtgtgtgtgtgtgtgtgtgtgtgtgtgtgtgtgcacgcgcacgcacacaaacatgcaaacatgcttgtgtttttttcatacacctcagaggccagaagagggcatcaaatcccttggagctagagttgaaggtgtttgtgagccagctgatatgagtcctgggaatcaatctgtgctgagccatctctccagtcctgcctctttctgttattacttgcctacatttttttcttatctactttccctggctagaatgtccagtacagtggtgaagaacagtggtgaaaaacgagtcattgtcttgctcctcactttcctgtgaacagtttttagttgttttttttaactacttaatgtgttagatgtgagttttcatgtatgccgtatcatgttaatgaagttcctttctatgcccaaatgtatgggcaggttttattatgaaagggtatcacatatcaattgctcaattgccttttgtttttacatcaatggacatgatccattaagtggaggtttattactgttgatgtagttcatagtctctcctagttcatttcctgatgcaagaacagaatggcacagattgggtacatttttaacaatagaatttatatgtcttgtggttctgaaggttagaaattcaaatgaaggaaaaaaatggaattggccataactttcttgcttcatgataacatggaggaaggacaagtggccctgaacctaggctagtctcccaactcttccccaagccccctaactacaagaattacaaacatgtgtgtccttccatgtctggcttaaggttcaacttctttttaaatttaatatattttaattttgtgtatgtatggatgtatatggatgtgtatatgtgagtaaagccacccaaagaggccagaagagggaagccatcatcctagattcatccgttgtcactgtagaccttcagttagatttcaacctctgaaattaagttcatggagacttattttagaagactattggggttgagggtttttgttgttgttgttgttgttgttgttgttgtttgatatagtgccctatatatgttaagtctgactttttaagaacctatttctatttttagctatatatatatttgtatgcaagaatatatacttctatatttatatttaggatatctttgctgagctcatttatagatattttattcacttttgggtatggtatttgcagagaatatcctgtgggagttggttctctttgtcaatcatattgagtcctgaggcttgaactcaggttgtcaacctaactgctaagccatttcactgtctttccctgtcttacactgtaaccccattctctctatactttcttccttttctcttgggaaaatatacatattttttccaatggaaggacaaaaagtattttaccaactccgccctgatatactttttgagctactccctaactgtgtatcccaacagtaaagttgtccttgtgatttctttcttatcttttagtcttgccacggttttaaatcaggcttctgttctacatgaaattcatgttacaacatttttcagggccatagaaaattctgcaatcttcgtgtgataaattaggacctcggagccttttgtttagtggggttttatttcaatgagataacatagttgaaggaacttcatgttctccaaagcatcttacacgagaacttgctaaagattactgaacctgtgaccaaatcaaaaaaaaaaaaatcatgttactagataaaggctctttattcttcatttttctgaacggatatttcttgtgaattaaaactctagcataaaaaacagattgagtgcccgtgtcttgcattggtgtgtaaatcctagggcgagaaagaagcaagatggaaaggctccaagatggcacccttttcccttgagactcctggtaaactcatggtcattctctactgtgtcacaaacctttctcttccctgcgcctccactgacatggatttagaattgagttacacttttattttacacaaacgagctctactgtgtgaaaactaatttttttttcttttaggaattgtggtcagatacaacagaccttcatccaaattttccttcaggtgtcaaggtagattaaatcaggcacattccaagagggtataaaaacttgtttttctgatgtaacaagtgtttcctgaacaaagcaagaaaactttccaacaacgtaaaagtggcttgaaagagtaaagcaaagtggcttcctagagagtttttggtggctaggggattggtccaggattagtttcggttggttggttggttggtggtggttggtggtttttttcccttgcttttggtttgaacttttcttcgatgcctaacaagagcaccctgatttcttctcagtgtgtccatatgtgaaagaaacagttatcagcttgtccatatgtgagacagtgtacaggagagtgattaaggtcagaacacattgtatgcatgtaagacatgtcgaaaaagaatttaaagtattatttttaaaaagcggatgaaccttagaagttctcagtaggtaggtaggtctcgaaagacggagctatgctctttgtcataagattgtagaatatctgccccatttgccagctttaagtacagcgtgtgcacagagtttattgtgaccaaagcaacatactaagttctgctgatggctgcatactagcatattgatctaaaaagctgaataacagaatagcctagatttacaaggagtcaataaaccaattatatggatatattgaacaattgcaatctttcttccaagagtaacttggcttgatgactagtataatcattaattagtataatcattttcctttagcacttctgagaataaaaagtaatgtttgatgtaaaaataataggagatatatatacacacacacacacacacacatatatatatatatatatacacacacacacacatacatacatacatatacacatacacacattcatatagacattggttggtagttagatttttttattttcttttttactttttttaatcacatttttacttatattattttgtgcacatgtttgtgtgtatgggtgtgctcctgatacaatgtatatttagaggtagagaataatttgtgggagttactcttaagagatgtaatatggtgaggagagtgcctggcaggcccatgctaaggtgtccccttaataaacatacctggtataaaggggagcctgtaggggaagagaggggagtatggtcctggagaactggtagaggcagacaaatgggatcagaagcacagaggacagaaaagggtagagagggactggctgggaatgcatgggtacagagagcaagtgagcgagccaactggggtggcaagcagttcttttgtatcctgctcacacctggccgcaagtaaagtggctggtgatgaagtaaggtgttgttaggtccctgagaggagcctagtggaatcatctgtaacccaagagttactctttccttttgtcttgtgggtcccagcaattgaacttaatgtcaacaggcctgttggtaggtgtttttacacacacacacacacacacacacacacacacacacacaaccatctggctggtcctactttcttatctttctcctcccctcccctcccctcccctcccctcccctcccctctcctctcctctcccttcccctccctccctccctccctccctttctctctctatcttgaaagataaggtttcattctgcggccctgactggtcttgctttataggcatgcaccggtattcttagcacagaattgttaggtaataactcttattaccagttgataaatggatgactaacacaattgaaaactgggtaaatgattttaatagatattcctctaaagaaagtacacattacaaccaacaaatcagggaagggtgcttaacagtcgtctttaggcacataaaatctaaacaacagtgctgcaacctccgtggctttgggattgacctgactgagcaactgggagtgaagacagacacagaaaacctaggataaggtgagccctgggttcttttggagacacgccagcagatgcttatcatatataactgacagaggaggtatgtttattatatacagttgaacaaggaagtgtgttaactaatctcactccataagggggcctctgtaggggagtggtctcaggttatggtcacctggcaagaagcagcttgggtaatactttctgtatacacagtcaacatcagtacttgttactcccctgaacctgactctaggaaggccttgccattgctttgtgccttaggtactggggtccatggcatgtcaacagtatacactgactgaagacttcatccactcaccacaccacaaaccagtttataccaacttacattttttaataaatgagaaacattggcaagaatgtggagaaatcagaacagttatccatcactagtgagaatataaaagtgtacagcaaatatgcaaaataattcatttcttttttgcatattaataacctttcaatgctccaattatatgtttgcagtttgggagccatactaggtctctatttgttttaataacatcaaactatatgctaatggactcttttttattagatatttactttatttacatttcaaatgttgttccctttcctggtttcccctccgaaaacaccctatctcctcaccctggtatccatcactagtgggaatataaaagggtacagcaaatatgcaaaatagttcatttccttagtatactgctttcagccctcatttcttttggcctttgagacagggtctgtcttagtcagggtttctattcctgcacaaacatcatgaccaagaagcaagttggagaggaaagggtttattcagcttacacttccatagtgctgttcatcactgaaagaagtcaggactggaactcaagcaggtccagggagcaggagctgatgcagaggccatggaagggtgtttcttactggcttgcttcccctggcttgctcagcgtgctctcttatagaaccaagactaccagcccagagatgacaccacccacaaggggacctccccacttgatcactaattgagaaaatgccttgcagctggatctcatggaggcatttcctcagctgaagctcctttctctctgataactccagcctgtgtcaagttgacacccaaaaccagccagtacagggtctcatatagttttgtctgactttgaactcaactatgctatctctgcactcctgatcttcctgcctttatctcccagatgctggaatgattggcacctgcccccacacccagccttcctttctcattctttagttttctcccaagaagtgaacctagagatagatgttaatatcttaactatatagtactaagatggaattaacaccagcttagttttagtagttacaggactcttcatccttttctgagtagtctcccccaccctcgttgatgctttacttgtcaagagttcatgaaaaaagttcaattcatacatgctgtgaatccagtcacatacatttatgaatttggtggttaaaatgtccaggaaaagaaagtagaaataacaaagccaagatattgtaacttctggatttaaaaaactaaacaaacaaaaaaaaatgactgtaacaaagcactttatatttacagaagaaagtgagctgaaagtgcatagtaaaggctacagatacagtgtaattatgaacatactacagtatctctaagactgattacatacacaataatggtcaggaaagattatatatactatcttagtaatggtttctattgctgtggcaaaaccccctggccatcagcaacttgggaaggaaagggttgatttcaccttagagcttgttacccatcattgaaggaagtcagggcaggcacactaggtagaaagtgatgcagataccatggaagggttctcccataattgtgcttctacattctgcttcttcccttggggtgtccagacgctgctgcacactgggctggaaggaagaagcagaacctagaatgggtggggtctgtaggctcccaatcaggcttagagtgccaggaaagaaggccttctccgaggagtttagtgttacagctctcttaaatagtattcagtgaaacatactgtgtacatacactatatttggggtgaatcaagggctatacatatgaagtttcttagggtgaagtttcattggctgaggctaaaggttctaggaatacttcatttgcatggagaagcattccaggaatctcagctgcttgttgagcaggttatctggagaggggaagctgaagctgcaatttcgccaaagactttgtgatgttccttgggtaaaagattgggggaggggggtggttgggctcccagatcaggcagagaagaggaagccccactaaaatatgggagtcttccatattgcacagagctcaggaaagataacgggacgtgctagactacaaccttagtagtgaggtgtaatactttttgcttgctcctcatggcttgctcagcctgctttcttacaactaccaggatctcctgctcagtagtgccatcacccacggtaagctgggctctcctgcatcaacaccaatcttgtagggacattttctctccctaaatgactcttaagttgtgtctagttgtcatagttgtgtaggcagcacaattatcatcttatttagtttaagtataatttatggtcataacaaagtgataagagtgcttactgtaaaatttcttagaatttatcctggctgttcagacttccctgttgttaagcaatatatggctgtacttcttctggagattcctagtctgtgcacacaggctctcatactattcaaacgttatcatgttctagtacagctgcgccactgcgtgacaaatactgtacgttattattaacaccagtctctgctgtactttggaatattccctttgttatgcacttcgatttttaaaaattgtggtagtactcacatggctttaaatttgccacttgtcttagtcagggtttctattcctgcacaaacatcatgaccaagaagcaagttggggaggaaagggtttattcggcttacatttccatactgctgttcatcaccaaggaagtcaggactggaactcaagcaggtcaggaagcaggagctgatgcagaggccatggagctatgttccttactggcttgcctcacctggcttgctcagcttgctctcttataaaacccaagactaccagcccagagatggttccacccacaaggggcctttcccccttgatcactaattgagaagatgccttacagctggatctcatggaggcatttcctcaactgaagctcctttctctgtggtaactccagctgtgtcaagttgacacaaaactagccagtacaattgaccccttgttaacttgacacacaaacacatcactagtaagcctcaacccttacaatcttattcatccccaaggtctaaataactttaaaagtcccacagtctttacatattcttaaattttcaatctctttaaaatatccatctcttttaaaatccaaagtctttttacaattaaaagtctcttaactgtgggctccactaaaacagtttcttccttcaagagggaaaatatcagggtacagtcacaatcaaaagcaaaaatcaatctccaaccgtccaatgtctgggatccaactcacgatcttctgggctcctccaagggcttgggtcacttctccagccctgcactttgtagcacacgcgtcatcctctaggctccagatgcctgtactccactgctgctgctgctcttggtggttatctcatggtactggcatctccaaaacactgcatggccccttcagtcctagggcttcaattgcaactgaggctgcaccttcaccaatgaccttccatggcttctcacagtgctgagcctcagctgctctgcgtgaccccttcatgccttcaaaaccagtaccacctgggtgacccttacacattaccaagtcccgctgcagcaggagtacaaccttggccatctctggaacacagcctctttgtgctttcagaaaactcttcccagaagatgtcacctcaaatgatgctggtctcttcttaatcaccgctaatttcttagctcctgctaaccagcatcaatagtcccagtaatgcaaagtttttgctttagtagttctggtatcttattaatcacagctgattcttcagccccagctaaccagaactacagaatcttcacaatcaacacagcaatggccctgaaaagagtccttaattttccctctgcaatttcacaaaccagacctccattttctgcactgttctcaacattatcttccaagctcctacacaacatctgacagagctcttaacaacggatggatcttcaagcccaaagttccaaagtccttccacagtcctccccaaaacatagtcaggttgtcacaggaataccccactatgctggtaccaatttgtcttagtcagggtttctattcctgcacaaacatcatgaccaagaagcaagttggggaggaaagggtttattcggcttacacttccatgctgctgttcatcaccaaaggaagtcaggactggaactcaagcaggtcaggaagcaggagctgatgcagaggccaaggagggatgttctttactggcttgcttcccctggcttgctctcttataaaacccaagactaccagcccagagatggtcccacccacaaggggccattcccccttgatcactaattgagaagatgccttacagctggatctcatggaggcattgcctcaactgaagctcctttctctgtggtaactccagctgtgtcaagttgacacaaaactagccagtacaccactttactcactttaactacaccttccaatagcattaaggacaccttgctatgcaaagatcaccattattttaaaaatcattgaacatctaaactgaaccacttacccattataaaaataagccctattagtctttgcagttagcttctagcaagcactattctgttttctgtgtctatgaatttgactttcctagttacttcatatacgtgaactattacaatatctgcccttttgtgttgcatccccataccataatattttcagattcattcttgttacgtgagtcacaatttcttttctttttcaaggctgaataatattacattgtatgtatatgccacatttatctatctctccacaaatggacattttggtatctaacttgtgcttatcatgaaaaatgctgctaaggacattggttatataaatgtttgtttgcatctgtcattttaggtgaatttagaagtacaaccgctatagtatatgaaattatgtgtttagtttagaaaacctcttgttcttcattgaagctacactattaaatgtccccctaagtaattcacaagtgtcctaatttccccgtatgcttgccaacatctgttattttctgtgctgatataagatgatcggtccttaatgtggtttgaatttgtatttccctaatatttagtgatgctgagtaacttttcctgtaattgttagtcattttctttgggaaaatgcacaagtactttatatcctttttacaatgaaaattttactgaaaacttctcattctatatcctaaatgttattagtcacttaccatttttatgatttttaattttttcctatttgatgagctgcttctcttttgtggcagtgtatttggagataccaaagtttggatgcagttgaacttgtatttttcatagtttttctatattttggtatcagcttccaaggaagcactcccattactgctggctacctttgctctgtgttttcatttatcagattttagttcttatgtgtttgatttatttgtgttcattttggcataaggttgaaatttctccaattgtcttagttagggttttactgctgtgaacagacaccatgatcaaggcaactcttacaaggacgacatttaattggagctggcttgcaggttcagaggttcagtccattatcatcaagacaggaggagcatgacaacatgcaggcagacatggctcttgcccttcagttaactgtctctgaaatgtctcatagagccatgcagacttatccttcacctatttgcttgtaattctaaatgtattcaagatgaagatgaagattagcaatcacaatatctttgtcaaacatttgagcatgtatttagggctttattttggactctccagtgtatatcattggttgatacttctctttctcttcatgttatttcatattgtttctcttactatagttagaaagttagctttgaaattagaaaatgctaatcttccttttgttctttcccaagattgctttgtctgtttgagggtcgcttgaaattaatatatgaattttgggataagatttttttctatataaatcattagattcaaataaactgattttgtgcattgttttgcatatattttaatatatacaaagcattcgttgacatcttactatagttttctaatcactgcacacagaatgacttttcattcatttatgtctttaattttcttcagcagtgctttctagttttctgtgtatatgtctctggcttccttaagtatatgtgtgaagattctaatctttctatgctgttgtcatttaaattttttagcagatgccacattgcctatatatggccatgacacagctttggaggttttctttctttgttttgtttttgtgtgcacaggtgatgtgtgtgagtggcagtgcgcatgtgccgtgatgcatgtggaggtcaggggacacctttcaccagtcagttctcaccttgctcttttgcagcaggctctgttatttgcaggcacttctctctcacttcccatctgactttaggatcacagatgcatgccacacttctggccttttatactctttgcatggggactggggcttgaacacctgtcaccaggcttgaatagcaagtgcttttatccactgagccatctccaaacccatggcacatcttgtatgttgaaaatgtgttagtgttgcttattaactttgactggttttctataaactcttgggtttattttttcacaggtcatctgtatgaagattattttatttattccatcctaagttatatgactttcatttgtttttcttgtttaattgctgtgtctgtgacttgagataccatgttgaatagaagtgggaaacatgcatatccttgactattcttgctttagggagaacctttcagactttgattttgttttatgagtttgctgtggacttttcacatgtggccttcctttatcatgttggaaaggtttccttttgtttctagttagtcttttttctgtaagaaagtatgttgacatagaagtataagcaactgaggaaagctggaagcaggagaggcggccttccccaggacgccaattggttgtctagtaccaaacagtcagccctgaaatcgcacatccaagccacatcataaagactgaataggttatatttaggaatatatgtatgtgtatatatgcatgcaataatagtgggaaagagactataaatttgaaggagagtggggagtggtatgtgggagggattggagggaggaaaggaagaaagaaatataagtatgttataatctcaaaaataaaaaagaagcatcttttctggattccccattatctaaagacgattatttgtcttttgagaaactttttttaatgtttatcctcacagcagagcagggtattgtcaataatctttctgccttatacttctatttttccctacataaaattaagtatattacaatttcttaactgcaatatgattttccaggtgatgagtttagcaagaattttacaacgctttgtaccatggggaggtgggggataggaaaacaatttaaaatggctgtatacatccctattctgactccaccatgtaataaaaagacattcaaccccctaaagaatattgtttttatagatttgttatgtctacataaattgattagtgtttctgtttcttgatttttaatagggtatattacattgattctgtgtttttaattgcctttatacttgagggataaaattcatttggccatggagcttcattctttaggctgataaattctgttaatattctgttgagtaattttgcattagtattcatagaaaatagcttttccttcttggggtacctcgtctgaattttctacctggctaataatagtagtcttatgaaatgatttagatagcattcttcacctgctttttctttacagtcttgtggaggacttgtgttaatacttaatataaatattagcagtttatccttcaaatatttaggattctttcttgaaggggaaacacaaagtttctactgatccccgactgtcctggaactcctcactgtataaataaagctatccttgaactcatagagatccacccacttctgccaagtgctctggggttaaaggcatgcaccaccatgccaagtcttaattaattttttttatgagtttggggttactgatttaatatccttactagctataggtctatgtagattttctagtacttcattattctgtcttcataagttgtatttatagaaatatatattatctggttgtctaatttgattacatttaatttcacacagtactcatattttttttatttctgtggaagtaattgtcaagtccaaaagaaattcaggacatatggctctctgcggtacctgcgagcataccagagtgcatggtggcctcgaggcccactcagtgccagtggtttttcttggttcttctcacctcaccccttaccctaaatttctcccgtgcatgggctttccttcccgcagcatctcattcctctataaccctgccattttggctacatgctctcttggttctctctcttgccttcctctctaggtcctcctctctgtctcctctcatggcctggtctagtctgctggtcatgtttagtctactactttccctgctctggactcttccacaggcctctggctgtactttccttcatatttacaataaaaacctaacactcaaccatatctggaagcaacaatgtcctcacattatacagcagcatttctaatttgatttatgactgttaaatttagtcacttttttcttgttttagtcaatctatctaaagatatgtaatttttccaaattctgtttttcattgattcgttttctattttgactctccccatctcctctgtgatgtttattgtctgtctctctccttctgctagctgtggttaacattgttccttttctaattctattacatatacacactttattattgacttgaaatcatttcaaactaatgcatgtatgttcctcgccgttactgaattatttatttctttttttaaaacaatttttttaaagatttatttatttgttatatgtaagtacactgtagctgtcttcagacactccagaagagggactcagatctccttacggatggttgtgagccatctgagcccactgagccatctcaccagccccgaattatttatttcttattgcttgatagttttatccatgtatgccatgaattttagttattttcagcaccacattctcctccgtccctccacctcctgcttcacagaagctttccttcttcctagcaagtcccctccctgctttcatggcttctttttctcagtgttttattaatttgtagctctgctcaatcattcttaatatgctcccttctagttttctaacacaaaatatgcacacaaatctataattttactgttaaacaatgccttacttatattgtaaggatttgggtgctttatttttattatcattcttttcaaaataccgattttttataaaatgtcctaacttgtttttgattaatttatttaaaagctatattcattttatttatccttttatttaattatactgtattctgaaaacattaaatgaatgttgtttttgatctcttaaatatgttaacatattttatggttcataatataatctattttgatgtgtttctcaagagattgagcataatgtatgtctggctttttctagaagaaatactatatagatatcatttaaatcaatttgactgtaagtactgttcagttcaactataattttttgttctttgagacagggtgccactatatagttctgactgactcagtgagtttgctgtgagtctatgtctcctaggaatgtcagaagctactcccataaagtctcatcaacatgacaacctaaacatgaactaagcaaagacaacagtaaatatgctaacatgggcaggagaaagcccaagaggcgacagccatatataaggaactataggcaacagaggatgctgagagtgggagaaacagtctacaccaaggaagaacacactgattgtttatcctatacccattgtcaacccaatggaaacatcatgcaagtgtctttatgtagactacacaggttgtatttaaatatttataaatatatatcatttgtcataaagcatgtgaaatacctatgaaggagtacagtatcacttgaaatgggatatgatattcatatacatgtttatatgtaataacagttaatggaaaaaggagaccatgaatttaaaatagagcaaggaagtatgtactacagagtttggatggaggaaaggaagggggaaaatgatgcattaatgaaatatagaaaaaggaaataatatgaaaaaccaatgggtctaagagctggttctttgaaaagataacaagactgatagaaccttgggccactaaccaaaagagaggaactgaattaacagaatcagaaatgaacaggaaaacattatacagacaccaaataaactcagaatattataaggaaatgctttaaaaaaaaaccattgtattccatgaaattgaaaaacctaaaggaaatggataaattctagattcagaaaagccactgaaattaaaccaaaaataagtcaacaacctatacagaccctagcaaatgagaagattggaaaagtaataaaaagtctgctaggaaaaaagtagaggtccagacttagatgggtttgtatgagaatttatctaccagacatttctaaagatctttacctagtagtaaattactcaaaatgatagaagcagaaggagcagagcactctatacccaaacaagggtaaagacataacaaaaaagaaaacactgaccactttccctgttgaacacaagttttaaatgcagcagccagaagagagcactgggtgtcctcctcttattggtcttgataagaagcttgatttaaaaaaaaacaaacaaacaaaccttgagctcaagttttctcacctaggctggaagccaacaagccctaaaaatcctcctgtccccccagccccccagagctaggatttccatgtttttaagggttttctgtgtgtgcgaggatctaagttcttgtcctgattgtagaacaagcactgttaactcaccagtccctaaagtaggttctagtaaacaacatagttccatcttcgtttgttttcatgtatgctgaaataatctaacttttaattagagtattcagaactttcacatgtaaaatgggatctggagaaatggctcagtagttaatatactgcttcctgtagaggacttgagtttggtttgcagcacccacatcaggtggcccacagccccctgtaactcctgctctagggatcaaaactcttcttctaacctgctggacacttgtcctcatgtgcagatacccacatacacaaatacacacgattaaaaattttaaatctatagaattaatattgagatgtttggattagtacttgtctcatttgttatttacggatgcttccatgattttactttcatggtttttctcttcctttgtgccttttctgtttttagtttagcatttacaatattccatgtactattttagcatcttaattatacttttatggaatttgtatggttattctaaaatttgttattaaatattttatatctcatttaaagtaaatctgtactgtactgtttcatagtactccacatgctttcgaatagtgttcaagttctccctcctatccactataatactgtttgaattcatataaaatattcattagcaataattttggaatacattttaattgttatttagtacaagcttatctatcaatcaactattaaaaagaaaatatattaaaatttaatttacccattcttcaacaatcttcattttctcatatataaatccacatttctaacttatgtaattttccattgttctgaagaatttactctaacattttttgtaagacaagcttaccagcattaggttctgccagtttttttttcctgaaaaaagtatttcacatctacacaagaaatatcattttctggatacaatatttcaggttggaattggtgtgttctcttccttaatattttatatattttagtatacttgcttaaagattgtagtttccaaaccaaaacccttgtaattcttatttttaatcctataagtacttgttcattaacaaattaatcgatagcattaacaatcccctcgaactatgttctcccttgtgtttttccctggtgaggtattggagggctcattggataaagtgcttgctgtgcaagcatgaggacctgagtccacatctccagaatccttgtaattctagacatagtagtgtgtgtcccagaactccaacagcaagcctcgaggcagagccaggagaacccctaagaggttgtcatcgaactagtacacacagtagttaaccagaagagcttctcttatgaatgaggtggaaggtaagaactgacattagaggctgttctctgacctccacctgcatgcccaagccatgcgcgtgtacacacacacacacacacacacacacacacacacacagagagagagagagagagagagagagagagagagagagagtcagaaagagaacagtataggagaggagaagaaggggatataactacgcttgatgaggatataaagaaaagggaacccttatacatggttgttgagaaagtaaatgaccatcaatgggtatgtacctcttgtgtgacagattcctggggagatgggaacagataggaactgagaactgatcaaagtatggataccagtgaagtccatcttgatgagccaattcgttttattggtgttattttcaggaatgtgggtgagggattacttacaggagcagaaatgaccaaaaggcagctgaatcaccaaagcccaccctaacataggtaatgtcttactaaacatggaaacttggagcacaataaacagcctgtgggcagcacaacaggctggagagtgttctttccgggcagctcggctaacctgagcctcttctgagtagcctgggtgtgttggtcagggtttctattcctgcacaaagcatcatgactaagaagcaagttgggggcaaggggcacgctggagagatggctcagtggttaagagcactgactgctctgctagaggtcctgagttcaattcccagcaaccacatggtggctcacaaccatctgtaattggatctgatacactcttctggtgtgtctgaagacagctacagtgtactcacatacataaaataaatctttttttaaaaaaagattggtaaaagaaaataaagcagccaggcgttggtggcacacacctttaatcccagcacttgggaggcagaggcacgctgatttctgagttcaaggccagcctgatctacagagtgagttccaggacagccagggctacacagagaaaccctgtcttgaaaaaaatggggaggaaagggtttattcagtttacatttccacgttgctgttcatcaccaaatgaagttaggactggaactcaagcaggtcaggaagcaggagctgatgcagaggccatggagggatgttacttactggcttacttcccctggcttgctcagcctgctctcttagagaacccaagactaccagcctagagatggcatcacccacaaggggccctcccacccttgatccttacagctggatcccatggaggcatttcctcaaggaaggctcctttctctgtgataacttgagcctgtgtcaacttgacacccaaaaccaaccagtacactgggtgttctttgattcctctacctctttcaaacagctcaacttctgtctcatttaaatgacttgtctagtctgagactgtctctcagcaggcctagcagcttgggagtgggggctagagctagtggagctggtgagtatcagggacttcccagatcctttgaattgtcttctgcctgaagcttctcttcaggatggaatgattcacatgcccacctctgaaaatccaattggtttatctcctttaacatcctgtgtcttaaggagctctcctacaagacagtttaatctcagaggaattgctacaaacaatatccagagcaaatgaagtcagtatgcttatcagcacttattggagcactatgtgaaatagccagtggatttagaaacaaatgtagcctaacaagtcatgagtgaacaaagactacactattcagcactttgtgagaagataatcctttcatttgagacagcatggatggagctggaggacgttattgctgaaacgggaagaaagaaacagttaaaggaaggtggataatgtatgtctacacttacatgtagactttaataaagctcaactcacacatgatgtgcaataatggctacaagtctgaggttataaatatttggttagataggagaaataagctgaagggatcaattgttctggtaactatagctgataacaatatatcatacgcttgaaagtgctaaaagaatgaattgtaagcctagtttgaattggaaaaagacgagtttttgaaatttaactcaatttaactattctacagttgtatatacctcaaggtaaaatgctgtatatgataagtagacttttttatcagtgaaataaaacggagccatgtgtgttcatatacactgcattcccagtacttgtaaggcaagaggaccataaggaacataagtttgaagacagcccaagttacataggtaggtactgtcttaaagaaaggaagacagacagacagacagacagacagacagacagggaggaaaaggaaaaaggaaaaaggagaaaggaaaggaaaggaaaggaaaggaaaggaaaggaaaggaaaggaaaggaaaggaaaggaaaggaaaggaaaggaaaaaggaaaacaatcaaataagaagccccagatgaaatgcaaacatttgcatcaaatgtgaactgaccatgagctgagcttacagtgaatgaaggcgtctcatccatcttttgtcccttctgttttagttggcatacatacatacacaaagttttaaaatagagaaaagtaggcagattgctggaaaacaatttaaatttttaaaagaaaacagcacaggcatgggccaccttccccgtgaagagctaaggacaggagctcgctggggtcggcctggagagaacacaagatagacactcatcaccctgaagatcctcattgttggcaaggccagctcgctattgaaattcacacatgatgcttttggttcagaacctatagcaacaataggtattgactttaaagtgaaaaagaattacagtagaaggaactaaggccaaacttacaatatgggaaacgctggtcaaattaactctcagccattatagtggtacacaatgtgttgcatttgtttgtaacatcacaagaagaggcaactttgttaaactggatagttagttaaatgaaatagaaatattccatacaagaaaggatatagttaacatgctgactggaagtaaaattgatgaagaacaacttgaggttgatagaaatgaaggctggaaatctgcacaaaagcattccatgttattcatagaggcaaggctgaaaacttgtgactcttcagtgtgccgttaagaaaattgtggagaagatctgttagacacctgggctgtgaaaaagtgaagatcagaacgaagaagtcaagctgtcacacgggagagagccgtggaagaggggccggtggtgatgactgttttgtgttacaaactcggggaattcgatctcttgcatagttaatcagcgccatctctgtgtatacacaatactcttaactgctatttagagaccttgcagtttgcacataattgttttcatcatggcaatgcatatttgcaagaaaacccactcaataacttgcccagatgaaatgttatggtaagcatgccatctgtagtttttcttttatgtaacataaaataggtatactttcctgagtgtatttggtttatgatttacatttattgtgtcattttttaaaatatccatctgtctagtgtgttttgctaaaggtctgctttggttttctttttatttaaatgccctgatcaactactgtgttacttgctattagaacaagaaggggggctggggggatacatgtcatcatgcctatctagtttcctttaaggaatagcaaggagcacaattcacagcttttctaagatgctagagattcttggtagtatgaagtaccagtctaggccagttcataatttaattactatctgttttgatgatgcctccaaagtaggattgatactactaaagtattgctatgctaaagcagtttggtatttttttttactgcagttattagctcagttaagctgagctttagtcctgtgatgtacaacttggattcatgatccctaatggaaaggtttagttacttgtcatataacagagtgacaataaggctttccctcatttgggttttagaataacatgaatggtgttttgtaactcataatatttttacttctaaaaccagcatcttttttcacaggtattgatattgtcaaggtgccttaactgtggctcacataatgtttatgactgtatcttatgccttctctagacagctactcattgttttgttttgttttttaaaaaagctatttctatgtatggaagatgaaggagaataactctaaatgatcatttgagaaagggatattgcttctggattctgacatgaggaaaaatgctattcgctattccaatgatcatttactctaacaagtacctagtatgtcccagtcagtgttcattgctgtgaagagacagcatgtccacggaaactcttatgaaaggaaatatttaattagggcttgcttacattttcagaggcttagttcattttcatcttagcagggagcatggcaacatgcaggcacatatgcagaaggatctgcaggcaacaggaagagtgagtgccactaggcctgactgagcttctgaaacctcaaagcctatccccagtgacacatttcctccaacaatgcacatccactccaataaggctatacctcctaatctttctcaagtagtatcactccctaatggccaagcattcaaatgtataagcctatgggagctattcctattcaaaccaccacattacactccctggccctcatatgcttgaagccatatcataatgcaaatatacgttcggtccaacttcaaaagtccccataacttaaaacagtctcaaaactgtttaaaagtccaaaattcaaagtcacttctaaaacttcatagcatctcttaactgtaacccccccccccataaaatcaaaatcaaaaagcagatcacatacttccaacatataatagcacaggatatagatattaccattccaaaaggaaggcaagggaacatagtgaggaaatactggaccaaagcaagactgaaagcttgcttgcacctccatgtctaatgtcaaagcgctcttcaggtctccaagtcctttctgctttgttgaatgcacttcttcctcttggactggtcgacactctgatagaagctctccttggcaggtatcccatgacactggcatctcagctccaacatcttggggtctccaacacaatccagacttcactttcacagcttcactcagtggcctttctgggcctccatgcagggacacccctgacatatgcctgaactcaacagcttttgctagctatggagggaggttccataaccccttacctccaaagccagaactacatggctgtggctgccacattctgctgtttgctggggctggaacttggccccctcattcaattacatctacatcagatttctattattgatggtttcctttactgcttaagtttttctttaacaccttttcccaagtcggagctcagcagagtgggaccttatcctgaggtcaccactcacttaaatccatttaacaccaggcttttctttaaactattttatttccttgagcaccggtgctcccttctcctcaaattgtactttttagtattttgccttgcttgttttcattattcatctgcataatctcttctgccaatgtcattaattcaaaactcttcaatttagcctcaggcatatttttcagacaggggaagaaagcagccatattctttgccaaaatattacaagaatgttctttagtcctcttactactattcttttcctctgagacctcttgagccaggcccccacatttccatatcatcctcactaccactgtgctccatgcttctgcgacaatggcccattaaagccccacttaaagtgttcagttgcttttctagtgcaaagtccatattccaccaacaagcagcatggccaggcctgtcacagcagtacccaagtccctggtatcaactcctgtcttagtcaattcaatgcttgattgttgtgaagagacagcaagacagcatgatcgtggcaactcataaagaaagcatttattcagggcttgcttacagctccagaggtttagtcaagtattgtcatggcagggatcatgacagcatgcaggcagacatggtactggagaagaagctctgagtcctatatgcagatttgccggcagcaggaagagtgagtaccattgggcctggtttgggcttctaaaacctcaaagctcacacccagtagcccacttcctccaacaaggccacatttcctccaactaaggccacacctcttattccccgtcctaatgactacaccttcaaattgctgagcctatggaggccattcctattcagaccaccacataatagtttatgaaaaccaacctatatgatcctattactatctccaaatgtgtccaacaaaatgattttgctgaaaacatttaaagggtgtttcttactctgaaacttaaaagaaacttaaaaggttaacatctcttttcaaactttacgctatggtaaaagtaatatgatttacataaacaacaaaaaataacccaggatgtcagaagctttgagtagtcaataaattgagtatattatgtatcagaccttgttcctatttcctagaaatctattatagaagtaaaacaaaataccctcttcatagaacttttaggggtggaggaaacaacagaattataaatatataatattgaatggtgataactgatacagagaaaaatgttatagcatataaggatagtgggtgttagaacgtaggaataatatttttggtgggatagtcagggaagttctctttaagaaagtaaaaaatgaaatgaaatgaaatgaagaggtaaggcatgctgcagagagtagtctctccctgagaaagaacaaatgaacttcttgggttatttttaaaaacagtgtcataactggtgtggcaaaaatgagacatcagtgactagcgaatggtagaactgattgcttagcacgtagaaaagtccccagtactataaaaaaaagaagaagaagaagaaagaggcaaaggaacggttaacagagctggttgtagcctgtgaaagaagagccaaaccatgtgagatagagatccactgtgaaaaggagtttgtactttttaaagtcttgtcgcaaaccattaggttttgacaaatggatcgttgtaatgtgacatgacttttttttcaaggatgatccttgctactatttgagaaaaacttgtggtagtttgaatgagtttgacccccatcggcccagagggagtggaattattaggctcccagtgactattagcctgctttgaggtctctgatgctcaagtcacacccggtgtgtcacgcgctttctgctccctgctgatctgcatgtagaactcagctccctttttcagcaccatgtgtacctgcatgctaccatacttccagctatgatgatactggactgaacctcggaaaccataagccagcctcaattaaatgaaaccaaacatcccacaacatttccccctttttgactacactaaaagttgtgttgtacacagtttaacctttacaacagaaaccattatcagtcccacaaacttaaccgccccaatgtctttctgaagaaccattgatgccatgatcctacataactgcagtcctgaacatctgtcttcatcagcagtccatttcagcatcaaggtttttaaactataagtctggtgaatgatttgtagttcttccactgatttgtggagttgtctccatgcagggggcatcagctttctttgtctctcccttccttgtgtcatgcctatcatgtggaaatttctcctacttggatcagatcgttatcaatttggatggagcccatagactttcatcacctttcaacatctagacaaaacctcttccttgacgtaacacattacctgacttccattctgatgtgaaaacagctttaaagtacacaggttgatttaattcagcaggggtttgttgttgttgttgtttttacaatccagtgtctttcagctaatcttattcccccctttcaaagtacattagatctttatgaatccacacataaactagatacttaagcacttgaattctatgcccagctgcatgcgagctgggcttcttacccattatcaatgagctgtctatcttgatcctcaatttcattggggtccataggcatttcctattcgcctaatccctctgtctcttgcttctcaagcctttgcattattgaagctaattttgcctgtcacacagattttcgcaaccttttttgagaggaaaaatataaagattgcaattgaaagtagggagaggttttctccagtagttaaaactgcaatgagtaccgagatgactttttcaagtaacgtttctatcccctcaatccctacccttgctctcagggatctgaaatggagtttcccatgtttaaatgtaggaagagtctgtctatatacttaaaactgtcttttggggttgcttactgtgatttgctgtctcaatcgcttctgcattgttccttgctctgagcttcaagttcttgctgcattgatccagagtgtccccaatctctcttggtgtccagttgaacttaaataactgatgtttcttctggagatgatcccaggccaatttctactcttggctttctgtcagatgtctcctgtcctctacagcttttctgtcagatgtcctttgctttcagcaatgttggcaggatttcttcttctccaatcacattaagtttttcttccaaatatgttaagtgccagatgtaaacatatttttattctcctggtcttctctgaggcttactgccccagtctgctaatttagacctagtcctgcaagcttctagcctatgtataatcttacttaggcctagaatatttttagcttctgagacttactgctaggatgtttgcagcaaaagagataagaggaatagaacagtaggtatggaatgatataggaataggggaatttcattttcaaagtgggagacagtttagatatacatgtttaattgctgataagactgttttggtagagaggagtctatttcaaaattatttttacattgacaagttttacattgacagcagaagttagtggaaaggatggaaatatccatatatcttatatacctgtgtgcatattcttccacagctgccaacaacaataatgcaattgttccaagtggtgaatctatgctaatacaccactatcacccaaatttcacattaggactcactacactttgtgggtttggaaagatatataatgtagtggcatgtatctgccatcataatatcatacaaaatacttcactgctctatataaactacttccattcatttttctctaactcagctcctgaaaccacttaaaaatttttgttgttttgtggttttattttattttagtgacaaggcctaagtatgtatacttagctggcatggaacttgctttgtagcaggttggcctagaatttgaagcagccctcttgcttctgctgatattacagaaatgtatcactatgcctggaaaaaagtctttttttcttgaagtattggaaatagaactgagggctccttgtatgctaggaaagcattctagtgattgaagtattctcgcagccctaagcactaccttttttcagtctccatagttttaccatttccaaatgtctagtaattggattgaaatagcatattgtctttgaaggcgggggccactcctgtgacaggtatgtgaatgtcttagtgttctattgctgtaaagagagacccatgaccatagcaaattttataaaagaaagcatgtaactgtagcttactaatagtttcaggggtttacttcataagtatcatggtggagaggatggtagcacacagtcagacatggtactggagaggagctgagagttttatatccaaatcttcaggcagtaaagagaatcactgtgcctggcttgggcttctaaaacctcatagccaacccccagtggcatacttcctccaacaaagctacatctaccccaacaagaccacacctcctaatcctttcaaacaatgccactccctaagcactgaaatatctgagcttaccagggccattgtcattcagtgaaggttagagtgcaactggcatagttagttttcttcctccaccatgtgggtttcaggtatggaatctaagcccttaacttcacaagcaaatgtctttacttgctaatattttgctggcctacatgttgtttttaaaaattggattagttcaagagagttagtgtggatctactgtgtggattccagatttaaatttctttctttgtatgtgtctatgtttgaggacagtaagagtgtaggacgagaaactagaaggcagatatgagagaaaggaaaggtttagggggaattaaaaacagggtaatatgatacatgggacatggaaacgggaaggggagttgaggatctcgtctgtgaacggtgaggagaaatgatatgagcatttcctgaccaaggattgtaagaaagagaattccttctcttctcctttcctttcccattttccttgctgaatacagccattaggaggtgttctcatgaagaagcagaaggtcatggttagttaataagaaaccccccaaaaaggactgtagactcctcatactttgtattttgagaagtaatttggcattctattaatttatattattttctttaattgtgtacacttataacttcgtatccatacagagctatcctcctccgttcctgtaattgtacacttttcaaggagtatttcccgggtttggaatttcagtgagttttttccatgattcttgcagctgctgctgccattcttagctttactgccaggcacttaagtgcctccatctgttcccttgtattttccaaacaacgttccctatgcagagtctagatgatgtcagaactaaatagtagtccaaacgttaaggcacattggagaagagggtgttttcctttgtttagggtccactttatccttatgtcagtagcgtagcaaagtgcctgaaagtttatttggaaatagttgtttctgggattacatagaaatcggcctttttgtgaccgatgtatagctgaggacttttgttggaaatgggacaaagaagattcctaagcccagagctactatgagaacagctgcgtttcccgaggataaagcattgttcattggctgaggacattgttcctggctctgttttcccttggtaagaagtgattcttcacaccattttccttcttattcccctactctttctgctactttgagatagagaatcatactatgtagccctggctggccgggcatttagtatgtagggcaggctaaccttaaacactaaatgtgtggtgatcctactgcctctgtctcaggctctaggattccagggtgtgcaccaccacacctggttgctgaagcatatagcttgacataacctgcaaatattcttatatgtggcttcttcaaattctgtaaatggaccctgtctcaagtagtagaaacagcaattcttttcctccactagaagtagatatttcttgggcctgtttcaccagttacttcaagaaacttggtcctgactagggaggttcagtttcctgtgtaccacatattagcttttcatcactataagaaagtagtcaaggtagtcaacttataaagagaagcgttttcttttggctcacagttttggaggttttagttcacaaccaagtgaatgtagcacatacacagcacagcacacacatagcagaacaaaacttctcaccttggtggccacctatcaaaagaaacagaaagggaatacagagacccttgcgggataggcataattcaaacggtagcaggaagttcctgaagcacatgggaagaaaagcaatgcattgtaagaacacacagaatttggatcaacctattctagaagagagtttgctgaagaacgtttgtttacctgaggaacatggaggtcagtagagaggcacgttagcctaaatctacaaaagcagattcatgagaggtgcaagaggagatgttgtgagccataatagcaataggcatatgctactgtgcgagttcatgagcacacgtgagaggtgacgtgacatggggaggggaaaggtgtggaagacactcccaagtactcatggctgcctctttatcccagggttgatgcttgggatttgattctgaaagttatatttcaggaacaagtcagtgttacgtagacacaagaggagatactgaatagtcgaacaatactttgttcccttatgctggaccagaatgcagttttggaggaagaaaatcatgtcttgcgatcataatataggtcaacatcttctacatagtatttgatctaatttcaagatgatatttaaccaatatatcaatacagactaataaaacacattaaaaaccttcccatagggccttttcaatcaataattgttagccacttattggctttattttgtaaatgaattgacaagagattatccaacagatatttcaactattgctaaaaccactcctatcagcaagtaaattggtgaaaagatattggtagttggggctctgttgcttatatatacatcgccagcccctctgagatctaaaacagaattataaggttgaggacgccttgggctgcatggtaaacctcaggtcagctggggaatttgatgagagcaatttcccagtaccatctttaaacagtattgtgaatatagctggctggtagattgcttcttgaacatactcaagggcctaagttgaatgcttagcagcaccacagcaacaaaaagggacattaaacctccacaaatatgagcaaattttatattggtgttattttagttatactgtgaaacagaagattggtgttaatgctggtgaaaactgagatacaaagtggcctgtcctggacattgacgtacagaaaagacacttagaaggagtgaacattatgaataaagatggtgtgtgtgtgtgtgtgtgtgtgtgtgtgtgtgtatacgtatacatacacttcctgctatcacaattgctataaatgtagtggcttaaaatgagactagcatatcatatcacagcactggatgcaaaaaaggtcttactaccctaaatcaaacagatccttaacttcggggcttactaaggaagaaactttcttctgcatagtttcttcagacttcctgcattccatgggtcctggattctttccatctttgaggccaacagtgtccactatggtttcgtttggtttgaccagtgctgctttcctgagatgcaaactcttaatgcctcagcctggcatacctaataagtacctttgcagtcacaacggctagattgacccaggataattttgtacagaattccactattaacaacctcacttctacctcaaacctcagttttccttggccaaataacatctttatgtatcatgggttgttattctgtgaaacactgggtaggtgcttaaataaatctctaaatgggcaagcgcaatagccttagtttgtgcttaatgacactcccctttttttccccagagaggtattgctacttagaatcacacaacacacacacacacacacacacacacacacacacaccaacacaccaaccaccaccaccaccatacacacaaacggacacgcacaaacatgggggaacgcaggcacacacaccccaaccaccacacacacacacacacacacacacactgtggcacaaagaattgactgttggcccaaacctgtggttgatttactaggccagaaggtgtagtttggttttccttttggaagaggggcaatggtggggaatgtaatggaggccccactttggattccatagagacaggagtgccctcccttcatggttgcatgaaccagtaaaagaaaacatgggagaatcaacaggaacctactggctggctggctgttgctaggtcacctgtcccctctcaggctgcagtacaagcagtccccctccccttccattggcgtcatatgaggaggcagaggagggggaagcaaagagggagtacagggaggggcaggcactgtccagcctcgttctgaaatacagatgtatcaaggttctcactcagtatccctccgctgctcccccctgctccctaactgcagaccttctcctccctatagtccccccctccccaaaaccctcatagactctagatcttagccatcccacacactgttgtggcgccaaaaaaaaagtggtggtggtctctggttagggtgaacaggggtctgcagacgcctaaccggtgcaacccacccctccaagaggagtggggctgtctggccccgcccactccgagtcggaactacagtgggttcgggagggggcgtagagccccgtgcgcagtatccctccgcccccttcccgacaccctccaggcgagctggcttgccgcagtctacgcagcccctgcctgtttggtgcagaggcgtggggacaggacacatctctgccattccactcgcgcgcaaagcgttaaagaccagtgagaggatccgccgaggacagagaacacccaggaataggagtcggacgtgggggagcccagggacctgggccgtgcgcctggccaggcaagtgggggtgtgtcgagggctctgggcggtcgcgcactgcaaacaactgcctggccctgacagtccagtggaggcaaagaggtcgcagctgctccctggagtgtgcgcggtgcccggagaccccagaccgtggtggggaggaggcgggaacccctgcggagccccaggcaccagggttgaatggagctgctgctgggtgtgatgatctgcagactagcacagcctactgaccgcctggcagttggctttctgagcgcccatacccggccctccgtaatctctgggccctataagggttatggggtaggcggctgctgttgaaatggcgatgcgggggtggggggggcatctgggagcccacaggtccgaggaaggcggctgcaagagaaatggccggccatactggagtgggggtgggggctaaagcccacaggtgtgggtgtggggcaagtgtccagcattggggccagctcagctggtgggtggtgagtcgcctcagctattaggttctgaactggttcctgagaggggccctggtaccctgcatcctgggtgctgtcactccccacaggcttctgattgatggaaagtgacctgtctgcatggtaggtctggcatattctggcaagccacggtgagcatctatagaccagaagcttgagaaaagaggaacaggaaaatggcgtggatttctggaggtgtgtagtaatggggatgggcaccagacagtgagtggagatgcaaaaagggtggggtgactggccagaacaggtgggatatccattagtgtctcctaatctcatttctcacaaccttgtaggtaccttccacactgcctttcccctccctcccaaatctggggtctgaaaagatggtttggggatgatgacggagtcataaatccaaggaccacttcagaacctggtttctagaatgtgctgcgcccttcccccattttttgctgcgcaaggaagggaaatatggccacctagtggcggatcttcaacattgcagaagggactaaaggatgacatcaggaagtgggtgttacctcaggagccctacagccaggctaaataaatctagaatgttccagcagtaggaccctaaatgctgaaagacacatgatctggttcatatccttggtgacattcataacatgatcagctgctaccatcatataagtgccatacattttcatctttgtccacagccctgctttaaggctggtcagttcttcaagcaagggaagaaggcttcaaggcgactgtctcaaatctctggagattggtgagactcagggcagtgcaggagccagccactgaggaggcaaattcagattgctctaacccaagagggtgcccgatgcctttactgtccccttaatttgcacaaagctgctgccatcatttcctgattgtcatacattttcatgtctctgttcacagccctgctttaaggctggtcagttcttcaagcaagggaagaaggcttcaaggcgactgtctcagatctctggagattggtgagactcagggcagtgcaggacccagccactgaggaggcaaattcagattgctctaacccaagagggtgcccgatgcctttattgtccccttaatttgcacaaagctgctgccatcatttcctgattgtcagacattttcatgtctttgtccacagtcctgctttaaggctggtcagttcttcaagcaagggaagaaggcttcaaggcgactgtctcagatcttggaggttggtgagactcagggcagtgcaggagccagccactgaggaggcaaattcagattctaaccaaattcagatcactgcccccttaatttgctcaatggtgtggcatcctttatttccttttagggatattaagaatattgaggtaggtgtgagttagactatgacccgcaggagaagaccagggaacagagactttagacagaagcaggcatggttttgttgttgtttgtttgggttcagggatctgtgcccatcttccaagcactgagactccattttgttttatgcacttgtaggactccctgcagtgagtcagctgttggtctttaacaccacttgaacgcagagaagaggggagacctgcaccacatctgtgaaggtgggtatgggagaggggttcacttttaggtggggtagtctcaatcaccccagagtgactactgtgagacttggggatcccctctctgtccattgctagtgtgtgcactttctcctggactctgtacctgtttcccagcaggcaaaaggaacacagggattttctcatggctgagctcttcccctcagcattacgcaccagcgtctctttgtaagtttctccaggaggcaacagaattgcgtaggcctgatttccccgtgcttctctctcctaggtcgcctgccgtggctgcttggtggtgctgaggttgctgctgaccagtgcaatcatcaggtctgcactcacccaggacctgtccatcgtcctccagcttgatttcagctcttctgcagtgtatctgtgttattgactgagactgcttgggtaggagcctcactgagtgctgaattgtcatttcaggctaattctttgtaatctcataccctcacttatctaagatcgtcgtgcagagctatcctgtaacagatctctagtgaaggctcactgttgttaagtcatatacagtagacttgattgaacttgtactatgactagggcagaggttgagcctggtgcccaggcaaaggctgaaaataagcctggggatgagaatgctaatgctgctgaagtagagcctgaagccccattggtggtcagacccaaggttaggacacaaatcatgactggagcaaggcccaaagtgaagcctaagggtacccctggagcaagacctaaaggtgaaaccagtacaccaggtggggcatatgccaaatgtaaacctaaggcaatccctattgctcgatccaagcatgatgcccaagtgtgggccccaaataagtttcgtggcgagtccatgtcaaagatgggaaagcaatgtcagatcagtgctgcagaccctccactgctcagtaatgattctgggatggttgctcaagctaagtgcctgcctgtagatagagaacttgctaatatggacactgagagtattcccaaaaaggctaattctccagctggattccagccttcctatggctcagaggagggaaccaatatggggtcctggtaccgtgccaggcctgtccccaaaggagaggcctatgagaattccgatttcaaatgggcagataaaccctcaggaagtccctccttttggaatagagatgaagccagtacaagatttcgtcctaggaaaagcatgaaggccaataacaggttcaggcatatggccaaacaagaggcaaataccatgcctaggcacaaaaacaaacaagagttctataatatttccagttctgattctgaggatgagtctggtaaaactccctggttctggcccaaagacaagaccaaagtctggtctaagcccaaagaagagcccaatagtaggtcctggtttaggtctaagaaagaagtccgtgttgaatccacttctgggtctgaatgtgaaaatcctacaaaatctttgttttggtctggagaagaggctaaatctagatccaaacccagagccaggaaaggggtcaatatgagggccaggcagcaggccaagcgagaagcttgcagtgatgccatgtctggagctatagatacaaataagaaagagtcctggttcttgcctgaagagaaagctaatgttttttcaaagtctaagacaaagaaagagcccagaaccagagcagtgccaaaggaagaagtcaaaactaaggccagagcaagtaccaagcaagaagccaggccagaggaggaagtcctcgttggggcttggttctgggacacccaggagtccactatggcagataggataagcatcaagaccacttttgtagaggaggagcccattgttggagattggttctggagtgaagaagaagccagtgtggactctgagacctgtcatacatccagacccagggctaaggaggagcaagttagtagtttctgtttagggtctggaaagaagagcagtatggaaagtgggccaaaggctacttctaaatctatgccagtagctaaggaggatgaggtcgttattgggtcctggttctgggcagatgatgaagagatcaacttacaggctgatgacgagtctatttttggatcttggttctggggcactggtgagaacagccttagatctgttggagtcaattgtgagaagatgccgaaggctggagaaaaagaagttactgattcctggttctgggctggagatgtcaatacagaggctgaggttgaagaacaggccaggtcggcatctacaaaagcaacaatctttgtgccttggttttggtctgaaaagcagccgaacatggatttagggtctgaaccttgctcagatatcatggcaggagctgaggaggagcccataattgggccctggttctgggctaaagtagataatagtgtggaggctgaagttaacagtaagtctagccttgaggatgaggaagaacccattagatccccttggtttggggccagagaacaaaccgatatgaagtatgcagctggtatcagatacaagcctatggcagaagctgaggatgctaacaaaaagtcttgtgtctgggcaaaagaaccctgtttgtatcctaccaatagagaatgcttgaaatctactctgggagaaaaagaagacactgttgatccatggctctggtccaataattatccaaggaccaagaccatcacagggtcctggctatgggctgcagaagagggaaatatagatgatgagactggagaaaagattaaactaccaactttagaggacaatgcattcaattcttggttctggaaagaaaatgaagaaagcattgtagaggctcccaagagagaagaattcaggccagaagcggaagaggaagacattattggttcttggttttgggctggggatgaagacaggtttgagccagctgctaagattaatgaagagaacaagatagcatctgaagatgaagatacagttggatcctggttctggggcaatgaagaggccagtctagaggcagtgagaaggggtacttttgagtctgctcctgggattaaggaagagaaagttactgggtcatggttctggactgataaggccaaagtaggggctgggtcccagactgtcgaaactgggtcagaaactgaagaggaagcaatttttgagtccttgatctgggctgcaaaaaaggacagtattcaagcaggagtaaagcgtgtgtccaagccaaaagatgacggtaacatagctgttgggtcctggctctggtctagtgacaaggccacaaaagaagctaaaactctgattgtcagtgaggccagtccagaaaatgggaaagagtcagttgttaagtttgggtcaagagcaaaagatgaggtgattaacaagactggcagtggtgacaattgtaaacatagtacagaagctgaaaccatagtgggagcctggttctgggaaggagatgaagctagctttgaatcaaatcctgtacctgtatgcaaggccgtttgtgaacccgagtcttcagctgagcacgaacctgacccttcccgcaggcctcagagctgggatgaggtcactgttcagtttaaggctggtccgtggggaaaagctggcttcccacccatgaaccccttcagattccccaaagaagcggcatctctgtttgcagaaatgtttgggggaaagcctaagcttgtggaagttggtccagaaagggagcctgaaccccagttcccatttcagtatgatccctcttaccgctcagtccgagaaattcgcgagcatcttaaggccagggaaagtgcacagccagagaattggtcttgcaactgcatccagtgtgagcttagaattggttctgaggagtttgaggagcttcttttactgatggaca

SEQ ID NO: 278 - DNA, 1476 bp, mus musculus
tggcttctgacgcaagtggcacgtgactagcccacgcaggctcacacccctcgctgggtctcggacctgccctcgctcactctctccagcccgccatccctaacggaggcacctgttcctggtggcgcagctcctggtggcgcagagcacgcgggcccgggcggcgcggaaagcagcaggaggaggaagagcggagcaggtgagggggacggcggaccggacccgcggagcccgtcgtcggggtcccgtggccgccacccgggccgtcggcagcgcaggccgaggctgcaggtggccgtcctggtgtgcgcagcggcacggccggacagggagggggcggcgggcccgggcggagaccctcggggagtaggagcatgcgccccgcgacagcttcccatagaccccggcatccctgcatcggggggacccaggggtggtcggcgtggagggatgggggcggccgaggcggcgggaagagcctgggcggtggcgctcgggacagcgccacaggtcctccctcccacctactcacccatccttctgggttgatcgcaggtctgagaagcagaagcttcgcggcgcacctggtggtgagcatctctagaaagaggagaaggcaaggataggcccaggtaggtgcaggggcagggctggggactgaaagcaggaaagggaacgtgcgcagagctggatctgacctccgggagttcaactttcctgcctactttcctcccatcccatgcttctgttttttgtacctgtagaggtcttggaaatgggtttgcgggcaaaatggtagcctctggggtgggaggggttctggcccagtctcgtgcctgggttctgtgctgataagtccaggaagtaagcaatcttatctctcctaggagtgatggcatccaaatttaaacaagtcatactggatctcactgtggagaaagacaaaaaagacaaaaaaggtgggaaggcctccaaacaaagtgaagaagaaccccaccatctggaagaggttgaaaacaagaagcctgggggaaatgtccgaaggaaagtcaggcgacttgtgcctaactttctctgggccataccaaataggcatgttgatcgcaatgaagggggagaggatgttgggagatttgtagtgcagggaacagaagtcaagagaaagactacggagcagcaggtgaggccttacaggcgtttccgaaccccggaacctgacaatcattacgacttttgcctcataccttgaaatctaagattttctctgagctcataaaatggctactgttttacaagctcttatcaagtgggggtattttttctgtaaacttttggtgtttccacttaacggtttctatgtaaaattgtttaattgttgcatttaattcaaacattcctgttagcatggcaatttaacccattttagaaaaaaatctttttcataatttgaaattaataaagcaattttaaaagcaa

SEQ ID NO: 279 - DNA, 587 bp, mus musculus
acgttcagctcgagcgccaggatcctgaagcccaatggcgagaagccggacgagttgagtctggcatctctcaggcgcgctgctcgagctggagatgaactccgatctcaaggcacagctgcgggaactcaacatcaccgcagccaaggaaattgaagttggtggtggtcggaaagctatcataatttttgtaccagttcctctacttaaatctttccagaaaatccaagtccggctagttcgtgaattggagaaaaagttcagtgggaagcacgaggtcttcattgctcagaggaggattctgcccaagccaaccccgaaaagccgtacgaagaataagcagaagcgccccagaagccgcaccctgacagcagtgcacgacttaagaccttgaggacttagtcttcccaagtgaaattgtgggtaagaggatccgtgggaaaccggatggcagccagctcataaaagctctcttagacaaagcatagcagagcaacgtggaacacaaggtcggaactttttctggtgtgtacaagaagctcacaggcaaggatgttaattttgaattcccagagtttcagctgtaa

SEQ ID NO: 280 - DNA, 587 bp, mus musculus; identical to SEQ ID NO: 279

SEQ ID NO: 281 - DNA, 587 bp, mus musculus; identical to SEQ ID NO: 279

SEQ ID NO: 282 - DNA, 587 bp, mus musculus; identical to SEQ ID NO: 279

SEQ ID NO: 283 - DNA, 834 bp, mus musculus
atgaaccccaaagaaggaccaggagggttcaggaagagaagcatgacaacttcccacataaccaaaggagagaggggaaggatgccggtttgtcttcgctggtgatgcaggccttcaaatcatttcagcaggaactggacgaggcacgacatatatgagagactcgtgaaactaagccgggatattactgtggaaagtaagaggacaatttttcttctccataggattacaagtgctcctgatacggaggagatactgactgaatcagcaagtaagctggatgatgtcagacagaaaatcctgcaggtagcccaagagctctcgggagaagaccattgagccgtcaccacaggactgcaggaatacgtggaggctgtctttttcaacacttcattaaaactcgttcactgatcagtatggaagagattaacaagcaattgacatttacagcagaagacagtgggaaagagagtaagactcctcccgctgatgggcaagagaagcagactgaagctcacacctgttgactacctgctgggcgtggctggcttaactggagagttgtgtattaacagtgtggggaatggggacattgacaccccctttgaagtgagccagtttttacgccaggtttacgatgggttctcgttcattggcaacactgagctctatgaggtctctaagaagctgtacaccttgaaacagagcctggccaaagtgaagaaagcttgctatgcccttaaagtccgaggttctgagattcctaagcacatgctggcaggcgtgttttcagttaaaacagacatgattgatcaggaagagagcatttcttaa

SEQ ID NO: 284 - DNA, 834 bp, mus musculus; identical to SEQ ID NO: 283

SEQ ID NO: 285 - DNA, 834 bp, mus musculus; identical to SEQ ID NO: 283

SEQ ID NO: 286 - DNA, 834 bp, mus musculus; identical to SEQ ID NO: 283

SEQ ID NO: 287 - DNA, 875 bp, mus musculus
atggctccattcctgtttgagagcgatttgcactcactgcttcaactggaagcgccaatccccaatgcacctttgctcgctggcagtgcaaagcagaggaaaagcagaggccctccacgtgggcctccaacagatcacacagcgcaaagcagaggccctccacgtgggcctccaacagatcacacagcgccctaggaccccggggtcagaactcctggcaaatctaatttctaggttcagaccacccctggcaaacttggaggtgatcactatatcccccaacgcagtgctacccaaatggaggtgggtggcggggagagacggggggggggggcgggggggggcgggggggggagggagacgcccaccaagaaagagcatcagaaagcctgggctctgaacctttttgatgtggaggaagccaagatcttcaggctcagtggaaaacctcagagtgccccagaaggctacctaccagaacagactagaaaagaaaagactctacagtcagaaagccatgcctggcttcagctggaaggcttgcagatacattcctttcctgctagacaggagtcttgatgcccctgaaatccggaacgactactacctgaatcttgtggattggagctccggaaatgttttggctgtggcactggacagcagtgtgtacttatggaatgctggttccggtggcatcttgctcttggctgcgaatggagcagcctggggactacatatcctcggtggcctggatcaaagaggacaactacctagctgtgggcaccagcaatgctgagatgcagctatggaatgtgcagcaagcagcacactctgctcgagtaagctccctcagttggaacagctatatcctgtcc

SEQ ID NO: 288 - DNA, 875 bp, mus musculus; identical to SEQ ID NO: 287

SEQ ID NO: 289 - DNA, 1543 bp, mus musculus
atggctccattcctgtttgagagcgatttgcactcactgcttcaactggaagcgccaatccccaatgcacctttgctcgctggcagtgcaaagcagaggaaaagcagaggccctccacgtgggcctccaacagatcacacagcgcaaagcagaggccctccacgtgggcctccaacagatcacacagcgccctaggaccccggggtcagaactcctggcaaatctaatttctaggttcagaccacccctggcaaacttggaggtgatcactatatcccccaacgcagtgctacccaaatggaggtgggtggcggggagagacgggggggggggggcgggggggcggggggggagggagacgcccaccaagaaagagcatcagaaagcctgggctctgaacctttttgatgtggaggaagccaagatcttcaggctcagtggaaaacctcagagtgccccagaaggctacctaccagaacagactagaaaagaaaagactctacagtcagaaagccatgcctggcttcagctggaaggcttgcagatacattcctttcctgctagacaggagtcttgatgcccctgaaatccggaacgactactacctgaatcttgtggattggagctccggaaatgttttggctgtggcactggacagcagtgtgtacttatggaatgctggttccggtggcatcttgctcttggctgcgaatggagcagcctggggactacatatcctcggtggcctggatcaaagaggacaactacctagctgtgggcaccagcaatgctgagatgcagctatggaatgtgcagcaagcagcacactctgctcgagtaagctccctcagttggaacagctatatcctgtccagtggttcccggtctggccacatccaccaccctgatgttcgggtagcagaacaccacgtggccacactgagtgagcggccaaagccaggaagtatgtgggctgccctgggccccagatggatgacatctggcaagtggtggcaatgaaaacatcgtcagacaaagtgtggcctagtggtcctggagaaagtggctggggtcccctgcactcaacatcaaggtgctgtcaacgctgttgcatggtgttcttgccagtccaatattctggcaacaggaggaggtaccagtgaccgacacattcgcattcggaacgtctgctctggggcctaagtactgtggatgtgcagtcccaggtgtgctccatcctgtggttcccccactgtaaagagcgtatctcagctcatggctctgcccaggatcagctggttatttggaagtacccaaccaaggccaaggtggctgaggtcaaaggtcacacagcctgggtcctgagtcttacgatgagtccagatggggccacagcagcagcagcagcagctgatgagactatggttgtggctctgctttgagttggaccctgccctttctcaggagcgggggtgggacagggcctggggagggggaagccagtgtagctaaaagtagccttatccaccaaggcatccattga

SEQ ID NO: 290 - DNA, 1543 bp, mus musculus; identical to SEQ ID NO: 289

SEQ ID NO: 291 - DNA, 1726 bp, mus musculus
gtggatcgtgatggccctattgtattgtagggacttgccatagtagagcgcttcctgatctactgttacaagatcaacggggggtgggggtgggggggtgggggggtggggtggggtgggggaggggaggggttaaacgccttggatgaatctttttatggtagaactttaaggaattatagcatcgctcacccagaagaaatctcttctcattctcaagtacaatcaagatcaccaaagaagagagcagagcctgtgctaattcagaaaggaaataataactgaagaacttctgatgtaaaacagcagagcgctcgagaatcttggacaatccctaggaaagaagactttcttcttcggaaaagggtgacctagaaaggcaggccctagagggttgtgagagaaggcagacagagccagctgccaccagtcttttttgttgttgttgttttgttttttgtttttgttttttgtttttggtttttccgagatagggtttctttgtatagccctggctgtcctggaattcactctgtagaccagactggcctcgaactcagaaatccacctgcctctgcctcctgagtgctgggattaaaggcatgaactaccaccgcccggccttttttatttattattatttttactagatattttccttatttacatttcaaatgctatcccgaaagtcccctataccctccccccaccctgctcccctatccacccactcccacttcttggccctggcattcccctgtattgaggcatataaagtttgcaagaccaacgggtctctcttcccaatgatggccgactaggccatcttctgctacatatgcagctagagacacgagctctggggccaccagtgttaaagaacattaaacaatgtcttagagctgaagccacaaacagttcagaagttttgcctgtaagaccagacaaggagcctgtaaaacataggaggacagtagtggaccatgatgcagacttttaagggactaactgagcttgtcgatgtcttatatctgatgattgtgagaaaagggtgaatgtcagtgcatcacttaatgctgcatcgttagtagaagaaatcacaagctatttgactgtcaatagtgttgatcagtgactcaggtgctataaactgtaaacaaaatacccctggtttctgtgtgctgcaggaagaaccagtcgttggaaacctagatttcagtgttctgtggcagtaggaagtaggacggttgtatagatcatttcgtgccttgcacaaagtcagatgtgcaggtcaagttggaggaccacaaactagtaactgcctgcctacctgtggaacgacgaaatcagctggctgcttagtcagcttcaggacctgtttctgaaatcctgtcatccttaagagattccgaggaagaagtagatgtggtgggagatagcagtgcctccaaagagcactgtaatgagaacagcagtaaccatctggacacgggttctgaacgaatgccagtctctggagagtcaaaactgtcctccatgctagactgtgtttcagctcagatgccatctttatcagaatctcaggaacatcgatacaccctgagaacttcaccttgaagggtggccctgaacagaggtagtcccacagtgctgatgacaaaaatgatcacctgatgtttattactttggatcagattatgtggcactgaaatacaacaaagagtat

SEQ ID NO: 292 - DNA, 135 bp, mus musculus
acttggataccttctctagatccttcattggggaccctgtgctccgtccaatggatggctgtcagcatccacttctgtatttgtgaggcaatggcagagcctctcaggagacagctttatcctgtcagcaagccc

SEQ ID NO: 293 - DNA, 92 bp, mus musculus
ccttatacagataatctccccattctactccttctccttttagaaggggagcctccctctataaaaccgcactcttttccctataaccccac

SEQ ID NO: 294 - DNA, 75370 bp, mus musculus
cgcaccctgccccggccgctctgcgctctcgccgcggagcacccttctggcttcttcgtctctcggacggacggacgctagagctctcttctccttcccttagccaaacttactttcccgcctcccgaaaaactccagcttccctcttcctcctcccgctcggctctcggctcttttcctctccacttccctctcctctcccgaaccacaaacccaccttcccattcctctctcccatcccatcctcccttcccgggacccccaaaactcttcctccttcacctcagacgcagtcccagcgcgcctgctggacgcggtctcccgcttggttcttctcgaagccatggcaggacctgggagttggagggacaaggaggtgacagatcttggccagttgccggtaagtaaaggactccgggacatcgtcccccttgtgaacttctttctgtggctttgaaagcccggggaagagagcccacaccctcgagtagcctaggccaggacttcgacgggctgtggcttaggatgggccagggaagctgccgtgcagaatcaccatccctgagctcccgactgaggtgaaggccacaaaacgcaaaggaatgggggatgggggggggtgagattggggagaaagaagtgggtcctaaaaaagggtggggccttttctatatagagcccgctttgtctaacagctgtctagcgcatgggtacctgtaatagaagcattccgggaaaggacaagtggcggaccaccccactttccttctttttgccagcagagatctctacctatgggcggagcccccaccccacccccacccctaccgtaaaaaaaaaataatgagcacacacacacacacacaaaatagaagcataggcatcacgcggctcttactttgtaatagtttctaaaactttattctcaccaggagaaggttctggagtaagtactgctggagtgaaaagaactcgacgcctctcagaaaggaacggaattctgtacatgcctattaatttttaaaagtgtatcatctctcttagataatgaaatataactttggtcatagttatcatttgtggggtcttctttttcagtgcccggttgaaattgattggtgggcttctaaagccatcataaacagcagacatactattgtagcaacaccgtgtatttcaacggcatctggtttctcgctgatactggatcccacccaaattcatttttcaagttccctttttagattggcatttcacttgcaccctctcttgaatgcaaagggcccctggattctccaaaggagaaatgagcaggcactgggctggaatgatcgccaagcatgtgtgtagtcagggcagtggcctcctcgccttgagaaaagctaaatattaaccttgaggttataggactattcaaagtcatcttgccttaattaattttgtgtatgtttggcatttaaagatatgtgttgttaatgatggcagatacttgcctccctaaatgcgggacagtcccaaagcctccctttatattttacattagaatggtatgtggtgtggggaggtgatggacatggctaatattctagcaaactgttatcagtcattaaaagaacacacttcaatacaaaactgttgaatagcaagtattaaaattacagttattgcaacttcagaaaataaggccaaagcatttttaaaaattaaactttttttcttcccagatactcctgaaatcacttcttttccaggatgtatggacgagatttctggactatggagacttcaattggattcccttccaccagagcaggacttttcccattcagattaagattgatttgagactgtaaggccaatgagtgagctcgtcccctcctcagcctgctctgggggaagggcggggcgtggtgaaagcacacgtggacgcactgaaatcaactgctgctttctaaaaaaatgacgaagttgagggatttaaaagaccttatagaaatgatagcatggggaatttcaaacccctaaagaacaacaaagggaaaagggaaaggtgtgtttagcccaaagaatggactaaattccctggattagctgacatggccctggctttgggatattctgatctgaggcatgtccatgagataagcatgatctttatattacagctcagtagaatattagtgttctccagattggtggagggtggcggtggttcccaaagagcaagatgagattgacttctaaagttgagacatatggaaaagacacaagaaccatgggtgccaatggtcttttccctcatttttaaatcatcatgaaaggtccagtttaagaaaattctttatttcagaattttataatagatccgtttttatgtactatctgagcaaatgattggtaattctcccctttcccagattcaaattccaagaaaataaatatagctggagagcagcatgcttagagatttaaagacatggtctctgcagtcactggggcataggagggtttttgttttgttctgttgacatttaacatatcctgacgacttcaaaagaaaggaatagagaaattgatagttaatttagtttgccttttgatggcagggagagatgttcaagtaaagaaaatggcctaggcagtgtcccttgtagtaattattctcaataggacacatatgaaggacagaatattattggcatatgtccctggtaagtgtaaccatttgaaaacagctagataatgagaagagattcaaaccttgaaccatcatattgatggtatcctggaggcttgggtgtggcctggcctagcagtagattgagtgctaccatgccgagtccctgggttcaattcccatactatacaggcactcgtcaacatagacatacatttttgcagattatagaaatacaattaaatgtaggtttgagatttgaatattttgtactctttgtggttgtgaaatttaatgaccagcaaccagaaacctttgagagtgcaagcttgtacaagagtataaattggaatttaaagaaaggggtagagatttgaataagaggtagaaggatcatgagtttgaagctagtgtgaactacaaatagcctgggcatcaaagaagatcctcttttatagcacacaataacaaaacagtgataaaaatgcctgtgcaattagatagcattttattattctgatttttattaattttactaatatttattaatataatatcagataaaattagataacattttattcctaaaacattacacagacaagaaaatcacaaagtacataattgtagatggtattgtaatgtaattataaacccttttctataggatcttagagacataaaataagaaggccgatacaattctcagtttactcttggttttgaagacagagactcgtgtagtcctggccaccttctgaactacttatatagctgaccctggccttgggctccttattcttaggctcttattttcttagccctggtactaaagatatgggccaccatataaccatacatgttaataaccggctgtaatttttcccaatttttaagtggatataaattttctataggtgaaaaaaaatacagaggtttgtagtgtatgcttcctttcttagaaaagagaattgcaatgttgtatgggttcatgcatcgttttaaaatagtgtgttttgccttgcttacctatacaaggggtgtacttattatttgtttatttatttatttatttacttattctctattaatgtatgatttattatatatggcctgcataactcaatcctctttatctccagatctagcttgtctgtcactatgattgtcccccaagccttctaatggccacattccttgtggcttcagccttggtatgtgacactgccatgtgtactcctaatctatattagggtcaggattagatagtctttgaaaacagtcgtggccgaggcgatctgaaatagtacatgacccaaacactatatttgaattacattaagtttatatttaaatataccttccagttttcccagccttcactaagaaggcaaaccctgagttcagcttcccactttaccaagtcccttagcggctgtgtggaagccattttgccttcaagtgcccaagctttgaaatatccagcacaccatccattgtaagtagaagagggcctcagcttgacattgtaattcaatttatttttttctgagccacgttccctgtctctaggccagtgtttttttttcccccccataggtttgtgcagagacaacagggtacaagagttgagaatctcctgggtattttaaaagaatcgtctaaggaaattctgattttataatttcatattagccataaagatttatttttaacaggattctctcatggagggaaaatctctgcatggagtatgagctagtaacctataaggacttttcctttctaagctccagttctattgcgaagctcattcttgttactgactgagtttcactctagaacttatcccattagagccgacagtttagagactacccattagttcttttttatatatataaaattacaatttgtaagattaaaaatggggaaggagaatcctgtgccgtctccctctgcgcacttggagtgtttagtccctcctgtgttgtgtaacccggggaacgccttcctcctgtttaagtaaatttaagcccacctggaacttctggctacctttgaccaggtgctgcctttcttcctcctttccgcaggcgcatcttccttgaccagcagacattgcctcctagtggttcttgtgcttccttcttccacacccttaaggaaatcagccagtggggggctcactcttgccttctccctagtcagaaggaaaaaaaaaaaaaaaaaaaaactctcaaattccagtttgcaagggcaactcaattaggatttccatttgaatatatagaagtatttgagaaatgtttttaaaaattgcttaacgagtcctgactcagaaatgactttatttagctccccccaccgccctccattttgagagaagatctagcgattgggtttcttatatacagtacagaataaatgtgtgctgaataaaaataagaaatgagatataaaagctgtgttttaatttaatagatcaacacagttttttccttcttttatcttaatttagttaaaaaaatatattacaaagtgataaagattaacaacaacatcaatactaagttcaatatacttttaagacgtgaaatgtaaaaatgttttattttatttaaagtgagcattaaggtcattaagatggtttttgaatagaaaaataacaagatttctaacaacattgatgaaactaaaataaggcgctgtgatttccacagtccattttctcacttaaaatctgactataagatatgctcattattgatgcacagacacgggatgaagcaaatttctgatcttttttttttaagtttcagagaatcaggctgagtagacaatatgagagttcactaacatatggtatctttatcaatttaaacacagacttataaaaataatagcttaccaataacagttagctaacttgtttaattgttttaagaattaagcagactctgcaagatgctcggcaggtaaatgtgcttgctgacaaacctcgggactggagttcaatccctagaactcacaaggtgaaaggagaaaatggactcctgcacgttgtcctctcacatggcatacctgaatgtgtccatacatgtacagaatgaatgaatgaatgaatgaatgaatgaatgaatgaatgaatgcatttttattggttgtttctcttgaattgctactaaggtaaatgtacttctcaatgatacatttaaaagtactgtactaaaataatcgtgcagaaaagctggttcttagtaactcctttgttgcttaccttttccccataaatctttccgagtgacagcaaaagtcatatactagacagtaaacgtagtctgcgtctcaaattctaaaagctgtcatttaaataacatttttattttgaatagaaaaatacgccctgatctacttgcttctaatcaccacttcattgtgtgattattttaagaaaggattctagattcctgccttgacaatcgttttgtcaatcctgtggagacatctggactttaggatgagagaatctaaatattagagctcagaaatcactgagcataatgccttcatttcacacatgtgataatagaatcctagagtataaatgagttacctagagttgtatagttagttaatagttctggtatgaagagccaagagaatattgatttacctgtgccatgaaaagacactcaaatgatacaaatgtgaatgtaagaaggaatacccacactatattcaggttttacagtataattacataatttcttagtattcttttgtgtgtgtgaaggactctacttaatctaaggacattgttacctattcttttgggaaacaatcgattcgtcacatttttgggctgccttttgttttgtaaattctaaagaaacaatgcagattggaattttttttcaagaaaactgataattttgttctaatttttgtaggatccaactggaatattctcactagataaagccattggtcttggtacttatggaagaatctttttggtaagtggagctaggttacttattcatgcttgattttataataataacagtaattgtgagtcaaatcccaacaatgcaaataaaacactgttaagtgtagtgcattaatctgagaggttaataatgttaaaatatatcatggacatttttaattttttgtttattaatgcaaaagaaaagcattataaaatctgttgaaccagtgaacataagatgtaaaatacatagcaaaaattaaattgttcagttgaaaggagaaaaagtaggatgaaccaaaataataatatcatttattttgtaatacatatcaatgttttagttgtccatattgaactttaagttggatgttttactactgataatcaaagttcataattttccattttagcgcacatgattctataaatgtataaagtttgttgaagaatttctcacgaaataatatatttatttaataattatatattacacattaaaggcgtcccaagaactgtgataatctcttgggatgaattaaagattaaacaaaatatagttcccaattttctgggggttataatattgaaacattacattaaatgtctatatgtatagggacttgtttgagacatatccacatatgtaactaatcacacaaccatataattttgtcacgtattaactctgagaaaatttatagcaatggagatgaataaaacgtggaagtttatttagatgagaggatcattcttggcctagttcctggaaagttaaaaactgatatcaggggtataaatatgaagtgttatggaggatattgatacattttaggggtatgacagtactaacctctggcatgtatttggtcaagcctgcttcttgtaaaatatgataaacttatgcttcctctatcttgtaatattatacaatataaggtctatacacggaagtacttcttattccaagaccttttccttaaaactaatatcactgtccctaggctaattgttactgcccacaggttacaggcatgtttatactgaaagtatagcaatgccctgatataggcctaaaggaaaaaaatctttgttattcagacaagggtaccctctatcaggacttgtctggagcaacatcttcccagtagagcttcttctctaatgtatctgccagcattggtgtaaaatatgcttttaaattttcataccaaagcacagtccacatagcagcaatagcaatgtagccatgtcctaagtgtagaaagaagctactgggagaggagagagagagagagagagagagagagagagagagagagagagagagagaaacagagacagagggagagacagagagagacagacagacagagacagagagagacagacagagagagagacagagagagacagggagagacagagagagagacagagagagagagacagagagagagagagacagagagagagagagacagagagagagacagagagagagagacagagagagagagacagagagagagagacagagagagagagacagagagagatagggagagacagagagagagacaggcagagagagacagacagagagagagagacagagagagagagacaaagagagagacagggagagacagagagagtgatacacacagagagagagagattagagagagagagaccataaaaaggataaacatttcctcttcttcaaatacacattccttcttacacattaagcagagttgattgtctacaaactaataatggcacagagccaattacattgcttacgctgagttttatttcctatttgttaaaattctcagttttgcctttcgatctaatgataaagcaccttatatatggataggaaaatacctttgtataagagacacatttagaagatgggtatagtctataaatatctcaattcctgtgttggtgagtataaatatatgtgtatgtataattcttctgactaagaagtataaaggcttctccatcaccaaagtttggaactaaggtaagaatcaaataaacatttatcacaagggtgatctcctcatcaccagaagaacaaaaaaggaaaaaggtatgttatgcgtggaaatttactttttgaaaaacctctggttctagtatttaaccaataactttcactcacaatgaagacttaaatatagattttatgttagtgtaagtcagtgaatgcctttacacttagatgggtgatatactggattatgttcaattttgcttttacatatcctgcagttgtattttaagcttatttatattgaatttgctcagtgtttctatactcacctctggagggttgccttgtcagctccctcagaccaaataaaataaatgctttttatatcaacttttgcattagccatttctagaattttctttaggaagatctaattttatatctgataggaagagcctaagactgaagaccttgatgttccttgtaatttgaggcttctactaaggaaatccatgacttctccattacttctcaaagatatttacggcaatataaacatgtcactctgttccccctttgtttccatagtttctgaggttgagtgtgtgtgtgtgtgtgtgtgtgtgtgggtgtgtgtgtgtgtgtgtgtgtgtgtgtgtgtgtgtgtgtgtgtgtgtgtttgtgtttcagagatagcccccctctctttcttgccccaccccagtagtattacttcttaccacgttcttgttaaccccatgctgaggctagggggagttctcgcgacttttctctgtcagcctcacgcttagccaaaccctctctctgtctctgacatattccacatcgtttggcttccaaactagttttgacgtctctccagagaggactgtaattcttaccttttacttatctggactcaggaatgaatgggattatttgcctttcatttgaataggggatttattccttaggtagaaaggaattggtgtactttctagtgcttctcagtatgttggtgtctcttcataaactctgtgccatgaatacatggagagatgcctgtatgcttgcttcccaagacttttgcactttcatctaaattcacacttgacttgtcataaatcacctagaatacatgatttcttcatgtgtgctcatatgtatgcctatttccactgtggccatatgtgagcccatgtccaggactgatttagtcttgcaggtggtacctttcttcatccttaaggctcatgggttgctttcacacttctctctagattcaaaagtgtgattttgtatatcatttagcgttttcttactatgagtctaggagtggttctcggttttgatttcgtatcctcatccaaagtgagaagtcaagtaaatttctcttaaatgaatgttcatgaagcaaccattcattgtatggtaggatacatcaacttccaagaattttatatgaatctattcagatctagagatagaaaacgcttttcactgtcagagttttctaaggaaaaactcgttgcaggatattgatgattaaagctctatgtacaacataaatatttctctctgttattcatgacacattttattatacctcagattaacttccttttgcaaaaaagtatattaatactacccccatagaaaacaatacagagcaagttgtaattgatttttaaactgagtatactttttatgctaataattctacctttagaagtttatgataagtactccagattggaagcataaagacactccttgtggtgtagaattagcatatttttggtgaggacatagctcctttgaaccacacagacctaatttggtacttagagctatgaccttaaatcagttatattacctctgactatatttttgttgttgtttataagatagattctgtaagttttgaagaagctttattgaaacaatatttatagaatgtttgacatatagtaggtttcctttaagacatctattactgccattatttttagtattattttcacacaaaaaatgaactaacactggaatggatttttttaaaaaaaggagttaccttatacttactatgccactattttgtaaagcagtatttagtaaaaggtcagaggtatactcaatgtgctaaataacacagtattgctcttacatcatcattatagttatgcctaaatatgcagatgggaaatattgaaataaattcttagattagtaagatattgggtaattttctagtccatagtttttgctagattgtcattccagtctgtgatgttacaaaaacatatctgtgtcttacatagacatgtacatctattttctgttatatattagacattgcagaactaacctataaaacaagatggagataggataccattcgaagttaatgtgagagtgactcacagagcccttcactttttcagtgctgccaaccacatcccctgctgttgtttgttttggttcaagtctctctgatgtcttccagcttggttccaagctctccttctctagcaggtttccagctgtctgctgaggtctgtgcacatggaaccaaagcccgagtctcacgctacctcctaagtcttttcccttccttcttctaattagacacctagcttcccaccctatcccccttcctgccactacaaacttgacttgaaattgtgggcttccttttccttcctcgttcttggagaagtactgctcttccatttccccccaagtagggttagaaatagtagatatcgctttacctttaattcctaggctcatagctaggtgactagtcatttcaattggaaaaatatttaatattggaccaagaaatgacataggtgcaaaaaagaaaatggcttataggctagtaagatggcttagtggctataggatcttgtagcacaagcctgatctgagttcaaccagcagagcccttatgaaggtaggaagaatccaatctacgaagttgttctcctactgtcatatgtacaccatggtacatgaatgatttccacaccccccgctgagaaagggaggcataataacagaaaatcagtgtttcagaagagagatagcaactcattctacaacaatgcaagctaaaactcaaatttctcaaggagagatgtacacagaagtactacagtaatttcatgaaacatgaagtaacagacaaacactctttagagaggaagggtagaaacttgtaacctgaccctcttaacttacactaagcatgccctttaagtcttctgagtatatttgttcaacaataacctcgatacactggacaagagaattgccaaagtttcctgtggctttgagatatagcactgtactactgaatacctgacaccacatatgatgtaagcaagtcctactctcagagtactaatgacaataatcctgtacttcctgaccttcttgcatgctaggtgatggccagctagtggcaattacttggagcatttctctgttttagttcacatacacacaaatattttttagcataattttctgttcccgcctcgatttaccccccacccccgaagtaggcttgagaattagctgagttattattataatatcccttccaaaggtaaaagctggcaccacagatgctaagaatgcaaaagtacattagtatgtggcacaactgggccaaatacagtattagtaaagtgatgcaggcgacaggactttctgaatggacagaatgggtacaatattcatgaacactcacctgacctgctagcatgatgaagtcagtaaaaggaagtggatgagacaaggcagccatttcaagccaaggcaaactcatctgagttaccctacaaatgtatggccatatggagatagttctgaaactgaaacttgccttggttgttgatccttgggagagctgaatagagaaacctgccctttggtaatcagaaggttaatttcaggtaaataagaatgtgccattgtagttctgagcaaatccctgacctgttttcactctggaagtgctacagtgattgtggaaaacttgttttaaaaagctgcctaatgtatggctcttaaattttattttttttacacaatgctgtgcacactgctcctagttgccaagcttaccagacaggtgagatttaggtttgttcgttgcattttctgcatttgaatttggagcaaggaatgggaaaagacaggaaggaaagaaatgtcttcaaagttgatgacatacaatttatgatatttaaaattaatttccaaaaatatggtgctgacatttgagttgcctagccactaggtctattggatgggagagtgaatattttttccttttaggctgaaattatactgtttatttgcctaccaaatgtctagcactgtgaatgctttctttttaggtaggaaagtttcctcacatccttgccattttgcaaatatagctcaattaagtcagccaacaaatatgacttgagtgcccacagagaacacaacactgggtattttatcatacattgcaagcctctcaagcaggagttgaagacgaagattaattgaagccataggcatatcaagctattgtgccttcctaatacaacatcccaattccagagctggccatgactccacctccttcctgtgccacagttccttttggataatatgcctctggtgtaaggattagtctttctcaagtaacacgagactgccccagcataagaaatgttaaaagtgtttattatataaaggcattattttgaatgtttaaaacactcatgatagaaattcccaaaaagttattgaatacatactatgtaccatattctgtgttgagtggaatgtggtaagataaccaaaacctattgggaggctggtttttcaagacagggtttctctgtgtacccctggctgtcctggaattcactttgtagaccaggctggcctcaaactcagaaatctgcctgcctctgcctcctgagttctgggactaaaggcatgcaccaccacgctcggctgggatgcaatttttcttgtcttacttaactgagacccacattagaggaagtaatgatgctaagaggaaggaagaaaaagggataaataagagtgggcaagaggggagaaaatattaatggtatttatttatttatttatctatctaattatttattttgctggctatagaaattataatgagtcaatgaaattctaagaagagtgttattgtcactaagagaacagagctagaatatttgtagtgaggatggtgaaaagaaccggaataggctaaataaaatgagacccaggccacattaacggaaagtactgagtcttaaaggctttggagaaaaggatagctttctatcttggcaatggcacctctcaaactggaaatggaggcaggcctctgaattttagggttgcatgttttctctggtttatcaaagcttatgtatctcaattaatcttgaagaaagaagaagtcattactattatagttaaagaagaacaagtcatgtgtgaatttttcccctaagatcattaatgtagtcaatataatatgtggatatgcaagccttaagcacatgtataaaatcacactcatattcacagagcaaattcagtttaaggcatttcaagtttcaagagtttctgctttgttttagcctttagtagtttcccactaggtcaccattacatgtcattagacacttcataaaatagcccttgcttattgaaacatggaattagaattaagaccgagccctaattggttttagagctgctcaacattctatcatacttgtatactagtctctaagatactattgcgagtggagccaaatgtgtttagaagttaactgtgactctctgaacattgtaaacagaaaattggaagttcttagaaatacattttacacaacaaatgcaatggtaaaaacttacgaagaatcctattagcaaaatcaaataaaaatataaaaaagcaaacaatatacaaacaggtctttatgcttcagtttttatttttctctgcttatctgcacaatattataataaattgcccctctacaaaagcacagggaaaggaaagggaaattagatgtgaattttgtgctattaaataagagaaataatggcaccatggtgtcttatgggtcatttttattataagataagaaaacttctttaagtttgtctttttaggcacagtcccttcatgactagaaaaagaaagctagattgtttggagtcccctgaggcgggaaaaaagattgattatattctaagcactgccagcaacattttgtataaataattaagtctgaagttcaagacagaaagaaagaaagaaagagagagagagagagagagggagggagggagggagggagggagggagggagggagggaggaaggaaggaaggaaggaaggaaggaaggaaggaaggaaggaaggaaggaaggaaggaaggaagagaaagagacagaaaaagcaccatcattatcaaaacttacaggtctatgagtctttggaggacagcttttcttgtctttgagaaaaatactagactttttgatgtaaacattatccacatttagagactgtgacctcaaggtctaaacatttccttagttcttacattgtcactagctcttacttgtcattattgccttgacatctcataagagcactgtgatgtaccttacctatctacacatgacagaagtgaccatggaaagataatgaacaaactgacaaaagcagtgaattagacatttcagaggaaaccccacaattccccagtccctaggtgtgtgctcttagccctactatgttatattcatcttagcatgtccagaccagaaaaaaagcagtctaatagatatcaagtgaacataagtatttgtttcacgaagtgcaaaaataacctcatttacaaaacaaaacaaaacaaaacaaactaagctcaggtcatgatgaagatcattaacaatgtgtccgtggaacacactgttttcttcctgatgagtactaagacatcatttcagaactggatgggaacagataggctttaaaggatgctcagggtcataactgcactcctcctcagactcctagaaagcactccctattgtctggtgcccaaggttctacttatgagtctagggacattttcctcagttactgttcctacttgtcacccccagggaaaaggaaaacactaaagaatcatgtagagttaggccttgtgtataactgatttcttttctttctttctttctttctttctttctttctttctttctttctttttaaagatttatttattatgtatacagcattctgcctgcatgtatgtatgccttcagaccagaagagggcaccagatctcattgtaaatggttatgagccaccatgtagttgctgggaattgaactcaggacatctgaaagagaagatataatgctcttaacttctgagccatctctccagcccaatgactgatttcttttattttttttaatgttttcaattttttaaaagatgtatttatttatttaatatatgtgagtacactgtcactgtcttcagacatgtcaatagagggcatcagatctcaatacagatagttgtcagccactatatggttgcagataattgaacttgagacatctggaagagcaaagtgctcttaacctcatagctacatatccagcccaatgactgattcctttttaaatgctttcatttaaaaaaaatatttatttatttattttctatatgtgagtatattgtcactctcagatcccatacagatggtagtaagttaccatgtggtggttgggaattgaactaaggacctctgcattcataatatgtttctagtagcatgtataaagattagaatgcacaaaacttaagaaccccctttctctgcttctcccagaaaagacaggaaaaacaagcaaacaaaacaaaacaaacaaacaaacaaacaaaaaaaaaacaccagaccatagcttggaaggttagacaggggcagaggatgaaacccatggaagtagacagtaagagtctggcattagagatgtggaggtgagaaccaggtgtgctgtttttaagtgtccttacattgttcctagcagagggggatgcaggtttcaacagaacttaccacttgaggtttccctagtggttaacctctacaagagttttgtaatcagccaaattcttcctaccttgccacaaaatagtattgtgatgacagtgaaatccagccagaaggtttggagtggatgtctaaagagtaattataattagtctttaaaactgctatacaagttctattgaaagcagggattcaagtgtatgtttttttctttattttgacaatcctgaagtgcctaataaagtgcattgcatatggctggcatagaaagtcatcagagataaataaaccaggaaaagtttcctgtcttccttttcaattgtccacatttatgtttccctttatcttaaatattatcatttaacaaagcgatgatttaaataaaaacactgtgcatccagaaagtctattttcatcagttttgtattctctttggaacaagcatggtaactaatatgcatggtgtttagcatattttctattggaactaaatggatgtgtgtagaagtgacctcctctgaaatgacactttattggtagctctctgcagatgtaccttgatggagaagcctaatgacaccctgcaaagccattactagagacagattagttttttcaaattataccagctaagtgactttctattctgacttttatttcaaaagatggtactgtgtagagataaatttttccaaaggatggaaatattagccctgctttttattactctctcctgaatgagtcatttaggacgcctgaaagagtatattttttcttagggtactgtagtttgcagtagtgttgttggcatggctgaataagatggtttcaagagtgcttcataccttcaggaagatgtctagaacatgttcaaatatttcctgacttggaaaattggcagccattagaaagaaaaacacatataaataagaacatacaagttcttgcttcccttcaccttctccccatgctcaccagtttctgaactatcctaaattttattatgctttaaaagaaatttaatggcccaaaatagtaaactttagaagatttagtaggataaatttttttagcagctcttcttctcctccctctgtacctctgtttctgtctctgtcctttactctccctttcctcctttttcccctcgcctctccctcccctccctcccccccccccgtgtgtgtatttatgtatgcttgatttatgaccctttaatacttttaaaacatatcatacttggcattaggtagatatattcagtcctcagttgcgctgagaaatagtcagtgtgaacaaaacggtgtgaactagttgaagcatgaaatagaggagtgatatctgtggagtgtggagtctgtgtttattccaaccggtgcattgtgggaacacgtttgacttctgtctttaacaaaacactactacccctgaaaacacacagatatagaataaattttatgactgttttttaaaggaaattattaaaaatgtttgtgggcacctggtatatatagccttactaaaatagaacatagatgttttctattgcactcaaatccaaatgcctagacttaagagaaagaaattacagaagaacaactcactgtcagcttctgccctaaggctctttagatgggatatgaggccagaactatccagataaaccgaaaccttccagaagtccctccaatgacatgtgtgggtatgtgagttgataggtcaataaatctatgcaagataatgtttataaaacaagaccaaaataattatatccataattctgttggagcatatataagacatcagggataaataaacaaggaactataaaatcggacaatatgtatttcgttaactttttaatttttgagattataattacaataattctcccttcccatttgtcctttacatgctcccatacaaccctcctaccctcacctttgattattgttacatgcatatatgtatacacatgtacgtgtatagtgcttaagataacctgctcagtctggataatggtacttctttgcatttcagctttaaaaggcaaaagacctactcttctgcagcacgcacagtgtctgagtgtgtgtgtgtgtgtgtgtgagagagagagagagagagagagagagagagagagagagagagagcaaagttcaactcagtaaatactagtttcttgggaattatgttgatttttttttcctagactgctacacatttgatagatgtgtgagatgtagcaatcaagacttattccttgagcatgtgtctgtaggtttataggacttgccttctatttgccagaatgagaggtaaactaaacaactttaccaattcctaattgagtctcctgttgaaaagtatccacaagggcaagggctagataacagttagcacttttcagtgttctctgcagaagcattatgccaaaactgattgactacttaattgtgtattttccatttttctttatttaaatattatatttcaaggtcttactgatcaagtagggagttaaaaaaaaaaggacaagcaagcaaaggcatgcgtgttaaaaggacagaaatagaaggatataaggcctttagaagcagagttgccaatttggctcccaaatgcaaaatattcactaaaatttcaatcgaattgaacagagaataattttgagcacagatatgccccaaaggggtatacgtatactacaagcacagttgtccatctgaaattagaatttagctgggcaagtcctgcattttacctgccagctttacctagaaccagctttacctagtcacaaatttattatctggtagccttatattaagaaataagaggggccttgtcttatccatctgctctgatatggtaaggaatgctgaatcagcttaactaaaactgctgccaaagggtggagagggttggtcttctagtcctaaaacagctgctactcctccttgcatatagcaaatgttgtctgtgcttcttttggagctccatggcaaagtgtcttggttggcagctatcagggttcactaggtgagtaattctttcctctgaacggctgagtctagcaaaggagaacatttgcctgctcattctactagagtggaaaagacaatcaaagtcactctgaaccacttggtggctttcttttctcttactgtacaagtagagggttctagactgttgaactcattagttcctgtgcagcttaagtgcacccaatggatgtgagtccaatcacctagtgtgattgtaccaactataaatcaataatgttgattattttctgctgctagaagatcatatattctatgacagagatgaggcaaaccagtcccagaaagattagtgttgtttcgaactcaatctgataaagttcattacttgcattgtgatgtatcgctcttagtgtatatatagcactagatcctttagcttaagaacacatacatagatgccattagtttgtatatagtgtagaatggaggtagactattagcaatgctgcttgcttctagccattacctcccccacttcaaaataccattagcatggtccagagatgttccctcaagtgcagctcacagtctccagaaaaatagtgtacccacagattttataaagatttcaaaaggaggtctcaagttgatgtggcattgcgagctgtgccatgtgggggactgctgagacccagtggaaagaaaaaagaaccctgagtagtgtcatcatctcagcaacataggctggctctcccactactaacagttctctctctcctcaaacttgcttcttcatttaaaagttgagagttcatcactgtaatgtgtagatcaaataagatttctacgtaataaaatcatgataaccttaattgcttacagatattctatatactatgtggaaattaaaccctttactttgtcatagcagcaccattaagtagttttatacgtgttacttgttttttctttacattttgttgtgacattggtgtgtgtttgtattacacatgtggtggtcagaggttgagctgttggaataggctttctctctctaccgtgtagggaatgaatttaggtctgtaggcttgacagcaagcacggttacccattgagccactttttcagccctgtaacttgtgattcttattttatctatgaaatgaaggactggcaaaatgaaataacttacctaaggtcatgcagtaagttgctaagcaagatttgaaacaagacttctttggcatacaaaaagccctcactatgtagtatcaaattatcaggcacttgttaattacaaaaagggagcctcttcctgcctggcaggtgagtgacaaaaggcacagtccttcctggcatctcagaaggggtttatcataaggctccattgcatacaactcacaacctctacaggattcttttttttttctttaatttggtaagtctcaaaaaattgtgccttctagataaagatggagaattaaagaattatctttttagtcacttgatggagccaaattatgttttatggggagcagagggagctatgtgagaaatgatttagttgtttatgatgtgcttgttcagaatggccagtatttaaggattacattttgtcacaaagaacaagcttttttctaaagaataaatttatagattttatgtaaaacatttcaacactaaagtgaccagtgtacaatgtgtttttgaaaccaactagagaagaaataacttaggcatgctattgatattgtgctatacaattttttttaaaaaagctttctttcaaataactagacagtacatatataacttcagagagactaaggctttaaataagagttcttcctaggaagataactgtttcatgaatttaattccatgtcaataactaaaaattaatgccaacacttattttgaatcatctttttataatcatatcattataaccctcataccacaacggaagcacacactttggtatcacacaggtctgaatttaacgttgtttttttttttttttttttttttttttttagttaaatgacctcctgagtggaatgcctagggggtgggtcacttaacttccttgagtctcagctatacaaaacaatggggaacaggcaagatccctatggaatgtagttgttattatccctgaaagaacttgtgaaagtcttttcaccaattctagaaattgtacaaaatgttattgtcactgaagacaggagaaatgatcaaggaattattttctttaatatcaagattcttttggagctacaggcaactaagaaatgctcaaatggaaaacatagtcttccccagggaagaacacagtaaatagctatccaatagcatggggtctccccccccccaaacaaacatgcaagtggcagtatatacagtgagcagattatgtttaggaatacatattatattcatataacaattaatgaaaaaggtagtcatggatttaaggaagagcaagagggacatgtgggaggggttggagagaagaaagaggaagaagtaatataattacaccataatctaaaaaacttaaattaaaaatcactgccccgaaaggtgaagtagttggggaaatatcaaactctactgcaggtcagagtagaaaggactccttagacactataggtctaccattaaattagaaataaaatcctgaagccctcagcagggaaattacataattaaggtcaaataagtaagaatgtaaaccctcattcttttagagaaaaacaaaacaacaacaacaacaacaaaacatgcccctatcctttgctaacttagtcacacatattcaaggcctccagatattggttttcaggtagctatgacgtggagagttgaaggtgaaatagctcacttttcccctgcttccgtaccagactgccaatgattaaaatattaatgcagactgatagcagtagcgcttgttagtacaccagggaagtagaactcttcagaaattagatgtgatgtgaatggttctctgagatcttttgagtggtagccatgagtaaacaatcctaagcaggttattcgacggagccttattgatatccacaacaattcaaggaaaaagcagacgagtcttctgtctttggcacgttactcccatttcctgcaactctcccttggtccatttttgttgttcttttgaatcttctctcttgactctttcctacttagatactactaacagtgcttagtgcagtgaaaaacttccactgccacaaatttcttcagattttttttttgaaagaaactgaagatacgggaaagaaatttgttcctttatacagccattttccaccacatttatttccatatgttctatattattatgtaaaagtttaggtaatttgtcctgggtttattggatgatggtgatttgaatgtagggtagtctgacctgccttggtttaaaatatctgtttacattgctaatgccagatatgcgtggggctaggaggccataatagcaggcgaatgaatgatgtacagtggactaggtttcaggatttcattccttctagagtaacccacaatttgatatgaactaagaaactctttgagcaatgtaagcagagccagtagcaggacttggacgtggatccctctgatggagtgtaatacccttattttttatactgcacaagttctttgattggagtgcacaccaaaatcctctggaggaataatttgcacaaacacatgcccaagatctacatgaaaatttctccactagggaatactgttaagttgagctacagatatgaactggaaatctcagcgagggcttattgatttagtcaggagcttgcaaaccttaagcataagttttgagaaaatagaggtttgactcaatatggtctggttttttaaaatgataggccaagatgatttcctgcagaacattttactgcattcttccatatttatgttactggacactcatgtgctttaggtcttcttaccaggaatcacgtttttatatgcattttataaattaagaaatgcattaagccactgcttaacaatttaaggaatgggattagttctcaccttaatctcaagggaaacaggtccaaggcagggaaattgtttctgatgattgtgtgaaagttaagagggagaattccataacaaggaaagttgctcccaagaaaagcaaagccagatgtagcacctctgtaaaaggaaagagccttaagggctatgtgggaggggtgggggatgaaggcaaactactctttgccagaggttatccaattgcccttgatggagagagcctggttctcttacttttaagggctcaattctctttacttagaatgacccttcactgacccaacttcatttaaatgcaaagaaacaaagaaagactgaaggacataatcctgtccctctaaattagcgtattgaacagctgaatgatatgaccaattcagagaagagacaacatactctgtatattcaaagcaatgttttaaatttatttgtcagttcaagaaaacaggctgcattaagtcaacggagaaacaactttctcaatctctttgcacacgctattttatttgcttacctgaacctcatctagagttatgaggcctttttattctctagtggaaagggaattgacctttggatcaaatattgtgagacttcattgaagtgttcataggctaaggacttaagctgaagaacagagaaaatggggacatggtcatatagatgagactgtcttaaattgactgatgaagagagaaacattaaaattctggttgtggatagaaacagaattgggggaacttctgaaattggtaaccatggcttttactacccccttttaaatctctttccagttatcaataaagcctgcttgtctagatgtcttcagagtacatatagttcagagactatgttccctttaaaatgtggttttgattaatccattcttggatcatccagttggtttttggtcagttaacttgagccttggaactttaatactttttctttttcatatttggccatgtaaaaggaggattaaagcacatatcaaatctaagcagcaggatttaaagcaagccagactcatgaactcttgttcttactcctcccttccgatgttagacatctagtccctacagcatcaccagtgttttcaattaaggaagccagttaaagtggcatgtggaccactttcttaagggaagcccaggagccagtgctaaagtcttggcagataataaaggcaaaattaaaatctagtcactttggatttactggaaatctgctgaaacttctatgaaaccccaagacattaacagcaaccccccccccaatgataaaggaaggagggccacaatgtctttcaaaaaaattttttaatgcccttttacatcctttggaaatctaccatcaaactcacagaatcatagaagtggttactcacttgtgtttctgcttctcttctggctaagccagattcatatattctactttcatatattaattccttttatgttgtcattctctaagtcaggcttcttgattaccaatggcatcagtatcatccagaaacttgttagaaatgcagaaccattccagtaatattgaaacaaacacatctgagattgccaaccgggtgaaacaggaagcttgctttaacagatgttgtcattctgggcttacacctagtgggagagtcattgctgaaaaacatttcttagctgtattccatccttgaaattgctattatcctcccatggtacacataacctacagttatgatcagttcctaaacagaagaaaagcacattttttttcttggaatttcatgatcatttggccaaacttacttaatctctttcccaatctcatgatatatgagatacatactcaaacactcatgcacaacacacacatttgcatatgcaaagatgcagttagaaataaaaaaatatttatcattatttagacatcccaacatcccatgaaaggaaaagtaaattatcttttttttttaacttggaaaatctaaagaaaaagatgaactgggcaaaatttcgcccatgtcaagcataaaagtttccaggttaagttcttagaacacacagatttgatgaagaaatttaaaactctccttcacaataaaaataaattataaaccatgaaagtatgtctttgggcatggataaaagcaaacaccctgactttcctgctcccacaaatccctagaagtttagaaatacacacagcctggttttgattatagaattagttacttttctctgcgtggcatatgtattctgttagtgaattggaaacttaagcaatttgttccttacatcttaatacacagtcgagtagcattttgggacagtcttcacaaagttctttcttggcaagttagtgatggcagcttaatgcactggtttggagtagtgtaacagcattctgcagtaaatttctctgtgatgatggcttagaatgtactaaatgtttctgcagagctttcagatctagaaacctgggcagggtttttcagaaagggcagaagttgacagttgtgatagaaaaagctgtacgttcttgtggtaagatttacaaagagataatttggaggtgatttgaagacttttgttattttcttgtcaaatatattcatccatagttccagtcaactttgtgactccatttaatagtaaataaggtaataagcgaaagaatgtttgtcaaaccacgtgtttgactaaattaatttttggttagcttatgctggctgaatataccattcaaaacacatagcctcaagctactactgatgttttatatattcctagcaagaaactgagtcaatattaacatctgtaagccacatgaatataatattatatttagttaatgagcttcagatgaaacatattcgagtcacagaaagcaccaatccatatgtattctagcatatgtcacttctgtttctcttaaccttcacccacagtgactgagtccagattcactacattctggaacatagtactttaaatggatgtgccacgtgataaagattcttaggttctctcagaggttggcttccagtaattacagggaactgtcattattttgttgttctactctttggaaaagagatcttaagtgaagggaaaagaaaagagagaaagtaaggaaatgcatgtgcaatgaatacagagagaggctgttgcagaggggaagagtccagcaacaggagagcagggtgggaggggagggagtggggagagtaagacaatagcatgcatgaagctgctataatgaaaccagttatttggtacactaacttaaaccaggaataaaaatgaaagcagcattggttggagtcttaatcctctaaaagtacaggcagttgggtaagaaacagaagcataatacagatcctgtgtttcagaatgctcctcatagccagctatgaagcagctggctgtaagcagctcagaagttcaactcttgctgtttgtcagaggattggaagtaatgtatgatagtaaaatgtacaatatccaggcgagaaatgagaaacaaaaaaagcagaacgaaaatcagtctaagaatctaagataataaatagaatagaatagaatagaatagaatagaatagaatagaatagaatagaatagaatagaatagaatagaatagatctttctggccttctgagtgggtggatgaataactgcaatcaggcatcacttaatgacggtgatatgttctgagagaaaagcacatcgtgaatatcttccatggaagaactccacatattatatacatatatcatacattatatacaatgcatattatacatactggatatatattatatatactaataattatggggtcaccttcatatatgtcatccaacattgacagaagcatcatcatgcagcagattaaaactctggcattatatcaatttatagagaactactaattattcttagttaaacttcaattagttaagcccaatcagaaggactcagcatttcctggctgtaggtgttttgttacacaaataactttcaaaacaagtagatctccagcaaaaaaaaaaaaaaaaaaacttttaaaaactatttccatgtatttatggatagacaggtacatacttagctgcatttctcatgtcttgatagatagatagatagatagatagatagatagatagatagatagagacagagatatgtaaaatcaatagtcaagactgacatttgaaaatatgtgaagaggccacattcttggatccacctcatctcccacttttattgctcatatgcttcctcactctccctttttacctccatcatcttttttgtttgaccctattgccctctctattgcccaagctctttgtctcctctcccttccccctcttttcctctctgctcctcatcaacaaatgaactctgatttattagaaaactttcaacaaatgtgggacaagaaaatgcttttcattgtccctctattaagctaaaggtttagtaaaatagaaaattccactaactgataaatccattatcagaactataatatagtaaaacatatatgtatataatataatatgtatataatatgtacaagcataatatataatatgtgatcagatgattacatatatttcttaaaactcataaaaatgtacactaaaagagaagaacttaagaatgtaaattatccttcaataaacctatctagattataacccagtaaatttatgcaattattgtgcatcatggaccaaagcatgagatgtatatctataatctcagaattttggaataaaaggcaggaatacgaggtaggggagggattcgaagacactctaggttacaggagaccctgcagaagagtcagataactcggagatttgctgtgagatagtatcttttatatatgacagagaaattgcatccatgaaatctcaacaatacaatttcttcaactatgataatacaagttgacatatcaatatggatgggggaaatcctacagtgctccagcgctagagctacaggcaattaatgactactgagagagggaggagggtcagtcttctccttgtccaattgcagtggtcaactcaaacatatgtgcatacaagcaacactaaagggatttagctggcgataatcataagcttatatgtgcatgtgcatttatataacattaataatcgaagaataagaggaatttttagagggaggtgtgagaacacaaaggaacttagagggagaagagggaggggaaaatgatgtgcccatatatgaacatattaaaaaattaagaaaaataaagacatgagacaaatgtgtagattaagagtagacaaccaaaatgctaaaaatgtaaaagtctaaagccaatcatggtagtgttcacacctcttcttaggtaacaaataggaagactggaaaggggggttgcttatggccaggagtttaaggcccttttggacattgtagaaagtcccatctctcaaaactaagaaatataatttgataaagaaaagaattgatactgagattccacgtgtataatagcatgcttgaccagtaacagacttcctccaaatggtgccataaggttaccgtcgttttccgtagtttgtttatgtgcgtataaactgaaggggttggattaaaatctcattaagctaaggcggttctccattgaggtgaactgatttgcagggtgatgggggaatagaactgtttaagtgtcagaaagtaaatcatctgtcacaaaacaggtggaatggataatgtcatgtgaaatttgagaaacatctgtttgcctatataacagtgcctgggtcaagatggagccacctggttgaaatgtaggatcaggttgcaaaaatcagaatctggctgacccaggccattttggggcagtgtgaagagaaaaaaaaaagacttatcggtttttacatttttaaagattcttttactttactttctgggagttagttcccatgctagcaggggaggaggaaacatgagttaatgaaaagtcactgtcattttgagggttgtgctcaagagaagagatggcagctaagatgaataagcactacattctgaatactttcctttcttgcttgtgcttggcttgtgcaaatgggtctctttcatctaggggaaggagagaccctgtgtcactgattacatccatgtgcaatgtgaatgcctaatgcatttatgtaattctcttaattatggtttacagaactggatctactttcctaagcatcacacaagcatacacgaaatacgaatcatggtaaaaatgatgatgtcaaaaaggcaataataagaaccaaggcccaagcatattatctttttgaccttggattccgttgctatacatacaaggagtacctataagtaccttgcagaaaagttttccagtgatgagtacacatatttcagtgacttaccaatcatatatagccaatcacatagatcttaaagtgcatcaggtctcctcaacaacacaattgccctcttaactcctgtaactttagcatccttaaaaacaaccctgctatcttcacagtgatttattttcatgctttttcacaaatgtaattaatgtgatgccaattgtggatagtgccatctatgggctggtagtcatgggttctataagagagcaggctgaacaagccaggggaagcaagccagtaagtaacatccctccatgccctctgcatcagctcctgtttcctaacttgcttgagttccagtcctgacatcctttggtgatcaacagcaatgtgaaaagtgtaagctgaataaattctttcctccccaacttacttcttggtcatgatgtttgtgcaagaatagaaaccctgactaagatatagataaacaacaagctttcctatattttgttttttgttttatcttttgtatttagacagtttatttattttgagatactgtctgtataaagaaagaagtggatttttttaaatagtggtatttgttaaactaatttagcctttcaattgactcgtgctgctgctcttgtcaaaaataatgcacgataaatataaagattttaaacttattttgtgtaattgttaatgttagtaattatgcatgttacgaatttggttaatttagtcaccatacaaaatgagatagcaacatactaagtggacttatttgctgtgaaataattactgaaataattttatgctcaagaaaaaaataggtttgtaacatagaatgtaaatatgacgagatgtggtcattcaccgttgcaatgctactactttgaaggccaagcaagtattgccatcagaatgaagctaacacagttggttccagggtagttgggaccatagaggatttgtctcaaaacaaatacatgaaacaaaaacaaagcaaagcagacaacaaccagaaagaaaatgtaattgagtctttgctaaaataaattatgttttttcttttcaacagtttatctgtgaatttggatttaatcaggagctagtttggaaaaatatgtcatcattaggggctttctttaaaaatccacgtttttctcactgattagccactaaaatttcaaacaggaaaagaaaggaagcaagaaaattatcatgcactaattaaacctaatcataagacatttcacaaaacaagatgtacaggaaagttatcacccaaatctaaaaggaagaaaaaaagtattttaaagtctcaggcatactttctccctcgtgattttactttgactgagattatccagagatgtgtttcaaaggagagtgatgggtgacagaatattttggtaccaggatatggatcatttgatgtacaaacaaactatacagagaagaagttggctccaaaatggatgtatttgtggctttgactttcctaagtcaacatttatgaacacaattagtggcagatgttagaactggggtagggagagttgtatttacagcatctttaatgcttctcagcaaatttgctaaacttatttctagtaggcaatataattttgaactatatagtacacagacagaaagcttatactttgttttgaagtcttctgtggttggtttgaaagtaaagtttttcatcattaaaaagattgaatgtagcatgtagcaagagaagttataacccattcattttggggataggcctgggggagaataatatattgtattgatggtatacaaggaaaaataggtactttgtggaatggtacaatagagaagttttatgaaatccaacccaagtcattgcatcatattaattacatttgtataaaagcatgaaaagaaatcattgtgaagacagcagggccatttttagggatgctaaagttacagaagagggcaactgtattgttgaataaatactgttgggggaaactgttgagttgcagcacgctctattcagattaaccatacttcagactgctgggttggctgagcaaacatatatacatatgcaaaattatcattttctatattgtctttctgaggtttagtcaaagtattactttaataaacctatctcattttcatcaggtcgctacagttaatagcagcagccatggtgttatatgtaattgaagttgatcttcaaagttatctttgaactttttctcctctcagagaaaagcaaccttattgtattgtgaattgtataccgcagttcccagtgatagttaataatcagaaagctaagtgaaacacaaaaacatcatttagcatataaaactgcattgtatatgtagttacctcctaaacatggagattttgagacttctatacgtcactgtccaccacacaagtatgtccacttggcaagtttgcaagttaagtccctctgtttcttaggcaaattatcaggtacttgagattcaagttcctagatcctttaaaattaaataaaatattgacatagaatatctgaaactatcgtgtgtaacagttatacaaaaaaatcaaaggcttagaagggaaaaattcaccattttttgaaactgatggcagaggcaattgttaggtacaaagtgtgaagaattaatgtatgcatatagagtgaaacacacatatttatttttctcttagagtttttgattgtgagcctagcctttaatggctgagccatctcaccagccattgaataattctgctgtttcaatttgttggcaaaagtaaacaattgtttctgattgactttctgtaagggaagaaagacttggtcaggacagaattagtatggttcactaagccatttatagaacctagattttgctaacaatagtagatacatttcaacaaatttgaagcaaaacaagccacttacatgagttgcctggctctacacttaactcagtttcctgacattcatcaaatatcaagtaacattgaaaccacaaccctgcccaatgttgttcctttcacagaataaatctttccattctttctcctctcttcttccttcccctttccttctgcatccctttctcccatctcttgtgtcaggaaggcagcttacagatatttgacactttcaccctcctaaatttcccagtgagaggatagaactgtcccctttgactctcccatatagaactccagttttcagtctcctcacctgagatgtttcatgccccccctcccatctctgcttttgaaactgtttcttgtactctctgcacctacgcaatgaaacattttttgcaacattttcgactaaagcaaagtaacactaaaacactgtatctaactcattacctgtgattgttggatgacaatagtgaatttggaggcagtgggaagtagaagctctttctgaggagagaagatttattattgtgagaaaagagggtcattaaggaggcccttgggctcagtcttttgtgtatttccccatgaaggctggattatttgacttgtcatagttcacaattaaataaaggtatacaatacatgacagtaagaacaacccctaaactacagtgttgacagtgactcatgactctaataccagcaaagacccttggagacaaaatacttttgagtcaaatcccagatgtagatttagtgagggttttcttttatttctttttctgtctgttgaagtgaaaatacaggagcacgttccaatagctcttcaggcatgcaacaaatgcttaggcccacacaagaagtgaagccctatgcattgcagtttatgaaaaaagctgtaatttgtcccagcagctaatcagtttggtatatcaataaagaagaatcagaatacagaagtaaaaccatcctaactttgccccctttctttattagaaataaaaaattgtttaggaagaaaataattagtcttgcagtctgatgagcatgcctgtggcaaagtccatagcagaatcttccctttccgttcatcttgccagtgttggtactttaggaaaattcatggaaaaaaaaacctccacttcagtcatatccccctccaaaaaataaattaggctcaaagaattcgtagctttgtgagtattaggtgatacagctttctaacaatgaaagtcaggcgcagttttagaaaaagaaaacactatcagaagccattttgacggtagggttttatctctgctgtgaagtctcaaatgtgcttgctttcctggctcacatttagttctataagcaataagaggtttaatgccctcatcattttaaaagtttattgctctattattaaaatataagaacttgcattcaaagaaatggaaaatatgttctaaagtaagtgaagttaaattagtaaaattacaaggagatattagtgcaatacatccaaagttacaatggaaatctttgaactctgtctcagaatttttatacatgaagttggcaaaattgctgggtacaattaggacatttggtctctttgaactgagatgaattttatcaacaagtagagaaaaaccatttttgtcaggcacacaagggacattttaataacctgattgtatgcttaagtataaagaaaatattatatttcagggatctgtattgtacagaacatactctggctaaattcaatacaatttacaaagcaatgacaaaatgcaacgcaactgcttgtgatatatctggaaatagaacacatgcctctgtctataatttgtaggccaatgactacttaaatataaactcaaaagtatcttgtctgagatccttatctaatccagtagttttttgctggtgacagttaatgcatatcaaataataatacattatagcataattcataaacatttgctgaaggcctgggcaaagtatttctaaaatcattaatataattcatctacttatagggaaattatttaatctacttgcaaaggtggttgtgttcaaatttttggcactattagactatatgtcacatatctggcttgatgaatagtttaaaggtgatatgaaataataacaaaaaggaaagagaagaaaaaccacacagagacaccttggaagactgaaaaatcaacagcagaataggaagggattcatggaatatactttgattctgttgttaattctgtcactggctatgtggactaacaaatttagggattagtagtagtgaagaatataatagaaaaaaaataaaccaatttgaaataggaaagaaaacagtcaaaaattttaacaaggccgcgtcaccctctctgtgcacccatgatacgtataccttcttttctttcatttccaacctgagaatattttcccatcaatatgtgtctcctttagataactgtcacggtctctcagattaccttactttttcagattgccttactaaacttaactaattttcctcaatgattttcttgtttgtggtacccttaaaatatcctgcacagtgtacatgaaaacttctcttgagtcataaacaccctgtccactttagagtcatacacaggtcttttgttaagtttaaacctctaatggtagagttgggagagttaagaatctcctttggagtgggtagattttgaaggcaaagatgatgctttgggctgctatgcccctcccctcccccatcagccagctgtttcaatgctttccttacactggttgctctgcttgatagaatcggagacactgcccctcacatctgtcagaacagatggaatacattctgtgtgagtgttaactgattcgtgcattgcagaaagaaagcagtttatgttaaaacattgtgacattgtggtgaggcattatgtgttctggctagaacctggttgcttataaaagatgtgtttctttgcccttgcccatgctttgatacactgttccacggttaagtccaaagatatcttacaaagaaaggaagaaagaagaaagaaagaaagaaagaaagaaagaaagaaagaaagaaagaaagaaagaaagaaagttggagagaaagaaagatggagaggaaggaaggaaggaaggaaggaaggaaggaaggaaggaaggaaggaaggaaggaaggtcgaaaaaggaacaaaacacccatggaaagagttacagagacaaagtttggagctgagacgaaaggatggaccatctagaaactgccatatccggggatccatcccataataagcttccaaacgctgacaccattgcatacagtagcaagattttgctgaaaggacccagatatagctgtctcttgtgagactttgccggggcctagcaaacacagaagtggatgctcacagtcagctattggatggatcacagggcccccaatggaggagctagagaaagtacccaaggagctaaagagatctgcaaccctataggtggaacaacaatatgaactaaccagtaccccctggagcttgtgtccctagctgcatatgtatcagaagatggcctagtcagccatcagtggaaagagaggcccattggtagtgcaaactttatatgcctcagtataggggaacgccagggccaagaagtgggagtgggtgggtgggggagcatgtgagggacttttgggatggcattggaaatgtaaatgaaataaatacctaattttttaaaaaaggaaaatagtggcagagaagggaagggagaaattccctcttgtatttgtaatgtatattacttccaagaggaaagaaaaagtcacaagcttaaacatgcacacacaagagttatgtaggtaccttttattttatcatgttttcactgtactttaatgaataatgatgcttggaagtgtgagcagtggttttaagagtgtgtaggactgagtagagtatgtcacactttcctcaatatttgaagttctggtttatagactgggactatttttaaagacttgtgtcctctctctctctctctctctctctctctctgtgtatgtctgtgtgtgtctgtgtgtgaatatgccatgaatattcagatgctagcatagaacaaaagatggtgttggatcccctggaactagagtgacaggtgactgtcagccagcctatatgggtgctagaaaccaagcccaggtcctctgaaagagtagccagtattcttagcctctgagctaacttttcatgcctgcgggttatgactttcaatttctattaatggccaacactgaaagttttatgatgccacctacttgtaagaatgaacttcaatggctttgtatttttgtcacctctagacctggcttatggtggagcagtctattgaggacacctcttagttacctagaagccactatccatatatttctagccacacatttttaactttattgtccattttatgcaatttgctgtttgagtgttgtagtgtcagagagagcagctccatttgcaaatgatgttacttcatattttgacctatttttccctgcaggagtaataacaaggataataaaaagtcggttgaagctgctgtataagcacacataactgcctcaaattacagggcagatcctaagctacaaagccactgaaaccgccaaggccctcttccgactatttcacagttgtactaaagcatgaccatgactgtcccagatttttggaagaggaaaaaacattagtctgtctggtgattccggtgcttcgggagctttttacttacaaaatctgcttcactctgaatccatttcctaggctagccaaggttttttgtaattggatggtttgctactgaagaaaggagatgaaacccttggtgtcctcagcacctcacacctctgagctcagtagaaccacaagggatatatagaacgggtatttagtgaaggtttcagtgtagtagcaacactgaggactaggtaatatcccctgacagactaaccttgtgtcagtttggcaagagtcttggcaccacttccttttaataggcccctgccctctgacatggacgagcatgtatctttccaagccttgaggctttctaaccgaagagaattgcatggaactttgagtggcctcacagtgtaaccacagagatgattacagggttgaggaagggaaattcacctactgataattagtgctcttggaattcctggagtaccaagcaacacggcagcatttaacgggctttgtctgaaatctcaagtgtattatagtgcttattaggtgttacgatctctctaaatttgctactaatttgtatgacttaaattatcttgtgttccagcatgacccacgtgtctacactcaccactcggcccattcccttgtgttttagaatcatactgagattaagttcacacctttgctgaatgcctgtaacctgataattaaataaaaataaaaacttcctttaaaaagttgtcatctaggtaaatgattcatttgatagaaggaatgtatggatcccagacacagagtatcaagtgattatataacttaaatttatgttacttaaatacctggagtgtaaattcaccttcattttacacaaagatatgacatgtcttcatagtggcatataagtaacaactgttttataaataatattcataatgtctttaagaaatcttttagaatttttaacagaaacatgactcattatcctcacctttaacttgcaatgcagtatatattgattatagaagttttaaatccaaaggtccaaaatttaaaatactatttattcagtttcaggttccaattgcttctagccacagttatttgcatctgcctattctgggttttctttaacagggtcagggtgggagggatggagagagtgcaagagagaacgagagaaagagagaggggggaggtggagagggagagagggaaagaagaagaagaagaaggaggaggaggaggaggaggaggaggaggaggaggaggaggaggaggaggaggaggaggaggaggaggagagatcacacctaggaagacatttccaatttcgatacacatgactcaataaaaatctttgcagcaatgagatgttcatgcaaatattgaataatagatcctgcataatactccttggccacccttcagtctaatgtaatgatcacagtgtgtgtccatgcaggatactaagatttgtgagaatgcaaacggatatgtcttgataactttgtcatgtattgtcacctatctaatatccgagtttcttaaaacttatttttttttaaaatgaaactcataaattcccttttcttcccaaatgtactacagctccttcttggagagtgtttggcatttcatataagtcctcagttttcaccctctatcttccccatatcatggctggttttgttcatacctcttctgatcactctcaactcatctgtcattttgggcttcctgagctgttttgtgatgacggaaggataagaaggaaacaatagaagccatccatgtaagaaacatcatccttgttaccagtctgaaaggatagttaagaaggggacatgcttagaaggaaagccctcagccagccacttgcttttatgtttctggacagccctgttggtagaagctattctgttagctatggtgtctcaccaagaactcctagatactacttatggctgccctggtggtggccatcaaggatcagttggatctcttgctagggaccaaaacagatgaccaagaacaaagctatgtgagtcaaagcaagctccgcagttatagaatggactcaagtatcgtgagtagctcagtggtcgctctccaccacaaacccaactaaaaagaaagaatgccatggagattgtgtggtttcagtttgccaactaaaagcaaaataaatgactggaggtactctgaaggaatggctgaagagaaggcagtttttccacaacaatttctttaactacatgatataaaaaaaattgtctaatgaaaattacaaggccatcaagaacgatcctatattctttctaggggaaaacatagtaattaactgttgcagaatgatggattttacaaacacagctgtcacaactgctactttaaatcatttgttatggtttaaaatgtataatccccaagaaattgatcattactgcaattcaatgctgatttttcagtgccttaccaattttgaggtttgcatcagcctagtagcgaacaaaagtcagtcataaagtacacaactaatggcttatctctcagggatatcttctctccccttttcaacatgattttatttttttcccactgacatttctgcttgtgactaaagcaggtgcacactgaccttccatgttcagttttccccccatttcctaacatttttgcatttcatggttggctgttcctactcagcattgcctgataatacttgcttgtgaagttctatgcaactgagaccaccatttgatccccagtcttttccaatactgtgccagatttacgttccaattggcatctgtactaactcgtccatgaagtttccctaactattctaatggaaatcaacaaaataactgggagagatcttcatcgtcacctgaacaatcccaaagatgtaggagagtattataaaacaaaactgaagaaatgcttactgaaaagaactgtgccaggagctagacttctgatgacacacttacacttacttctgaaaccttagcatttaaattagccttactttatcattttcaggatgcttccccaaagtgtgactagtcttgagtgtagtaatttgacttcccaaagtaattgaaggagtctggatattaagaaggaataaatacatgttttcttgtaacccacacaattgtattcatgattttaccttcatgttttatgtatatccaagtgtagtcttcaattaaagaaatcatttatacatgtatataaggatactatatatgcatatgtttgtatgtgatcagtcttaaattttcagagcatgtagtattttctgttaataagatacattcaaaatgctagtgttaattttcaagctcatgaaaaccaacagcatagtaatgaactccttttcctagagaaagcaaactaaataatgctgtttatttgattaccaaaattaattaagaacacaaatctttgccaagttgaaattaacacatcgagggaatttttttctcttgaatttcttcaaatagatctgtgaaataatgcatgtttagttgtgaaagcattatatgttgctaggaaagttatttaggatcttattaatgtctttttatggtagcctatattcattgttctgaaccctttaacagattctaccagaaattcaaaactatttgattaacaagtccttgaattttcttttccctgtatacacatcttaaaatttatgactcaagacagtatctttctagtactttttgagtactttatattttaaaaatattattattccagtgaaaccagtgggttcctgtatattgttgatatttctataggaaaagtgaatggcaaaatctaatttatatttttgtgtttttcaatactcagtacatcaatgacagttctgattactttagagtacaaaacctatctgctttcttagcactttacatacatttaattttgcataaaaggcaaattatacctgaaaacaaaaaggtcatacctaacccatattacaaatactgctctcctctcactatagcatagccttcagctctcagcagaaagcagcttccacataatcagcaagccacaagatggcactactgaacaattagtttatttctagattctctaattagttagtcaagaataacagtattctccttcaaaactgatgtctgtaacttccaatgatttataatatgacaaggaatgagtagtggagaaacttcacaagtctaacattaagtgatcaaggtcactaccttataagtgttacgttgtgatatatgtgatgatgtatatggggtgagaggaccttccatttatttgttctcctgcaagtgtgtaatctctggataattacaagaaagcatcagataaacacaagctgaggtatattatacaaaatggttgaacataaataaactttaatgcactttataggagcattatgccaatattaattaacttttatactgtaatcatgtaatatatgctatttttgaaactatcgtctgaatttaaaatgacttcataataaatgttaaaaatatcagagcacaagggagaactctgaattgttattaatagcaacaatttataattatgtatttttgtatgcattagacataatggttggttattaacctattatgtgattctaagacctagggtttatttttccttcagggatagtgaataacttcttgaaacagcatgttagtatataattggctgacaaaaagctgtgcaattttgaaatgagagtcaatccctgatcgctgattgagaggatatttaaaagaaaaaaaacctttacatcatgaataccagcacttaatgaagttcaagtacttcactaatgtatattcacaaggataaaagtgatatagttcaaatttttcatattatgcatgattaatatttttgctaatatgccaaatgctttatattgcgcagaatagtaataggcacagaatagcagtttgacccatgaataacctcttagaatcaaagaaaggaaagttgtaattcactatgcctacagagaaattcagggatgaccaaataaggtcacaatctggagtacaaggtgaaattcaaatatgggagactactgttcaacctagtatagtccaagagtaattttctgctagagaactatcatataaggcattctgcttaacttacacataataatacaggggaggaatttttctgtaccacagcatgagatatttttgaaaattaacagccataaaataatctctacttataaaaactatatattcattttaatattatcataaatatatgatttgcatttgggctaagactacattattagaaatcattatgattccactaagaaaaaaatttccagaaatattttgtaagtcttgtggttcctgtgattcaagacatattaaaacatttagagtctgttagattaattatgcatcgctcttatcagtgatcattatggaagaaatgaattcaataggaagatacctttgcacagtactacatgcatatacatcaaaagcgtacagtaaatatcttctatttttgtggttttcaattaaaaattgcactgttcatctggactcttcagtggaacacaaattgagactcttaattatattgcataaacaacatctatagcttaacataagcacacaaatataagctagttaataaatttgcttcattttcactgaagtgctttgtgtttatttaaatgttgataacatagttgtgtatgctataaacatatgtacatattttataacatgctatgtccttgccatgatttaattatatttcactttattagttccttggtggctgggtaaatagcaaacctttgacacctatcaatttcctttctttcagggaatccatgaaaagactggttcattggtggctgttaaagtaatgagtgccaggaaggtaatcaataccatgtcctctatgtattctgctcacttacccactgtacagtggataaacaactccaaaatcattggtttgaaattatgatttcatatactagtgagataatccagaataattataggtttgtaatcacagttgttaatgtattacaattactggtttgttatatttccacattaaaaatgcttcactcataccataaattctaaatatttgatattataaaccaactgggaaagtatcttcctctctatttccagttgatgatctattgtcagggaaagcaaaggagatatttcctttaatattatgttaatgctgctctgctctgtcacattttttctccaatcatttcttctgagaattgaggccactagattcccaatgacaggtagaaggaaagaagttgtcagaggagcacatttttcgtatattttctgacagagaagcaagagagaccatttaattggcactgttcctgcgaacattcataaaactgtgctacggttcataatctgtcgtcaaagaagctgtgaattctgcccattttctttagtacttcattttctcaagacagtattaacacaaacataacagaagttaagacatttttatttcattatatctcaaagcaaaaatactcgatagattaggtagcttgacgcagctgctgtaccttacaatgaactgttactttgcaattagtgaagaaactgaagggtacttttgtttggtcagtaaatcttgcaaaccaatgtgagattcaggaaatttgtccatttataaaactcagttcccaaatattccactgctttttaaagtaagattgtataggatacttaatttcttattttaacttaggagctctagagccatattaaatcttagaatatttaaaagtcatggtaggacattagatatttaatatttactgtgtgcatttgtaaaaggaaaataatgcttcactattgcaaaatttcccattaatgtgtcagttacatccattcacataaatttgttcccagtttacacacactataagaaattgaaatttttagattaatactattcgtgcaaagcaagaaagggatgatgttacattcctgtacaatttagtgctaacatagcacaaagtactttggcataagttattgtaagagtgtactacgaggtctaataatatttttcttggtcttttgttcagactcctttgcctgagataggaagacgggtgagagtgaataaataccaaaagtctgttggatggagatacagcgtgagtacttagtcttccttggcaccgccatagtgtttcccttgattttagctttcaattcatcctttgcattatctcttcgtgggctccctctaaactgctcttggtggaaatgatagcatgcatctcttctactattcctatagatttactcatcagagttaaacactgtcatctgtcaaagaagagggcctttacacagtaaattattggctgcaggggaaaaagagtatgtctacagtgcatagagccttcacactggctagcaatgaagaaagagctgactgtgtcaagaattttattttcctaaaattgaccttcacagaatacttttttatatggtgcacaccttcttgagaatcatcagcctctattgcccagttatgataatcacaaacatcattgtatttgagccaaattcatggttgctttttataatgcaaaactaataatagaaagccaaccaagtacccatgctaacattcttcggatatttgttcacaatacgtggacacaggaaggagtatgaaccacgttctccttgcagaattattgatctctctcctatctcaataatcacgggttttagaataagttcaggcatacagaactatatttatcaaaacactttagttttctatcgaaatgttatataagcttaaaacaaaaattattgttcataatatttcatcaatacaatttttctagttttctttcctgcagtcaaataaatgaggttcagttattttcggtctttatgccttcataaatgcagtgacatgtacattaaaataaaaaatgaaaaaaaaagaaaaaaataaccctttctattaatgcaaacatatttggaatctttctaggtatatgaaaaagtccactgccaaataccttcatgatttatctgttatacacaggcttcttttagtttataatatatcataatagtagaaacatattcagaggaagcagctataaccagcttttatagatcaaaaatccaccaaaagttgaagaaatgtaaaacagaattattaggctaattctacttttttcaaaagtttacattaataaaaaattaaattgtccaaaacttctctggtattctttccatattaaaaagagggggttggttgtagcgttggtgaatttacaaagggaattctggcatccttgagctgcctcttgacaaaaagcaggatattcaggccagtctgggatcagctggcacggagccagaaaaccctgtagaatcatattactgggagatgtgtgagagtttgaaattacccacttggcctgatggatattatgtacttgtgtgtttcttacaagctcaacttcccgttaattgagagtggcaaacacactaatgttttccaaacatatctgatcttcatttatttgttttgggagagtttacatttatgtgggaaacccactcttggaagtttttttttttttaagtcatgtcttttgaattctatggttatgttttaggaaaggaacagcattgctagctaatcagttactatctctaaatcagcttgactatttgggctaaaaagtgtgttagctgcacatacgtagatcttctatgaagacaggacggtgtgcctatcttctacggtatttttaaagtaaatggaatcctggggagagaaatgagtttcttactatggggagtcaatggtaaaaagggaagtataccaatactcagagttggtgttctttcctggctaaggtcaaattctcttttgataaagttgttcctttaaactttgcttttcaccttagtgatctcatctaatcaggtggattcaatgatcaataaattggtaattcttaaaaatgaatagttcaacatcagtcctcaccctgtaagcatcagacccatatatccattaattataattttatgctgcttccaaatgatatacaagggttcactgctataggtaaatgtgttttatgtactaatataaaaattgaaagaaaaaggcaattctttagattaaaataaatgccacatatgcatttctgtagctattgtatgtatcccatgttgcatatgtgtattgtgtatttctcacgttagtctctagctacttcattagcatacacaactctgacagaatgtgtactccgaccttttaacaagagtctgtgcaataatcagagagactaaatcattacatggtttactacatagacatgaggtacacctgttatgattaggcaaacgaaattttattataaacttactttagaaaattaacatcaaatgatcccatacctttaaaatgtattaaaggctaatcacaacattctactactagctctataaatgtacaagaaaaaaaggactgaaaagtggatcaaatgtctaaacataagagccaaaactataaaatgcctagaaaataacgtagagctaaatgtctgtaattttgatttaatggtgaatacttagataggaaacaaaaggcactaactatagaacaataataagttggactttataaaaagtaaaaatgtgtgtgccctaaagaacacatggaagattaggacaactcacagaataagagaagatacttataagtcaatatgcatatatatatatatatatatatatatatatatatatatatatatatatatatatacatacatacatatatgtatatacatacatatatgtgtgtgtgtgtgtgtgtgtatttttctaatacacacacacacacacacacacacacactagctaataagaaattgatattcttccccggagattataaaccacatgatattgtctctgcactatctaagaacagatataatgactactggtgaatttggagcagtcaaaacttcctatatatgtctattggaaggagaaatgatgcaatggctgttgaaaatgagtttggctttttatcacaatattcaacatcccagattcttccgaatgaacttcaaacacatacattaagaaagttgacatgaatgcttatagaaacattattcacagtgcccatcatttgattgtaaaccaaaatcaatgaaacactaatattttatgaatcgctatttcatgtataaacctcaaaaatagctagtctgaaaagaatacatattataaaataccatttatatactttggatagaatataaattagtgctttttaagatgagtgtggtagaattagaggtaagctatagtttcaattgagaggaaatatgttctgtgattgactgtgataatattaatatatagctatgtaatttaaacagtagggcattataattgaagttactgaagtatacagtatatgaattatatttcaatggaattataaaaattattacaccatttattaactaatttcttaaggtctggtgctgctgttcttgggtcacattataagaacttctgaattaagagatctttcatttactctttccttttgctccttttataaaaagatttccattaacttttaatcctataagattttcttttgtatacacattatactttagagactcattgccactgatctgtgctcaaaaggaagctttgctttcactctttaggatgaagaagaggatcttaggacggaactcaacctgctgaggaagtactctttccacaaaaacattgtgaccttctatggagcatttttcaagctgaatcctcctggccatcagcaccaactttgggtatgtttttctttgccctggtcttagtctataagaaatgtcaaacacagtgaaggagctatggtgggatatttgccttcctactagaaaccgtaagtcctcaactggtccagatagtatggcaaaatgtattcggactccctgagacagtgtgatgtaagaaatagagagaataacttaaataccagacaaggtgggatggagacagacacaaatgaacactgctaatttaagattcaaattttaaatggtagctttgctgtttttactttttgctggtatccaggtggcttgacaggctagaaaataaatagatgaagataaacttgaattagcacttgacatggacataccatgttttaggcgttttgacatatatgcacttgtgcataaatgcagctaaatggatcattgatttgtcattgcacctggactattatgaatgtcagatcaatgagacataaatttcagtaactaagtggagcctaatataacaaagccatagtcactcgaatttttcccatgctccactatcctagataagtttcagtcaatgataccttgaaaaacagagtacttgggacataaacttgaataatgttttttttaaaggctcttctagtatcagttaaaagttctcttatgttgtacataatgtattttaggaatggggccattgatactatagaaatgcttaccacacattacattgaaattcacatgttagcatgaatcagaatcttctagagaattttctatatcacagtgctggccctctttcacgggcatttacaccatataggtctggaatgtgtgtgaattttgtgtcctctagtaagtccatagatgatacagatgctgctagtttaaaacatcatacttaatatcgataaatttagaaatttctcaaatcaaccttgtttttctcaaatatccaggtaactagaattctctcttttctgaaaataggtgcgattgtattgaatattgttctataaataataatggttacttatttaatatttaggtgtatactgtatttccataaaatattataaaatttacctttcacacaatatgaaaagttattagaaatattgagtcccattatcaaatatattagtactctgctcattcagtcactctagcccattaaaaaatgaaaataaatctagtataaattagctgtaaattcttgtaagatttcccatatccaggcaaactagtctctcaaatatccattcctctcttttctgctcccatcaccattcaggcttcttctcctcacaaattttttccaaggatatttgttcttatttttggggcataaacttgagtgaccttccttataaaaacctatgagtggaggattaattcaaatcctacctgctggtggaacattatgatgtgtttcctggtttaccttcttccacacattctcatcccactgctgcaactttctaaaatggttcatgtttttgtggctccgttgcagatggtaatggagctatgtgcagcaggctcagtcactgatgtagtgaggatgacaagaaatcagagtttaaaagaagactggatcgcttatatctgtcgagaaatccttcaggtaagtagttaaatcaccgttgacttagctcttaaaagaacctagctcttaagatataactttataatactgcatagctaagaattctagacataacctgtgaaaaaggaaatctagaagaccaaactcctgagatcaacaccttgatctcagagtctttgagagtctttgagactctcactactgtgttcaccagatcatggaaatgacatcatggcttgactctatttttaagtgttgaagtattatcatagattaagatgaggactagtcaggagaagtcagtgttctccagtgtggccccaaactctctgcatcctttttaagagacatatatcttcttcgaatataagccccacatttttctttaacttctaacatctagttaggtgaaagcaatgagtttctcggtcagccaaattcgattgttgttcaataggtaagtcattagggtcaccccaaaaagaatattaataaaatgaagagtaccccaaacactgttggaatgctattcttctcatttcgtttgaatgtatttttgataacaatggaactgatcaagagtacagacaattcaccaaatttggattttagttcatcatatataatttctgtgacctttaatcagtttcttgctttccctagctctcattttccttatccataatatgggagaatagcatattccccaaagggattgtgtggcaacttagtaattacttcatctaaatatttagcacaatggcttgcacagaataaaagctcaataaatgtattattaatgcccaactagtttctggcatgatctcactgaagcataatactacatatcatgtcatggtatagccaggtcatggggttctcaatagtgaatgggctggatccaacatggtaagccaacacaaattatacacactttaaaatgaatttccatagtccctcagattctaggcctacaggccgcaccagaaaatattttggactaaacaaatgtttggataagaaatagaacaaagtagttaatagttaagatgtccaggactttactgtcatccctactcagaaatatagaggctataaaggaggataaagtttcccaatctatataaatattacttttcggtgttctttttcttttatgagtattctgatatattttcctttccttatagccaaaagcagtatttctgggaactggctgtagtcattccagcctaaagaattttgtttaaaaaaccaaatgtggaccatttttcttaacaaaagctcaccccccccccccaaagcactttaaagcactaccaaaaaaactgaaaaatgaatatgtatctaggtacttacttgacttttaaaatatgtctgtctgtccagggcttagctcaccttcatgcacaccaagtaattcaccgggacatcaaaggacaaaatgtgctgctgactcatgatgctgaagtcaaaataggtaagttcgttcttgcagagggctagatgaggcagccagctaagacaacggccttgtaacctatcagtaccaatagagttatttggtttttcttgaaacttgtttggcagggaggtggcatgaaagtagaaaaggaaataactaattatttctttgaaattgcagataacctttaaaaacctgtatttagcattatttcttctagattttacccattgctttccctgcatgtatgggatataccagtttatagccttcatgggtatttcttggctcttaaattcggctgttagagagagtaagaacattgagttattatgtaaagataaacttttgtaaagtctagataatgaaaggttacagcaaagaaaaatcctcaaaaatacttgaaatatttcttccttttcttcgatgctttctgaaagactatctaagactattaattttgcttcatttttctttgattccactaaattattcaagctgcttttcagttattttgttcaccatcttccagattcccagaaaccgttataaatttgaaaatctacttcatatttcatccctgtcttattgtttttggaatcaataaccccagtctacttcagcatttttctgtctgtttctcaggataccatactaaatattttcttacaatgtatcccacagaagaataggaaaataaacagttttagagtaaagctaagctatagatagcccagatattagttgtgcctgattcgggacgcatctacagtaaattaacttcaactgggaagctcacttttccttatcagatttgagtttctgacatcatgcatgaggctttaacaggaatgacattgctaagacgtagctcccagtgccgtacatctccagcttagtggcagatccaagctctacttatgccatatgccacatcttagcaaccagtgaaactttatttttaatattcatgataaacatttatccaaacctacattaaatttataacagtactgttgggcctcattccaacataaatagcagctaaagctcatttcccagtattcctggagaagacttcagggtgaagttctctgggccagaaagaaaatttgttatccattgtggcttttgtattgcctttccaagttaaagcaataacttattgagatttgtgttcctgattaattattttgacatatgtagtggattttggagtgagtgcccaagtgagcagaacaaatggacggagaaatagcttcattggtacaccgtactggatggccccagaggtgattcattgtgatgaggacccaaggtgttcctatgattacagagtgagtatgataattccgacagagaggattcaaatttgagaagaaaatgactacatttattttatttttgagatttcttttactcatgtgtatgtatgcctctgtgcaaatgtacacacactttatgtccaggtgccattggaggacagaacacagtgtgcaataccctgtggctggagttaaaaataattagcataccatatgacatggcataccatgtgctagaatgtgaaccctggtcatcatgattaagcaacaagtgctcttaactgctgagccatctctccagccccagctatatctaatttgaatgataaaagaataaaaagtagatcttccttttaaataaacacaatcagaaatagtagcctgtatttccatatgtggtttcagagtatgaataagaataatattttataataatgaagacaaagtagaacattggcactttctcagaatcaggagggaatatctacttcatattgttgtcaacttctttataaaaatatattaggtggtttcaattggaattttaacttccaagaacagaggaatttgtaaacttgttgaaatgaggccaggactggggcctcaagactgtaatatcaactacttaggcagctaagacaggagtattaggcctgcctgagctacaaaatgagtttgaggtcaggtttttatcacaatgaagagtgacaaacagggctgatgatacagatcaggatagaaattctggcattcatgaagccctaaatttaaccagcagttccacacataaagaatgaatgtatagcaaataatccttgtaagttaaaaataaaaataataatatcattacttggtgtactgaagacaatccttggcagttggttcatctcaaaaaccacagaaaatcaatgggatcaaaaacaacaatttgtgctgcatattaacatttctactgaaatgtctatctgaagtgcacatatacacatccatgtatacaaccgtttgttacagcaagttaacagggaaaggagcaaagctccccgtgtgctaaaaagtagaaaaagaaaacttcattcaaccatggcgtcacaagtcttccaaacaattcattgtgatctctttttgtagcacgcaggactcgcggtctcacatagatcagtttacatttcatctctttgccttttcctccaatccgttttgcttgttttatttatttatttatttatttatttatttagttagttagttagttagttagttgtttttggttttttgagacagggtttctctgtgtagccctggctgtcctggaactcactttgtagaccaggctggcctcgagccactgcgcctggctccttttcgcttgtcatgtaaagaaattatttactgagagcctgttgcagttttggaaagctaggaagatgatgagaataaggttatttaactcattttctgcaaggtgcgaagctttatatctgtataaattttaccatcctctaagtattttaaccccttgcttttcctatttaatctcaaaataattagaagaaaccttaagcttgcaatatcttaagaagcaaagttaagctatctgtaagttgaggctctaaaacaagagtaaagttttttttttttaagagtcagccaatacaccactaataaggtgccctttacacttttctagaactgcattttatttaagtatggtctctgtgctcattgcacctgcctgcatgtatgtgtgtaaaagcacacatgtggaattcaaagggcttgcagaactcagttctctcctttcaaaatgtggattctaaagactgaactcacgtccgcaggcctggcggcaaatgtctttacccactgaactatcgaaccagccccttttccttctttgaaaaaccaagtacagctaatactggtgaagacagtttataagagcttcataatgattctaagctccattgattatattccaggagctagtgaaatatgtatctaataattaataagaactatttcaacaaatatagtttatatgtagcataatttatatacattaatgtttaacttataaatgttaggtatctctacatgtctattaaagatatatattttgtgtacatatatgaatatatttatatattatatgtgtgtatgtgtgtactaatgtatgtatatcaatcctatgaagagggtgctattaagaaacattctacattaaatgaaattgagatacaaagaattaaatcacttactctatatcacacataatagatcttaatactaagacttcattatgacaagttatgcaaaatgcatttacctttcactgaacatcattctatgtgaacatatggtacagtgaaattctggctagtcacatactcaaataatgtctttctgtaactttagtctacaatgaagcttcattatagaaacagatgaaatggctgtagaattgatatccaatcccaaccaaaatgatattgagtctcctaatactaatttcccactttaataggcttcttaatatcttctttttagagtgatgtgtggtctgtgggaatcactgctattgaaatggctgaaggggctcctcgtaagtacaaatgcttgatatatttgatgtatttctaagtttgtaagattatactgtataaatctgtctctctggaacatgaccatttgtaacagtcagtgtttagttagccacacatgcatcatatcatgtaccaaaccataaatggtagtttttcaatgatgaccaaatgctttttttttttacaaaccatcctatgtaaatatatatgtcttattcttttatgtttcttgtgtcttatcttcaatgcctacttctctgtccatctcttcaaattcaaaatatgatacttggcattaattttattttaagattttaagtcatagaaggaaaatggattaaaaggcagactcatagtaggaggacaggagagttttgcatagagattgcaaatgacaagtttccttgaaaagatacattagggtcaggagattttgtactcacaaagagacaggccatcctgcctagataagcatcgaaactggctttaatcctaagcatctctagattgcatccctaagaaacatttctctttcaccactatccttcatttctggagtaagaactctgcgtgaaagcaatactcagcaagttaactgtagcagccttctaggttttcataattttcatctcagaagagatagttttccaaaaccacaattatcatatggtgtcttccaagatttaggtaagaaaatgatcatcctttgatcttttatacatcatcagggtctcccagaaaaacagagacgggcagaggaaaagcttatgagggagaagttgctttaacaatagaaaacaaaaccttttggctatcaaggtcttcttcggtttttatgttataggtgggaacttaagcaatataggggtatttacaccaagtctggaagatttacagcagctttcaaacaccataataacatagggcacgagttgaagagatgtgtttcttaggcgctgcctttgtgtatgtgtgtgtgtctctgtgtgtgatagtatgaatcctctgctagaaacaaagcagaatatggacaaaacatcttcctgtacaccagaagaatttaatttcatctgcaccaaatatttccctttttcacattcccctagatattaataaaattattttaatattgttggccatttttctaatagctgtttctttcatattttattaaattgttagatcaggtaatgaaggcacgtcagttacttcttactgtaacttattactgtaatgttgctattaaagtaaattttgctgttagttattatacaattatttatctgttcatctcttagtgtctatttaacaggatatgtgaatgagactgtgggatgagcagcgggctctgcacttagtcttcctgttcgtcctaaccctatctgtttcccttcacagctctgtgtaagcttcagcctctggaagccctttgtgttattctacgggaagccgctcccaaagtcaaatccagtggatggtaaacaggaatttcttaaatatattgatttaggaatttgtatagaaattttcattgatttgatcattcttgtttcaacatttttgttggacagtatttcctgcaatccagtgtcttaggttgaatgtctaaatcgtcagtatttatttaagtcaagatctaggtgattaaccagaaataagcaacatcctccttatgtgtgatgaggatattgtagtgatttttgttaatggacgtgattatcagatgcttctatagcaatgaggtgaagggagcgatgaggcccatatgtgatgtttgtcatggtgcctagacatgcagtcagtaactgtgatgtacatgcagtcagtaactgcggtgtgcagccctattggttacccagttaaattaaacatccacacacttgaagagccgctctgcattgctgcagacctggcaaccatgagaattgtgttttatgaagcttcatccaactacatgtgattagtaagaagtggcaattgttgttcaattattggcatttctttgcttgaattcggtttaactgtttacatagatttagcttgaatctctttgcatgtgctgttttacaagcctgcttcgtactgtttagcaacaccttctttcggaatcacattgagtctcttaattgccatctgattacatgagctttactatgtacctgctgctgaattcatggacatttctagtgttgagtagaaaaatctgttgactcgacttctatttctgaggtttacgtgacatcatcgtatcatgtatattgttaagacgtgggatatttcctaattgaaaagacaatcctagttctaacaagtctttcggaatctttgaccttgaaatcagcacagtagtgggctaagagtagcacagcaattaaatagtgtcattcatctttctatgctccattcttttcaggtcccgtaagttccagaatttcatggaaaattgcatgataaaaaatttcctatttcgtcctacatctggaaacatgcttcttcacccatttgtccatgatataaaaaatgaacgacgtgttgtggagtccttgacaaaacatcttactgggatcattcaaaagagagagaaaaaaggtagagacgacaaagctttgtatctttcagagttggtatcattcagaatcgatataggagcttacatttatttcttgtttttagttttaaagtatttgttaaagaatttggactgcaggggtggcactagagagttggttcagcagatacgaggccctaagttcatgtcccaccacctatgtcatgtggcccaaaactatccctaactccatggcaagtagacatgtagatctgacacatcggggacaatcccagagccttttgccatttcagtttttcagcgctgtatgtcagtaattcattcaattgcctcttttgtgagcatttatctatgaggctagttagctattcccattatacctatcaagtattcatacttataagacctaaagcctcagattcaaatagaattttggattgtggctgtattattttaagtcaacttctaacaaaagaaaggtaagcaactctttgagataactgtgttcgtaactgcaaatttcatgacttagttttgaaatgatttgtatataccatatgaagttcatgtcatgtcctaatcacaaacttgaggtataattaaagaagctcacctatgtacacaaaggtcagctacacttactgatccccacagtgacaagatgattttactcaatggacaggaaaacactgaggaagcactgcagacaaggccctgattgtggaacctgaaaacaatagaaagcaggctaagatcaaatcaaatgtgagaacgactgcaggattacttgtccggtccacaaaattatgtgccctctttataaatggggagctacagggttcgtgtatgtgcctctgatcatgatgttatgggggccagcatcatacaggtcattcttaagtcgctagaggaacatcagccatgatttgctgaaatctagaggtgtaagatttcaaaaaatgttacctatagcaaaagtcccacttcactggtgatttctccacaaatgcaattatagcggccctaggcaatttaatacagggaattggaagagaactctcccatttgtaagatgtcacatttcagtaataacaccacagttgacaggaaaaaatccgaatgcattaaatatattaaatataaaacaagcacaagcagactacttagaacgctgcatgtagattgcccctctcaaggtgggttacgtcagggaaaagcacttaaacaacttcaaggggaagccaaagtgtttatgtcactctaagcttgggatcttacacataactaagcctctcttggagcagacgcaggtccatcagtgagcatatagggtggatcaagtgttcaaggttctacaggtcaaatccataccatcaagtggtccttgtcctttttcttcctttatcccattctgccttttcttgatggcagccatcagattgctaagatttatttcccttaagtccagaaaaattaatagggctgagttatctctactgtgtttcaaaactatgcctagaaacttgtcaacatcaccagcaaagtatgtttgaagagctcccttatttcttaccttcttacccatagtaattcactcttcgtcctgagccatagaaagctgcagtcactaaggtgaaccataagctgttttttcattacttccttttctctttttcacacaaaaggaatacctgtggcctttgaaggagaagaagctgctaaggaacagtacatcacaaggagattcaggtgtgttgggaaaactcataattagacgatagcatgatacctgagacagtagatttaaatactgttgtcttccgctcaagacgacttaatcctatttgatacaaaacaaacaaacaaacaaacaaacaaaacccgccatacttctgcttctatgagatattgtgagaaaacattgtgaatttttgttactattccgaaatgacatagagcaataaaacaatcaagtagaataccaacctacagtaagggtttaattcatcagtggcattatattacctacaggatatttcagacactgcaagaatgagtacagaattatttgctatctttgttggtgggtctatcttttaaaaattaaagcaattctcagacatgacctagttccagcaaacactcatgaaatgccattcttctgtatgcttattttagagggccttcttgcactcctgagcttctcagagtgccaaccagcagcagatgcagaccactcagagtcctgcatggagagccccctcagccaaggtggctacctgatcaagaagacccacaggaccaagaacttcaacaactgcagaaggcagccggagtgttcatgcctctacattctcaggacaatacatccaagcttttcccaaagcaggttgaggtagcaccctatctccgtggggcagctcaggtggtcatgccagtactggtacaggttgaagcaccgccccaagtaagcaaagcagcccagatgctcaagtcactccccactcaggacaacaaagctacttctccagaggtccaggcccccgtagccgaaggacagcaggcccagcatgaggccttagagacagaacagcctaaagatttggaccaggtgccagaagaatttcaggggcaagacagggcacctgaacagccaaggcagggccaggctgctgagcagcagcagatacataatccggttcctgagcagccgccggaggaggatagggagcctgagcaagctgaggtgcaggaagaggctgtggagcctccccaagctgagatcgaggacaaggaacctgaggtagtgcaagtgcacgcccaggtgctcctgcctttactgtcccagaaccgtcacgtgctcttgcctcttcatttggatagacagctgctcattccggtaggggaacaaaatgaagaggtaccacgagcccaggcctgggatctagaggcctcaagggcagttggtgcagtgcaagcgctgatcgagggactatccagggacttgcttcgagcaccaaatgcatttgtcacaaaaccacttggtccgctgcagatcttcttggaaaatttgtctacagacgggttttacactgagccggaaccgacacagaagaaaaagtcgaaagttgctagtctaaggaaagcaatagcaaaacgactaagacccaagaggttcagagcaaaggcattatggcgacttgaagattttgaattctcagatgtagaaaccagcaggagacggcgccaccgtagatgggaggacatctttaatcagcatgaagagcaactgagacgagttgaaaatgtaagagatttttgatattttttcctgagtgaaaactactgggaaaatatgctcgttgttgcttgcatattttcccagaggaaccaaatgaaaccaatattccatgttctaccaaagttttacacttcaaatgaatcattctgaaatctccagataattgtgatcaaaagaggagaaattgctttaatagtacaactaatggtttaatgtatcgctactaaaggagttgtggcttaattaattattagggttttattttgctttgttttacttttctccaattactcccttaaccagtaaatggataacctacaaacacttaaaatttgaaacattcctaatttaaaattccaaagttgcctccattttttatgtttctaacatataactttccgggactacagagctgactccacagataaaagcatttactgctcttgcccaggacgtaggttcaattcctagaaccctacaaggaagctcattacagcctgtagcctgtctcctgtgggtttctgcacacatttggtacacatgattaaagtaggtaaatacacataaattgattttttttcaatttgaagttgcttatttgttatttcttgccatagaacggaggatggcactatttatgtgaattgcattaatttatactttgggattttagaattgaggttaaaataaaaacaaaaactaaggactagagagatggcccagaggttaagagcacatactttcacagggctcaacttcagttttcagtatcacatgacatctaaccatctagaactccagtcctggacaatctattaccctcctctgatctcttcaaaaactgtacacctatacaaataaaacaaaataaaagcaaatacatctcttgtgaaatgaagacaaaactcatatccaaaacactttgaatatacgtgtcatatttataacttgtcttcttaatattcccatgcttttatgtagttgttcaatgatgtgactgcacagaccagggaacaagtagaacttgacttcccatttaagaatagtcaataaaacttcaaagctcccatatgtaggtggataaaatttgacagacttggttgaactttatgtggcactattaatttaacaatgaatagtttataggtttaataagcaaattattaaggtcaatatagattaggaaagcagctgttttctagtaatttccagtattcatttatataaaaggaaatgtaatatgatgattaatcacatctacctaataataactgatgtagtaattacaaatgaacccttcccgaatatctagatatgttataatttgggtttgtgcacatgaagccaattatgtaactggtaacttcctggcacttctacatagaaaggattttaaaaagtgaaaggagagtgagccaaaagggtaaatggacacctccttcccagaatgtaaggagacagaacttgtatgagtctgaaaccatgatctgtggcctgaaataaggcatataacttgctaatgactattctcaatggtctctctaaaccaattagagctaatgggatttgcattattgaacaagacttgtatttatcctggaaatatgcccaatattagcagcagagaacatacttactgtcattgtttttaatatatatgtgagaagctacttcaaaatagaaataagtcagttaataattgttagccatcctatgagcctaagttctcacatagacatcatatccagatatgtgagatatatatatttccttatggaatacataaaggaaataaaattctttatacgacagaaaacatcacagttcttttgaaatacgtgaaatttaattaaaatttatagacatgtctgagtgctttgccataccagtatgtaagacgcatatattttcattataatctgtacgtggaagagataatagtggttgattcatttgattgaacaatttcttaaactccgagagcttaatttaggaggaatggttgggctctatatcacagatcttcttctatttagagcccaattttagagttataggagcttactaaatgtgaaaccgtaggttgtgattatgtgttaatcaagcattaaatcagattcttaatctggatcccaaagataagcttcaggaaaccagcagttaacccccaaactgtatgcaaatgtgtgtctgcattcagttttctgttggcaatctgtacttttccttagattttaaaagggatccttaaccaaaaattattagaaactgctggtttaaataatttttaagtctttggaaatttttcgtcatggttacaaaataagatgattctgttgttcttatcacttgcacactcataatgatttaaatatttatattattttttttgtttcaaaggacagagaagatgactcatcagacaatgatgaagtgtttcattcaattcaggctgaagtccaaatagaaccacacgctgcaaatcctgcaggaaatgaggtaaagttctcagtatgagttgttatgacattaataagtacctagaaaagtgcctcttaaacttaatggtctcaggatccctttataattttaagtatcgagaattctgtaaagcttttccagtatgtcattcactaacttactgaaaattaaaaccaaaaaggtataaatacattgaacataatgagtaaatataaatgaaaaatatttatttttcccaaaattttattatacagatgtcgttttctcccattttcatatccttttaatctgtcttacttaatagaaaacagctggatgttcatatctacgtcataattcaatctgtgaccatatgttgtttttcttgaactatatgtatgagctggcttagtacctagagatggctaaaaaagaggaatttgatataaatttttcagataattgtgactcgtagattttccttcagagtgtccttcaaatacttgtgcatattcattggtaaatgcccaaactataaaaatagaatctaaaatagtccaagtaaaatattgtgtacctccaaaacttcattgtcctgtcttgtactctgaatagagactccacttctacatgatttctaaattcatctattcatcaattggaaaacattacttcgctgtatatatagattcccccaaatgtttacattccattgcacagtatcagaacagcattttaacagcattaccaatgtttaccataaatgtaactgagtattcataagctgtcaaatgttcagtgacaggtactaatttacactttctcattttccactgagagctcatgtttttatcattgctggcaagtagcctcactttgattttttttttcttcagtttccaaacttatttcatttacgatatctagcacatacacatagttcatgcaagaaagcttttcaggaattttttaaatctacgatttcatattaaactgtgagtagctcactgtggaacatagccgtacatgttttacctcggttctctctgcccttgatagactatttatcatagatctaagtcagtctacgattcatcttctcacacacgaaaaattgaatgatgtcagagtgacttcggttttgatgaccacatcaaataatacaatatttacagcatggatatggtggtgtgagttcacttcttatgcacagacagtagcatgatcatgacttggttggtaacagccaacatttcccattcttcttggtcactggaattatttagtatataaataaataaccatgactttcttctagtgatggtggatcacatttgttgcacaccatcagcacaagatacttcacagaagtccacgataaaaaaaaaattgtcaatgcttttgcaatatagttttttagaaactaaatcttgtgtgactaagagtattgaattataaatactaaatatttgcagagggatcaggagttggattgtgttagtcaatgagaatagtcaattgtgtctctgtgttgccttaactcatacccttctaaactaactctacattttctaaggttatcattcacacaaaagtcaatataatttctttgagaaagtatggcataattggtgttccaaatactttttgcctctaagtcaattatactcatccaatgtagtaaaatattcaagaaagagcacatgcatacaatgctggcttacatcaacaaaattacattcctttctgttagcagggcaggcagagccagagtgctgccttatcacatttagtgttagagggctatttttactcccagtaatttttagctatggcccacaataagccatctgacgtgtaataagaagagtatgagtttgaacttaaattctttgctttttgtgggggagaggaggaggatgtgatttgctttctcaagacagggtttctctgtacagaccaggttggccttgaactcagaaatcctccctcctgaatgtgggattaaagtcgtgctgtagcactaataccctgcatgatttcattttgtaaaattttataaaagctattatccttttctgggctagtgattactcaataataaaaagaaaacttttgattacatacatagtttccagagtctactcttatactaaggctctaagaaaccaccaaaaattattgttaattagttctaagattataactataaaaataatttcagtttataaaggttgtgtttttaagttagatatttgggaaatatatgtgaagaattttcaaataaattagtaactcaaaagaatttatgataacgaatttgatcaatcaattgcactgcatctttaaggtccatgagagatctgctcccatgccttgcaaccggaatcgcacacatcgtgtgaaattttctccaaggtatgtgttcctgttttcaaattatttgcaactgtgagattgataaaacaaaattttgtttctgtgacattaatttttgtgtgaaatcaaaatgcagttgtcactaacatcatgaccatttggcaaaattggcttatatttaaaaacctaactttggtgacccaattacaagaccttccagtaacagtgctcatgtttagtccatgtggttcaattcaataattacttaacaattttgagaatgcagaaatagaagtgatcacaataatttatttgataatattcattttgccatagggtttaatacatgtcaggtgacttgtctcacatgtacaacataataaaagagaaatttttgataaatgcagaagctaatgccacagaataggaaagccaaaaagtgttctgtggtcacaatcaaatatatgaatcattgtcctataaataagaatatatatacatatatatatatatatatatatatatacatatatatacacatatgtatatatagtttgattttttttatatatttgcaaaatccttcgtagctgagttaatagatattaactaggctcttttttttttgtttcctcataatagggtttatggacttttttcttttttattagatatttcctttatttacatttcaaatgatatatgtatgaataaatatgcaacatagaaactatttgttgtaattttaatcttcatagcattcttgatttcagtgattttcaaagattatgttctataagtcaggtttcagtttgaaagacaattttcaaaatagaccagactcacagtggagagaactttagtctatgttcattaggtttgtcattgactaaatatttattgaccgttccttatattaagatattaagacagggtcagtgaggtggctcagtaggtgagaagacatcatttcaagcccaatattgacctgagttcagctcccaacatgcacacagtcaaaggagtgaatcaacttccacaagttgactctatgacttccacatatgcaatgtgacattttttttacctctagttgcatgtacacacacacacacacacactgaaaaaaatatgttttaattggtgttccaaacaatttttgcccttaagtaaattaattttgacttactaattataagctcacctagtatagtaaaatattcatgaaaaagcaataagaatgaacataaaatcaaaagtaaagatactgtacaccatgtacagatatacatactgcaaactgtggccagatgatagagaattcatatttaataagcatagccctatgacataatttttttaaaatcttgtgactttatatctttacacaacacctatgggagaaactttttctttctttgggtttggtttgagtttctttcacagatggctttaagagacgaagataaaatttccctatacgcttatcaggatgctaaatacaccaccttccttaaccctgtgctctctgccattttagtgttggtgaggaagagccttctttggaagaagcccagccgcagcagcagcagcagcagcccatgaacatccgaccgaggaattgcctaaatcctcagaattttcaagctcaatcaggtgagtcaagacgggaagtttcaacgtaggcctaatgttaacagcttatatctcagaactatagaagaatttcaagaaggaacgcatgaacatgttaggtaggccaagtagtattaagacaagatgttgatttggggtttgagtgatcagtggggacctctgagaaatggaatccaacatgagataatgcatgaaaccttgagagaccatccttcaactagccaaagtgtattaagctacttttatgacattaagtcaagtaattgtgaggacaacttttccttgtcatttgatttcacctcttgaaagtatgacgagctcaacattacatatcaaaacataaggaaaacattcctaaaatttggcctgatttttttcaaaacaggatttctatgtgaaaatatactttgaaaacaactgtttcattatattaatctcctaaaatggactaaggttttaaaattcaaatattttaatatctagtcttctatagcccttataataaaaacatttaacaaaaatctctatgacaactttttataaataatgtgagagcttggtaaggaaacatcctttagttaagcatatcttgcacacttaaaagtggaaaacgtcagattttatgatccaatgcacaatttttgcatttttcataatgttcacaaatgtataatagttttaacaatctttgaaatagacagcactgtttgattgtaaatgatactgcaatttttgaagctatcttagtattttgcctatgagatgtgaattctctatcacctggccacagtttacagtatgtacatctgtacatagtgtacagtatatttatttacttttgattttgagttcatcatattgcttttttatgaatattttactatactaggtgagttttaaattacaattattttttcaaatattttgaataaagccataagtttgtaatatttcatatgaggtgatgtttctgcaattgaattgcaaaggatgagagagaacagtgagctattgaattaatccactacaaaaatgggagcaattgtgaaatctctgttgttactaatggacttttggcatttcatagactcatcttctgaggaggacagtcctgtgactaggaggaagtcccagtcatcaccgccttattctactattgatcagaagctactgattgatatccacgtaagtttagatcatgatacacttatatgtatttttatcatctaaataggtttgacctattctttctgaccttccaaccttgaggttatggactgaacagatggctcagcacttgtttctctttcagcgacagacaaggattggttttccagaatttatctgatgactcacagtcatctgtaaccccagttctaggagacttaacacccagctctggcatttacatatgcctggcatacacaagatgcacatatatacatagaggcaaccactcatacacgtaaagagttaagagtttaaatgtgtcgtattagcctttataaaaagatcatattgttaggcaagtattcaggatacaaaatttgcaagttaaaattgaaatggggaaagagcaaacagtactgtattttaactttctatcaaagtgtgttgttgaggggtgctgaagatatagcttggtggtagagtgcttgcctagcatactccggtctccaggttcaatcccattaccacacaaaatagaaatacaatatagaggaaagaacattaacaaatggatacatccagactaatctatgaccaagaagtataaatcacattttcaacttttgcttaatagtatttcctagataaggagacaaataacatattagagaaaaatattgtcttctgattgtataagtaaaaggcctccctaaacattttcaatgtgctttcagatcatattatgtaattttcataatatccctattctatcctacatatatctatacctaccatcagaattgtacttgtatttgcttgcttttggaggcatttgaaataatttaagatcatatatggcctatgcagacaaaactgggaaaataacctatgtatttcaagagctatgccctaatctcagtgttaggataaaacaaaaggaaataactgactttatctagagcatactgcctgacatcaaaagcaaatgtctactcctcagcaggcaagtagggttaataaaacagtgagttaattgtgctgtgtgatctataatgtccactaataactactgaagtttgggtttgggcaactcatttcactaaaattttttctcgatataataggtggacatctctttcaataaagaatataatattaacttgttttaaaatgtcattttggaaagttctgctacccaaatataaaaaaggagagaaacttttagagactaccttaccttttcttgtgcacacaggttccagatggatttaaagtggggaaaatatcacctcctgtgtacttgacaaatgaatgggtaggctataatgcactctctgaaatcttctgggatgactggataatgcctacacgtcccgctcggccacctgaagaagatggtgattatgttgaactctatgatgctgatgccaatgctaatggtgatgaagaagttgcaaacggtgcttatgaagatcctcgtgatggtgccaatggccatgatgacatgaataaccagcttgatcaagcaaatggttatgaaggccatggtgctgctggctacaatggtggagacgttggtggtaatcatggtgctgctttcaatgggccaaggttggttcatctctcttattacacagtagatgcttataaactcagaacgattggcatatttggtttatttcaaaatgtagcataacatttgagaattaatgaattgtacttgcatagtggtgaatgttccatattataattttaaatgttctaagttagaatacttagttctgattttaatatttatatattataaaatgcatatacaatttatagttatttattagactgtatgagatttctcttaaaattaatcccactaaatctccttcccctataaaatcacaattaaaaatatgtcaaaagaatgagggattctactactatttgcaagcatagttaagcctttctcagagagttgagattttgccatgtatatgatcaacttaattatgatctttattcatttaattgctggagaagttacaaaaagatcttccagatttctcccaaaataaataatctataaaaagttccattttcacacagtttttcttttatgatcacaatagggacatatttttaatagtgtattccatgcataacaaggtactagcatgtaaaaaagagtatttataaacactgattatgtgactctcttacttatcctctaacatttgaagcctatattacatgtactttctgatgagagtagttgaccaatgtgtctatagcagagctgtttgtatatatgtaaatgaatgaaagcatatgttcaaattaacataatataaaatactgaaagattctaatattattatggggttgatcattaaatgtgactaaaatttattagtgaattatctatttgagaaaattagcattttctgtagctacccagttatgtgtacctaacaacataaaatgtagttcttttcctctgtttccacaatgatgacgcagacttaacagtcttaaatcattatttagtataggcaaagcattggggactttttcatgtctgtatgcaaccaaaagcattcacaaaaagcaaaaacattcctgaacatggtgtgtgtgtgtgtgtgtgtgtgtgtgtgtgtgtgtgtgtgtgtgaatttttctctttttctttccttttgtggccttgatttgtgtttgtattaaatggccttctttcattaatttctccttgttatcagagcaaattatcccagagcgggaatcttgaaaaacggtcataatgatggacgtgctctaaacaggggagcttttggagtctttggagacaatgcagccagagctttccatggagctgccggtgaagcaggtgcagcctttggaaaccatggagccaataggggcaatggaagaggtaacagaaacagggaggccaatggaaggaatgaagagaatggagcatttggacgggatcaacatgtatttccagagtttgaacatgaggtgatgaacatataatataatgaatatatacttctcttgtaaatgtatgtcaacacatatgtaatattataggtatttaacattgattataaccttttttctcaaatcctgaaattatttaaattataagtgtataggatctttactacatacaatgtgatggttcctacgtacttccaagggagacaatctgatttattttgtcattttatgtcagattatacacttggtatagtatttcaaggagatggcaagattctttatagctgtagaatacaaatactgaaatttttcatttgaagtctgtaaatcactaacatttttggacatggacaatattatgcaaccatatgtatttgtatagcacataaagggatggctttcatgatggcattttcccacatcctttgtctttattgcttttcctcttctttcccttcctcttcccctcaattatatccagtttgcctccatttaactctcaagtcatgtgtattctcttgacacatttcccccattactcttccttaaaatctttctccctctcattcataatcatttctagttctatactatccacacacatatatgtatgtatttgcatgtgtataaattaaaacctaggacctgtgtgtgtatcataaagaataggaaatacacttctgagtagaattgtacccattaatataataatttccacacacagacaatacattgaaattttcatgatttcatttttctttgtggctgaatataattctgttgtgtatatgtacatagcacatttttgttttccacttccgctgctagacatctaggcctatacatttttatcttcccgaataattaactcccaattcttcccctgattattcagtcccctccacagataaaatatagtattgccacgttcggaggcttttatcattaagtgcctactccttaaaaggaaacatgcaaaacttagagtgaaatacgcttactctaagatttttataatttggatttgttttgctttgttttgttttccatcttttgtttgatcatttgtccccatgtctccagaggttcttcttgctctcagttttcctaagccatgtattttttttttggtgtgttttgttctcttgtgtttgttttgttactgttttaggatcagagtctatctctgtaggcccaccctaacctgaaacttgtatagctcaggctggcctaagactctcaaaaacagtcttccatgggccagcattagattctcgtgcctatgccatgagacccagctctgtagatatcttaaactaacaaatgcaatatcctcatgctgtgcttttcttttcaaagtaactatttggcgcatatactttggggtcagagtcttctacttaccagctctctgacccagacaacttttgatttctttaagttttggtttccttataactgaatcagaggcaatggcatgtaccttattgtgttgtagtaactgttcatggagatgcatggttaagggtattagcatagtgcctgatctacttctacaaagattacatcagaaattctacatttggcaatttaatgctccttctagataataaatttacttctcagatgatactgttcaatatttttagtagatatgaaattttaagaatatatatatatatacaaatatatatgtattacagattaaactttcaagtcgctgatagcatttttccaggtatattaaaagttgggtctttggcttccttttaggaatcagatcgtggaactgagacctcagattcaattgccttggagatcacatcctttgatggtgagcaaaacagtggtagaccagtatcatcaacaacaatgggttttcctattggacgctcatctcctagaggttctgattttgggagtgacatctgtgagtatttctgttgtgatctttcaatgctgaatgcttctacttgcttataccataagtcataatgtgtaacgaatcagacatggaatattcatttggtataaatcgagatttatgcatgctttgaaaaaattattcctcagaagataaagtcatttgccaccaagttaagtctaatcccctaaacacacatggtaggagaacagacctaacgtatgtgccttaataataagttaataaggtaaacatacatgtatatttgcatatacacatacgcatactttttccttagatttttggatgtcttgtgtacccaggatggcactgagctcattctatagtacttactggcactgacttcctcatcttcctgggatcacagacccttgctatcctactgacctgtcactcaatctttttggtgactagctttgacctgcaattgagaaatttagtccttcactcaactcttggttttgcactactataaaagccacaaatcacattcatactcagcgttgtattttaaccactataatatatattttctaatgtgttaagaatttgcaaaaacttcatattgttgttccacctatagggttgcagatccctttagctccttgggtattttctctagcttttccattgggagccctgtgttccatccaatagctgactgggagcatccacttctgtgtttgctaggcccaagaatatcccccagtgctcgtgtccctagctgcatatgaatcagaagatggcctagtcggccattagtggaaagagaggcccattggtcttgcaaactttatatgcctaagtacaggggaacgccagggccaagaagtgggaagggggagagtagggggagggcatgggggacttttgggatagcattggaaatgtaaatgaagaaaatacctaatt

SEQ ID NO: 295 - DNA, 96124 bp, mus musculus
cgcaccctgccccggccgctctgcgctctcgccgcggagcacccttctggcttcttcgtctctcggacggacggacgctagagctctcttctccttcccttagccaaacttactttcccgcctcccgaaaaactccagcttccctcttcctcctcccgctcggctctcggctcttttcctctccacttccctctcctctcccgaaccacaaacccaccttcccattcctctctcccatcccatcctcccttcccgggacccccaaaactcttcctccttcacctcagacgcagtcccagcgcgcctgctggacgcggtctcccgcttggttcttctcgaagccatggcaggacctgggagttggagggacaaggaggtgacagatcttggccagttgccggtaagtaaaggactccgggacatcgtcccccttgtgaacttctttctgtggctttgaaagcccggggaagagagcccacaccctcgagtagcctaggccaggacttcgacgggctgtggcttaggatgggccagggaagctgccgtgcagaatcaccatccctgagctcccgactgaggtgaaggccacaaaacgcaaaggaatgggggatgggggggggtgagattggggagaaagaagtgggtcctaaaaaagggtggggccttttctatatagagcccgctttgtctaacagctgtctagcgcatgggtacctgtaatagaagcattccgggaaaggacaagtggcggaccaccccactttccttctttttgccagcagagatctctacctatgggcggagcccccaccccacccccacccctaccgtaaaaaaaaaataatgagcacacacacacacacacaaaatagaagcataggcatcacgcggctcttactttgtaatagtttctaaaactttattctcaccaggagaaggttctggagtaagtactgctggagtgaaaagaactcgacgcctctcagaaaggaacggaattctgtacatgcctattaatttttaaaagtgtatcatctctcttagataatgaaatataactttggtcatagttatcatttgtggggtcttctttttcagtgcccggttgaaattgattggtgggcttctaaagccatcataaacagcagacatactattgtagcaacaccgtgtatttcaacggcatctggtttctcgctgatactggatcccacccaaattcatttttcaagttccctttttagattggcatttcacttgcaccctctcttgaatgcaaagggcccctggattctccaaaggagaaatgagcaggcactgggctggaatgatcgccaagcatgtgtgtagtcagggcagtggcctcctcgccttgagaaaagctaaatattaaccttgaggttataggactattcaaagtcatcttgccttaattaattttgtgtatgtttggcatttaaagatatgtgttgttaatgatggcagatacttgcctccctaaatgcgggacagtcccaaagcctccctttatattttacattagaatggtatgtggtgtggggaggtgatggacatggctaatattctagcaaactgttatcagtcattaaaagaacacacttcaatacaaaactgttgaatagcaagtattaaaattacagttattgcaacttcagaaaataaggccaaagcatttttaaaaattaaactttttttcttcccagatactcctgaaatcacttcttttccaggatgtatggacgagatttctggactatggagacttcaattggattcccttccaccagagcaggacttttcccattcagattaagattgatttgagactgtaaggccaatgagtgagctcgtcccctcctcagcctgctctgggggaagggcggggcgtggtgaaagcacacgtggacgcactgaaatcaactgctgctttctaaaaaaatgacgaagttgagggatttaaaagaccttatagaaatgatagcatggggaatttcaaacccctaaagaacaacaaagggaaaagggaaaggtgtgtttagcccaaagaatggactaaattccctggattagctgacatggccctggctttgggatattctgatctgaggcatgtccatgagataagcatgatctttatattacagctcagtagaatattagtgttctccagattggtggagggtggcggtggttcccaaagagcaagatgagattgacttctaaagttgagacatatggaaaagacacaagaaccatgggtgccaatggtcttttccctcatttttaaatcatcatgaaaggtccagtttaagaaaattctttatttcagaattttataatagatccgtttttatgtactatctgagcaaatgattggtaattctcccctttcccagattcaaattccaagaaaataaatatagctggagagcagcatgcttagagatttaaagacatggtctctgcagtcactggggcataggagggtttttgttttgttctgttgacatttaacatatcctgacgacttcaaaagaaaggaatagagaaattgatagttaatttagtttgccttttgatggcagggagagatgttcaagtaaagaaaatggcctaggcagtgtcccttgtagtaattattctcaataggacacatatgaaggacagaatattattggcatatgtccctggtaagtgtaaccatttgaaaacagctagataatgagaagagattcaaaccttgaaccatcatattgatggtatcctggaggcttgggtgtggcctggcctagcagtagattgagtgctaccatgccgagtccctgggttcaattcccatactatacaggcactcgtcaacatagacatacatttttgcagattatagaaatacaattaaatgtaggtttgagatttgaatattttgtactctttgtggttgtgaaatttaatgaccagcaaccagaaacctttgagagtgcaagcttgtacaagagtataaattggaatttaaagaaaggggtagagatttgaataagaggtagaaggatcatgagtttgaagctagtgtgaactacaaatagcctgggcatcaaagaagatcctcttttatagcacacaataacaaaacagtgataaaaatgcctgtgcaattagatagcattttattattctgatttttattaattttactaatatttattaatataatatcagataaaattagataacattttattcctaaaacattacacagacaagaaaatcacaaagtacataattgtagatggtattgtaatgtaattataaacccttttctataggatcttagagacataaaataagaaggccgatacaattctcagtttactcttggttttgaagacagagactcgtgtagtcctggccaccttctgaactacttatatagctgaccctggccttgggctccttattcttaggctcttattttcttagccctggtactaaagatatgggccaccatataaccatacatgttaataaccggctgtaatttttcccaatttttaagtggatataaattttctataggtgaaaaaaaatacagaggtttgtagtgtatgcttcctttcttagaaaagagaattgcaatgttgtatgggttcatgcatcgttttaaaatagtgtgttttgccttgcttacctatacaaggggtgtacttattatttgtttatttatttatttatttacttattctctattaatgtatgatttattatatatggcctgcataactcaatcctctttatctccagatctagcttgtctgtcactatgattgtcccccaagccttctaatggccacattccttgtggcttcagccttggtatgtgacactgccatgtgtactcctaatctatattagggtcaggattagatagtctttgaaaacagtcgtggccgaggcgatctgaaatagtacatgacccaaacactatatttgaattacattaagtttatatttaaatataccttccagttttcccagccttcactaagaaggcaaaccctgagttcagcttcccactttaccaagtcccttagcggctgtgtggaagccattttgccttcaagtgcccaagctttgaaatatccagcacaccatccattgtaagtagaagagggcctcagcttgacattgtaattcaatttatttttttctgagccacgttccctgtctctaggccagtgtttttttttcccccccataggtttgtgcagagacaacagggtacaagagttgagaatctcctgggtattttaaaagaatcgtctaaggaaattctgattttataatttcatattagccataaagatttatttttaacaggattctctcatggagggaaaatctctgcatggagtatgagctagtaacctataaggacttttcctttctaagctccagttctattgcgaagctcattcttgttactgactgagtttcactctagaacttatcccattagagccgacagtttagagactacccattagttcttttttatatatataaaattacaatttgtaagattaaaaatggggaaggagaatcctgtgccgtctccctctgcgcacttggagtgtttagtccctcctgtgttgtgtaacccggggaacgccttcctcctgtttaagtaaatttaagcccacctggaacttctggctacctttgaccaggtgctgcctttcttcctcctttccgcaggcgcatcttccttgaccagcagacattgcctcctagtggttcttgtgcttccttcttccacacccttaaggaaatcagccagtggggggctcactcttgccttctccctagtcagaaggaaaaaaaaaaaaaaaaaaaaactctcaaattccagtttgcaagggcaactcaattaggatttccatttgaatatatagaagtatttgagaaatgtttttaaaaattgcttaacgagtcctgactcagaaatgactttatttagctccccccaccgccctccattttgagagaagatctagcgattgggtttcttatatacagtacagaataaatgtgtgctgaataaaaataagaaatgagatataaaagctgtgttttaatttaatagatcaacacagttttttccttcttttatcttaatttagttaaaaaaatatattacaaagtgataaagattaacaacaacatcaatactaagttcaatatacttttaagacgtgaaatgtaaaaatgttttattttatttaaagtgagcattaaggtcattaagatggtttttgaatagaaaaataacaagatttctaacaacattgatgaaactaaaataaggcgctgtgatttccacagtccattttctcacttaaaatctgactataagatatgctcattattgatgcacagacacgggatgaagcaaatttctgatcttttttttttaagtttcagagaatcaggctgagtagacaatatgagagttcactaacatatggtatctttatcaatttaaacacagacttataaaaataatagcttaccaataacagttagctaacttgtttaattgttttaagaattaagcagactctgcaagatgctcggcaggtaaatgtgcttgctgacaaacctcgggactggagttcaatccctagaactcacaaggtgaaaggagaaaatggactcctgcacgttgtcctctcacatggcatacctgaatgtgtccatacatgtacagaatgaatgaatgaatgaatgaatgaatgaatgaatgaatgaatgcatttttattggttgtttctcttgaattgctactaaggtaaatgtacttctcaatgatacatttaaaagtactgtactaaaataatcgtgcagaaaagctggttcttagtaactcctttgttgcttaccttttccccataaatctttccgagtgacagcaaaagtcatatactagacagtaaacgtagtctgcgtctcaaattctaaaagctgtcatttaaataacatttttattttgaatagaaaaatacgccctgatctacttgcttctaatcaccacttcattgtgtgattattttaagaaaggattctagattcctgccttgacaatcgttttgtcaatcctgtggagacatctggactttaggatgagagaatctaaatattagagctcagaaatcactgagcataatgccttcatttcacacatgtgataatagaatcctagagtataaatgagttacctagagttgtatagttagttaatagttctggtatgaagagccaagagaatattgatttacctgtgccatgaaaagacactcaaatgatacaaatgtgaatgtaagaaggaatacccacactatattcaggttttacagtataattacataatttcttagtattcttttgtgtgtgtgaaggactctacttaatctaaggacattgttacctattcttttgggaaacaatcgattcgtcacatttttgggctgccttttgttttgtaaattctaaagaaacaatgcagattggaattttttttcaagaaaactgataattttgttctaatttttgtaggatccaactggaatattctcactagataaagccattggtcttggtacttatggaagaatctttttggtaagtggagctaggttacttattcatgcttgattttataataataacagtaattgtgagtcaaatcccaacaatgcaaataaaacactgttaagtgtagtgcattaatctgagaggttaataatgttaaaatatatcatggacatttttaattttttgtttattaatgcaaaagaaaagcattataaaatctgttgaaccagtgaacataagatgtaaaatacatagcaaaaattaaattgttcagttgaaaggagaaaaagtaggatgaaccaaaataataatatcatttattttgtaatacatatcaatgttttagttgtccatattgaactttaagttggatgttttactactgataatcaaagttcataattttccattttagcgcacatgattctataaatgtataaagtttgttgaagaatttctcacgaaataatatatttatttaataattatatattacacattaaaggcgtcccaagaactgtgataatctcttgggatgaattaaagattaaacaaaatatagttcccaattttctgggggttataatattgaaacattacattaaatgtctatatgtatagggacttgtttgagacatatccacatatgtaactaatcacacaaccatataattttgtcacgtattaactctgagaaaatttatagcaatggagatgaataaaacgtggaagtttatttagatgagaggatcattcttggcctagttcctggaaagttaaaaactgatatcaggggtataaatatgaagtgttatggaggatattgatacattttaggggtatgacagtactaacctctggcatgtatttggtcaagcctgcttcttgtaaaatatgataaacttatgcttcctctatcttgtaatattatacaatataaggtctatacacggaagtacttcttattccaagaccttttccttaaaactaatatcactgtccctaggctaattgttactgcccacaggttacaggcatgtttatactgaaagtatagcaatgccctgatataggcctaaaggaaaaaaatctttgttattcagacaagggtaccctctatcaggacttgtctggagcaacatcttcccagtagagcttcttctctaatgtatctgccagcattggtgtaaaatatgcttttaaattttcataccaaagcacagtccacatagcagcaatagcaatgtagccatgtcctaagtgtagaaagaagctactgggagaggagagagagagagagagagagagagagagagagagagagagagagagagaaacagagacagagggagagacagagagagacagacagacagagacagagagagacagacagagagagagacagagagagacagggagagacagagagagagacagagagagagagacagagagagagagagacagagagagagagagacagagagagagacagagagagagagacagagagagagagacagagagagagagacagagagagagagacagagagagatagggagagacagagagagagacaggcagagagagacagacagagagagagagacagagagagagagacaaagagagagacagggagagacagagagagtgatacacacagagagagagagattagagagagagagaccataaaaaggataaacatttcctcttcttcaaatacacattccttcttacacattaagcagagttgattgtctacaaactaataatggcacagagccaattacattgcttacgctgagttttatttcctatttgttaaaattctcagttttgcctttcgatctaatgataaagcaccttatatatggataggaaaatacctttgtataagagacacatttagaagatgggtatagtctataaatatctcaattcctgtgttggtgagtataaatatatgtgtatgtataattcttctgactaagaagtataaaggcttctccatcaccaaagtttggaactaaggtaagaatcaaataaacatttatcacaagggtgatctcctcatcaccagaagaacaaaaaaggaaaaaggtatgttatgcgtggaaatttactttttgaaaaacctctggttctagtatttaaccaataactttcactcacaatgaagacttaaatatagattttatgttagtgtaagtcagtgaatgcctttacacttagatgggtgatatactggattatgttcaattttgcttttacatatcctgcagttgtattttaagcttatttatattgaatttgctcagtgtttctatactcacctctggagggttgccttgtcagctccctcagaccaaataaaataaatgctttttatatcaacttttgcattagccatttctagaattttctttaggaagatctaattttatatctgataggaagagcctaagactgaagaccttgatgttccttgtaatttgaggcttctactaaggaaatccatgacttctccattacttctcaaagatatttacggcaatataaacatgtcactctgttccccctttgtttccatagtttctgaggttgagtgtgtgtgtgtgtgtgtgtgtgtgtgggtgtgtgtgtgtgtgtgtgtgtgtgtgtgtgtgtgtgtgtgtgtgtgtgtttgtgtttcagagatagcccccctctctttcttgccccaccccagtagtattacttcttaccacgttcttgttaaccccatgctgaggctagggggagttctcgcgacttttctctgtcagcctcacgcttagccaaaccctctctctgtctctgacatattccacatcgtttggcttccaaactagttttgacgtctctccagagaggactgtaattcttaccttttacttatctggactcaggaatgaatgggattatttgcctttcatttgaataggggatttattccttaggtagaaaggaattggtgtactttctagtgcttctcagtatgttggtgtctcttcataaactctgtgccatgaatacatggagagatgcctgtatgcttgcttcccaagacttttgcactttcatctaaattcacacttgacttgtcataaatcacctagaatacatgatttcttcatgtgtgctcatatgtatgcctatttccactgtggccatatgtgagcccatgtccaggactgatttagtcttgcaggtggtacctttcttcatccttaaggctcatgggttgctttcacacttctctctagattcaaaagtgtgattttgtatatcatttagcgttttcttactatgagtctaggagtggttctcggttttgatttcgtatcctcatccaaagtgagaagtcaagtaaatttctcttaaatgaatgttcatgaagcaaccattcattgtatggtaggatacatcaacttccaagaattttatatgaatctattcagatctagagatagaaaacgcttttcactgtcagagttttctaaggaaaaactcgttgcaggatattgatgattaaagctctatgtacaacataaatatttctctctgttattcatgacacattttattatacctcagattaacttccttttgcaaaaaagtatattaatactacccccatagaaaacaatacagagcaagttgtaattgatttttaaactgagtatactttttatgctaataattctacctttagaagtttatgataagtactccagattggaagcataaagacactccttgtggtgtagaattagcatatttttggtgaggacatagctcctttgaaccacacagacctaatttggtacttagagctatgaccttaaatcagttatattacctctgactatatttttgttgttgtttataagatagattctgtaagttttgaagaagctttattgaaacaatatttatagaatgtttgacatatagtaggtttcctttaagacatctattactgccattatttttagtattattttcacacaaaaaatgaactaacactggaatggatttttttaaaaaaaggagttaccttatacttactatgccactattttgtaaagcagtatttagtaaaaggtcagaggtatactcaatgtgctaaataacacagtattgctcttacatcatcattatagttatgcctaaatatgcagatgggaaatattgaaataaattcttagattagtaagatattgggtaattttctagtccatagtttttgctagattgtcattccagtctgtgatgttacaaaaacatatctgtgtcttacatagacatgtacatctattttctgttatatattagacattgcagaactaacctataaaacaagatggagataggataccattcgaagttaatgtgagagtgactcacagagcccttcactttttcagtgctgccaaccacatcccctgctgttgtttgttttggttcaagtctctctgatgtcttccagcttggttccaagctctccttctctagcaggtttccagctgtctgctgaggtctgtgcacatggaaccaaagcccgagtctcacgctacctcctaagtcttttcccttccttcttctaattagacacctagcttcccaccctatcccccttcctgccactacaaacttgacttgaaattgtgggcttccttttccttcctcgttcttggagaagtactgctcttccatttccccccaagtagggttagaaatagtagatatcgctttacctttaattcctaggctcatagctaggtgactagtcatttcaattggaaaaatatttaatattggaccaagaaatgacataggtgcaaaaaagaaaatggcttataggctagtaagatggcttagtggctataggatcttgtagcacaagcctgatctgagttcaaccagcagagcccttatgaaggtaggaagaatccaatctacgaagttgttctcctactgtcatatgtacaccatggtacatgaatgatttccacaccccccgctgagaaagggaggcataataacagaaaatcagtgtttcagaagagagatagcaactcattctacaacaatgcaagctaaaactcaaatttctcaaggagagatgtacacagaagtactacagtaatttcatgaaacatgaagtaacagacaaacactctttagagaggaagggtagaaacttgtaacctgaccctcttaacttacactaagcatgccctttaagtcttctgagtatatttgttcaacaataacctcgatacactggacaagagaattgccaaagtttcctgtggctttgagatatagcactgtactactgaatacctgacaccacatatgatgtaagcaagtcctactctcagagtactaatgacaataatcctgtacttcctgaccttcttgcatgctaggtgatggccagctagtggcaattacttggagcatttctctgttttagttcacatacacacaaatattttttagcataattttctgttcccgcctcgatttaccccccacccccgaagtaggcttgagaattagctgagttattattataatatcccttccaaaggtaaaagctggcaccacagatgctaagaatgcaaaagtacattagtatgtggcacaactgggccaaatacagtattagtaaagtgatgcaggcgacaggactttctgaatggacagaatgggtacaatattcatgaacactcacctgacctgctagcatgatgaagtcagtaaaaggaagtggatgagacaaggcagccatttcaagccaaggcaaactcatctgagttaccctacaaatgtatggccatatggagatagttctgaaactgaaacttgccttggttgttgatccttgggagagctgaatagagaaacctgccctttggtaatcagaaggttaatttcaggtaaataagaatgtgccattgtagttctgagcaaatccctgacctgttttcactctggaagtgctacagtgattgtggaaaacttgttttaaaaagctgcctaatgtatggctcttaaattttattttttttacacaatgctgtgcacactgctcctagttgccaagcttaccagacaggtgagatttaggtttgttcgttgcattttctgcatttgaatttggagcaaggaatgggaaaagacaggaaggaaagaaatgtcttcaaagttgatgacatacaatttatgatatttaaaattaatttccaaaaatatggtgctgacatttgagttgcctagccactaggtctattggatgggagagtgaatattttttccttttaggctgaaattatactgtttatttgcctaccaaatgtctagcactgtgaatgctttctttttaggtaggaaagtttcctcacatccttgccattttgcaaatatagctcaattaagtcagccaacaaatatgacttgagtgcccacagagaacacaacactgggtattttatcatacattgcaagcctctcaagcaggagttgaagacgaagattaattgaagccataggcatatcaagctattgtgccttcctaatacaacatcccaattccagagctggccatgactccacctccttcctgtgccacagttccttttggataatatgcctctggtgtaaggattagtctttctcaagtaacacgagactgccccagcataagaaatgttaaaagtgtttattatataaaggcattattttgaatgtttaaaacactcatgatagaaattcccaaaaagttattgaatacatactatgtaccatattctgtgttgagtggaatgtggtaagataaccaaaacctattgggaggctggtttttcaagacagggtttctctgtgtacccctggctgtcctggaattcactttgtagaccaggctggcctcaaactcagaaatctgcctgcctctgcctcctgagttctgggactaaaggcatgcaccaccacgctcggctgggatgcaatttttcttgtcttacttaactgagacccacattagaggaagtaatgatgctaagaggaaggaagaaaaagggataaataagagtgggcaagaggggagaaaatattaatggtatttatttatttatttatctatctaattatttattttgctggctatagaaattataatgagtcaatgaaattctaagaagagtgttattgtcactaagagaacagagctagaatatttgtagtgaggatggtgaaaagaaccggaataggctaaataaaatgagacccaggccacattaacggaaagtactgagtcttaaaggctttggagaaaaggatagctttctatcttggcaatggcacctctcaaactggaaatggaggcaggcctctgaattttagggttgcatgttttctctggtttatcaaagcttatgtatctcaattaatcttgaagaaagaagaagtcattactattatagttaaagaagaacaagtcatgtgtgaatttttcccctaagatcattaatgtagtcaatataatatgtggatatgcaagccttaagcacatgtataaaatcacactcatattcacagagcaaattcagtttaaggcatttcaagtttcaagagtttctgctttgttttagcctttagtagtttcccactaggtcaccattacatgtcattagacacttcataaaatagcccttgcttattgaaacatggaattagaattaagaccgagccctaattggttttagagctgctcaacattctatcatacttgtatactagtctctaagatactattgcgagtggagccaaatgtgtttagaagttaactgtgactctctgaacattgtaaacagaaaattggaagttcttagaaatacattttacacaacaaatgcaatggtaaaaacttacgaagaatcctattagcaaaatcaaataaaaatataaaaaagcaaacaatatacaaacaggtctttatgcttcagtttttatttttctctgcttatctgcacaatattataataaattgcccctctacaaaagcacagggaaaggaaagggaaattagatgtgaattttgtgctattaaataagagaaataatggcaccatggtgtcttatgggtcatttttattataagataagaaaacttctttaagtttgtctttttaggcacagtcccttcatgactagaaaaagaaagctagattgtttggagtcccctgaggcgggaaaaaagattgattatattctaagcactgccagcaacattttgtataaataattaagtctgaagttcaagacagaaagaaagaaagaaagagagagagagagagagagggagggagggagggagggagggagggagggagggagggaggaaggaaggaaggaaggaaggaaggaaggaaggaaggaaggaaggaaggaaggaaggaaggaagagaaagagacagaaaaagcaccatcattatcaaaacttacaggtctatgagtctttggaggacagcttttcttgtctttgagaaaaatactagactttttgatgtaaacattatccacatttagagactgtgacctcaaggtctaaacatttccttagttcttacattgtcactagctcttacttgtcattattgccttgacatctcataagagcactgtgatgtaccttacctatctacacatgacagaagtgaccatggaaagataatgaacaaactgacaaaagcagtgaattagacatttcagaggaaaccccacaattccccagtccctaggtgtgtgctcttagccctactatgttatattcatcttagcatgtccagaccagaaaaaaagcagtctaatagatatcaagtgaacataagtatttgtttcacgaagtgcaaaaataacctcatttacaaaacaaaacaaaacaaaacaaactaagctcaggtcatgatgaagatcattaacaatgtgtccgtggaacacactgttttcttcctgatgagtactaagacatcatttcagaactggatgggaacagataggctttaaaggatgctcagggtcataactgcactcctcctcagactcctagaaagcactccctattgtctggtgcccaaggttctacttatgagtctagggacattttcctcagttactgttcctacttgtcacccccagggaaaaggaaaacactaaagaatcatgtagagttaggccttgtgtataactgatttcttttctttctttctttctttctttctttctttctttctttctttctttttaaagatttatttattatgtatacagcattctgcctgcatgtatgtatgccttcagaccagaagagggcaccagatctcattgtaaatggttatgagccaccatgtagttgctgggaattgaactcaggacatctgaaagagaagatataatgctcttaacttctgagccatctctccagcccaatgactgatttcttttattttttttaatgttttcaattttttaaaagatgtatttatttatttaatatatgtgagtacactgtcactgtcttcagacatgtcaatagagggcatcagatctcaatacagatagttgtcagccactatatggttgcagataattgaacttgagacatctggaagagcaaagtgctcttaacctcatagctacatatccagcccaatgactgattcctttttaaatgctttcatttaaaaaaaatatttatttatttattttctatatgtgagtatattgtcactctcagatcccatacagatggtagtaagttaccatgtggtggttgggaattgaactaaggacctctgcattcataatatgtttctagtagcatgtataaagattagaatgcacaaaacttaagaaccccctttctctgcttctcccagaaaagacaggaaaaacaagcaaacaaaacaaaacaaacaaacaaacaaacaaaaaaaaaacaccagaccatagcttggaaggttagacaggggcagaggatgaaacccatggaagtagacagtaagagtctggcattagagatgtggaggtgagaaccaggtgtgctgtttttaagtgtccttacattgttcctagcagagggggatgcaggtttcaacagaacttaccacttgaggtttccctagtggttaacctctacaagagttttgtaatcagccaaattcttcctaccttgccacaaaatagtattgtgatgacagtgaaatccagccagaaggtttggagtggatgtctaaagagtaattataattagtctttaaaactgctatacaagttctattgaaagcagggattcaagtgtatgtttttttctttattttgacaatcctgaagtgcctaataaagtgcattgcatatggctggcatagaaagtcatcagagataaataaaccaggaaaagtttcctgtcttccttttcaattgtccacatttatgtttccctttatcttaaatattatcatttaacaaagcgatgatttaaataaaaacactgtgcatccagaaagtctattttcatcagttttgtattctctttggaacaagcatggtaactaatatgcatggtgtttagcatattttctattggaactaaatggatgtgtgtagaagtgacctcctctgaaatgacactttattggtagctctctgcagatgtaccttgatggagaagcctaatgacaccctgcaaagccattactagagacagattagttttttcaaattataccagctaagtgactttctattctgacttttatttcaaaagatggtactgtgtagagataaatttttccaaaggatggaaatattagccctgctttttattactctctcctgaatgagtcatttaggacgcctgaaagagtatattttttcttagggtactgtagtttgcagtagtgttgttggcatggctgaataagatggtttcaagagtgcttcataccttcaggaagatgtctagaacatgttcaaatatttcctgacttggaaaattggcagccattagaaagaaaaacacatataaataagaacatacaagttcttgcttcccttcaccttctccccatgctcaccagtttctgaactatcctaaattttattatgctttaaaagaaatttaatggcccaaaatagtaaactttagaagatttagtaggataaatttttttagcagctcttcttctcctccctctgtacctctgtttctgtctctgtcctttactctccctttcctcctttttcccctcgcctctccctcccctccctcccccccccccgtgtgtgtatttatgtatgcttgatttatgaccctttaatacttttaaaacatatcatacttggcattaggtagatatattcagtcctcagttgcgctgagaaatagtcagtgtgaacaaaacggtgtgaactagttgaagcatgaaatagaggagtgatatctgtggagtgtggagtctgtgtttattccaaccggtgcattgtgggaacacgtttgacttctgtctttaacaaaacactactacccctgaaaacacacagatatagaataaattttatgactgttttttaaaggaaattattaaaaatgtttgtgggcacctggtatatatagccttactaaaatagaacatagatgttttctattgcactcaaatccaaatgcctagacttaagagaaagaaattacagaagaacaactcactgtcagcttctgccctaaggctctttagatgggatatgaggccagaactatccagataaaccgaaaccttccagaagtccctccaatgacatgtgtgggtatgtgagttgataggtcaataaatctatgcaagataatgtttataaaacaagaccaaaataattatatccataattctgttggagcatatataagacatcagggataaataaacaaggaactataaaatcggacaatatgtatttcgttaactttttaatttttgagattataattacaataattctcccttcccatttgtcctttacatgctcccatacaaccctcctaccctcacctttgattattgttacatgcatatatgtatacacatgtacgtgtatagtgcttaagataacctgctcagtctggataatggtacttctttgcatttcagctttaaaaggcaaaagacctactcttctgcagcacgcacagtgtctgagtgtgtgtgtgtgtgtgtgtgagagagagagagagagagagagagagagagagagagagagagagcaaagttcaactcagtaaatactagtttcttgggaattatgttgatttttttttcctagactgctacacatttgatagatgtgtgagatgtagcaatcaagacttattccttgagcatgtgtctgtaggtttataggacttgccttctatttgccagaatgagaggtaaactaaacaactttaccaattcctaattgagtctcctgttgaaaagtatccacaagggcaagggctagataacagttagcacttttcagtgttctctgcagaagcattatgccaaaactgattgactacttaattgtgtattttccatttttctttatttaaatattatatttcaaggtcttactgatcaagtagggagttaaaaaaaaaaggacaagcaagcaaaggcatgcgtgttaaaaggacagaaatagaaggatataaggcctttagaagcagagttgccaatttggctcccaaatgcaaaatattcactaaaatttcaatcgaattgaacagagaataattttgagcacagatatgccccaaaggggtatacgtatactacaagcacagttgtccatctgaaattagaatttagctgggcaagtcctgcattttacctgccagctttacctagaaccagctttacctagtcacaaatttattatctggtagccttatattaagaaataagaggggccttgtcttatccatctgctctgatatggtaaggaatgctgaatcagcttaactaaaactgctgccaaagggtggagagggttggtcttctagtcctaaaacagctgctactcctccttgcatatagcaaatgttgtctgtgcttcttttggagctccatggcaaagtgtcttggttggcagctatcagggttcactaggtgagtaattctttcctctgaacggctgagtctagcaaaggagaacatttgcctgctcattctactagagtggaaaagacaatcaaagtcactctgaaccacttggtggctttcttttctcttactgtacaagtagagggttctagactgttgaactcattagttcctgtgcagcttaagtgcacccaatggatgtgagtccaatcacctagtgtgattgtaccaactataaatcaataatgttgattattttctgctgctagaagatcatatattctatgacagagatgaggcaaaccagtcccagaaagattagtgttgtttcgaactcaatctgataaagttcattacttgcattgtgatgtatcgctcttagtgtatatatagcactagatcctttagcttaagaacacatacatagatgccattagtttgtatatagtgtagaatggaggtagactattagcaatgctgcttgcttctagccattacctcccccacttcaaaataccattagcatggtccagagatgttccctcaagtgcagctcacagtctccagaaaaatagtgtacccacagattttataaagatttcaaaaggaggtctcaagttgatgtggcattgcgagctgtgccatgtgggggactgctgagacccagtggaaagaaaaaagaaccctgagtagtgtcatcatctcagcaacataggctggctctcccactactaacagttctctctctcctcaaacttgcttcttcatttaaaagttgagagttcatcactgtaatgtgtagatcaaataagatttctacgtaataaaatcatgataaccttaattgcttacagatattctatatactatgtggaaattaaaccctttactttgtcatagcagcaccattaagtagttttatacgtgttacttgttttttctttacattttgttgtgacattggtgtgtgtttgtattacacatgtggtggtcagaggttgagctgttggaataggctttctctctctaccgtgtagggaatgaatttaggtctgtaggcttgacagcaagcacggttacccattgagccactttttcagccctgtaacttgtgattcttattttatctatgaaatgaaggactggcaaaatgaaataacttacctaaggtcatgcagtaagttgctaagcaagatttgaaacaagacttctttggcatacaaaaagccctcactatgtagtatcaaattatcaggcacttgttaattacaaaaagggagcctcttcctgcctggcaggtgagtgacaaaaggcacagtccttcctggcatctcagaaggggtttatcataaggctccattgcatacaactcacaacctctacaggattcttttttttttctttaatttggtaagtctcaaaaaattgtgccttctagataaagatggagaattaaagaattatctttttagtcacttgatggagccaaattatgttttatggggagcagagggagctatgtgagaaatgatttagttgtttatgatgtgcttgttcagaatggccagtatttaaggattacattttgtcacaaagaacaagcttttttctaaagaataaatttatagattttatgtaaaacatttcaacactaaagtgaccagtgtacaatgtgtttttgaaaccaactagagaagaaataacttaggcatgctattgatattgtgctatacaattttttttaaaaaagctttctttcaaataactagacagtacatatataacttcagagagactaaggctttaaataagagttcttcctaggaagataactgtttcatgaatttaattccatgtcaataactaaaaattaatgccaacacttattttgaatcatctttttataatcatatcattataaccctcataccacaacggaagcacacactttggtatcacacaggtctgaatttaacgttgtttttttttttttttttttttttttttttagttaaatgacctcctgagtggaatgcctagggggtgggtcacttaacttccttgagtctcagctatacaaaacaatggggaacaggcaagatccctatggaatgtagttgttattatccctgaaagaacttgtgaaagtcttttcaccaattctagaaattgtacaaaatgttattgtcactgaagacaggagaaatgatcaaggaattattttctttaatatcaagattcttttggagctacaggcaactaagaaatgctcaaatggaaaacatagtcttccccagggaagaacacagtaaatagctatccaatagcatggggtctccccccccccaaacaaacatgcaagtggcagtatatacagtgagcagattatgtttaggaatacatattatattcatataacaattaatgaaaaaggtagtcatggatttaaggaagagcaagagggacatgtgggaggggttggagagaagaaagaggaagaagtaatataattacaccataatctaaaaaacttaaattaaaaatcactgccccgaaaggtgaagtagttggggaaatatcaaactctactgcaggtcagagtagaaaggactccttagacactataggtctaccattaaattagaaataaaatcctgaagccctcagcagggaaattacataattaaggtcaaataagtaagaatgtaaaccctcattcttttagagaaaaacaaaacaacaacaacaacaacaaaacatgcccctatcctttgctaacttagtcacacatattcaaggcctccagatattggttttcaggtagctatgacgtggagagttgaaggtgaaatagctcacttttcccctgcttccgtaccagactgccaatgattaaaatattaatgcagactgatagcagtagcgcttgttagtacaccagggaagtagaactcttcagaaattagatgtgatgtgaatggttctctgagatcttttgagtggtagccatgagtaaacaatcctaagcaggttattcgacggagccttattgatatccacaacaattcaaggaaaaagcagacgagtcttctgtctttggcacgttactcccatttcctgcaactctcccttggtccatttttgttgttcttttgaatcttctctcttgactctttcctacttagatactactaacagtgcttagtgcagtgaaaaacttccactgccacaaatttcttcagattttttttttgaaagaaactgaagatacgggaaagaaatttgttcctttatacagccattttccaccacatttatttccatatgttctatattattatgtaaaagtttaggtaatttgtcctgggtttattggatgatggtgatttgaatgtagggtagtctgacctgccttggtttaaaatatctgtttacattgctaatgccagatatgcgtggggctaggaggccataatagcaggcgaatgaatgatgtacagtggactaggtttcaggatttcattccttctagagtaacccacaatttgatatgaactaagaaactctttgagcaatgtaagcagagccagtagcaggacttggacgtggatccctctgatggagtgtaatacccttattttttatactgcacaagttctttgattggagtgcacaccaaaatcctctggaggaataatttgcacaaacacatgcccaagatctacatgaaaatttctccactagggaatactgttaagttgagctacagatatgaactggaaatctcagcgagggcttattgatttagtcaggagcttgcaaaccttaagcataagttttgagaaaatagaggtttgactcaatatggtctggttttttaaaatgataggccaagatgatttcctgcagaacattttactgcattcttccatatttatgttactggacactcatgtgctttaggtcttcttaccaggaatcacgtttttatatgcattttataaattaagaaatgcattaagccactgcttaacaatttaaggaatgggattagttctcaccttaatctcaagggaaacaggtccaaggcagggaaattgtttctgatgattgtgtgaaagttaagagggagaattccataacaaggaaagttgctcccaagaaaagcaaagccagatgtagcacctctgtaaaaggaaagagccttaagggctatgtgggaggggtgggggatgaaggcaaactactctttgccagaggttatccaattgcccttgatggagagagcctggttctcttacttttaagggctcaattctctttacttagaatgacccttcactgacccaacttcatttaaatgcaaagaaacaaagaaagactgaaggacataatcctgtccctctaaattagcgtattgaacagctgaatgatatgaccaattcagagaagagacaacatactctgtatattcaaagcaatgttttaaatttatttgtcagttcaagaaaacaggctgcattaagtcaacggagaaacaactttctcaatctctttgcacacgctattttatttgcttacctgaacctcatctagagttatgaggcctttttattctctagtggaaagggaattgacctttggatcaaatattgtgagacttcattgaagtgttcataggctaaggacttaagctgaagaacagagaaaatggggacatggtcatatagatgagactgtcttaaattgactgatgaagagagaaacattaaaattctggttgtggatagaaacagaattgggggaacttctgaaattggtaaccatggcttttactacccccttttaaatctctttccagttatcaataaagcctgcttgtctagatgtcttcagagtacatatagttcagagactatgttccctttaaaatgtggttttgattaatccattcttggatcatccagttggtttttggtcagttaacttgagccttggaactttaatactttttctttttcatatttggccatgtaaaaggaggattaaagcacatatcaaatctaagcagcaggatttaaagcaagccagactcatgaactcttgttcttactcctcccttccgatgttagacatctagtccctacagcatcaccagtgttttcaattaaggaagccagttaaagtggcatgtggaccactttcttaagggaagcccaggagccagtgctaaagtcttggcagataataaaggcaaaattaaaatctagtcactttggatttactggaaatctgctgaaacttctatgaaaccccaagacattaacagcaaccccccccccaatgataaaggaaggagggccacaatgtctttcaaaaaaattttttaatgcccttttacatcctttggaaatctaccatcaaactcacagaatcatagaagtggttactcacttgtgtttctgcttctcttctggctaagccagattcatatattctactttcatatattaattccttttatgttgtcattctctaagtcaggcttcttgattaccaatggcatcagtatcatccagaaacttgttagaaatgcagaaccattccagtaatattgaaacaaacacatctgagattgccaaccgggtgaaacaggaagcttgctttaacagatgttgtcattctgggcttacacctagtgggagagtcattgctgaaaaacatttcttagctgtattccatccttgaaattgctattatcctcccatggtacacataacctacagttatgatcagttcctaaacagaagaaaagcacattttttttcttggaatttcatgatcatttggccaaacttacttaatctctttcccaatctcatgatatatgagatacatactcaaacactcatgcacaacacacacatttgcatatgcaaagatgcagttagaaataaaaaaatatttatcattatttagacatcccaacatcccatgaaaggaaaagtaaattatcttttttttttaacttggaaaatctaaagaaaaagatgaactgggcaaaatttcgcccatgtcaagcataaaagtttccaggttaagttcttagaacacacagatttgatgaagaaatttaaaactctccttcacaataaaaataaattataaaccatgaaagtatgtctttgggcatggataaaagcaaacaccctgactttcctgctcccacaaatccctagaagtttagaaatacacacagcctggttttgattatagaattagttacttttctctgcgtggcatatgtattctgttagtgaattggaaacttaagcaatttgttccttacatcttaatacacagtcgagtagcattttgggacagtcttcacaaagttctttcttggcaagttagtgatggcagcttaatgcactggtttggagtagtgtaacagcattctgcagtaaatttctctgtgatgatggcttagaatgtactaaatgtttctgcagagctttcagatctagaaacctgggcagggtttttcagaaagggcagaagttgacagttgtgatagaaaaagctgtacgttcttgtggtaagatttacaaagagataatttggaggtgatttgaagacttttgttattttcttgtcaaatatattcatccatagttccagtcaactttgtgactccatttaatagtaaataaggtaataagcgaaagaatgtttgtcaaaccacgtgtttgactaaattaatttttggttagcttatgctggctgaatataccattcaaaacacatagcctcaagctactactgatgttttatatattcctagcaagaaactgagtcaatattaacatctgtaagccacatgaatataatattatatttagttaatgagcttcagatgaaacatattcgagtcacagaaagcaccaatccatatgtattctagcatatgtcacttctgtttctcttaaccttcacccacagtgactgagtccagattcactacattctggaacatagtactttaaatggatgtgccacgtgataaagattcttaggttctctcagaggttggcttccagtaattacagggaactgtcattattttgttgttctactctttggaaaagagatcttaagtgaagggaaaagaaaagagagaaagtaaggaaatgcatgtgcaatgaatacagagagaggctgttgcagaggggaagagtccagcaacaggagagcagggtgggaggggagggagtggggagagtaagacaatagcatgcatgaagctgctataatgaaaccagttatttggtacactaacttaaaccaggaataaaaatgaaagcagcattggttggagtcttaatcctctaaaagtacaggcagttgggtaagaaacagaagcataatacagatcctgtgtttcagaatgctcctcatagccagctatgaagcagctggctgtaagcagctcagaagttcaactcttgctgtttgtcagaggattggaagtaatgtatgatagtaaaatgtacaatatccaggcgagaaatgagaaacaaaaaaagcagaacgaaaatcagtctaagaatctaagataataaatagaatagaatagaatagaatagaatagaatagaatagaatagaatagaatagaatagaatagaatagaatagatctttctggccttctgagtgggtggatgaataactgcaatcaggcatcacttaatgacggtgatatgttctgagagaaaagcacatcgtgaatatcttccatggaagaactccacatattatatacatatatcatacattatatacaatgcatattatacatactggatatatattatatatactaataattatggggtcaccttcatatatgtcatccaacattgacagaagcatcatcatgcagcagattaaaactctggcattatatcaatttatagagaactactaattattcttagttaaacttcaattagttaagcccaatcagaaggactcagcatttcctggctgtaggtgttttgttacacaaataactttcaaaacaagtagatctccagcaaaaaaaaaaaaaaaaaaacttttaaaaactatttccatgtatttatggatagacaggtacatacttagctgcatttctcatgtcttgatagatagatagatagatagatagatagatagatagatagatagagacagagatatgtaaaatcaatagtcaagactgacatttgaaaatatgtgaagaggccacattcttggatccacctcatctcccacttttattgctcatatgcttcctcactctccctttttacctccatcatcttttttgtttgaccctattgccctctctattgcccaagctctttgtctcctctcccttccccctcttttcctctctgctcctcatcaacaaatgaactctgatttattagaaaactttcaacaaatgtgggacaagaaaatgcttttcattgtccctctattaagctaaaggtttagtaaaatagaaaattccactaactgataaatccattatcagaactataatatagtaaaacatatatgtatataatataatatgtatataatatgtacaagcataatatataatatgtgatcagatgattacatatatttcttaaaactcataaaaatgtacactaaaagagaagaacttaagaatgtaaattatccttcaataaacctatctagattataacccagtaaatttatgcaattattgtgcatcatggaccaaagcatgagatgtatatctataatctcagaattttggaataaaaggcaggaatacgaggtaggggagggattcgaagacactctaggttacaggagaccctgcagaagagtcagataactcggagatttgctgtgagatagtatcttttatatatgacagagaaattgcatccatgaaatctcaacaatacaatttcttcaactatgataatacaagttgacatatcaatatggatgggggaaatcctacagtgctccagcgctagagctacaggcaattaatgactactgagagagggaggagggtcagtcttctccttgtccaattgcagtggtcaactcaaacatatgtgcatacaagcaacactaaagggatttagctggcgataatcataagcttatatgtgcatgtgcatttatataacattaataatcgaagaataagaggaatttttagagggaggtgtgagaacacaaaggaacttagagggagaagagggaggggaaaatgatgtgcccatatatgaacatattaaaaaattaagaaaaataaagacatgagacaaatgtgtagattaagagtagacaaccaaaatgctaaaaatgtaaaagtctaaagccaatcatggtagtgttcacacctcttcttaggtaacaaataggaagactggaaaggggggttgcttatggccaggagtttaaggcccttttggacattgtagaaagtcccatctctcaaaactaagaaatataatttgataaagaaaagaattgatactgagattccacgtgtataatagcatgcttgaccagtaacagacttcctccaaatggtgccataaggttaccgtcgttttccgtagtttgtttatgtgcgtataaactgaaggggttggattaaaatctcattaagctaaggcggttctccattgaggtgaactgatttgcagggtgatgggggaatagaactgtttaagtgtcagaaagtaaatcatctgtcacaaaacaggtggaatggataatgtcatgtgaaatttgagaaacatctgtttgcctatataacagtgcctgggtcaagatggagccacctggttgaaatgtaggatcaggttgcaaaaatcagaatctggctgacccaggccattttggggcagtgtgaagagaaaaaaaaaagacttatcggtttttacatttttaaagattcttttactttactttctgggagttagttcccatgctagcaggggaggaggaaacatgagttaatgaaaagtcactgtcattttgagggttgtgctcaagagaagagatggcagctaagatgaataagcactacattctgaatactttcctttcttgcttgtgcttggcttgtgcaaatgggtctctttcatctaggggaaggagagaccctgtgtcactgattacatccatgtgcaatgtgaatgcctaatgcatttatgtaattctcttaattatggtttacagaactggatctactttcctaagcatcacacaagcatacacgaaatacgaatcatggtaaaaatgatgatgtcaaaaaggcaataataagaaccaaggcccaagcatattatctttttgaccttggattccgttgctatacatacaaggagtacctataagtaccttgcagaaaagttttccagtgatgagtacacatatttcagtgacttaccaatcatatatagccaatcacatagatcttaaagtgcatcaggtctcctcaacaacacaattgccctcttaactcctgtaactttagcatccttaaaaacaaccctgctatcttcacagtgatttattttcatgctttttcacaaatgtaattaatgtgatgccaattgtggatagtgccatctatgggctggtagtcatgggttctataagagagcaggctgaacaagccaggggaagcaagccagtaagtaacatccctccatgccctctgcatcagctcctgtttcctaacttgcttgagttccagtcctgacatcctttggtgatcaacagcaatgtgaaaagtgtaagctgaataaattctttcctccccaacttacttcttggtcatgatgtttgtgcaagaatagaaaccctgactaagatatagataaacaacaagctttcctatattttgttttttgttttatcttttgtatttagacagtttatttattttgagatactgtctgtataaagaaagaagtggatttttttaaatagtggtatttgttaaactaatttagcctttcaattgactcgtgctgctgctcttgtcaaaaataatgcacgataaatataaagattttaaacttattttgtgtaattgttaatgttagtaattatgcatgttacgaatttggttaatttagtcaccatacaaaatgagatagcaacatactaagtggacttatttgctgtgaaataattactgaaataattttatgctcaagaaaaaaataggtttgtaacatagaatgtaaatatgacgagatgtggtcattcaccgttgcaatgctactactttgaaggccaagcaagtattgccatcagaatgaagctaacacagttggttccagggtagttgggaccatagaggatttgtctcaaaacaaatacatgaaacaaaaacaaagcaaagcagacaacaaccagaaagaaaatgtaattgagtctttgctaaaataaattatgttttttcttttcaacagtttatctgtgaatttggatttaatcaggagctagtttggaaaaatatgtcatcattaggggctttctttaaaaatccacgtttttctcactgattagccactaaaatttcaaacaggaaaagaaaggaagcaagaaaattatcatgcactaattaaacctaatcataagacatttcacaaaacaagatgtacaggaaagttatcacccaaatctaaaaggaagaaaaaaagtattttaaagtctcaggcatactttctccctcgtgattttactttgactgagattatccagagatgtgtttcaaaggagagtgatgggtgacagaatattttggtaccaggatatggatcatttgatgtacaaacaaactatacagagaagaagttggctccaaaatggatgtatttgtggctttgactttcctaagtcaacatttatgaacacaattagtggcagatgttagaactggggtagggagagttgtatttacagcatctttaatgcttctcagcaaatttgctaaacttatttctagtaggcaatataattttgaactatatagtacacagacagaaagcttatactttgttttgaagtcttctgtggttggtttgaaagtaaagtttttcatcattaaaaagattgaatgtagcatgtagcaagagaagttataacccattcattttggggataggcctgggggagaataatatattgtattgatggtatacaaggaaaaataggtactttgtggaatggtacaatagagaagttttatgaaatccaacccaagtcattgcatcatattaattacatttgtataaaagcatgaaaagaaatcattgtgaagacagcagggccatttttagggatgctaaagttacagaagagggcaactgtattgttgaataaatactgttgggggaaactgttgagttgcagcacgctctattcagattaaccatacttcagactgctgggttggctgagcaaacatatatacatatgcaaaattatcattttctatattgtctttctgaggtttagtcaaagtattactttaataaacctatctcattttcatcaggtcgctacagttaatagcagcagccatggtgttatatgtaattgaagttgatcttcaaagttatctttgaactttttctcctctcagagaaaagcaaccttattgtattgtgaattgtataccgcagttcccagtgatagttaataatcagaaagctaagtgaaacacaaaaacatcatttagcatataaaactgcattgtatatgtagttacctcctaaacatggagattttgagacttctatacgtcactgtccaccacacaagtatgtccacttggcaagtttgcaagttaagtccctctgtttcttaggcaaattatcaggtacttgagattcaagttcctagatcctttaaaattaaataaaatattgacatagaatatctgaaactatcgtgtgtaacagttatacaaaaaaatcaaaggcttagaagggaaaaattcaccattttttgaaactgatggcagaggcaattgttaggtacaaagtgtgaagaattaatgtatgcatatagagtgaaacacacatatttatttttctcttagagtttttgattgtgagcctagcctttaatggctgagccatctcaccagccattgaataattctgctgtttcaatttgttggcaaaagtaaacaattgtttctgattgactttctgtaagggaagaaagacttggtcaggacagaattagtatggttcactaagccatttatagaacctagattttgctaacaatagtagatacatttcaacaaatttgaagcaaaacaagccacttacatgagttgcctggctctacacttaactcagtttcctgacattcatcaaatatcaagtaacattgaaaccacaaccctgcccaatgttgttcctttcacagaataaatctttccattctttctcctctcttcttccttcccctttccttctgcatccctttctcccatctcttgtgtcaggaaggcagcttacagatatttgacactttcaccctcctaaatttcccagtgagaggatagaactgtcccctttgactctcccatatagaactccagttttcagtctcctcacctgagatgtttcatgccccccctcccatctctgcttttgaaactgtttcttgtactctctgcacctacgcaatgaaacattttttgcaacattttcgactaaagcaaagtaacactaaaacactgtatctaactcattacctgtgattgttggatgacaatagtgaatttggaggcagtgggaagtagaagctctttctgaggagagaagatttattattgtgagaaaagagggtcattaaggaggcccttgggctcagtcttttgtgtatttccccatgaaggctggattatttgacttgtcatagttcacaattaaataaaggtatacaatacatgacagtaagaacaacccctaaactacagtgttgacagtgactcatgactctaataccagcaaagacccttggagacaaaatacttttgagtcaaatcccagatgtagatttagtgagggttttcttttatttctttttctgtctgttgaagtgaaaatacaggagcacgttccaatagctcttcaggcatgcaacaaatgcttaggcccacacaagaagtgaagccctatgcattgcagtttatgaaaaaagctgtaatttgtcccagcagctaatcagtttggtatatcaataaagaagaatcagaatacagaagtaaaaccatcctaactttgccccctttctttattagaaataaaaaattgtttaggaagaaaataattagtcttgcagtctgatgagcatgcctgtggcaaagtccatagcagaatcttccctttccgttcatcttgccagtgttggtactttaggaaaattcatggaaaaaaaaacctccacttcagtcatatccccctccaaaaaataaattaggctcaaagaattcgtagctttgtgagtattaggtgatacagctttctaacaatgaaagtcaggcgcagttttagaaaaagaaaacactatcagaagccattttgacggtagggttttatctctgctgtgaagtctcaaatgtgcttgctttcctggctcacatttagttctataagcaataagaggtttaatgccctcatcattttaaaagtttattgctctattattaaaatataagaacttgcattcaaagaaatggaaaatatgttctaaagtaagtgaagttaaattagtaaaattacaaggagatattagtgcaatacatccaaagttacaatggaaatctttgaactctgtctcagaatttttatacatgaagttggcaaaattgctgggtacaattaggacatttggtctctttgaactgagatgaattttatcaacaagtagagaaaaaccatttttgtcaggcacacaagggacattttaataacctgattgtatgcttaagtataaagaaaatattatatttcagggatctgtattgtacagaacatactctggctaaattcaatacaatttacaaagcaatgacaaaatgcaacgcaactgcttgtgatatatctggaaatagaacacatgcctctgtctataatttgtaggccaatgactacttaaatataaactcaaaagtatcttgtctgagatccttatctaatccagtagttttttgctggtgacagttaatgcatatcaaataataatacattatagcataattcataaacatttgctgaaggcctgggcaaagtatttctaaaatcattaatataattcatctacttatagggaaattatttaatctacttgcaaaggtggttgtgttcaaatttttggcactattagactatatgtcacatatctggcttgatgaatagtttaaaggtgatatgaaataataacaaaaaggaaagagaagaaaaaccacacagagacaccttggaagactgaaaaatcaacagcagaataggaagggattcatggaatatactttgattctgttgttaattctgtcactggctatgtggactaacaaatttagggattagtagtagtgaagaatataatagaaaaaaaataaaccaatttgaaataggaaagaaaacagtcaaaaattttaacaaggccgcgtcaccctctctgtgcacccatgatacgtataccttcttttctttcatttccaacctgagaatattttcccatcaatatgtgtctcctttagataactgtcacggtctctcagattaccttactttttcagattgccttactaaacttaactaattttcctcaatgattttcttgtttgtggtacccttaaaatatcctgcacagtgtacatgaaaacttctcttgagtcataaacaccctgtccactttagagtcatacacaggtcttttgttaagtttaaacctctaatggtagagttgggagagttaagaatctcctttggagtgggtagattttgaaggcaaagatgatgctttgggctgctatgcccctcccctcccccatcagccagctgtttcaatgctttccttacactggttgctctgcttgatagaatcggagacactgcccctcacatctgtcagaacagatggaatacattctgtgtgagtgttaactgattcgtgcattgcagaaagaaagcagtttatgttaaaacattgtgacattgtggtgaggcattatgtgttctggctagaacctggttgcttataaaagatgtgtttctttgcccttgcccatgctttgatacactgttccacggttaagtccaaagatatcttacaaagaaaggaagaaagaagaaagaaagaaagaaagaaagaaagaaagaaagaaagaaagaaagaaagaaagaaagttggagagaaagaaagatggagaggaaggaaggaaggaaggaaggaaggaaggaaggaaggaaggaaggaaggaaggaaggtcgaaaaaggaacaaaacacccatggaaagagttacagagacaaagtttggagctgagacgaaaggatggaccatctagaaactgccatatccggggatccatcccataataagcttccaaacgctgacaccattgcatacagtagcaagattttgctgaaaggacccagatatagctgtctcttgtgagactttgccggggcctagcaaacacagaagtggatgctcacagtcagctattggatggatcacagggcccccaatggaggagctagagaaagtacccaaggagctaaagagatctgcaaccctataggtggaacaacaatatgaactaaccagtaccccctggagcttgtgtccctagctgcatatgtatcagaagatggcctagtcagccatcagtggaaagagaggcccattggtagtgcaaactttatatgcctcagtataggggaacgccagggccaagaagtgggagtgggtgggtgggggagcatgtgagggacttttgggatggcattggaaatgtaaatgaaataaatacctaattttttaaaaaaggaaaatagtggcagagaagggaagggagaaattccctcttgtatttgtaatgtatattacttccaagaggaaagaaaaagtcacaagcttaaacatgcacacacaagagttatgtaggtaccttttattttatcatgttttcactgtactttaatgaataatgatgcttggaagtgtgagcagtggttttaagagtgtgtaggactgagtagagtatgtcacactttcctcaatatttgaagttctggtttatagactgggactatttttaaagacttgtgtcctctctctctctctctctctctctctctctgtgtatgtctgtgtgtgtctgtgtgtgaatatgccatgaatattcagatgctagcatagaacaaaagatggtgttggatcccctggaactagagtgacaggtgactgtcagccagcctatatgggtgctagaaaccaagcccaggtcctctgaaagagtagccagtattcttagcctctgagctaacttttcatgcctgcgggttatgactttcaatttctattaatggccaacactgaaagttttatgatgccacctacttgtaagaatgaacttcaatggctttgtatttttgtcacctctagacctggcttatggtggagcagtctattgaggacacctcttagttacctagaagccactatccatatatttctagccacacatttttaactttattgtccattttatgcaatttgctgtttgagtgttgtagtgtcagagagagcagctccatttgcaaatgatgttacttcatattttgacctatttttccctgcaggagtaataacaaggataataaaaagtcggttgaagctgctgtataagcacacataactgcctcaaattacagggcagatcctaagctacaaagccactgaaaccgccaaggccctcttccgactatttcacagttgtactaaagcatgaccatgactgtcccagatttttggaagaggaaaaaacattagtctgtctggtgattccggtgcttcgggagctttttacttacaaaatctgcttcactctgaatccatttcctaggctagccaaggttttttgtaattggatggtttgctactgaagaaaggagatgaaacccttggtgtcctcagcacctcacacctctgagctcagtagaaccacaagggatatatagaacgggtatttagtgaaggtttcagtgtagtagcaacactgaggactaggtaatatcccctgacagactaaccttgtgtcagtttggcaagagtcttggcaccacttccttttaataggcccctgccctctgacatggacgagcatgtatctttccaagccttgaggctttctaaccgaagagaattgcatggaactttgagtggcctcacagtgtaaccacagagatgattacagggttgaggaagggaaattcacctactgataattagtgctcttggaattcctggagtaccaagcaacacggcagcatttaacgggctttgtctgaaatctcaagtgtattatagtgcttattaggtgttacgatctctctaaatttgctactaatttgtatgacttaaattatcttgtgttccagcatgacccacgtgtctacactcaccactcggcccattcccttgtgttttagaatcatactgagattaagttcacacctttgctgaatgcctgtaacctgataattaaataaaaataaaaacttcctttaaaaagttgtcatctaggtaaatgattcatttgatagaaggaatgtatggatcccagacacagagtatcaagtgattatataacttaaatttatgttacttaaatacctggagtgtaaattcaccttcattttacacaaagatatgacatgtcttcatagtggcatataagtaacaactgttttataaataatattcataatgtctttaagaaatcttttagaatttttaacagaaacatgactcattatcctcacctttaacttgcaatgcagtatatattgattatagaagttttaaatccaaaggtccaaaatttaaaatactatttattcagtttcaggttccaattgcttctagccacagttatttgcatctgcctattctgggttttctttaacagggtcagggtgggagggatggagagagtgcaagagagaacgagagaaagagagaggggggaggtggagagggagagagggaaagaagaagaagaagaaggaggaggaggaggaggaggaggaggaggaggaggaggaggaggaggaggaggaggaggaggaggaggagagatcacacctaggaagacatttccaatttcgatacacatgactcaataaaaatctttgcagcaatgagatgttcatgcaaatattgaataatagatcctgcataatactccttggccacccttcagtctaatgtaatgatcacagtgtgtgtccatgcaggatactaagatttgtgagaatgcaaacggatatgtcttgataactttgtcatgtattgtcacctatctaatatccgagtttcttaaaacttatttttttttaaaatgaaactcataaattcccttttcttcccaaatgtactacagctccttcttggagagtgtttggcatttcatataagtcctcagttttcaccctctatcttccccatatcatggctggttttgttcatacctcttctgatcactctcaactcatctgtcattttgggcttcctgagctgttttgtgatgacggaaggataagaaggaaacaatagaagccatccatgtaagaaacatcatccttgttaccagtctgaaaggatagttaagaaggggacatgcttagaaggaaagccctcagccagccacttgcttttatgtttctggacagccctgttggtagaagctattctgttagctatggtgtctcaccaagaactcctagatactacttatggctgccctggtggtggccatcaaggatcagttggatctcttgctagggaccaaaacagatgaccaagaacaaagctatgtgagtcaaagcaagctccgcagttatagaatggactcaagtatcgtgagtagctcagtggtcgctctccaccacaaacccaactaaaaagaaagaatgccatggagattgtgtggtttcagtttgccaactaaaagcaaaataaatgactggaggtactctgaaggaatggctgaagagaaggcagtttttccacaacaatttctttaactacatgatataaaaaaaattgtctaatgaaaattacaaggccatcaagaacgatcctatattctttctaggggaaaacatagtaattaactgttgcagaatgatggattttacaaacacagctgtcacaactgctactttaaatcatttgttatggtttaaaatgtataatccccaagaaattgatcattactgcaattcaatgctgatttttcagtgccttaccaattttgaggtttgcatcagcctagtagcgaacaaaagtcagtcataaagtacacaactaatggcttatctctcagggatatcttctctccccttttcaacatgattttatttttttcccactgacatttctgcttgtgactaaagcaggtgcacactgaccttccatgttcagttttccccccatttcctaacatttttgcatttcatggttggctgttcctactcagcattgcctgataatacttgcttgtgaagttctatgcaactgagaccaccatttgatccccagtcttttccaatactgtgccagatttacgttccaattggcatctgtactaactcgtccatgaagtttccctaactattctaatggaaatcaacaaaataactgggagagatcttcatcgtcacctgaacaatcccaaagatgtaggagagtattataaaacaaaactgaagaaatgcttactgaaaagaactgtgccaggagctagacttctgatgacacacttacacttacttctgaaaccttagcatttaaattagccttactttatcattttcaggatgcttccccaaagtgtgactagtcttgagtgtagtaatttgacttcccaaagtaattgaaggagtctggatattaagaaggaataaatacatgttttcttgtaacccacacaattgtattcatgattttaccttcatgttttatgtatatccaagtgtagtcttcaattaaagaaatcatttatacatgtatataaggatactatatatgcatatgtttgtatgtgatcagtcttaaattttcagagcatgtagtattttctgttaataagatacattcaaaatgctagtgttaattttcaagctcatgaaaaccaacagcatagtaatgaactccttttcctagagaaagcaaactaaataatgctgtttatttgattaccaaaattaattaagaacacaaatctttgccaagttgaaattaacacatcgagggaatttttttctcttgaatttcttcaaatagatctgtgaaataatgcatgtttagttgtgaaagcattatatgttgctaggaaagttatttaggatcttattaatgtctttttatggtagcctatattcattgttctgaaccctttaacagattctaccagaaattcaaaactatttgattaacaagtccttgaattttcttttccctgtatacacatcttaaaatttatgactcaagacagtatctttctagtactttttgagtactttatattttaaaaatattattattccagtgaaaccagtgggttcctgtatattgttgatatttctataggaaaagtgaatggcaaaatctaatttatatttttgtgtttttcaatactcagtacatcaatgacagttctgattactttagagtacaaaacctatctgctttcttagcactttacatacatttaattttgcataaaaggcaaattatacctgaaaacaaaaaggtcatacctaacccatattacaaatactgctctcctctcactatagcatagccttcagctctcagcagaaagcagcttccacataatcagcaagccacaagatggcactactgaacaattagtttatttctagattctctaattagttagtcaagaataacagtattctccttcaaaactgatgtctgtaacttccaatgatttataatatgacaaggaatgagtagtggagaaacttcacaagtctaacattaagtgatcaaggtcactaccttataagtgttacgttgtgatatatgtgatgatgtatatggggtgagaggaccttccatttatttgttctcctgcaagtgtgtaatctctggataattacaagaaagcatcagataaacacaagctgaggtatattatacaaaatggttgaacataaataaactttaatgcactttataggagcattatgccaatattaattaacttttatactgtaatcatgtaatatatgctatttttgaaactatcgtctgaatttaaaatgacttcataataaatgttaaaaatatcagagcacaagggagaactctgaattgttattaatagcaacaatttataattatgtatttttgtatgcattagacataatggttggttattaacctattatgtgattctaagacctagggtttatttttccttcagggatagtgaataacttcttgaaacagcatgttagtatataattggctgacaaaaagctgtgcaattttgaaatgagagtcaatccctgatcgctgattgagaggatatttaaaagaaaaaaaacctttacatcatgaataccagcacttaatgaagttcaagtacttcactaatgtatattcacaaggataaaagtgatatagttcaaatttttcatattatgcatgattaatatttttgctaatatgccaaatgctttatattgcgcagaatagtaataggcacagaatagcagtttgacccatgaataacctcttagaatcaaagaaaggaaagttgtaattcactatgcctacagagaaattcagggatgaccaaataaggtcacaatctggagtacaaggtgaaattcaaatatgggagactactgttcaacctagtatagtccaagagtaattttctgctagagaactatcatataaggcattctgcttaacttacacataataatacaggggaggaatttttctgtaccacagcatgagatatttttgaaaattaacagccataaaataatctctacttataaaaactatatattcattttaatattatcataaatatatgatttgcatttgggctaagactacattattagaaatcattatgattccactaagaaaaaaatttccagaaatattttgtaagtcttgtggttcctgtgattcaagacatattaaaacatttagagtctgttagattaattatgcatcgctcttatcagtgatcattatggaagaaatgaattcaataggaagatacctttgcacagtactacatgcatatacatcaaaagcgtacagtaaatatcttctatttttgtggttttcaattaaaaattgcactgttcatctggactcttcagtggaacacaaattgagactcttaattatattgcataaacaacatctatagcttaacataagcacacaaatataagctagttaataaatttgcttcattttcactgaagtgctttgtgtttatttaaatgttgataacatagttgtgtatgctataaacatatgtacatattttataacatgctatgtccttgccatgatttaattatatttcactttattagttccttggtggctgggtaaatagcaaacctttgacacctatcaatttcctttctttcagggaatccatgaaaagactggttcattggtggctgttaaagtaatgagtgccaggaaggtaatcaataccatgtcctctatgtattctgctcacttacccactgtacagtggataaacaactccaaaatcattggtttgaaattatgatttcatatactagtgagataatccagaataattataggtttgtaatcacagttgttaatgtattacaattactggtttgttatatttccacattaaaaatgcttcactcataccataaattctaaatatttgatattataaaccaactgggaaagtatcttcctctctatttccagttgatgatctattgtcagggaaagcaaaggagatatttcctttaatattatgttaatgctgctctgctctgtcacattttttctccaatcatttcttctgagaattgaggccactagattcccaatgacaggtagaaggaaagaagttgtcagaggagcacatttttcgtatattttctgacagagaagcaagagagaccatttaattggcactgttcctgcgaacattcataaaactgtgctacggttcataatctgtcgtcaaagaagctgtgaattctgcccattttctttagtacttcattttctcaagacagtattaacacaaacataacagaagttaagacatttttatttcattatatctcaaagcaaaaatactcgatagattaggtagcttgacgcagctgctgtaccttacaatgaactgttactttgcaattagtgaagaaactgaagggtacttttgtttggtcagtaaatcttgcaaaccaatgtgagattcaggaaatttgtccatttataaaactcagttcccaaatattccactgctttttaaagtaagattgtataggatacttaatttcttattttaacttaggagctctagagccatattaaatcttagaatatttaaaagtcatggtaggacattagatatttaatatttactgtgtgcatttgtaaaaggaaaataatgcttcactattgcaaaatttcccattaatgtgtcagttacatccattcacataaatttgttcccagtttacacacactataagaaattgaaatttttagattaatactattcgtgcaaagcaagaaagggatgatgttacattcctgtacaatttagtgctaacatagcacaaagtactttggcataagttattgtaagagtgtactacgaggtctaataatatttttcttggtcttttgttcagactcctttgcctgagataggaagacgggtgagagtgaataaataccaaaagtctgttggatggagatacagcgtgagtacttagtcttccttggcaccgccatagtgtttcccttgattttagctttcaattcatcctttgcattatctcttcgtgggctccctctaaactgctcttggtggaaatgatagcatgcatctcttctactattcctatagatttactcatcagagttaaacactgtcatctgtcaaagaagagggcctttacacagtaaattattggctgcaggggaaaaagagtatgtctacagtgcatagagccttcacactggctagcaatgaagaaagagctgactgtgtcaagaattttattttcctaaaattgaccttcacagaatacttttttatatggtgcacaccttcttgagaatcatcagcctctattgcccagttatgataatcacaaacatcattgtatttgagccaaattcatggttgctttttataatgcaaaactaataatagaaagccaaccaagtacccatgctaacattcttcggatatttgttcacaatacgtggacacaggaaggagtatgaaccacgttctccttgcagaattattgatctctctcctatctcaataatcacgggttttagaataagttcaggcatacagaactatatttatcaaaacactttagttttctatcgaaatgttatataagcttaaaacaaaaattattgttcataatatttcatcaatacaatttttctagttttctttcctgcagtcaaataaatgaggttcagttattttcggtctttatgccttcataaatgcagtgacatgtacattaaaataaaaaatgaaaaaaaaagaaaaaaataaccctttctattaatgcaaacatatttggaatctttctaggtatatgaaaaagtccactgccaaataccttcatgatttatctgttatacacaggcttcttttagtttataatatatcataatagtagaaacatattcagaggaagcagctataaccagcttttatagatcaaaaatccaccaaaagttgaagaaatgtaaaacagaattattaggctaattctacttttttcaaaagtttacattaataaaaaattaaattgtccaaaacttctctggtattctttccatattaaaaagagggggttggttgtagcgttggtgaatttacaaagggaattctggcatccttgagctgcctcttgacaaaaagcaggatattcaggccagtctgggatcagctggcacggagccagaaaaccctgtagaatcatattactgggagatgtgtgagagtttgaaattacccacttggcctgatggatattatgtacttgtgtgtttcttacaagctcaacttcccgttaattgagagtggcaaacacactaatgttttccaaacatatctgatcttcatttatttgttttgggagagtttacatttatgtgggaaacccactcttggaagtttttttttttttaagtcatgtcttttgaattctatggttatgttttaggaaaggaacagcattgctagctaatcagttactatctctaaatcagcttgactatttgggctaaaaagtgtgttagctgcacatacgtagatcttctatgaagacaggacggtgtgcctatcttctacggtatttttaaagtaaatggaatcctggggagagaaatgagtttcttactatggggagtcaatggtaaaaagggaagtataccaatactcagagttggtgttctttcctggctaaggtcaaattctcttttgataaagttgttcctttaaactttgcttttcaccttagtgatctcatctaatcaggtggattcaatgatcaataaattggtaattcttaaaaatgaatagttcaacatcagtcctcaccctgtaagcatcagacccatatatccattaattataattttatgctgcttccaaatgatatacaagggttcactgctataggtaaatgtgttttatgtactaatataaaaattgaaagaaaaaggcaattctttagattaaaataaatgccacatatgcatttctgtagctattgtatgtatcccatgttgcatatgtgtattgtgtatttctcacgttagtctctagctacttcattagcatacacaactctgacagaatgtgtactccgaccttttaacaagagtctgtgcaataatcagagagactaaatcattacatggtttactacatagacatgaggtacacctgttatgattaggcaaacgaaattttattataaacttactttagaaaattaacatcaaatgatcccatacctttaaaatgtattaaaggctaatcacaacattctactactagctctataaatgtacaagaaaaaaaggactgaaaagtggatcaaatgtctaaacataagagccaaaactataaaatgcctagaaaataacgtagagctaaatgtctgtaattttgatttaatggtgaatacttagataggaaacaaaaggcactaactatagaacaataataagttggactttataaaaagtaaaaatgtgtgtgccctaaagaacacatggaagattaggacaactcacagaataagagaagatacttataagtcaatatgcatatatatatatatatatatatatatatatatatatatatatatatatatatatacatacatacatatatgtatatacatacatatatgtgtgtgtgtgtgtgtgtgtatttttctaatacacacacacacacacacacacacacactagctaataagaaattgatattcttccccggagattataaaccacatgatattgtctctgcactatctaagaacagatataatgactactggtgaatttggagcagtcaaaacttcctatatatgtctattggaaggagaaatgatgcaatggctgttgaaaatgagtttggctttttatcacaatattcaacatcccagattcttccgaatgaacttcaaacacatacattaagaaagttgacatgaatgcttatagaaacattattcacagtgcccatcatttgattgtaaaccaaaatcaatgaaacactaatattttatgaatcgctatttcatgtataaacctcaaaaatagctagtctgaaaagaatacatattataaaataccatttatatactttggatagaatataaattagtgctttttaagatgagtgtggtagaattagaggtaagctatagtttcaattgagaggaaatatgttctgtgattgactgtgataatattaatatatagctatgtaatttaaacagtagggcattataattgaagttactgaagtatacagtatatgaattatatttcaatggaattataaaaattattacaccatttattaactaatttcttaaggtctggtgctgctgttcttgggtcacattataagaacttctgaattaagagatctttcatttactctttccttttgctccttttataaaaagatttccattaacttttaatcctataagattttcttttgtatacacattatactttagagactcattgccactgatctgtgctcaaaaggaagctttgctttcactctttaggatgaagaagaggatcttaggacggaactcaacctgctgaggaagtactctttccacaaaaacattgtgaccttctatggagcatttttcaagctgaatcctcctggccatcagcaccaactttgggtatgtttttctttgccctggtcttagtctataagaaatgtcaaacacagtgaaggagctatggtgggatatttgccttcctactagaaaccgtaagtcctcaactggtccagatagtatggcaaaatgtattcggactccctgagacagtgtgatgtaagaaatagagagaataacttaaataccagacaaggtgggatggagacagacacaaatgaacactgctaatttaagattcaaattttaaatggtagctttgctgtttttactttttgctggtatccaggtggcttgacaggctagaaaataaatagatgaagataaacttgaattagcacttgacatggacataccatgttttaggcgttttgacatatatgcacttgtgcataaatgcagctaaatggatcattgatttgtcattgcacctggactattatgaatgtcagatcaatgagacataaatttcagtaactaagtggagcctaatataacaaagccatagtcactcgaatttttcccatgctccactatcctagataagtttcagtcaatgataccttgaaaaacagagtacttgggacataaacttgaataatgttttttttaaaggctcttctagtatcagttaaaagttctcttatgttgtacataatgtattttaggaatggggccattgatactatagaaatgcttaccacacattacattgaaattcacatgttagcatgaatcagaatcttctagagaattttctatatcacagtgctggccctctttcacgggcatttacaccatataggtctggaatgtgtgtgaattttgtgtcctctagtaagtccatagatgatacagatgctgctagtttaaaacatcatacttaatatcgataaatttagaaatttctcaaatcaaccttgtttttctcaaatatccaggtaactagaattctctcttttctgaaaataggtgcgattgtattgaatattgttctataaataataatggttacttatttaatatttaggtgtatactgtatttccataaaatattataaaatttacctttcacacaatatgaaaagttattagaaatattgagtcccattatcaaatatattagtactctgctcattcagtcactctagcccattaaaaaatgaaaataaatctagtataaattagctgtaaattcttgtaagatttcccatatccaggcaaactagtctctcaaatatccattcctctcttttctgctcccatcaccattcaggcttcttctcctcacaaattttttccaaggatatttgttcttatttttggggcataaacttgagtgaccttccttataaaaacctatgagtggaggattaattcaaatcctacctgctggtggaacattatgatgtgtttcctggtttaccttcttccacacattctcatcccactgctgcaactttctaaaatggttcatgtttttgtggctccgttgcagatggtaatggagctatgtgcagcaggctcagtcactgatgtagtgaggatgacaagaaatcagagtttaaaagaagactggatcgcttatatctgtcgagaaatccttcaggtaagtagttaaatcaccgttgacttagctcttaaaagaacctagctcttaagatataactttataatactgcatagctaagaattctagacataacctgtgaaaaaggaaatctagaagaccaaactcctgagatcaacaccttgatctcagagtctttgagagtctttgagactctcactactgtgttcaccagatcatggaaatgacatcatggcttgactctatttttaagtgttgaagtattatcatagattaagatgaggactagtcaggagaagtcagtgttctccagtgtggccccaaactctctgcatcctttttaagagacatatatcttcttcgaatataagccccacatttttctttaacttctaacatctagttaggtgaaagcaatgagtttctcggtcagccaaattcgattgttgttcaataggtaagtcattagggtcaccccaaaaagaatattaataaaatgaagagtaccccaaacactgttggaatgctattcttctcatttcgtttgaatgtatttttgataacaatggaactgatcaagagtacagacaattcaccaaatttggattttagttcatcatatataatttctgtgacctttaatcagtttcttgctttccctagctctcattttccttatccataatatgggagaatagcatattccccaaagggattgtgtggcaacttagtaattacttcatctaaatatttagcacaatggcttgcacagaataaaagctcaataaatgtattattaatgcccaactagtttctggcatgatctcactgaagcataatactacatatcatgtcatggtatagccaggtcatggggttctcaatagtgaatgggctggatccaacatggtaagccaacacaaattatacacactttaaaatgaatttccatagtccctcagattctaggcctacaggccgcaccagaaaatattttggactaaacaaatgtttggataagaaatagaacaaagtagttaatagttaagatgtccaggactttactgtcatccctactcagaaatatagaggctataaaggaggataaagtttcccaatctatataaatattacttttcggtgttctttttcttttatgagtattctgatatattttcctttccttatagccaaaagcagtatttctgggaactggctgtagtcattccagcctaaagaattttgtttaaaaaaccaaatgtggaccatttttcttaacaaaagctcaccccccccccccaaagcactttaaagcactaccaaaaaaactgaaaaatgaatatgtatctaggtacttacttgacttttaaaatatgtctgtctgtccagggcttagctcaccttcatgcacaccaagtaattcaccgggacatcaaaggacaaaatgtgctgctgactcatgatgctgaagtcaaaataggtaagttcgttcttgcagagggctagatgaggcagccagctaagacaacggccttgtaacctatcagtaccaatagagttatttggtttttcttgaaacttgtttggcagggaggtggcatgaaagtagaaaaggaaataactaattatttctttgaaattgcagataacctttaaaaacctgtatttagcattatttcttctagattttacccattgctttccctgcatgtatgggatataccagtttatagccttcatgggtatttcttggctcttaaattcggctgttagagagagtaagaacattgagttattatgtaaagataaacttttgtaaagtctagataatgaaaggttacagcaaagaaaaatcctcaaaaatacttgaaatatttcttccttttcttcgatgctttctgaaagactatctaagactattaattttgcttcatttttctttgattccactaaattattcaagctgcttttcagttattttgttcaccatcttccagattcccagaaaccgttataaatttgaaaatctacttcatatttcatccctgtcttattgtttttggaatcaataaccccagtctacttcagcatttttctgtctgtttctcaggataccatactaaatattttcttacaatgtatcccacagaagaataggaaaataaacagttttagagtaaagctaagctatagatagcccagatattagttgtgcctgattcgggacgcatctacagtaaattaacttcaactgggaagctcacttttccttatcagatttgagtttctgacatcatgcatgaggctttaacaggaatgacattgctaagacgtagctcccagtgccgtacatctccagcttagtggcagatccaagctctacttatgccatatgccacatcttagcaaccagtgaaactttatttttaatattcatgataaacatttatccaaacctacattaaatttataacagtactgttgggcctcattccaacataaatagcagctaaagctcatttcccagtattcctggagaagacttcagggtgaagttctctgggccagaaagaaaatttgttatccattgtggcttttgtattgcctttccaagttaaagcaataacttattgagatttgtgttcctgattaattattttgacatatgtagtggattttggagtgagtgcccaagtgagcagaacaaatggacggagaaatagcttcattggtacaccgtactggatggccccagaggtgattcattgtgatgaggacccaaggtgttcctatgattacagagtgagtatgataattccgacagagaggattcaaatttgagaagaaaatgactacatttattttatttttgagatttcttttactcatgtgtatgtatgcctctgtgcaaatgtacacacactttatgtccaggtgccattggaggacagaacacagtgtgcaataccctgtggctggagttaaaaataattagcataccatatgacatggcataccatgtgctagaatgtgaaccctggtcatcatgattaagcaacaagtgctcttaactgctgagccatctctccagccccagctatatctaatttgaatgataaaagaataaaaagtagatcttccttttaaataaacacaatcagaaatagtagcctgtatttccatatgtggtttcagagtatgaataagaataatattttataataatgaagacaaagtagaacattggcactttctcagaatcaggagggaatatctacttcatattgttgtcaacttctttataaaaatatattaggtggtttcaattggaattttaacttccaagaacagaggaatttgtaaacttgttgaaatgaggccaggactggggcctcaagactgtaatatcaactacttaggcagctaagacaggagtattaggcctgcctgagctacaaaatgagtttgaggtcaggtttttatcacaatgaagagtgacaaacagggctgatgatacagatcaggatagaaattctggcattcatgaagccctaaatttaaccagcagttccacacataaagaatgaatgtatagcaaataatccttgtaagttaaaaataaaaataataatatcattacttggtgtactgaagacaatccttggcagttggttcatctcaaaaaccacagaaaatcaatgggatcaaaaacaacaatttgtgctgcatattaacatttctactgaaatgtctatctgaagtgcacatatacacatccatgtatacaaccgtttgttacagcaagttaacagggaaaggagcaaagctccccgtgtgctaaaaagtagaaaaagaaaacttcattcaaccatggcgtcacaagtcttccaaacaattcattgtgatctctttttgtagcacgcaggactcgcggtctcacatagatcagtttacatttcatctctttgccttttcctccaatccgttttgcttgttttatttatttatttatttatttatttatttagttagttagttagttagttagttgtttttggttttttgagacagggtttctctgtgtagccctggctgtcctggaactcactttgtagaccaggctggcctcgagccactgcgcctggctccttttcgcttgtcatgtaaagaaattatttactgagagcctgttgcagttttggaaagctaggaagatgatgagaataaggttatttaactcattttctgcaaggtgcgaagctttatatctgtataaattttaccatcctctaagtattttaaccccttgcttttcctatttaatctcaaaataattagaagaaaccttaagcttgcaatatcttaagaagcaaagttaagctatctgtaagttgaggctctaaaacaagagtaaagttttttttttttaagagtcagccaatacaccactaataaggtgccctttacacttttctagaactgcattttatttaagtatggtctctgtgctcattgcacctgcctgcatgtatgtgtgtaaaagcacacatgtggaattcaaagggcttgcagaactcagttctctcctttcaaaatgtggattctaaagactgaactcacgtccgcaggcctggcggcaaatgtctttacccactgaactatcgaaccagccccttttccttctttgaaaaaccaagtacagctaatactggtgaagacagtttataagagcttcataatgattctaagctccattgattatattccaggagctagtgaaatatgtatctaataattaataagaactatttcaacaaatatagtttatatgtagcataatttatatacattaatgtttaacttataaatgttaggtatctctacatgtctattaaagatatatattttgtgtacatatatgaatatatttatatattatatgtgtgtatgtgtgtactaatgtatgtatatcaatcctatgaagagggtgctattaagaaacattctacattaaatgaaattgagatacaaagaattaaatcacttactctatatcacacataatagatcttaatactaagacttcattatgacaagttatgcaaaatgcatttacctttcactgaacatcattctatgtgaacatatggtacagtgaaattctggctagtcacatactcaaataatgtctttctgtaactttagtctacaatgaagcttcattatagaaacagatgaaatggctgtagaattgatatccaatcccaaccaaaatgatattgagtctcctaatactaatttcccactttaataggcttcttaatatcttctttttagagtgatgtgtggtctgtgggaatcactgctattgaaatggctgaaggggctcctcgtaagtacaaatgcttgatatatttgatgtatttctaagtttgtaagattatactgtataaatctgtctctctggaacatgaccatttgtaacagtcagtgtttagttagccacacatgcatcatatcatgtaccaaaccataaatggtagtttttcaatgatgaccaaatgctttttttttttacaaaccatcctatgtaaatatatatgtcttattcttttatgtttcttgtgtcttatcttcaatgcctacttctctgtccatctcttcaaattcaaaatatgatacttggcattaattttattttaagattttaagtcatagaaggaaaatggattaaaaggcagactcatagtaggaggacaggagagttttgcatagagattgcaaatgacaagtttccttgaaaagatacattagggtcaggagattttgtactcacaaagagacaggccatcctgcctagataagcatcgaaactggctttaatcctaagcatctctagattgcatccctaagaaacatttctctttcaccactatccttcatttctggagtaagaactctgcgtgaaagcaatactcagcaagttaactgtagcagccttctaggttttcataattttcatctcagaagagatagttttccaaaaccacaattatcatatggtgtcttccaagatttaggtaagaaaatgatcatcctttgatcttttatacatcatcagggtctcccagaaaaacagagacgggcagaggaaaagcttatgagggagaagttgctttaacaatagaaaacaaaaccttttggctatcaaggtcttcttcggtttttatgttataggtgggaacttaagcaatataggggtatttacaccaagtctggaagatttacagcagctttcaaacaccataataacatagggcacgagttgaagagatgtgtttcttaggcgctgcctttgtgtatgtgtgtgtgtctctgtgtgtgatagtatgaatcctctgctagaaacaaagcagaatatggacaaaacatcttcctgtacaccagaagaatttaatttcatctgcaccaaatatttccctttttcacattcccctagatattaataaaattattttaatattgttggccatttttctaatagctgtttctttcatattttattaaattgttagatcaggtaatgaaggcacgtcagttacttcttactgtaacttattactgtaatgttgctattaaagtaaattttgctgttagttattatacaattatttatctgttcatctcttagtgtctatttaacaggatatgtgaatgagactgtgggatgagcagcgggctctgcacttagtcttcctgttcgtcctaaccctatctgtttcccttcacagctctgtgtaagcttcagcctctggaagccctttgtgttattctacgggaagccgctcccaaagtcaaatccagtggatggtaaacaggaatttcttaaatatattgatttaggaatttgtatagaaattttcattgatttgatcattcttgtttcaacatttttgttggacagtatttcctgcaatccagtgtcttaggttgaatgtctaaatcgtcagtatttatttaagtcaagatctaggtgattaaccagaaataagcaacatcctccttatgtgtgatgaggatattgtagtgatttttgttaatggacgtgattatcagatgcttctatagcaatgaggtgaagggagcgatgaggcccatatgtgatgtttgtcatggtgcctagacatgcagtcagtaactgtgatgtacatgcagtcagtaactgcggtgtgcagccctattggttacccagttaaattaaacatccacacacttgaagagccgctctgcattgctgcagacctggcaaccatgagaattgtgttttatgaagcttcatccaactacatgtgattagtaagaagtggcaattgttgttcaattattggcatttctttgcttgaattcggtttaactgtttacatagatttagcttgaatctctttgcatgtgctgttttacaagcctgcttcgtactgtttagcaacaccttctttcggaatcacattgagtctcttaattgccatctgattacatgagctttactatgtacctgctgctgaattcatggacatttctagtgttgagtagaaaaatctgttgactcgacttctatttctgaggtttacgtgacatcatcgtatcatgtatattgttaagacgtgggatatttcctaattgaaaagacaatcctagttctaacaagtctttcggaatctttgaccttgaaatcagcacagtagtgggctaagagtagcacagcaattaaatagtgtcattcatctttctatgctccattcttttcaggtcccgtaagttccagaatttcatggaaaattgcatgataaaaaatttcctatttcgtcctacatctggaaacatgcttcttcacccatttgtccatgatataaaaaatgaacgacgtgttgtggagtccttgacaaaacatcttactgggatcattcaaaagagagagaaaaaaggtagagacgacaaagctttgtatctttcagagttggtatcattcagaatcgatataggagcttacatttatttcttgtttttagttttaaagtatttgttaaagaatttggactgcaggggtggcactagagagttggttcagcagatacgaggccctaagttcatgtcccaccacctatgtcatgtggcccaaaactatccctaactccatggcaagtagacatgtagatctgacacatcggggacaatcccagagccttttgccatttcagtttttcagcgctgtatgtcagtaattcattcaattgcctcttttgtgagcatttatctatgaggctagttagctattcccattatacctatcaagtattcatacttataagacctaaagcctcagattcaaatagaattttggattgtggctgtattattttaagtcaacttctaacaaaagaaaggtaagcaactctttgagataactgtgttcgtaactgcaaatttcatgacttagttttgaaatgatttgtatataccatatgaagttcatgtcatgtcctaatcacaaacttgaggtataattaaagaagctcacctatgtacacaaaggtcagctacacttactgatccccacagtgacaagatgattttactcaatggacaggaaaacactgaggaagcactgcagacaaggccctgattgtggaacctgaaaacaatagaaagcaggctaagatcaaatcaaatgtgagaacgactgcaggattacttgtccggtccacaaaattatgtgccctctttataaatggggagctacagggttcgtgtatgtgcctctgatcatgatgttatgggggccagcatcatacaggtcattcttaagtcgctagaggaacatcagccatgatttgctgaaatctagaggtgtaagatttcaaaaaatgttacctatagcaaaagtcccacttcactggtgatttctccacaaatgcaattatagcggccctaggcaatttaatacagggaattggaagagaactctcccatttgtaagatgtcacatttcagtaataacaccacagttgacaggaaaaaatccgaatgcattaaatatattaaatataaaacaagcacaagcagactacttagaacgctgcatgtagattgcccctctcaaggtgggttacgtcagggaaaagcacttaaacaacttcaaggggaagccaaagtgtttatgtcactctaagcttgggatcttacacataactaagcctctcttggagcagacgcaggtccatcagtgagcatatagggtggatcaagtgttcaaggttctacaggtcaaatccataccatcaagtggtccttgtcctttttcttcctttatcccattctgccttttcttgatggcagccatcagattgctaagatttatttcccttaagtccagaaaaattaatagggctgagttatctctactgtgtttcaaaactatgcctagaaacttgtcaacatcaccagcaaagtatgtttgaagagctcccttatttcttaccttcttacccatagtaattcactcttcgtcctgagccatagaaagctgcagtcactaaggtgaaccataagctgttttttcattacttccttttctctttttcacacaaaaggaatacctgtggcctttgaaggagaagaagctgctaaggaacagtacatcacaaggagattcaggtgtgttgggaaaactcataattagacgatagcatgatacctgagacagtagatttaaatactgttgtcttccgctcaagacgacttaatcctatttgatacaaaacaaacaaacaaacaaacaaacaaaacccgccatacttctgcttctatgagatattgtgagaaaacattgtgaatttttgttactattccgaaatgacatagagcaataaaacaatcaagtagaataccaacctacagtaagggtttaattcatcagtggcattatattacctacaggatatttcagacactgcaagaatgagtacagaattatttgctatctttgttggtgggtctatcttttaaaaattaaagcaattctcagacatgacctagttccagcaaacactcatgaaatgccattcttctgtatgcttattttagagggccttcttgcactcctgagcttctcagagtgccaaccagcagcagatgcagaccactcagagtcctgcatggagagccccctcagccaaggtggctacctgatcaagaagacccacaggaccaagaacttcaacaactgcagaaggcagccggagtgttcatgcctctacattctcaggacaatacatccaagcttttcccaaagcaggttgaggtagcaccctatctccgtggggcagctcaggtggtcatgccagtactggtacaggttgaagcaccgccccaagtaagcaaagcagcccagatgctcaagtcactccccactcaggacaacaaagctacttctccagaggtccaggcccccgtagccgaaggacagcaggcccagcatgaggccttagagacagaacagcctaaagatttggaccaggtgccagaagaatttcaggggcaagacagggcacctgaacagccaaggcagggccaggctgctgagcagcagcagatacataatccggttcctgagcagccgccggaggaggatagggagcctgagcaagctgaggtgcaggaagaggctgtggagcctccccaagctgagatcgaggacaaggaacctgaggtagtgcaagtgcacgcccaggtgctcctgcctttactgtcccagaaccgtcacgtgctcttgcctcttcatttggatagacagctgctcattccggtaggggaacaaaatgaagaggtaccacgagcccaggcctgggatctagaggcctcaagggcagttggtgcagtgcaagcgctgatcgagggactatccagggacttgcttcgagcaccaaatgcatttgtcacaaaaccacttggtccgctgcagatcttcttggaaaatttgtctacagacgggttttacactgagccggaaccgacacagaagaaaaagtcgaaagttgctagtctaaggaaagcaatagcaaaacgactaagacccaagaggttcagagcaaaggcattatggcgacttgaagattttgaattctcagatgtagaaaccagcaggagacggcgccaccgtagatgggaggacatctttaatcagcatgaagagcaactgagacgagttgaaaatgtaagagatttttgatattttttcctgagtgaaaactactgggaaaatatgctcgttgttgcttgcatattttcccagaggaaccaaatgaaaccaatattccatgttctaccaaagttttacacttcaaatgaatcattctgaaatctccagataattgtgatcaaaagaggagaaattgctttaatagtacaactaatggtttaatgtatcgctactaaaggagttgtggcttaattaattattagggttttattttgctttgttttacttttctccaattactcccttaaccagtaaatggataacctacaaacacttaaaatttgaaacattcctaatttaaaattccaaagttgcctccattttttatgtttctaacatataactttccgggactacagagctgactccacagataaaagcatttactgctcttgcccaggacgtaggttcaattcctagaaccctacaaggaagctcattacagcctgtagcctgtctcctgtgggtttctgcacacatttggtacacatgattaaagtaggtaaatacacataaattgattttttttcaatttgaagttgcttatttgttatttcttgccatagaacggaggatggcactatttatgtgaattgcattaatttatactttgggattttagaattgaggttaaaataaaaacaaaaactaaggactagagagatggcccagaggttaagagcacatactttcacagggctcaacttcagttttcagtatcacatgacatctaaccatctagaactccagtcctggacaatctattaccctcctctgatctcttcaaaaactgtacacctatacaaataaaacaaaataaaagcaaatacatctcttgtgaaatgaagacaaaactcatatccaaaacactttgaatatacgtgtcatatttataacttgtcttcttaatattcccatgcttttatgtagttgttcaatgatgtgactgcacagaccagggaacaagtagaacttgacttcccatttaagaatagtcaataaaacttcaaagctcccatatgtaggtggataaaatttgacagacttggttgaactttatgtggcactattaatttaacaatgaatagtttataggtttaataagcaaattattaaggtcaatatagattaggaaagcagctgttttctagtaatttccagtattcatttatataaaaggaaatgtaatatgatgattaatcacatctacctaataataactgatgtagtaattacaaatgaacccttcccgaatatctagatatgttataatttgggtttgtgcacatgaagccaattatgtaactggtaacttcctggcacttctacatagaaaggattttaaaaagtgaaaggagagtgagccaaaagggtaaatggacacctccttcccagaatgtaaggagacagaacttgtatgagtctgaaaccatgatctgtggcctgaaataaggcatataacttgctaatgactattctcaatggtctctctaaaccaattagagctaatgggatttgcattattgaacaagacttgtatttatcctggaaatatgcccaatattagcagcagagaacatacttactgtcattgtttttaatatatatgtgagaagctacttcaaaatagaaataagtcagttaataattgttagccatcctatgagcctaagttctcacatagacatcatatccagatatgtgagatatatatatttccttatggaatacataaaggaaataaaattctttatacgacagaaaacatcacagttcttttgaaatacgtgaaatttaattaaaatttatagacatgtctgagtgctttgccataccagtatgtaagacgcatatattttcattataatctgtacgtggaagagataatagtggttgattcatttgattgaacaatttcttaaactccgagagcttaatttaggaggaatggttgggctctatatcacagatcttcttctatttagagcccaattttagagttataggagcttactaaatgtgaaaccgtaggttgtgattatgtgttaatcaagcattaaatcagattcttaatctggatcccaaagataagcttcaggaaaccagcagttaacccccaaactgtatgcaaatgtgtgtctgcattcagttttctgttggcaatctgtacttttccttagattttaaaagggatccttaaccaaaaattattagaaactgctggtttaaataatttttaagtctttggaaatttttcgtcatggttacaaaataagatgattctgttgttcttatcacttgcacactcataatgatttaaatatttatattattttttttgtttcaaaggacagagaagatgactcatcagacaatgatgaagtgtttcattcaattcaggctgaagtccaaatagaaccacacgctgcaaatcctgcaggaaatgaggtaaagttctcagtatgagttgttatgacattaataagtacctagaaaagtgcctcttaaacttaatggtctcaggatccctttataattttaagtatcgagaattctgtaaagcttttccagtatgtcattcactaacttactgaaaattaaaaccaaaaaggtataaatacattgaacataatgagtaaatataaatgaaaaatatttatttttcccaaaattttattatacagatgtcgttttctcccattttcatatccttttaatctgtcttacttaatagaaaacagctggatgttcatatctacgtcataattcaatctgtgaccatatgttgtttttcttgaactatatgtatgagctggcttagtacctagagatggctaaaaaagaggaatttgatataaatttttcagataattgtgactcgtagattttccttcagagtgtccttcaaatacttgtgcatattcattggtaaatgcccaaactataaaaatagaatctaaaatagtccaagtaaaatattgtgtacctccaaaacttcattgtcctgtcttgtactctgaatagagactccacttctacatgatttctaaattcatctattcatcaattggaaaacattacttcgctgtatatatagattcccccaaatgtttacattccattgcacagtatcagaacagcattttaacagcattaccaatgtttaccataaatgtaactgagtattcataagctgtcaaatgttcagtgacaggtactaatttacactttctcattttccactgagagctcatgtttttatcattgctggcaagtagcctcactttgattttttttttcttcagtttccaaacttatttcatttacgatatctagcacatacacatagttcatgcaagaaagcttttcaggaattttttaaatctacgatttcatattaaactgtgagtagctcactgtggaacatagccgtacatgttttacctcggttctctctgcccttgatagactatttatcatagatctaagtcagtctacgattcatcttctcacacacgaaaaattgaatgatgtcagagtgacttcggttttgatgaccacatcaaataatacaatatttacagcatggatatggtggtgtgagttcacttcttatgcacagacagtagcatgatcatgacttggttggtaacagccaacatttcccattcttcttggtcactggaattatttagtatataaataaataaccatgactttcttctagtgatggtggatcacatttgttgcacaccatcagcacaagatacttcacagaagtccacgataaaaaaaaaattgtcaatgcttttgcaatatagttttttagaaactaaatcttgtgtgactaagagtattgaattataaatactaaatatttgcagagggatcaggagttggattgtgttagtcaatgagaatagtcaattgtgtctctgtgttgccttaactcatacccttctaaactaactctacattttctaaggttatcattcacacaaaagtcaatataatttctttgagaaagtatggcataattggtgttccaaatactttttgcctctaagtcaattatactcatccaatgtagtaaaatattcaagaaagagcacatgcatacaatgctggcttacatcaacaaaattacattcctttctgttagcagggcaggcagagccagagtgctgccttatcacatttagtgttagagggctatttttactcccagtaatttttagctatggcccacaataagccatctgacgtgtaataagaagagtatgagtttgaacttaaattctttgctttttgtgggggagaggaggaggatgtgatttgctttctcaagacagggtttctctgtacagaccaggttggccttgaactcagaaatcctccctcctgaatgtgggattaaagtcgtgctgtagcactaataccctgcatgatttcattttgtaaaattttataaaagctattatccttttctgggctagtgattactcaataataaaaagaaaacttttgattacatacatagtttccagagtctactcttatactaaggctctaagaaaccaccaaaaattattgttaattagttctaagattataactataaaaataatttcagtttataaaggttgtgtttttaagttagatatttgggaaatatatgtgaagaattttcaaataaattagtaactcaaaagaatttatgataacgaatttgatcaatcaattgcactgcatctttaaggtccatgagagatctgctcccatgccttgcaaccggaatcgcacacatcgtgtgaaattttctccaaggtatgtgttcctgttttcaaattatttgcaactgtgagattgataaaacaaaattttgtttctgtgacattaatttttgtgtgaaatcaaaatgcagttgtcactaacatcatgaccatttggcaaaattggcttatatttaaaaacctaactttggtgacccaattacaagaccttccagtaacagtgctcatgtttagtccatgtggttcaattcaataattacttaacaattttgagaatgcagaaatagaagtgatcacaataatttatttgataatattcattttgccatagggtttaatacatgtcaggtgacttgtctcacatgtacaacataataaaagagaaatttttgataaatgcagaagctaatgccacagaataggaaagccaaaaagtgttctgtggtcacaatcaaatatatgaatcattgtcctataaataagaatatatatacatatatatatatatatatatatatatacatatatatacacatatgtatatatagtttgattttttttatatatttgcaaaatccttcgtagctgagttaatagatattaactaggctcttttttttttgtttcctcataatagggtttatggacttttttcttttttattagatatttcctttatttacatttcaaatgatatatgtatgaataaatatgcaacatagaaactatttgttgtaattttaatcttcatagcattcttgatttcagtgattttcaaagattatgttctataagtcaggtttcagtttgaaagacaattttcaaaatagaccagactcacagtggagagaactttagtctatgttcattaggtttgtcattgactaaatatttattgaccgttccttatattaagatattaagacagggtcagtgaggtggctcagtaggtgagaagacatcatttcaagcccaatattgacctgagttcagctcccaacatgcacacagtcaaaggagtgaatcaacttccacaagttgactctatgacttccacatatgcaatgtgacattttttttacctctagttgcatgtacacacacacacacacacactgaaaaaaatatgttttaattggtgttccaaacaatttttgcccttaagtaaattaattttgacttactaattataagctcacctagtatagtaaaatattcatgaaaaagcaataagaatgaacataaaatcaaaagtaaagatactgtacaccatgtacagatatacatactgcaaactgtggccagatgatagagaattcatatttaataagcatagccctatgacataatttttttaaaatcttgtgactttatatctttacacaacacctatgggagaaactttttctttctttgggtttggtttgagtttctttcacagatggctttaagagacgaagataaaatttccctatacgcttatcaggatgctaaatacaccaccttccttaaccctgtgctctctgccattttagtgttggtgaggaagagccttctttggaagaagcccagccgcagcagcagcagcagcagcccatgaacatccgaccgaggaattgcctaaatcctcagaattttcaagctcaatcaggtgagtcaagacgggaagtttcaacgtaggcctaatgttaacagcttatatctcagaactatagaagaatttcaagaaggaacgcatgaacatgttaggtaggccaagtagtattaagacaagatgttgatttggggtttgagtgatcagtggggacctctgagaaatggaatccaacatgagataatgcatgaaaccttgagagaccatccttcaactagccaaagtgtattaagctacttttatgacattaagtcaagtaattgtgaggacaacttttccttgtcatttgatttcacctcttgaaagtatgacgagctcaacattacatatcaaaacataaggaaaacattcctaaaatttggcctgatttttttcaaaacaggatttctatgtgaaaatatactttgaaaacaactgtttcattatattaatctcctaaaatggactaaggttttaaaattcaaatattttaatatctagtcttctatagcccttataataaaaacatttaacaaaaatctctatgacaactttttataaataatgtgagagcttggtaaggaaacatcctttagttaagcatatcttgcacacttaaaagtggaaaacgtcagattttatgatccaatgcacaatttttgcatttttcataatgttcacaaatgtataatagttttaacaatctttgaaatagacagcactgtttgattgtaaatgatactgcaatttttgaagctatcttagtattttgcctatgagatgtgaattctctatcacctggccacagtttacagtatgtacatctgtacatagtgtacagtatatttatttacttttgattttgagttcatcatattgcttttttatgaatattttactatactaggtgagttttaaattacaattattttttcaaatattttgaataaagccataagtttgtaatatttcatatgaggtgatgtttctgcaattgaattgcaaaggatgagagagaacagtgagctattgaattaatccactacaaaaatgggagcaattgtgaaatctctgttgttactaatggacttttggcatttcatagactcatcttctgaggaggacagtcctgtgactaggaggaagtcccagtcatcaccgccttattctactattgatcagaagctactgattgatatccacgtaagtttagatcatgatacacttatatgtatttttatcatctaaataggtttgacctattctttctgaccttccaaccttgaggttatggactgaacagatggctcagcacttgtttctctttcagcgacagacaaggattggttttccagaatttatctgatgactcacagtcatctgtaaccccagttctaggagacttaacacccagctctggcatttacatatgcctggcatacacaagatgcacatatatacatagaggcaaccactcatacacgtaaagagttaagagtttaaatgtgtcgtattagcctttataaaaagatcatattgttaggcaagtattcaggatacaaaatttgcaagttaaaattgaaatggggaaagagcaaacagtactgtattttaactttctatcaaagtgtgttgttgaggggtgctgaagatatagcttggtggtagagtgcttgcctagcatactccggtctccaggttcaatcccattaccacacaaaatagaaatacaatatagaggaaagaacattaacaaatggatacatccagactaatctatgaccaagaagtataaatcacattttcaacttttgcttaatagtatttcctagataaggagacaaataacatattagagaaaaatattgtcttctgattgtataagtaaaaggcctccctaaacattttcaatgtgctttcagatcatattatgtaattttcataatatccctattctatcctacatatatctatacctaccatcagaattgtacttgtatttgcttgcttttggaggcatttgaaataatttaagatcatatatggcctatgcagacaaaactgggaaaataacctatgtatttcaagagctatgccctaatctcagtgttaggataaaacaaaaggaaataactgactttatctagagcatactgcctgacatcaaaagcaaatgtctactcctcagcaggcaagtagggttaataaaacagtgagttaattgtgctgtgtgatctataatgtccactaataactactgaagtttgggtttgggcaactcatttcactaaaattttttctcgatataataggtggacatctctttcaataaagaatataatattaacttgttttaaaatgtcattttggaaagttctgctacccaaatataaaaaaggagagaaacttttagagactaccttaccttttcttgtgcacacaggttccagatggatttaaagtggggaaaatatcacctcctgtgtacttgacaaatgaatgggtaggctataatgcactctctgaaatcttctgggatgactggataatgcctacacgtcccgctcggccacctgaagaagatggtgattatgttgaactctatgatgctgatgccaatgctaatggtgatgaagaagttgcaaacggtgcttatgaagatcctcgtgatggtgccaatggccatgatgacatgaataaccagcttgatcaagcaaatggttatgaaggccatggtgctgctggctacaatggtggagacgttggtggtaatcatggtgctgctttcaatgggccaaggttggttcatctctcttattacacagtagatgcttataaactcagaacgattggcatatttggtttatttcaaaatgtagcataacatttgagaattaatgaattgtacttgcatagtggtgaatgttccatattataattttaaatgttctaagttagaatacttagttctgattttaatatttatatattataaaatgcatatacaatttatagttatttattagactgtatgagatttctcttaaaattaatcccactaaatctccttcccctataaaatcacaattaaaaatatgtcaaaagaatgagggattctactactatttgcaagcatagttaagcctttctcagagagttgagattttgccatgtatatgatcaacttaattatgatctttattcatttaattgctggagaagttacaaaaagatcttccagatttctcccaaaataaataatctataaaaagttccattttcacacagtttttcttttatgatcacaatagggacatatttttaatagtgtattccatgcataacaaggtactagcatgtaaaaaagagtatttataaacactgattatgtgactctcttacttatcctctaacatttgaagcctatattacatgtactttctgatgagagtagttgaccaatgtgtctatagcagagctgtttgtatatatgtaaatgaatgaaagcatatgttcaaattaacataatataaaatactgaaagattctaatattattatggggttgatcattaaatgtgactaaaatttattagtgaattatctatttgagaaaattagcattttctgtagctacccagttatgtgtacctaacaacataaaatgtagttcttttcctctgtttccacaatgatgacgcagacttaacagtcttaaatcattatttagtataggcaaagcattggggactttttcatgtctgtatgcaaccaaaagcattcacaaaaagcaaaaacattcctgaacatggtgtgtgtgtgtgtgtgtgtgtgtgtgtgtgtgtgtgtgtgtgtgaatttttctctttttctttccttttgtggccttgatttgtgtttgtattaaatggccttctttcattaatttctccttgttatcagagcaaattatcccagagcgggaatcttgaaaaacggtcataatgatggacgtgctctaaacaggggagcttttggagtctttggagacaatgcagccagagctttccatggagctgccggtgaagcaggtgcagcctttggaaaccatggagccaataggggcaatggaagaggtaacagaaacagggaggccaatggaaggaatgaagagaatggagcatttggacgggatcaacatgtatttccagagtttgaacatgaggtgatgaacatataatataatgaatatatacttctcttgtaaatgtatgtcaacacatatgtaatattataggtatttaacattgattataaccttttttctcaaatcctgaaattatttaaattataagtgtataggatctttactacatacaatgtgatggttcctacgtacttccaagggagacaatctgatttattttgtcattttatgtcagattatacacttggtatagtatttcaaggagatggcaagattctttatagctgtagaatacaaatactgaaatttttcatttgaagtctgtaaatcactaacatttttggacatggacaatattatgcaaccatatgtatttgtatagcacataaagggatggctttcatgatggcattttcccacatcctttgtctttattgcttttcctcttctttcccttcctcttcccctcaattatatccagtttgcctccatttaactctcaagtcatgtgtattctcttgacacatttcccccattactcttccttaaaatctttctccctctcattcataatcatttctagttctatactatccacacacatatatgtatgtatttgcatgtgtataaattaaaacctaggacctgtgtgtgtatcataaagaataggaaatacacttctgagtagaattgtacccattaatataataatttccacacacagacaatacattgaaattttcatgatttcatttttctttgtggctgaatataattctgttgtgtatatgtacatagcacatttttgttttccacttccgctgctagacatctaggcctatacatttttatcttcccgaataattaactcccaattcttcccctgattattcagtcccctccacagataaaatatagtattgccacgttcggaggcttttatcattaagtgcctactccttaaaaggaaacatgcaaaacttagagtgaaatacgcttactctaagatttttataatttggatttgttttgctttgttttgttttccatcttttgtttgatcatttgtccccatgtctccagaggttcttcttgctctcagttttcctaagccatgtattttttttttggtgtgttttgttctcttgtgtttgttttgttactgttttaggatcagagtctatctctgtaggcccaccctaacctgaaacttgtatagctcaggctggcctaagactctcaaaaacagtcttccatgggccagcattagattctcgtgcctatgccatgagacccagctctgtagatatcttaaactaacaaatgcaatatcctcatgctgtgcttttcttttcaaagtaactatttggcgcatatactttggggtcagagtcttctacttaccagctctctgacccagacaacttttgatttctttaagttttggtttccttataactgaatcagaggcaatggcatgtaccttattgtgttgtagtaactgttcatggagatgcatggttaagggtattagcatagtgcctgatctacttctacaaagattacatcagaaattctacatttggcaatttaatgctccttctagataataaatttacttctcagatgatactgttcaatatttttagtagatatgaaattttaagaatatatatatatatacaaatatatatgtattacagattaaactttcaagtcgctgatagcatttttccaggtatattaaaagttgggtctttggcttccttttaggaatcagatcgtggaactgagacctcagattcaattgccttggagatcacatcctttgatggtgagcaaaacagtggtagaccagtatcatcaacaacaatgggttttcctattggacgctcatctcctagaggttctgattttgggagtgacatctgtgagtatttctgttgtgatctttcaatgctgaatgcttctacttgcttataccataagtcataatgtgtaacgaatcagacatggaatattcatttggtataaatcgagatttatgcatgctttgaaaaaattattcctcagaagataaagtcatttgccaccaagttaagtctaatcccctaaacacacatggtaggagaacagacctaacgtatgtgccttaataataagttaataaggtaaacatacatgtatatttgcatatacacatacgcatactttttccttagatttttggatgtcttgtgtacccaggatggcactgagctcattctatagtacttactggcactgacttcctcatcttcctgggatcacagacccttgctatcctactgacctgtcactcaatctttttggtgactagctttgacctgcaattgagaaatttagtccttcactcaactcttggttttgcactactataaaagccacaaatcacattcatactcagcgttgtattttaaccactataatatatattttctaatgtgttaagaatttgcaaaaacttcatattgttgttccacctatagggttgcagatccctttagctccttgggtattttctctagcttttccattgggagccctgtgttccatccaatagctgactgggagcatccacttctgtgtttgctaggcccaagaatatcccccagtgctcgtgtccctagctgcatatgaatcagaagatggcctagtcggccattagtggaaagagaggcccattggtcttgcaaactttatatgcctaagtacaggggaacgccagggccaagaagtgggaagggggagagtagggggagggcatgggggacttttgggatagcattggaaatgtaaatgaagaaaatacctaattaaaaaaaggaaaaaaaaagaatttgcaaaaacttacataaaagatgaaatgcaataagaaaaccaaactttgagggacatctacatgatggaaatacttgtcacacgtttagtatacagaccagtgatttgtctcaatacctttccccttcacagtatatgtaggactagttgaggtgcctgaaaaagcagctaagctaccatctgcagtcaatgttaacccgctctctgtctctccagcatataacagcccaatactacatgtgtatgaaaaggatttctcatctgaggtctactgtggttctttgtggggtgagtttgatttcttgaactgagggtttatgtatgtatttatttatttatttagtcactttacactccaatatcagccccctcattccagtgcccaggcatgcaagtcttccctgggtccagcctcacctttgtcatcatcagcacccctgctccaaatcctgcacataaaagttgctgtggggctaagcacatcctcttccactgaggccagcagcgggatccacatgcaggcaggccatatgttcagggatagattattttttaaagtccatatttgtgtagaaaactttcaaagcttgtggaagtaaaacatgtttaccattgccaatacattaaacataaatttataataattggttgagggttgatttggcttgttgaattaatgtctttctcttttatgctttgtttagcttgtgttaactagagtgaaatacaaacttagacttcattctaattatttgaaaatttgagtttatttttttctaacttagaatacatttattacaagaaagatttctgtagggtcttaaaatttttaagtctaaagtatgtataatttttctctataaattttcttaaatttaacaagtttttttcaactgtttttggtatgaccttatcagtagggctgagattatatgttgttctaagatagtcttcataggactttgctataaagtaacttaatagcagagaagaggtccaaagtaaacactaacttctaacttaacacttcatagattttcacctaatgtataattgaacagaagatatgctttaaaaatgacaaatagaaaccagcaattttttttcaatttgtgaagaaatgaccttgctgtgcatcagaaatcagtcccaagagagactccagggcatggaacagggtagaaaggattactggaaaggaggagaaagggtcccaactggagtctttggacaaagcactgtaattagaacgttaaaatgtatacatttagttatccccatccctagacatgtggtcttcttatcagaaaccagcaactgtaactctatggttggtgccctcagaagaaaatcatcattctcaatgttttgttactttagtggctcagacaatatggcatgtgccacttcagtctggcaagtactcagaaatatagtccatgtctagaaaatgaactgacagtaattgtctatgtatagactaagtttgcttgaagggaactttcagaagcgctgactgattctagaaatgtttttgacaattaaaaaatagtgctatgatacatacaccattttgtatgtcatatgacacattagacggcaggaagatataatatttgttgtatatggatacctatttacacattttaggggacatactctgatagacatgtacatagttgaataatatgaggttaataaggcttgagatagtatgagataaacatttgcctgaattgataaaaagtcatctttatatagattagcaaggtgaaattacaaaaggaattatacacatatatttagttataaaatcgatagataaagggtgaagaaatatggaatacacatgtacacagtagagtattattcagctggaaaaaagaatagaattatgtgtgtaggaaaatagttgataactgattgttgaaataagccaaatgtgtaaagacaaataacacattttgccttctatgtaaactctaggttgttttaaggtactactggtagaataaagaggaccagagggagggagaaggaaaagtaaggtgggggaggggtaatgagtgtgattttgattaaattttgtgatacatttaaaaacatcatagtgaaacccctttctgtagaattaatgcacgctaataaaacaatcagcgaatcacttttccgtgtctgcatctgaacaggagtcaatttgttgctgggcacccaatctcatctgtatctgatggaccgaagtggaaaggcagaaattgttaaacttataaagcgaagaccattccggcagattcaagtcgtggagcagctcaatttgctgattaccatctctggtttgtttaagacctaaaattaactgagtaattatgtggggtaattgaagtgcaaactgggttaaaggctttcttaggtgaaagtgttcacaggcaaacccttgaaatataatgtttaattgggacagcaggatctcctacctgggttttcttatccatttggactgtgaacagaatccttttgatctcgattcacataacctaggctggagatcaggaaaactacttttgcatccttgaaagctcctttcagagttatctctaataaaactccagagctgtaatcacgtgcacaagggactacaccgatctctcctatctaccttttgatgtgtctgaaacaacaaccaaccaaatggatgactatttggataaaaaaaaagagagaattgtacctgtctccccaccttattacaagggcatacagacaagggttaggtgcaagaatggatgccctaaagacacctacacgtttcccaaacagtagtggattttcatgatcttgatcagtcaaggcctgaaacttgaacaatgaaagcaaaataagttggtgttaaattgtgactactaaatgaatggaaaaagataagtaaaggaggtcgtgactattcctagctatggtggaggagatttattgtagatacaatagagagcatagccaggggcctagacagagacatctgtgagagtctaaagtgaacaggaccagcagactgaggccatatgaagagaggagagaggagaaccttgagtggcagtcatgaggtcaagaggtcaaatactataaaaacatcatcatcagatgtgaatcttctaaggctactctggaaaaaaaaattctttcaaggatgcaatgtgaagttattcagtagtttattttaccagttaagtattaagtaataataagtatagttttggaaccctaagacttctttaaaatttccctattaaaacacagtaaaatcgatcatattgagaattttactttgtaggctgagtgtggtggcaacatgcttttggtgtcagcactcaggaggcaggggaaggtggatctccatatttgaggcaagcatggtctcaaaaataagattcttattgttgtgactttcataacaatcttaaatttgctaagaagaattaataaattcaatagtaggacctttagttcttaaattataagaacttgatagaattatttattaggaaattagaagtaaatacagccccactcatgagcaggatataaaaattttctcaacaggttatttttatatatttaggaatagccatgtatatacatatctgtatataacaacaattaatgacaaatagctcatggctgtgaaagagagaaaagagtgttataaggaaaggcttggagggagggaagggaaaagtgagatgatgtaattataatctccaaatgtaaaagaaagatgtaaacgtctcaaagcaactgagaatagactagttgccaaaggctggattcatagaaagggagaagaaaggtgatgcagacaacaggtggataatagctaaaggctaaataagtacaacattttgttgttctatggcccaataggtaaacataatgaaaacagggcattatatatttgaaaatagtcagaagataggaatttaaatgtactcaccataaacaaaattttaaaatttaggtaataaatatgctcatttcatgatgtctacatgaattaaaataccacatcatacatcataaatatataaaaaagaagctttatagtaataatagtaatggggtttgtttcctaaaggcagtcttaatgtatcccagtgaattattttagatccacttcagacaggcataaagacagctagtagaatccaactgtttcttggaattgagacagaagtgtcttaatatatctgtttttaaacgtgacttttattttatgagaatttcgtttaaagggcagtgcaccctacatctttgcatttctagaaaataaaagaattgaaatgccatcatgttttcctaccaggcaaaaagaacagacttcgcgtgtatcatctgtcttggctgaggaacaaaattctgaataatgatccaaagagtaagaaaaggcagaaggcgatgaggaagaaagaggaagcttgcaaagctatcgataagttgattggctgtgaacacttcagtgtccgtacgtccatttcacatttaatattgatgtatagtttctgctttccttcgtgtggagaggttcataactgcaaaagacaaaatgaggaaaggaaagaattcacagagtgattgtcacagagacatctcccaggccttttctacataatcagacctattggctgaaattgctctgggagttaaatatggttgacttctttcttcctttggtagtcactcgtagtaattgaagtactagtttccacactataaatgtccttgatgtatcttcagcaacttgcagagatataagagatggtattttttcctctctgaatagcaataaaccatgaccacaaaattttatgctgaatctgcaaaggaggttttctgtgatctgttgactcttgctcctaatattttatgtttcactatagaatgttttcatatcctgtatctctccatgaatgtctctgtaaatgcagtaataactccctttggcctctgaattctgttggcagatgtcgacaactatgaactaatgctgcccatttctgaatgctcttccatttctgaatcaaatcctcttctctcagcttcctttttctctaaaacaattgacccttcaggcagaatgggtaatgtagataaaagactgctgaaatcacattatatgaatagcaagagaatatttctcgtttattattattattattattattattattttattattattattattagatattttctttatttacatttcaactgctatcctgaaagttccctataccctcccccgtccctgctcccctacccacccactcccacttcttggccctggagtttctctgtactggggcatataaagtttgcaagaccaaggggtctttcttcccaataatggccaactcagccatcttctgctacatacacagctagagacatgagctctgggggtactggttagttcatatagttgttccacctatagggttactatactaccaagatactaccaaggtcagtttcactttcttatgccctgagatgcacaaaagatttaaattttgatgaagcttgatttatttttttcttgtatcacttatatataattttttttcaaatgtaagaatacattgccatatagaaagttaaaatttatccctgtttactgcttatacttttgtagcataagctctgacatttaggtctttgattcatattggcttaatttgtgtgtatgctgtaaggtagttttctcttctgttcttttgcttatacattaccatatgtctcagcaccatgtgtttaaggcactgtggttttttggttttgttttttctttattgaatggtcttagagctactgagctcatatgtgcagagtatattttctgaaagtcaaatgtattcagtttatcagtactcctattgttttaaaaatattttatttgtgtaactattctacaaataatgtagcttttgctcttaaggttgtgctgtttgtttgtgagaatatatataaccacatgactatccttgttaattctgaggtataaatattttgtatgttgccattacagttcaacatgaagaaacaacatacattgcggttgctgtgaagtcatcaattcacctctttgcatgggcaccaaaatcctttgatgaaaacactgccattaaagtatgtggccatttcactctcatcatgttctttttctcttaagaagacattataagcaaaatagtagtttggaatatagatgtggaaatatataccatttggctacagttattgcaatatgaatataccatgtcaataattatcatttaacccttttttagacaatccacaggtaccacagcagggagagtatgagggaattccctaacccctccccttacaggacattcccaccagctcctctctcccatttcctgtagtcaacatgaagatcttctcttctagaggcccaaaatcaggcttcaggtgccaccccaatgacctgatgtggggaaagtacctgcactctcatcgtgggatgggggtgggattggagagcagagggaaaggaagaagagatgcagcgatactaaggaggccacatctgaaggggggacgagaagaactttgttccaactatcattacaacaccagatgggcggggggaggacctgggggtctatatttcttccaatgtgaaacatgcttctctgaagaactattctggaacacagtgggtaggcccaccagtgcctttgacatcttttgatgaagctgaacttctatggatcagctactaaccatctagtagcaagaacaaatcttgttcactccccataaactgaggactgtggataaattacatacaatgtgccagaactctatttaaataggatagatttttaggaaacccaaatagcttctttaatcttacctattgtgggcatcagaatcagggggagcattttgttaaatgttcagatctcagacccaaccccaggctgagttagtgcgtctgcagtggggcctgagaatctgattttaacaaatggtctcaatgatactgaactacgtggtctacatacaaatttcccagagcactgataggagcatatcctgatcaaggtagtcatgaaatacatttgtatcttatatcaggatctatttatatatctttgagcccaaacattgcatgtatacactgatcatggtataatgcatatgactactcccagtatagctactagactactagatggacagtctaccatggcagatatagcatcccttatctggtctacctaaattgggtcttggctcagctgtcaacatttggatatggaataattcttgggtgtctgctgacttgtcagtgctacctagtatggaactggaaaacaaagagagaaatatcatctgtacatttagcctgttctgcccaagtcctccctccatccttaatgcccatcttacgaccatgttattgtgaatcctacatgctcagtgctttccatcatctgatctcagcaatgaatcctgtttggccttttgtttccttggactgtcaacattaggagtcttagagtagagtctgtctaccatagggttaatgtgtatggcctttttcattccttaccaagtatgcattgaccaatcagcagactccgaaggagactacatgtcctatgaagcctatatacgaatattggcaaaaatacaggcagctgatccagcgaaccggtttaagagaccagatgagctccttcatttgctgaagctcaaggcaagaatttcaggacagctaacaagagaacaaggccatatatgggtctgaggggtctaacagtttgatcgttgtaggttgttcaatgcccaggatcataatcattcaatcaatcattaaaaaaaaagccatctgacttgcatacatttgtaaatatgacaaaagaatagggaaagtttcccttagtcagaatgtcattttggcctttgggccatatttgcttttctgttttcaggtgtttccaactcgtgatcttaagccactgacagttgacctggctgttggttcagagaaaacactgaagattttcttcagctcagctaatggatatcatatcatcgatgcagaatctgaagttatgtctgaggtgaccttgccaaataatgtaagataataccttcactatcctagaagttattgtaaaacactttgaattttcctgattatcaaaattctcaaaagtttaaaggtacaacttagactgcagccaagatctaacaggtaacctgagtatgtcagaaagtgttgacacataaggaaaattcactaattatttcatacttcagatatctaaatgtgctcctcagacatattatttggccataatgatttgtaacctttaaaatccagacttctattgataatctatatatcagacttctattctgataatctcatgcccaaaccatcatctggccactatcaactggaactaattgaggtctgcctcctttaatggctttgtattctacattcactatccatttatctatatgcattcatattaattggccctaagaaacttttcaattggctttaatatttctatgccctgtaatatactaatacattttgttaagaaatcaataacagtattacatacttatatgtgctcccctctttattgcattagctatagatgatagcaacttatgtaaaaatgaatttattatattcattatactccagaatttttgatggaaaaattcagcatttttaaagtaatggcacagtattttcaaatcatgactggttgcacataatataaaaatcttgaccataacatcgtagtccactaaatgaatcatacaaaatattgatggtggaattgatggttttcctgttggaatttatatttaaaaggaatgcctttactagcagttttttgcttcatcttttcttagtattcagtttgttgaacattaaaattttagcagcttatcattatgcaaaatccctgaacaaagtatgtatggattttaaatctcgccatttgtgtgataatgtgaaatttttggtaatataacctatgtctccaataacacaattttcaaaactacagaaaacaagcatccaaacattggtgaagacatctttaaagatcaagctaacaatcattagctaatgatctcgtagttgcctatacagacagcttaccctgcttgtactgtgaaaatattaaatacaacctcagccaaattcacaaagcaattgtgatatattattcttcagttaattgcccctggagcttcatccctcttagatttatcagaacagctagcctttcctcagaagccagtacaacagcgaatattttaaaaatcgggttaagtttacacttattgaaatacccacacaggcatattagtgtatgcacgtaatcccataactttggaagtataggcaaaaagcatgggagaattacagccatcatcagctttttagcaaattcgagccccgactgggatacatgattctctgggttgaaaaataaaatcactgaaaaaagttaaatctaaataataaccagggaaattatttgctttaggaacaatcagttaattaactgaacctagaatgagaaaagacgttacaaatcattttctgacctaattaggatgcctcatatatatgcaaacgtatttttagacaagttccccagtgtcttgacccactaaattagaaaggactctactctaaagcagaggagggtgtcatctgaaagagaatgtcctaaaaatactattctctcagaagtgctacattacaaaggctctggtggtgcaggagagctacacgtgctgaaaagtatccagttgcttcagaaatcatctgagaaagcaagggaattacctcagaggctctccggatttgcagcgggcccggtttattacaaacagattttcttgagaaaactgtatttcttgaattttctttccttctttcttatctgttttctgattcaactgctcatgcacgtacccagggaacgcattaaaattgcgttttgcctctggattcccattttagttttgaggattgttgttgctgagacatggcctcaagcacttggcctgagtacgctggctttggcaagtatagtttctgaccttcccttcccttccccccgtaacttgctaatttggagaaacagcagaacaaatttcttttatttttcagagaaataccaccagtgtcataatatctaagctctaagcagatttcgccccatttatatatctggacgtttacgaatgcttagttttctcataatatttccttgttctacaacaaatacttctgaactctatattgggcttattttagcatgtgaattaaatgagaaaaatctacattttattgtaaaggggacaaatataaaataagccataaacaatattaaaggttgccccttaaaatatttaagctcaagctacttgaggtttaattttctttttttcatgaatttgccaatgagcaagaattgttgtatatgatttattgcttgggtcacacatacattatgaaaatattgcttaatttctgaaataaatctgaaattccagattgtatttgttcccattaaaatacacaataatttgtgtagcatttcaagaaagttctctgtgttagaaataaatctctgttttccccaactgattatcctaaataaaaaaaagtgagagaatattaaaattgatggctttgagccataaaggaaacctacccttctaaaatgtttatttcatgccactcactttagacacaaagattaccttccccccctgcactttggacatcttcttgtcttcagttaagtaatagttgcttcgattaacgtaatagtgataaaatgctggacacaaaaaagtcttcatgaaagataatcctggtcactggaaatcattatcccacagaatgtcgtcattttacctgattgcttgggacttggtgtgatgctctccctcaatgctgaagctgcctccgaggaagcaaacgaacaactccttaagaagatcctggacgtgtggaaggacataccgtcttctgtgggtatgtacaaagctcttttgctctcaagccatcttaacaggatcaaaagataggtcctaaatacgttttcctggattgcttctttttcctaaagcaccgaagggtaacttaacgtcttatccattaaaaaaaaaaaaaaaaaaaaaaaagaaaagaaagaaagaaagaaaaagaaaaaagaaaacttctattttgtctggccactttatagagtggtatttgggtgaagtcatttatacttgtaatttgccacccagatggcaacatgggtataaccctacttttacagactacacccctaaacagtgcaggactgctggtctgggaaattaaaataactaatttgagattttttttatgttcctaaggtttggtgactagatggcagaaaatattcaaatagttaaagtattagagagggtaaagggtataatgataagataaatgacctactcctctctctctctttctgtgtgtgtgtgtgtgtgtttctgtctgtctgtctgtctctttctctctgtgtgtctctgtctctctgtgtgtttctctctctctgtctctctctttctgtctctctgtctctctctctctttctctctctctctctctctctctctgtgtgtgtgtgtgtgtgtgtgtgtgtgtgtgtgtgtgtgtgtttgcagaagcatagtgagttatagaagagagagagagcaaaggaaaggctgtttgtccaaacaggacagaatcctctcaaatgcctatgggtagaagtgacatccatattgttttagtgaccaatttgaaagaaaactcctttttaaacaactttcttatgggatgatagggtttttttttttttttgcattgcatcttcagaatcttttaattatttttatgcatggtcaatgttaaggcttgtcctaaaaacctgctctaatttcttccaacaggtaagaattcacagagggcttaaaaccattatgagtgaaaaacacttaatgcttatagtacacattgatgaatttagggcaaacgaaagtaagcacaatgagccatattatatcttgcatagtgatacgtcagggaacaataagtgaggtaggacccagtgaggctgcccagtgaaagaaagcctgcctaggatgtgaaggactggcttccatccccagaacctcagaaagtacatgagtcagaaatgaaaatcaggtacctaagttcaaagagaagaataagcagaacactgatattcaagcagctcagtgatcatagctataaaagggatttgaaaagttgtctacaacatttcttgtccttaggcaagaagagttctaacctagatcaaaaagcttggttgaatttggacgacatatacataaaataacacatagcacaaacacaagtgttttgtttagcatgtactgaaaatatattacaaaataacactgatatcaaggaaataattcaatttgttttctacatcaacacaacttgctgtttacaaatagcataaaaccagatttccctggactaaaatttacatttctttaaactataatgttttcaataacaaagacaatgtcctttattctcaggtatcacagtttaagaatggcagatagttttgccaaaaatacctacttccagatttcagagtcccatttcagaacgcacactagttcagtaagtagtggcagatctgtgagaacctgcgtactgggttcagaacccagtagctaggctgttaaattgcaacgctttactctatgtgcctgttgagaagaatagtattctagtataatagtcacagaagtaaaataaaagtgaattcatagatgttagacctgttactcgtttcggtaagacaggtcactgttcttcatacttcctgtgcccacttcaattccggcctgattttatactatacattgctcacactatgtatttgctagttgcttttataagattgtatgtagtcttccataagttattttatgtaaatttaatgtacacatacagcaggtaaattttggtttaagtaagagtacctgagagcatttgataaaaatgggagactattttttaaagacaactacacaaatgctgattttccctcttttaaaataaaggaaaacagaaagtcagattaactaacaaattctggtttcaaacaaagtgctatgtttcgtattttaacttcagttaaaatttgtgtcatttaaaatgttataatttactttatatatggaaatttttcctgtaaatttcataaagaataaaaatttgaaagtgaaacatttaataaaattgctctttatactataaaatacttcacagagtcaatggagtatatggacttttcaaaattagggttatgctttcataaattatatttccatgatggactataaaacatgtctaaaaggtttaaaatgcaatacaattttccccagaaggaaaaacctttaagtgtataaaattcccctcagttctgcttatagcagaaaaattgttcaattgaattagggttactaaaatcattatttgaataagatattatttaacagatttagttttttcaggactgagaactgaacttaaagccttgcacataaccacttagctaaatccctactccctgttttcatttgttgaaaagtcagcattccatgttatgctacaacctggctctttattagggaccttccatttgtagctggtatcgtactggatctcacctacaccatgaaaaagagatgtaaagccatggattgatctgagcaactagaaacaaagtcattacctcttgggttgtctgtgatctgacaggacattaatacaaacattaagaacgttctagcaagtcaatgttcatcacctatagaataccagtcctaagcagcaaaatgtccaaagtggtagacttcaaaacaagatgaagaaaagacgggactaacctaacctagagctatgagctcttaatagttaactttagttatgtttttcatatcactgctaccaaaaataaatgttctttcaccatctccaattgtatcatagcttttgagtgtacaaagagaatcactggatgggaccaaaaggctattgaagtgcgctctcttcagtcaactattctcgagaatgagctgaagcgccgctcaatcaagaaactgagatttctctgtgcccgtggtgacaaggtagagtttacacctttcagtaaagtaaaaaaacaaattaagcattaaaattattagactttataccttttcctttggctagtacatatttaggatttttttaagttggcacattattaataaaaacaattttcatttttgcagtagaaacctatttggtaaataatgtaattttgtttcaacagaacctattttcaaagtacaaatctctagttatatcctaattaaactaggatattttctttggcatgaacactttcattagttttgatccatggtccttttcattttcatgccaagaaaatttagtaaagaatatgagattaaaacctaccttcttagagtgatttcagtgttttgatttggattaccataatttaaccacacatatgaatgacattctttgtgatatttccgtgtatgccctccatgtgcactactcagatctacactccttttatctgccccactccccatattgttcttaatctctagattgatttttgtttagctttgatatataaaagaaaccactaacattcgtttttaggttatttcacttaagttctccatttttcctgaaaatgaatgatttcattagttttatccattcatttgtagattggtgcccagcttgactcaaaagttattgtggataatgttcctataaccgtgggatttaaatatctctggtaggctggtatccaattctggtggacagatgctaagatatgtgagaaccagatcacatgacaagtttattagtttgtctgtctgtctgtctgtctgtttgtttgtggaactttcattcatagtattttccacagtggatagaataatttacactcccaccaaccatgtgcgagaggtcttttccagcaagcgccttgccagcatttttttgatggctgaaaaatctttcatttctacttttagcatattctaagactaaaagaaaagtacttacatttattgactatataattatatgttaggatatgcttgctattttagaatcttgtctcagtttatcctcacaaataggtataatgatgacgatttgacaagggtgaaaactaaaattgagactcagaaattttctgtgaaatttgatcagtgttaacaattcaaatagctaggtgggaaagttcaacacccaagttaataatttaagaaataatactgtgaaaaaataaccttgaatataattaagaatcatcaccaaggagtacacagaattcaaattctgtgtaaacagtgaattcaggcaaaacagcaaagttgtcgaatgttaacaaaatatgtgccatttcggggatgtaaagtgtagaagcagggtttgaggtcagagagctttggattgcagctctggctctgtcacctaacaagatgtgggaaccagaaatgttaagggatttttccttttttctttggtcgggtgttgggagaatgctagtcatggactcacacatgctaggcaaacactgtatcacttggccacatccccgacccttgtttggtctctttagaattgaattccttcatcactaaaatagaataactgtttggggaacaaagttagaattctaatgtatcacgtgcctacgcagcatcttccagggtatttggcacataaatggtatgaagggtagctgctgatcttaccctcatcatcattaggtctcctgccctgctacctataagcatcaatggctttaaaaactttgccttctttttgagatttatgtctgggttctattctggttttctttattaggggaagaacccatatttatacaacatgttcttccttaacacgtggcatttacgtcagtgtaccaagggaaggaggatatgaaactcagttacaatctcaaaaacataaaatcgaacttatttcgattcaaattggcttttcttttaatataaggaagcaaattatttctgtgatttgccacctgtgcttatgcttaataagtcactgaaatgttctactttttatgactatttctgtaaaaaggaattgacactataaaatgtagagattttaattacaacatttcttccctccattttctccctccagaccctccctgtattcctctcccaagtcataatagtcctcttattacaatatattatattattatattatatgagtccacagaatgttgcttgtatgcatgtatctagggctgaccttttgacactggacaactaattgttgctctgttttctgggcaagaccacctctctcacttcctgctcctagctttcttcagttgcctgtagttcattatgtagagttgaggtctcctgggctattctccatctagtttgatgtgttcattgatgtcatctttgctcagctaaaggaaatgtgttgctaaccaaaactagtaagaaacttccagagaggaccaccatctactataaatatatggcagttggtagctgctaagggaaggagaatcattagtctttggggagatgcaaggaactggccactggcatcttcccattatccagtggatggtctcacgcctgtgcacagcactgaatggacccaacaagttgtaaattttaaaaagccgacaggagtctgggaagaaacatgttgagggagtccacagggaattgaaagagaagtgaccaggtgatcaaaattcattgtggagatgtgtgaaaggctccacaagaatacactttaaaagtgaaaacagggccaaaataataagtatataaattacaattatgtagaccatggtgaaaatgttactttgaaatatgtaatttaaatcccaaactaatcaaatgtatgttccttaacaaagaaaatttggtccaaataagatggcttaatattttgattatatcaaattatagttatatactggtacttaacacttctgtttattaagtatctagttgaaatgcattagaaacacactgatgatgctttgtcctgtctttttttttaaagatgttctttgcttctacactgagcaatgaccacagccgggtttaccttatgagccttggaaaacttgaagagctccatagaagctatgctgtttaaaggggtccagtgatcgactacaacctttacatccaccacacacatgccattgaatcctaacatcagaattttatcattagagaaaactttcatcagaggcttttaatgtagcacagaatagtttggataagaaatgaagctttataaagaaaattaactatagcaagctctatgtactccagtggtgtacaatctgttttgcacaaactttgtaacttttgttactgtgaattcaaacatttctcttaggacagtttggacagtatctgtattcagatttacagcatggagtaaagaaacctgttataaattgcatcaccagcaactttcaaaggaattggccctaattaagcttttccaaaacaaaaaaatagatacatgttttttttttccaagtgaaggttagattaaaagacaaaacataatgaattttgcaacccagactaaggttgaacaacctgtgtgcgcaaagaaaattacatagatcaaggggaacattctacccaattctttttcacaataaatacacaactgaagaccaattgtgacttttttccagccccttgttaaatttaatttttctatatagaaaaagagaagaaaacctcagatgcttgcttctgcccccctaaaagccccaaatatgtgtaagaactgtttttataaagtaccaaacaatatatttactatcttgaatacaggactgaactccaatgcacatgtactgtagaaaaaaaattttaacacatcaaacgaggcgtcaaattttgtcccccaaattggctaagttttgaattttattatatagccaatgctgtgaccatcagacaacattaaatatttttaaatattgaaatatgttttaaatacattaaagtatataaaatgtcctccaagttattaagcaaagcaatataacaaaaggagaagaatgttgattggcaataattatatttttacatttttatcactacaaattcaaaattaagataatcaaggtgataatccaaatttagagtcattcgttctaggtatgaaaattacaagaattttagaaaaaatataacatccactgtatactaaagtctgcaaaactgaagcagtgaaattcatgccagtccatatccacatattttatagacgccaaaaataggtgatatttcctcacctatggtaactgctacctgatttttttaaagcgtgatttatacctatccatcctcaatgacatggttagttctggggtaataggaaaaactacagaacctaccacaaagtatacctcaataagtcctctagctctgcttctcaaatctgaagagtgtgctagcaggataataatttttaaactacctggttaaccaaaacaaaaagcagctgactatgtgtgatttcctgatagtacatcatttcctggtacctttgtgccagaaatgaatgaagatttggattttcctaatgactcctatcaagagtgtagtaactcagtgttcagattataggagaacctgaatccacaagttaactgtgattcgcatttctgttactgtgacacactaatgtgacccaaaaactggcttatccttgagtgtttacaattcaaattactttttttaagttcagtagttattttaaataagcaaactttaatgtcaaattaatacattagaagtagctttctttaaaacaaaaaaaaaaatgtacaccaaaaggccatgaggaactttgtgcaagtaccttatcgctgaggaaatggagcttgctatgttggaggttcagaactatttctcatttaagtagtatgtaggatcaaaccttttaagaatttttttcttcatatttactcaaaaataagcttacaataagttttatcttaaaatcatatgtttaaggcagtaagacactaaaccaaaacaaaaaacaaaaaacaaaaacattttaacaactcaactcccattgttctctgtggcatttattccagcaagcacaggaaatagcaaagagaatctacaatgctgtcccaaagcaattacacatgaaagattaccaatgcagggctgggctttgaaggccaaagtgttagtgaagaaacagagcttgacacctagcaagaagaaaggagtttggagcgttgggtgctcaagtatgaaagattgaaatatttgaagtagttcattagtcataaaggtcactaataaatagttgcaacttaggtgtaaatctgtgtgggagttttatagcctttggcaggtgaaaaagcagactgggactatgtcctttcctcctcattatactttgtaatagaagaaatgacatatgccctataccttgtaacaggacctgcaagggccaatacatggcagtagtgtggagaggcagtccagaaagccagttttaatgagaatcctggttggaagtgtgaacattttggcaggttaggagccgtactggagagagaatggtttgattttgtggcagtttagttttattaccaaagcactggtaataaaatgcatcatgtaagatgtctgaaaactagaatagggctggtaaacaaatttctgaatgaatgagtaaattcaaacaaaggcagatcgtaagggcaaagagcaagaagggaaaatcagccactcaatgtcccttcgcatggagttcagaatggacaagattaggtactttctgtatcaccatttctgagataaattgatagctaagtgatgttttcttccaagtttcatttctttgagtgctagagagatagctaggtaactaaagcccatgccttatagctgtaaattccatccgcagacatcacatacaaattccagtcagtgatgaatactttcaattcctgtgctaagaggatagacaagtagatctctagagcttgctggccaatgagaagccctatctccaaacaggtggctagatggcactcctgaggatgacactggttgttatcttctactccccttctccctccctcgctttcttcctccattcctccctccctccctctcccccctcactcatacaaatacatacatgctcacaaaaaaccacaagtacacacacacacacacacacagacacacagacacacacacacacacacacacaaatacacataaaacacaatctattcatctgagatagtctctgtacgatagagagtaagtaatgccacacactctcaatgggatctttgaagtacttttccggttgttccaagacatgttccagtttgcatcatttatattcaacttgtactgagttaacctttgaaatgaattgtttgaccagaaactctgtaatgaatcattgtttggcttctgaaataaaaatttgcagtta

SEQ ID NO: 296 - DNA, 96119 bp, mus musculus
cctgccccggccgctctgcgctctcgccgcggagcacccttctggcttcttcgtctctcggacggacggacgctagagctctcttctccttcccttagccaaacttactttcccgcctcccgaaaaactccagcttccctcttcctcctcccgctcggctctcggctcttttcctctccacttccctctcctctcccgaaccacaaacccaccttcccattcctctctcccatcccatcctcccttcccgggacccccaaaactcttcctccttcacctcagacgcagtcccagcgcgcctgctggacgcggtctcccgcttggttcttctcgaagccatggcaggacctgggagttggagggacaaggaggtgacagatcttggccagttgccggtaagtaaaggactccgggacatcgtcccccttgtgaacttctttctgtggctttgaaagcccggggaagagagcccacaccctcgagtagcctaggccaggacttcgacgggctgtggcttaggatgggccagggaagctgccgtgcagaatcaccatccctgagctcccgactgaggtgaaggccacaaaacgcaaaggaatgggggatgggggggggtgagattggggagaaagaagtgggtcctaaaaaagggtggggccttttctatatagagcccgctttgtctaacagctgtctagcgcatgggtacctgtaatagaagcattccgggaaaggacaagtggcggaccaccccactttccttctttttgccagcagagatctctacctatgggcggagcccccaccccacccccacccctaccgtaaaaaaaaaataatgagcacacacacacacacacaaaatagaagcataggcatcacgcggctcttactttgtaatagtttctaaaactttattctcaccaggagaaggttctggagtaagtactgctggagtgaaaagaactcgacgcctctcagaaaggaacggaattctgtacatgcctattaatttttaaaagtgtatcatctctcttagataatgaaatataactttggtcatagttatcatttgtggggtcttctttttcagtgcccggttgaaattgattggtgggcttctaaagccatcataaacagcagacatactattgtagcaacaccgtgtatttcaacggcatctggtttctcgctgatactggatcccacccaaattcatttttcaagttccctttttagattggcatttcacttgcaccctctcttgaatgcaaagggcccctggattctccaaaggagaaatgagcaggcactgggctggaatgatcgccaagcatgtgtgtagtcagggcagtggcctcctcgccttgagaaaagctaaatattaaccttgaggttataggactattcaaagtcatcttgccttaattaattttgtgtatgtttggcatttaaagatatgtgttgttaatgatggcagatacttgcctccctaaatgcgggacagtcccaaagcctccctttatattttacattagaatggtatgtggtgtggggaggtgatggacatggctaatattctagcaaactgttatcagtcattaaaagaacacacttcaatacaaaactgttgaatagcaagtattaaaattacagttattgcaacttcagaaaataaggccaaagcatttttaaaaattaaactttttttcttcccagatactcctgaaatcacttcttttccaggatgtatggacgagatttctggactatggagacttcaattggattcccttccaccagagcaggacttttcccattcagattaagattgatttgagactgtaaggccaatgagtgagctcgtcccctcctcagcctgctctgggggaagggcggggcgtggtgaaagcacacgtggacgcactgaaatcaactgctgctttctaaaaaaatgacgaagttgagggatttaaaagaccttatagaaatgatagcatggggaatttcaaacccctaaagaacaacaaagggaaaagggaaaggtgtgtttagcccaaagaatggactaaattccctggattagctgacatggccctggctttgggatattctgatctgaggcatgtccatgagataagcatgatctttatattacagctcagtagaatattagtgttctccagattggtggagggtggcggtggttcccaaagagcaagatgagattgacttctaaagttgagacatatggaaaagacacaagaaccatgggtgccaatggtcttttccctcatttttaaatcatcatgaaaggtccagtttaagaaaattctttatttcagaattttataatagatccgtttttatgtactatctgagcaaatgattggtaattctcccctttcccagattcaaattccaagaaaataaatatagctggagagcagcatgcttagagatttaaagacatggtctctgcagtcactggggcataggagggtttttgttttgttctgttgacatttaacatatcctgacgacttcaaaagaaaggaatagagaaattgatagttaatttagtttgccttttgatggcagggagagatgttcaagtaaagaaaatggcctaggcagtgtcccttgtagtaattattctcaataggacacatatgaaggacagaatattattggcatatgtccctggtaagtgtaaccatttgaaaacagctagataatgagaagagattcaaaccttgaaccatcatattgatggtatcctggaggcttgggtgtggcctggcctagcagtagattgagtgctaccatgccgagtccctgggttcaattcccatactatacaggcactcgtcaacatagacatacatttttgcagattatagaaatacaattaaatgtaggtttgagatttgaatattttgtactctttgtggttgtgaaatttaatgaccagcaaccagaaacctttgagagtgcaagcttgtacaagagtataaattggaatttaaagaaaggggtagagatttgaataagaggtagaaggatcatgagtttgaagctagtgtgaactacaaatagcctgggcatcaaagaagatcctcttttatagcacacaataacaaaacagtgataaaaatgcctgtgcaattagatagcattttattattctgatttttattaattttactaatatttattaatataatatcagataaaattagataacattttattcctaaaacattacacagacaagaaaatcacaaagtacataattgtagatggtattgtaatgtaattataaacccttttctataggatcttagagacataaaataagaaggccgatacaattctcagtttactcttggttttgaagacagagactcgtgtagtcctggccaccttctgaactacttatatagctgaccctggccttgggctccttattcttaggctcttattttcttagccctggtactaaagatatgggccaccatataaccatacatgttaataaccggctgtaatttttcccaatttttaagtggatataaattttctataggtgaaaaaaaatacagaggtttgtagtgtatgcttcctttcttagaaaagagaattgcaatgttgtatgggttcatgcatcgttttaaaatagtgtgttttgccttgcttacctatacaaggggtgtacttattatttgtttatttatttatttatttacttattctctattaatgtatgatttattatatatggcctgcataactcaatcctctttatctccagatctagcttgtctgtcactatgattgtcccccaagccttctaatggccacattccttgtggcttcagccttggtatgtgacactgccatgtgtactcctaatctatattagggtcaggattagatagtctttgaaaacagtcgtggccgaggcgatctgaaatagtacatgacccaaacactatatttgaattacattaagtttatatttaaatataccttccagttttcccagccttcactaagaaggcaaaccctgagttcagcttcccactttaccaagtcccttagcggctgtgtggaagccattttgccttcaagtgcccaagctttgaaatatccagcacaccatccattgtaagtagaagagggcctcagcttgacattgtaattcaatttatttttttctgagccacgttccctgtctctaggccagtgtttttttttcccccccataggtttgtgcagagacaacagggtacaagagttgagaatctcctgggtattttaaaagaatcgtctaaggaaattctgattttataatttcatattagccataaagatttatttttaacaggattctctcatggagggaaaatctctgcatggagtatgagctagtaacctataaggacttttcctttctaagctccagttctattgcgaagctcattcttgttactgactgagtttcactctagaacttatcccattagagccgacagtttagagactacccattagttcttttttatatatataaaattacaatttgtaagattaaaaatggggaaggagaatcctgtgccgtctccctctgcgcacttggagtgtttagtccctcctgtgttgtgtaacccggggaacgccttcctcctgtttaagtaaatttaagcccacctggaacttctggctacctttgaccaggtgctgcctttcttcctcctttccgcaggcgcatcttccttgaccagcagacattgcctcctagtggttcttgtgcttccttcttccacacccttaaggaaatcagccagtggggggctcactcttgccttctccctagtcagaaggaaaaaaaaaaaaaaaaaaaaactctcaaattccagtttgcaagggcaactcaattaggatttccatttgaatatatagaagtatttgagaaatgtttttaaaaattgcttaacgagtcctgactcagaaatgactttatttagctccccccaccgccctccattttgagagaagatctagcgattgggtttcttatatacagtacagaataaatgtgtgctgaataaaaataagaaatgagatataaaagctgtgttttaatttaatagatcaacacagttttttccttcttttatcttaatttagttaaaaaaatatattacaaagtgataaagattaacaacaacatcaatactaagttcaatatacttttaagacgtgaaatgtaaaaatgttttattttatttaaagtgagcattaaggtcattaagatggtttttgaatagaaaaataacaagatttctaacaacattgatgaaactaaaataaggcgctgtgatttccacagtccattttctcacttaaaatctgactataagatatgctcattattgatgcacagacacgggatgaagcaaatttctgatcttttttttttaagtttcagagaatcaggctgagtagacaatatgagagttcactaacatatggtatctttatcaatttaaacacagacttataaaaataatagcttaccaataacagttagctaacttgtttaattgttttaagaattaagcagactctgcaagatgctcggcaggtaaatgtgcttgctgacaaacctcgggactggagttcaatccctagaactcacaaggtgaaaggagaaaatggactcctgcacgttgtcctctcacatggcatacctgaatgtgtccatacatgtacagaatgaatgaatgaatgaatgaatgaatgaatgaatgaatgaatgcatttttattggttgtttctcttgaattgctactaaggtaaatgtacttctcaatgatacatttaaaagtactgtactaaaataatcgtgcagaaaagctggttcttagtaactcctttgttgcttaccttttccccataaatctttccgagtgacagcaaaagtcatatactagacagtaaacgtagtctgcgtctcaaattctaaaagctgtcatttaaataacatttttattttgaatagaaaaatacgccctgatctacttgcttctaatcaccacttcattgtgtgattattttaagaaaggattctagattcctgccttgacaatcgttttgtcaatcctgtggagacatctggactttaggatgagagaatctaaatattagagctcagaaatcactgagcataatgccttcatttcacacatgtgataatagaatcctagagtataaatgagttacctagagttgtatagttagttaatagttctggtatgaagagccaagagaatattgatttacctgtgccatgaaaagacactcaaatgatacaaatgtgaatgtaagaaggaatacccacactatattcaggttttacagtataattacataatttcttagtattcttttgtgtgtgtgaaggactctacttaatctaaggacattgttacctattcttttgggaaacaatcgattcgtcacatttttgggctgccttttgttttgtaaattctaaagaaacaatgcagattggaattttttttcaagaaaactgataattttgttctaatttttgtaggatccaactggaatattctcactagataaagccattggtcttggtacttatggaagaatctttttggtaagtggagctaggttacttattcatgcttgattttataataataacagtaattgtgagtcaaatcccaacaatgcaaataaaacactgttaagtgtagtgcattaatctgagaggttaataatgttaaaatatatcatggacatttttaattttttgtttattaatgcaaaagaaaagcattataaaatctgttgaaccagtgaacataagatgtaaaatacatagcaaaaattaaattgttcagttgaaaggagaaaaagtaggatgaaccaaaataataatatcatttattttgtaatacatatcaatgttttagttgtccatattgaactttaagttggatgttttactactgataatcaaagttcataattttccattttagcgcacatgattctataaatgtataaagtttgttgaagaatttctcacgaaataatatatttatttaataattatatattacacattaaaggcgtcccaagaactgtgataatctcttgggatgaattaaagattaaacaaaatatagttcccaattttctgggggttataatattgaaacattacattaaatgtctatatgtatagggacttgtttgagacatatccacatatgtaactaatcacacaaccatataattttgtcacgtattaactctgagaaaatttatagcaatggagatgaataaaacgtggaagtttatttagatgagaggatcattcttggcctagttcctggaaagttaaaaactgatatcaggggtataaatatgaagtgttatggaggatattgatacattttaggggtatgacagtactaacctctggcatgtatttggtcaagcctgcttcttgtaaaatatgataaacttatgcttcctctatcttgtaatattatacaatataaggtctatacacggaagtacttcttattccaagaccttttccttaaaactaatatcactgtccctaggctaattgttactgcccacaggttacaggcatgtttatactgaaagtatagcaatgccctgatataggcctaaaggaaaaaaatctttgttattcagacaagggtaccctctatcaggacttgtctggagcaacatcttcccagtagagcttcttctctaatgtatctgccagcattggtgtaaaatatgcttttaaattttcataccaaagcacagtccacatagcagcaatagcaatgtagccatgtcctaagtgtagaaagaagctactgggagaggagagagagagagagagagagagagagagagagagagagagagagagagaaacagagacagagggagagacagagagagacagacagacagagacagagagagacagacagagagagagacagagagagacagggagagacagagagagagacagagagagagagacagagagagagagagacagagagagagagagacagagagagagacagagagagagagacagagagagagagacagagagagagagacagagagagagagacagagagagatagggagagacagagagagagacaggcagagagagacagacagagagagagagacagagagagagagacaaagagagagacagggagagacagagagagtgatacacacagagagagagagattagagagagagagaccataaaaaggataaacatttcctcttcttcaaatacacattccttcttacacattaagcagagttgattgtctacaaactaataatggcacagagccaattacattgcttacgctgagttttatttcctatttgttaaaattctcagttttgcctttcgatctaatgataaagcaccttatatatggataggaaaatacctttgtataagagacacatttagaagatgggtatagtctataaatatctcaattcctgtgttggtgagtataaatatatgtgtatgtataattcttctgactaagaagtataaaggcttctccatcaccaaagtttggaactaaggtaagaatcaaataaacatttatcacaagggtgatctcctcatcaccagaagaacaaaaaaggaaaaaggtatgttatgcgtggaaatttactttttgaaaaacctctggttctagtatttaaccaataactttcactcacaatgaagacttaaatatagattttatgttagtgtaagtcagtgaatgcctttacacttagatgggtgatatactggattatgttcaattttgcttttacatatcctgcagttgtattttaagcttatttatattgaatttgctcagtgtttctatactcacctctggagggttgccttgtcagctccctcagaccaaataaaataaatgctttttatatcaacttttgcattagccatttctagaattttctttaggaagatctaattttatatctgataggaagagcctaagactgaagaccttgatgttccttgtaatttgaggcttctactaaggaaatccatgacttctccattacttctcaaagatatttacggcaatataaacatgtcactctgttccccctttgtttccatagtttctgaggttgagtgtgtgtgtgtgtgtgtgtgtgtgtgggtgtgtgtgtgtgtgtgtgtgtgtgtgtgtgtgtgtgtgtgtgtgtgtgtttgtgtttcagagatagcccccctctctttcttgccccaccccagtagtattacttcttaccacgttcttgttaaccccatgctgaggctagggggagttctcgcgacttttctctgtcagcctcacgcttagccaaaccctctctctgtctctgacatattccacatcgtttggcttccaaactagttttgacgtctctccagagaggactgtaattcttaccttttacttatctggactcaggaatgaatgggattatttgcctttcatttgaataggggatttattccttaggtagaaaggaattggtgtactttctagtgcttctcagtatgttggtgtctcttcataaactctgtgccatgaatacatggagagatgcctgtatgcttgcttcccaagacttttgcactttcatctaaattcacacttgacttgtcataaatcacctagaatacatgatttcttcatgtgtgctcatatgtatgcctatttccactgtggccatatgtgagcccatgtccaggactgatttagtcttgcaggtggtacctttcttcatccttaaggctcatgggttgctttcacacttctctctagattcaaaagtgtgattttgtatatcatttagcgttttcttactatgagtctaggagtggttctcggttttgatttcgtatcctcatccaaagtgagaagtcaagtaaatttctcttaaatgaatgttcatgaagcaaccattcattgtatggtaggatacatcaacttccaagaattttatatgaatctattcagatctagagatagaaaacgcttttcactgtcagagttttctaaggaaaaactcgttgcaggatattgatgattaaagctctatgtacaacataaatatttctctctgttattcatgacacattttattatacctcagattaacttccttttgcaaaaaagtatattaatactacccccatagaaaacaatacagagcaagttgtaattgatttttaaactgagtatactttttatgctaataattctacctttagaagtttatgataagtactccagattggaagcataaagacactccttgtggtgtagaattagcatatttttggtgaggacatagctcctttgaaccacacagacctaatttggtacttagagctatgaccttaaatcagttatattacctctgactatatttttgttgttgtttataagatagattctgtaagttttgaagaagctttattgaaacaatatttatagaatgtttgacatatagtaggtttcctttaagacatctattactgccattatttttagtattattttcacacaaaaaatgaactaacactggaatggatttttttaaaaaaaggagttaccttatacttactatgccactattttgtaaagcagtatttagtaaaaggtcagaggtatactcaatgtgctaaataacacagtattgctcttacatcatcattatagttatgcctaaatatgcagatgggaaatattgaaataaattcttagattagtaagatattgggtaattttctagtccatagtttttgctagattgtcattccagtctgtgatgttacaaaaacatatctgtgtcttacatagacatgtacatctattttctgttatatattagacattgcagaactaacctataaaacaagatggagataggataccattcgaagttaatgtgagagtgactcacagagcccttcactttttcagtgctgccaaccacatcccctgctgttgtttgttttggttcaagtctctctgatgtcttccagcttggttccaagctctccttctctagcaggtttccagctgtctgctgaggtctgtgcacatggaaccaaagcccgagtctcacgctacctcctaagtcttttcccttccttcttctaattagacacctagcttcccaccctatcccccttcctgccactacaaacttgacttgaaattgtgggcttccttttccttcctcgttcttggagaagtactgctcttccatttccccccaagtagggttagaaatagtagatatcgctttacctttaattcctaggctcatagctaggtgactagtcatttcaattggaaaaatatttaatattggaccaagaaatgacataggtgcaaaaaagaaaatggcttataggctagtaagatggcttagtggctataggatcttgtagcacaagcctgatctgagttcaaccagcagagcccttatgaaggtaggaagaatccaatctacgaagttgttctcctactgtcatatgtacaccatggtacatgaatgatttccacaccccccgctgagaaagggaggcataataacagaaaatcagtgtttcagaagagagatagcaactcattctacaacaatgcaagctaaaactcaaatttctcaaggagagatgtacacagaagtactacagtaatttcatgaaacatgaagtaacagacaaacactctttagagaggaagggtagaaacttgtaacctgaccctcttaacttacactaagcatgccctttaagtcttctgagtatatttgttcaacaataacctcgatacactggacaagagaattgccaaagtttcctgtggctttgagatatagcactgtactactgaatacctgacaccacatatgatgtaagcaagtcctactctcagagtactaatgacaataatcctgtacttcctgaccttcttgcatgctaggtgatggccagctagtggcaattacttggagcatttctctgttttagttcacatacacacaaatattttttagcataattttctgttcccgcctcgatttaccccccacccccgaagtaggcttgagaattagctgagttattattataatatcccttccaaaggtaaaagctggcaccacagatgctaagaatgcaaaagtacattagtatgtggcacaactgggccaaatacagtattagtaaagtgatgcaggcgacaggactttctgaatggacagaatgggtacaatattcatgaacactcacctgacctgctagcatgatgaagtcagtaaaaggaagtggatgagacaaggcagccatttcaagccaaggcaaactcatctgagttaccctacaaatgtatggccatatggagatagttctgaaactgaaacttgccttggttgttgatccttgggagagctgaatagagaaacctgccctttggtaatcagaaggttaatttcaggtaaataagaatgtgccattgtagttctgagcaaatccctgacctgttttcactctggaagtgctacagtgattgtggaaaacttgttttaaaaagctgcctaatgtatggctcttaaattttattttttttacacaatgctgtgcacactgctcctagttgccaagcttaccagacaggtgagatttaggtttgttcgttgcattttctgcatttgaatttggagcaaggaatgggaaaagacaggaaggaaagaaatgtcttcaaagttgatgacatacaatttatgatatttaaaattaatttccaaaaatatggtgctgacatttgagttgcctagccactaggtctattggatgggagagtgaatattttttccttttaggctgaaattatactgtttatttgcctaccaaatgtctagcactgtgaatgctttctttttaggtaggaaagtttcctcacatccttgccattttgcaaatatagctcaattaagtcagccaacaaatatgacttgagtgcccacagagaacacaacactgggtattttatcatacattgcaagcctctcaagcaggagttgaagacgaagattaattgaagccataggcatatcaagctattgtgccttcctaatacaacatcccaattccagagctggccatgactccacctccttcctgtgccacagttccttttggataatatgcctctggtgtaaggattagtctttctcaagtaacacgagactgccccagcataagaaatgttaaaagtgtttattatataaaggcattattttgaatgtttaaaacactcatgatagaaattcccaaaaagttattgaatacatactatgtaccatattctgtgttgagtggaatgtggtaagataaccaaaacctattgggaggctggtttttcaagacagggtttctctgtgtacccctggctgtcctggaattcactttgtagaccaggctggcctcaaactcagaaatctgcctgcctctgcctcctgagttctgggactaaaggcatgcaccaccacgctcggctgggatgcaatttttcttgtcttacttaactgagacccacattagaggaagtaatgatgctaagaggaaggaagaaaaagggataaataagagtgggcaagaggggagaaaatattaatggtatttatttatttatttatctatctaattatttattttgctggctatagaaattataatgagtcaatgaaattctaagaagagtgttattgtcactaagagaacagagctagaatatttgtagtgaggatggtgaaaagaaccggaataggctaaataaaatgagacccaggccacattaacggaaagtactgagtcttaaaggctttggagaaaaggatagctttctatcttggcaatggcacctctcaaactggaaatggaggcaggcctctgaattttagggttgcatgttttctctggtttatcaaagcttatgtatctcaattaatcttgaagaaagaagaagtcattactattatagttaaagaagaacaagtcatgtgtgaatttttcccctaagatcattaatgtagtcaatataatatgtggatatgcaagccttaagcacatgtataaaatcacactcatattcacagagcaaattcagtttaaggcatttcaagtttcaagagtttctgctttgttttagcctttagtagtttcccactaggtcaccattacatgtcattagacacttcataaaatagcccttgcttattgaaacatggaattagaattaagaccgagccctaattggttttagagctgctcaacattctatcatacttgtatactagtctctaagatactattgcgagtggagccaaatgtgtttagaagttaactgtgactctctgaacattgtaaacagaaaattggaagttcttagaaatacattttacacaacaaatgcaatggtaaaaacttacgaagaatcctattagcaaaatcaaataaaaatataaaaaagcaaacaatatacaaacaggtctttatgcttcagtttttatttttctctgcttatctgcacaatattataataaattgcccctctacaaaagcacagggaaaggaaagggaaattagatgtgaattttgtgctattaaataagagaaataatggcaccatggtgtcttatgggtcatttttattataagataagaaaacttctttaagtttgtctttttaggcacagtcccttcatgactagaaaaagaaagctagattgtttggagtcccctgaggcgggaaaaaagattgattatattctaagcactgccagcaacattttgtataaataattaagtctgaagttcaagacagaaagaaagaaagaaagagagagagagagagagagggagggagggagggagggagggagggagggagggagggaggaaggaaggaaggaaggaaggaaggaaggaaggaaggaaggaaggaaggaaggaaggaaggaagagaaagagacagaaaaagcaccatcattatcaaaacttacaggtctatgagtctttggaggacagcttttcttgtctttgagaaaaatactagactttttgatgtaaacattatccacatttagagactgtgacctcaaggtctaaacatttccttagttcttacattgtcactagctcttacttgtcattattgccttgacatctcataagagcactgtgatgtaccttacctatctacacatgacagaagtgaccatggaaagataatgaacaaactgacaaaagcagtgaattagacatttcagaggaaaccccacaattccccagtccctaggtgtgtgctcttagccctactatgttatattcatcttagcatgtccagaccagaaaaaaagcagtctaatagatatcaagtgaacataagtatttgtttcacgaagtgcaaaaataacctcatttacaaaacaaaacaaaacaaaacaaactaagctcaggtcatgatgaagatcattaacaatgtgtccgtggaacacactgttttcttcctgatgagtactaagacatcatttcagaactggatgggaacagataggctttaaaggatgctcagggtcataactgcactcctcctcagactcctagaaagcactccctattgtctggtgcccaaggttctacttatgagtctagggacattttcctcagttactgttcctacttgtcacccccagggaaaaggaaaacactaaagaatcatgtagagttaggccttgtgtataactgatttcttttctttctttctttctttctttctttctttctttctttctttctttttaaagatttatttattatgtatacagcattctgcctgcatgtatgtatgccttcagaccagaagagggcaccagatctcattgtaaatggttatgagccaccatgtagttgctgggaattgaactcaggacatctgaaagagaagatataatgctcttaacttctgagccatctctccagcccaatgactgatttcttttattttttttaatgttttcaattttttaaaagatgtatttatttatttaatatatgtgagtacactgtcactgtcttcagacatgtcaatagagggcatcagatctcaatacagatagttgtcagccactatatggttgcagataattgaacttgagacatctggaagagcaaagtgctcttaacctcatagctacatatccagcccaatgactgattcctttttaaatgctttcatttaaaaaaaatatttatttatttattttctatatgtgagtatattgtcactctcagatcccatacagatggtagtaagttaccatgtggtggttgggaattgaactaaggacctctgcattcataatatgtttctagtagcatgtataaagattagaatgcacaaaacttaagaaccccctttctctgcttctcccagaaaagacaggaaaaacaagcaaacaaaacaaaacaaacaaacaaacaaacaaaaaaaaaacaccagaccatagcttggaaggttagacaggggcagaggatgaaacccatggaagtagacagtaagagtctggcattagagatgtggaggtgagaaccaggtgtgctgtttttaagtgtccttacattgttcctagcagagggggatgcaggtttcaacagaacttaccacttgaggtttccctagtggttaacctctacaagagttttgtaatcagccaaattcttcctaccttgccacaaaatagtattgtgatgacagtgaaatccagccagaaggtttggagtggatgtctaaagagtaattataattagtctttaaaactgctatacaagttctattgaaagcagggattcaagtgtatgtttttttctttattttgacaatcctgaagtgcctaataaagtgcattgcatatggctggcatagaaagtcatcagagataaataaaccaggaaaagtttcctgtcttccttttcaattgtccacatttatgtttccctttatcttaaatattatcatttaacaaagcgatgatttaaataaaaacactgtgcatccagaaagtctattttcatcagttttgtattctctttggaacaagcatggtaactaatatgcatggtgtttagcatattttctattggaactaaatggatgtgtgtagaagtgacctcctctgaaatgacactttattggtagctctctgcagatgtaccttgatggagaagcctaatgacaccctgcaaagccattactagagacagattagttttttcaaattataccagctaagtgactttctattctgacttttatttcaaaagatggtactgtgtagagataaatttttccaaaggatggaaatattagccctgctttttattactctctcctgaatgagtcatttaggacgcctgaaagagtatattttttcttagggtactgtagtttgcagtagtgttgttggcatggctgaataagatggtttcaagagtgcttcataccttcaggaagatgtctagaacatgttcaaatatttcctgacttggaaaattggcagccattagaaagaaaaacacatataaataagaacatacaagttcttgcttcccttcaccttctccccatgctcaccagtttctgaactatcctaaattttattatgctttaaaagaaatttaatggcccaaaatagtaaactttagaagatttagtaggataaatttttttagcagctcttcttctcctccctctgtacctctgtttctgtctctgtcctttactctccctttcctcctttttcccctcgcctctccctcccctccctcccccccccccgtgtgtgtatttatgtatgcttgatttatgaccctttaatacttttaaaacatatcatacttggcattaggtagatatattcagtcctcagttgcgctgagaaatagtcagtgtgaacaaaacggtgtgaactagttgaagcatgaaatagaggagtgatatctgtggagtgtggagtctgtgtttattccaaccggtgcattgtgggaacacgtttgacttctgtctttaacaaaacactactacccctgaaaacacacagatatagaataaattttatgactgttttttaaaggaaattattaaaaatgtttgtgggcacctggtatatatagccttactaaaatagaacatagatgttttctattgcactcaaatccaaatgcctagacttaagagaaagaaattacagaagaacaactcactgtcagcttctgccctaaggctctttagatgggatatgaggccagaactatccagataaaccgaaaccttccagaagtccctccaatgacatgtgtgggtatgtgagttgataggtcaataaatctatgcaagataatgtttataaaacaagaccaaaataattatatccataattctgttggagcatatataagacatcagggataaataaacaaggaactataaaatcggacaatatgtatttcgttaactttttaatttttgagattataattacaataattctcccttcccatttgtcctttacatgctcccatacaaccctcctaccctcacctttgattattgttacatgcatatatgtatacacatgtacgtgtatagtgcttaagataacctgctcagtctggataatggtacttctttgcatttcagctttaaaaggcaaaagacctactcttctgcagcacgcacagtgtctgagtgtgtgtgtgtgtgtgtgtgagagagagagagagagagagagagagagagagagagagagagagcaaagttcaactcagtaaatactagtttcttgggaattatgttgatttttttttcctagactgctacacatttgatagatgtgtgagatgtagcaatcaagacttattccttgagcatgtgtctgtaggtttataggacttgccttctatttgccagaatgagaggtaaactaaacaactttaccaattcctaattgagtctcctgttgaaaagtatccacaagggcaagggctagataacagttagcacttttcagtgttctctgcagaagcattatgccaaaactgattgactacttaattgtgtattttccatttttctttatttaaatattatatttcaaggtcttactgatcaagtagggagttaaaaaaaaaaggacaagcaagcaaaggcatgcgtgttaaaaggacagaaatagaaggatataaggcctttagaagcagagttgccaatttggctcccaaatgcaaaatattcactaaaatttcaatcgaattgaacagagaataattttgagcacagatatgccccaaaggggtatacgtatactacaagcacagttgtccatctgaaattagaatttagctgggcaagtcctgcattttacctgccagctttacctagaaccagctttacctagtcacaaatttattatctggtagccttatattaagaaataagaggggccttgtcttatccatctgctctgatatggtaaggaatgctgaatcagcttaactaaaactgctgccaaagggtggagagggttggtcttctagtcctaaaacagctgctactcctccttgcatatagcaaatgttgtctgtgcttcttttggagctccatggcaaagtgtcttggttggcagctatcagggttcactaggtgagtaattctttcctctgaacggctgagtctagcaaaggagaacatttgcctgctcattctactagagtggaaaagacaatcaaagtcactctgaaccacttggtggctttcttttctcttactgtacaagtagagggttctagactgttgaactcattagttcctgtgcagcttaagtgcacccaatggatgtgagtccaatcacctagtgtgattgtaccaactataaatcaataatgttgattattttctgctgctagaagatcatatattctatgacagagatgaggcaaaccagtcccagaaagattagtgttgtttcgaactcaatctgataaagttcattacttgcattgtgatgtatcgctcttagtgtatatatagcactagatcctttagcttaagaacacatacatagatgccattagtttgtatatagtgtagaatggaggtagactattagcaatgctgcttgcttctagccattacctcccccacttcaaaataccattagcatggtccagagatgttccctcaagtgcagctcacagtctccagaaaaatagtgtacccacagattttataaagatttcaaaaggaggtctcaagttgatgtggcattgcgagctgtgccatgtgggggactgctgagacccagtggaaagaaaaaagaaccctgagtagtgtcatcatctcagcaacataggctggctctcccactactaacagttctctctctcctcaaacttgcttcttcatttaaaagttgagagttcatcactgtaatgtgtagatcaaataagatttctacgtaataaaatcatgataaccttaattgcttacagatattctatatactatgtggaaattaaaccctttactttgtcatagcagcaccattaagtagttttatacgtgttacttgttttttctttacattttgttgtgacattggtgtgtgtttgtattacacatgtggtggtcagaggttgagctgttggaataggctttctctctctaccgtgtagggaatgaatttaggtctgtaggcttgacagcaagcacggttacccattgagccactttttcagccctgtaacttgtgattcttattttatctatgaaatgaaggactggcaaaatgaaataacttacctaaggtcatgcagtaagttgctaagcaagatttgaaacaagacttctttggcatacaaaaagccctcactatgtagtatcaaattatcaggcacttgttaattacaaaaagggagcctcttcctgcctggcaggtgagtgacaaaaggcacagtccttcctggcatctcagaaggggtttatcataaggctccattgcatacaactcacaacctctacaggattcttttttttttctttaatttggtaagtctcaaaaaattgtgccttctagataaagatggagaattaaagaattatctttttagtcacttgatggagccaaattatgttttatggggagcagagggagctatgtgagaaatgatttagttgtttatgatgtgcttgttcagaatggccagtatttaaggattacattttgtcacaaagaacaagcttttttctaaagaataaatttatagattttatgtaaaacatttcaacactaaagtgaccagtgtacaatgtgtttttgaaaccaactagagaagaaataacttaggcatgctattgatattgtgctatacaattttttttaaaaaagctttctttcaaataactagacagtacatatataacttcagagagactaaggctttaaataagagttcttcctaggaagataactgtttcatgaatttaattccatgtcaataactaaaaattaatgccaacacttattttgaatcatctttttataatcatatcattataaccctcataccacaacggaagcacacactttggtatcacacaggtctgaatttaacgttgtttttttttttttttttttttttttttttagttaaatgacctcctgagtggaatgcctagggggtgggtcacttaacttccttgagtctcagctatacaaaacaatggggaacaggcaagatccctatggaatgtagttgttattatccctgaaagaacttgtgaaagtcttttcaccaattctagaaattgtacaaaatgttattgtcactgaagacaggagaaatgatcaaggaattattttctttaatatcaagattcttttggagctacaggcaactaagaaatgctcaaatggaaaacatagtcttccccagggaagaacacagtaaatagctatccaatagcatggggtctccccccccccaaacaaacatgcaagtggcagtatatacagtgagcagattatgtttaggaatacatattatattcatataacaattaatgaaaaaggtagtcatggatttaaggaagagcaagagggacatgtgggaggggttggagagaagaaagaggaagaagtaatataattacaccataatctaaaaaacttaaattaaaaatcactgccccgaaaggtgaagtagttggggaaatatcaaactctactgcaggtcagagtagaaaggactccttagacactataggtctaccattaaattagaaataaaatcctgaagccctcagcagggaaattacataattaaggtcaaataagtaagaatgtaaaccctcattcttttagagaaaaacaaaacaacaacaacaacaacaaaacatgcccctatcctttgctaacttagtcacacatattcaaggcctccagatattggttttcaggtagctatgacgtggagagttgaaggtgaaatagctcacttttcccctgcttccgtaccagactgccaatgattaaaatattaatgcagactgatagcagtagcgcttgttagtacaccagggaagtagaactcttcagaaattagatgtgatgtgaatggttctctgagatcttttgagtggtagccatgagtaaacaatcctaagcaggttattcgacggagccttattgatatccacaacaattcaaggaaaaagcagacgagtcttctgtctttggcacgttactcccatttcctgcaactctcccttggtccatttttgttgttcttttgaatcttctctcttgactctttcctacttagatactactaacagtgcttagtgcagtgaaaaacttccactgccacaaatttcttcagattttttttttgaaagaaactgaagatacgggaaagaaatttgttcctttatacagccattttccaccacatttatttccatatgttctatattattatgtaaaagtttaggtaatttgtcctgggtttattggatgatggtgatttgaatgtagggtagtctgacctgccttggtttaaaatatctgtttacattgctaatgccagatatgcgtggggctaggaggccataatagcaggcgaatgaatgatgtacagtggactaggtttcaggatttcattccttctagagtaacccacaatttgatatgaactaagaaactctttgagcaatgtaagcagagccagtagcaggacttggacgtggatccctctgatggagtgtaatacccttattttttatactgcacaagttctttgattggagtgcacaccaaaatcctctggaggaataatttgcacaaacacatgcccaagatctacatgaaaatttctccactagggaatactgttaagttgagctacagatatgaactggaaatctcagcgagggcttattgatttagtcaggagcttgcaaaccttaagcataagttttgagaaaatagaggtttgactcaatatggtctggttttttaaaatgataggccaagatgatttcctgcagaacattttactgcattcttccatatttatgttactggacactcatgtgctttaggtcttcttaccaggaatcacgtttttatatgcattttataaattaagaaatgcattaagccactgcttaacaatttaaggaatgggattagttctcaccttaatctcaagggaaacaggtccaaggcagggaaattgtttctgatgattgtgtgaaagttaagagggagaattccataacaaggaaagttgctcccaagaaaagcaaagccagatgtagcacctctgtaaaaggaaagagccttaagggctatgtgggaggggtgggggatgaaggcaaactactctttgccagaggttatccaattgcccttgatggagagagcctggttctcttacttttaagggctcaattctctttacttagaatgacccttcactgacccaacttcatttaaatgcaaagaaacaaagaaagactgaaggacataatcctgtccctctaaattagcgtattgaacagctgaatgatatgaccaattcagagaagagacaacatactctgtatattcaaagcaatgttttaaatttatttgtcagttcaagaaaacaggctgcattaagtcaacggagaaacaactttctcaatctctttgcacacgctattttatttgcttacctgaacctcatctagagttatgaggcctttttattctctagtggaaagggaattgacctttggatcaaatattgtgagacttcattgaagtgttcataggctaaggacttaagctgaagaacagagaaaatggggacatggtcatatagatgagactgtcttaaattgactgatgaagagagaaacattaaaattctggttgtggatagaaacagaattgggggaacttctgaaattggtaaccatggcttttactacccccttttaaatctctttccagttatcaataaagcctgcttgtctagatgtcttcagagtacatatagttcagagactatgttccctttaaaatgtggttttgattaatccattcttggatcatccagttggtttttggtcagttaacttgagccttggaactttaatactttttctttttcatatttggccatgtaaaaggaggattaaagcacatatcaaatctaagcagcaggatttaaagcaagccagactcatgaactcttgttcttactcctcccttccgatgttagacatctagtccctacagcatcaccagtgttttcaattaaggaagccagttaaagtggcatgtggaccactttcttaagggaagcccaggagccagtgctaaagtcttggcagataataaaggcaaaattaaaatctagtcactttggatttactggaaatctgctgaaacttctatgaaaccccaagacattaacagcaaccccccccccaatgataaaggaaggagggccacaatgtctttcaaaaaaattttttaatgcccttttacatcctttggaaatctaccatcaaactcacagaatcatagaagtggttactcacttgtgtttctgcttctcttctggctaagccagattcatatattctactttcatatattaattccttttatgttgtcattctctaagtcaggcttcttgattaccaatggcatcagtatcatccagaaacttgttagaaatgcagaaccattccagtaatattgaaacaaacacatctgagattgccaaccgggtgaaacaggaagcttgctttaacagatgttgtcattctgggcttacacctagtgggagagtcattgctgaaaaacatttcttagctgtattccatccttgaaattgctattatcctcccatggtacacataacctacagttatgatcagttcctaaacagaagaaaagcacattttttttcttggaatttcatgatcatttggccaaacttacttaatctctttcccaatctcatgatatatgagatacatactcaaacactcatgcacaacacacacatttgcatatgcaaagatgcagttagaaataaaaaaatatttatcattatttagacatcccaacatcccatgaaaggaaaagtaaattatcttttttttttaacttggaaaatctaaagaaaaagatgaactgggcaaaatttcgcccatgtcaagcataaaagtttccaggttaagttcttagaacacacagatttgatgaagaaatttaaaactctccttcacaataaaaataaattataaaccatgaaagtatgtctttgggcatggataaaagcaaacaccctgactttcctgctcccacaaatccctagaagtttagaaatacacacagcctggttttgattatagaattagttacttttctctgcgtggcatatgtattctgttagtgaattggaaacttaagcaatttgttccttacatcttaatacacagtcgagtagcattttgggacagtcttcacaaagttctttcttggcaagttagtgatggcagcttaatgcactggtttggagtagtgtaacagcattctgcagtaaatttctctgtgatgatggcttagaatgtactaaatgtttctgcagagctttcagatctagaaacctgggcagggtttttcagaaagggcagaagttgacagttgtgatagaaaaagctgtacgttcttgtggtaagatttacaaagagataatttggaggtgatttgaagacttttgttattttcttgtcaaatatattcatccatagttccagtcaactttgtgactccatttaatagtaaataaggtaataagcgaaagaatgtttgtcaaaccacgtgtttgactaaattaatttttggttagcttatgctggctgaatataccattcaaaacacatagcctcaagctactactgatgttttatatattcctagcaagaaactgagtcaatattaacatctgtaagccacatgaatataatattatatttagttaatgagcttcagatgaaacatattcgagtcacagaaagcaccaatccatatgtattctagcatatgtcacttctgtttctcttaaccttcacccacagtgactgagtccagattcactacattctggaacatagtactttaaatggatgtgccacgtgataaagattcttaggttctctcagaggttggcttccagtaattacagggaactgtcattattttgttgttctactctttggaaaagagatcttaagtgaagggaaaagaaaagagagaaagtaaggaaatgcatgtgcaatgaatacagagagaggctgttgcagaggggaagagtccagcaacaggagagcagggtgggaggggagggagtggggagagtaagacaatagcatgcatgaagctgctataatgaaaccagttatttggtacactaacttaaaccaggaataaaaatgaaagcagcattggttggagtcttaatcctctaaaagtacaggcagttgggtaagaaacagaagcataatacagatcctgtgtttcagaatgctcctcatagccagctatgaagcagctggctgtaagcagctcagaagttcaactcttgctgtttgtcagaggattggaagtaatgtatgatagtaaaatgtacaatatccaggcgagaaatgagaaacaaaaaaagcagaacgaaaatcagtctaagaatctaagataataaatagaatagaatagaatagaatagaatagaatagaatagaatagaatagaatagaatagaatagaatagaatagatctttctggccttctgagtgggtggatgaataactgcaatcaggcatcacttaatgacggtgatatgttctgagagaaaagcacatcgtgaatatcttccatggaagaactccacatattatatacatatatcatacattatatacaatgcatattatacatactggatatatattatatatactaataattatggggtcaccttcatatatgtcatccaacattgacagaagcatcatcatgcagcagattaaaactctggcattatatcaatttatagagaactactaattattcttagttaaacttcaattagttaagcccaatcagaaggactcagcatttcctggctgtaggtgttttgttacacaaataactttcaaaacaagtagatctccagcaaaaaaaaaaaaaaaaaaacttttaaaaactatttccatgtatttatggatagacaggtacatacttagctgcatttctcatgtcttgatagatagatagatagatagatagatagatagatagatagatagagacagagatatgtaaaatcaatagtcaagactgacatttgaaaatatgtgaagaggccacattcttggatccacctcatctcccacttttattgctcatatgcttcctcactctccctttttacctccatcatcttttttgtttgaccctattgccctctctattgcccaagctctttgtctcctctcccttccccctcttttcctctctgctcctcatcaacaaatgaactctgatttattagaaaactttcaacaaatgtgggacaagaaaatgcttttcattgtccctctattaagctaaaggtttagtaaaatagaaaattccactaactgataaatccattatcagaactataatatagtaaaacatatatgtatataatataatatgtatataatatgtacaagcataatatataatatgtgatcagatgattacatatatttcttaaaactcataaaaatgtacactaaaagagaagaacttaagaatgtaaattatccttcaataaacctatctagattataacccagtaaatttatgcaattattgtgcatcatggaccaaagcatgagatgtatatctataatctcagaattttggaataaaaggcaggaatacgaggtaggggagggattcgaagacactctaggttacaggagaccctgcagaagagtcagataactcggagatttgctgtgagatagtatcttttatatatgacagagaaattgcatccatgaaatctcaacaatacaatttcttcaactatgataatacaagttgacatatcaatatggatgggggaaatcctacagtgctccagcgctagagctacaggcaattaatgactactgagagagggaggagggtcagtcttctccttgtccaattgcagtggtcaactcaaacatatgtgcatacaagcaacactaaagggatttagctggcgataatcataagcttatatgtgcatgtgcatttatataacattaataatcgaagaataagaggaatttttagagggaggtgtgagaacacaaaggaacttagagggagaagagggaggggaaaatgatgtgcccatatatgaacatattaaaaaattaagaaaaataaagacatgagacaaatgtgtagattaagagtagacaaccaaaatgctaaaaatgtaaaagtctaaagccaatcatggtagtgttcacacctcttcttaggtaacaaataggaagactggaaaggggggttgcttatggccaggagtttaaggcccttttggacattgtagaaagtcccatctctcaaaactaagaaatataatttgataaagaaaagaattgatactgagattccacgtgtataatagcatgcttgaccagtaacagacttcctccaaatggtgccataaggttaccgtcgttttccgtagtttgtttatgtgcgtataaactgaaggggttggattaaaatctcattaagctaaggcggttctccattgaggtgaactgatttgcagggtgatgggggaatagaactgtttaagtgtcagaaagtaaatcatctgtcacaaaacaggtggaatggataatgtcatgtgaaatttgagaaacatctgtttgcctatataacagtgcctgggtcaagatggagccacctggttgaaatgtaggatcaggttgcaaaaatcagaatctggctgacccaggccattttggggcagtgtgaagagaaaaaaaaaagacttatcggtttttacatttttaaagattcttttactttactttctgggagttagttcccatgctagcaggggaggaggaaacatgagttaatgaaaagtcactgtcattttgagggttgtgctcaagagaagagatggcagctaagatgaataagcactacattctgaatactttcctttcttgcttgtgcttggcttgtgcaaatgggtctctttcatctaggggaaggagagaccctgtgtcactgattacatccatgtgcaatgtgaatgcctaatgcatttatgtaattctcttaattatggtttacagaactggatctactttcctaagcatcacacaagcatacacgaaatacgaatcatggtaaaaatgatgatgtcaaaaaggcaataataagaaccaaggcccaagcatattatctttttgaccttggattccgttgctatacatacaaggagtacctataagtaccttgcagaaaagttttccagtgatgagtacacatatttcagtgacttaccaatcatatatagccaatcacatagatcttaaagtgcatcaggtctcctcaacaacacaattgccctcttaactcctgtaactttagcatccttaaaaacaaccctgctatcttcacagtgatttattttcatgctttttcacaaatgtaattaatgtgatgccaattgtggatagtgccatctatgggctggtagtcatgggttctataagagagcaggctgaacaagccaggggaagcaagccagtaagtaacatccctccatgccctctgcatcagctcctgtttcctaacttgcttgagttccagtcctgacatcctttggtgatcaacagcaatgtgaaaagtgtaagctgaataaattctttcctccccaacttacttcttggtcatgatgtttgtgcaagaatagaaaccctgactaagatatagataaacaacaagctttcctatattttgttttttgttttatcttttgtatttagacagtttatttattttgagatactgtctgtataaagaaagaagtggatttttttaaatagtggtatttgttaaactaatttagcctttcaattgactcgtgctgctgctcttgtcaaaaataatgcacgataaatataaagattttaaacttattttgtgtaattgttaatgttagtaattatgcatgttacgaatttggttaatttagtcaccatacaaaatgagatagcaacatactaagtggacttatttgctgtgaaataattactgaaataattttatgctcaagaaaaaaataggtttgtaacatagaatgtaaatatgacgagatgtggtcattcaccgttgcaatgctactactttgaaggccaagcaagtattgccatcagaatgaagctaacacagttggttccagggtagttgggaccatagaggatttgtctcaaaacaaatacatgaaacaaaaacaaagcaaagcagacaacaaccagaaagaaaatgtaattgagtctttgctaaaataaattatgttttttcttttcaacagtttatctgtgaatttggatttaatcaggagctagtttggaaaaatatgtcatcattaggggctttctttaaaaatccacgtttttctcactgattagccactaaaatttcaaacaggaaaagaaaggaagcaagaaaattatcatgcactaattaaacctaatcataagacatttcacaaaacaagatgtacaggaaagttatcacccaaatctaaaaggaagaaaaaaagtattttaaagtctcaggcatactttctccctcgtgattttactttgactgagattatccagagatgtgtttcaaaggagagtgatgggtgacagaatattttggtaccaggatatggatcatttgatgtacaaacaaactatacagagaagaagttggctccaaaatggatgtatttgtggctttgactttcctaagtcaacatttatgaacacaattagtggcagatgttagaactggggtagggagagttgtatttacagcatctttaatgcttctcagcaaatttgctaaacttatttctagtaggcaatataattttgaactatatagtacacagacagaaagcttatactttgttttgaagtcttctgtggttggtttgaaagtaaagtttttcatcattaaaaagattgaatgtagcatgtagcaagagaagttataacccattcattttggggataggcctgggggagaataatatattgtattgatggtatacaaggaaaaataggtactttgtggaatggtacaatagagaagttttatgaaatccaacccaagtcattgcatcatattaattacatttgtataaaagcatgaaaagaaatcattgtgaagacagcagggccatttttagggatgctaaagttacagaagagggcaactgtattgttgaataaatactgttgggggaaactgttgagttgcagcacgctctattcagattaaccatacttcagactgctgggttggctgagcaaacatatatacatatgcaaaattatcattttctatattgtctttctgaggtttagtcaaagtattactttaataaacctatctcattttcatcaggtcgctacagttaatagcagcagccatggtgttatatgtaattgaagttgatcttcaaagttatctttgaactttttctcctctcagagaaaagcaaccttattgtattgtgaattgtataccgcagttcccagtgatagttaataatcagaaagctaagtgaaacacaaaaacatcatttagcatataaaactgcattgtatatgtagttacctcctaaacatggagattttgagacttctatacgtcactgtccaccacacaagtatgtccacttggcaagtttgcaagttaagtccctctgtttcttaggcaaattatcaggtacttgagattcaagttcctagatcctttaaaattaaataaaatattgacatagaatatctgaaactatcgtgtgtaacagttatacaaaaaaatcaaaggcttagaagggaaaaattcaccattttttgaaactgatggcagaggcaattgttaggtacaaagtgtgaagaattaatgtatgcatatagagtgaaacacacatatttatttttctcttagagtttttgattgtgagcctagcctttaatggctgagccatctcaccagccattgaataattctgctgtttcaatttgttggcaaaagtaaacaattgtttctgattgactttctgtaagggaagaaagacttggtcaggacagaattagtatggttcactaagccatttatagaacctagattttgctaacaatagtagatacatttcaacaaatttgaagcaaaacaagccacttacatgagttgcctggctctacacttaactcagtttcctgacattcatcaaatatcaagtaacattgaaaccacaaccctgcccaatgttgttcctttcacagaataaatctttccattctttctcctctcttcttccttcccctttccttctgcatccctttctcccatctcttgtgtcaggaaggcagcttacagatatttgacactttcaccctcctaaatttcccagtgagaggatagaactgtcccctttgactctcccatatagaactccagttttcagtctcctcacctgagatgtttcatgccccccctcccatctctgcttttgaaactgtttcttgtactctctgcacctacgcaatgaaacattttttgcaacattttcgactaaagcaaagtaacactaaaacactgtatctaactcattacctgtgattgttggatgacaatagtgaatttggaggcagtgggaagtagaagctctttctgaggagagaagatttattattgtgagaaaagagggtcattaaggaggcccttgggctcagtcttttgtgtatttccccatgaaggctggattatttgacttgtcatagttcacaattaaataaaggtatacaatacatgacagtaagaacaacccctaaactacagtgttgacagtgactcatgactctaataccagcaaagacccttggagacaaaatacttttgagtcaaatcccagatgtagatttagtgagggttttcttttatttctttttctgtctgttgaagtgaaaatacaggagcacgttccaatagctcttcaggcatgcaacaaatgcttaggcccacacaagaagtgaagccctatgcattgcagtttatgaaaaaagctgtaatttgtcccagcagctaatcagtttggtatatcaataaagaagaatcagaatacagaagtaaaaccatcctaactttgccccctttctttattagaaataaaaaattgtttaggaagaaaataattagtcttgcagtctgatgagcatgcctgtggcaaagtccatagcagaatcttccctttccgttcatcttgccagtgttggtactttaggaaaattcatggaaaaaaaaacctccacttcagtcatatccccctccaaaaaataaattaggctcaaagaattcgtagctttgtgagtattaggtgatacagctttctaacaatgaaagtcaggcgcagttttagaaaaagaaaacactatcagaagccattttgacggtagggttttatctctgctgtgaagtctcaaatgtgcttgctttcctggctcacatttagttctataagcaataagaggtttaatgccctcatcattttaaaagtttattgctctattattaaaatataagaacttgcattcaaagaaatggaaaatatgttctaaagtaagtgaagttaaattagtaaaattacaaggagatattagtgcaatacatccaaagttacaatggaaatctttgaactctgtctcagaatttttatacatgaagttggcaaaattgctgggtacaattaggacatttggtctctttgaactgagatgaattttatcaacaagtagagaaaaaccatttttgtcaggcacacaagggacattttaataacctgattgtatgcttaagtataaagaaaatattatatttcagggatctgtattgtacagaacatactctggctaaattcaatacaatttacaaagcaatgacaaaatgcaacgcaactgcttgtgatatatctggaaatagaacacatgcctctgtctataatttgtaggccaatgactacttaaatataaactcaaaagtatcttgtctgagatccttatctaatccagtagttttttgctggtgacagttaatgcatatcaaataataatacattatagcataattcataaacatttgctgaaggcctgggcaaagtatttctaaaatcattaatataattcatctacttatagggaaattatttaatctacttgcaaaggtggttgtgttcaaatttttggcactattagactatatgtcacatatctggcttgatgaatagtttaaaggtgatatgaaataataacaaaaaggaaagagaagaaaaaccacacagagacaccttggaagactgaaaaatcaacagcagaataggaagggattcatggaatatactttgattctgttgttaattctgtcactggctatgtggactaacaaatttagggattagtagtagtgaagaatataatagaaaaaaaataaaccaatttgaaataggaaagaaaacagtcaaaaattttaacaaggccgcgtcaccctctctgtgcacccatgatacgtataccttcttttctttcatttccaacctgagaatattttcccatcaatatgtgtctcctttagataactgtcacggtctctcagattaccttactttttcagattgccttactaaacttaactaattttcctcaatgattttcttgtttgtggtacccttaaaatatcctgcacagtgtacatgaaaacttctcttgagtcataaacaccctgtccactttagagtcatacacaggtcttttgttaagtttaaacctctaatggtagagttgggagagttaagaatctcctttggagtgggtagattttgaaggcaaagatgatgctttgggctgctatgcccctcccctcccccatcagccagctgtttcaatgctttccttacactggttgctctgcttgatagaatcggagacactgcccctcacatctgtcagaacagatggaatacattctgtgtgagtgttaactgattcgtgcattgcagaaagaaagcagtttatgttaaaacattgtgacattgtggtgaggcattatgtgttctggctagaacctggttgcttataaaagatgtgtttctttgcccttgcccatgctttgatacactgttccacggttaagtccaaagatatcttacaaagaaaggaagaaagaagaaagaaagaaagaaagaaagaaagaaagaaagaaagaaagaaagaaagaaagaaagttggagagaaagaaagatggagaggaaggaaggaaggaaggaaggaaggaaggaaggaaggaaggaaggaaggaaggaaggtcgaaaaaggaacaaaacacccatggaaagagttacagagacaaagtttggagctgagacgaaaggatggaccatctagaaactgccatatccggggatccatcccataataagcttccaaacgctgacaccattgcatacagtagcaagattttgctgaaaggacccagatatagctgtctcttgtgagactttgccggggcctagcaaacacagaagtggatgctcacagtcagctattggatggatcacagggcccccaatggaggagctagagaaagtacccaaggagctaaagagatctgcaaccctataggtggaacaacaatatgaactaaccagtaccccctggagcttgtgtccctagctgcatatgtatcagaagatggcctagtcagccatcagtggaaagagaggcccattggtagtgcaaactttatatgcctcagtataggggaacgccagggccaagaagtgggagtgggtgggtgggggagcatgtgagggacttttgggatggcattggaaatgtaaatgaaataaatacctaattttttaaaaaaggaaaatagtggcagagaagggaagggagaaattccctcttgtatttgtaatgtatattacttccaagaggaaagaaaaagtcacaagcttaaacatgcacacacaagagttatgtaggtaccttttattttatcatgttttcactgtactttaatgaataatgatgcttggaagtgtgagcagtggttttaagagtgtgtaggactgagtagagtatgtcacactttcctcaatatttgaagttctggtttatagactgggactatttttaaagacttgtgtcctctctctctctctctctctctctctctctgtgtatgtctgtgtgtgtctgtgtgtgaatatgccatgaatattcagatgctagcatagaacaaaagatggtgttggatcccctggaactagagtgacaggtgactgtcagccagcctatatgggtgctagaaaccaagcccaggtcctctgaaagagtagccagtattcttagcctctgagctaacttttcatgcctgcgggttatgactttcaatttctattaatggccaacactgaaagttttatgatgccacctacttgtaagaatgaacttcaatggctttgtatttttgtcacctctagacctggcttatggtggagcagtctattgaggacacctcttagttacctagaagccactatccatatatttctagccacacatttttaactttattgtccattttatgcaatttgctgtttgagtgttgtagtgtcagagagagcagctccatttgcaaatgatgttacttcatattttgacctatttttccctgcaggagtaataacaaggataataaaaagtcggttgaagctgctgtataagcacacataactgcctcaaattacagggcagatcctaagctacaaagccactgaaaccgccaaggccctcttccgactatttcacagttgtactaaagcatgaccatgactgtcccagatttttggaagaggaaaaaacattagtctgtctggtgattccggtgcttcgggagctttttacttacaaaatctgcttcactctgaatccatttcctaggctagccaaggttttttgtaattggatggtttgctactgaagaaaggagatgaaacccttggtgtcctcagcacctcacacctctgagctcagtagaaccacaagggatatatagaacgggtatttagtgaaggtttcagtgtagtagcaacactgaggactaggtaatatcccctgacagactaaccttgtgtcagtttggcaagagtcttggcaccacttccttttaataggcccctgccctctgacatggacgagcatgtatctttccaagccttgaggctttctaaccgaagagaattgcatggaactttgagtggcctcacagtgtaaccacagagatgattacagggttgaggaagggaaattcacctactgataattagtgctcttggaattcctggagtaccaagcaacacggcagcatttaacgggctttgtctgaaatctcaagtgtattatagtgcttattaggtgttacgatctctctaaatttgctactaatttgtatgacttaaattatcttgtgttccagcatgacccacgtgtctacactcaccactcggcccattcccttgtgttttagaatcatactgagattaagttcacacctttgctgaatgcctgtaacctgataattaaataaaaataaaaacttcctttaaaaagttgtcatctaggtaaatgattcatttgatagaaggaatgtatggatcccagacacagagtatcaagtgattatataacttaaatttatgttacttaaatacctggagtgtaaattcaccttcattttacacaaagatatgacatgtcttcatagtggcatataagtaacaactgttttataaataatattcataatgtctttaagaaatcttttagaatttttaacagaaacatgactcattatcctcacctttaacttgcaatgcagtatatattgattatagaagttttaaatccaaaggtccaaaatttaaaatactatttattcagtttcaggttccaattgcttctagccacagttatttgcatctgcctattctgggttttctttaacagggtcagggtgggagggatggagagagtgcaagagagaacgagagaaagagagaggggggaggtggagagggagagagggaaagaagaagaagaagaaggaggaggaggaggaggaggaggaggaggaggaggaggaggaggaggaggaggaggaggaggaggaggagagatcacacctaggaagacatttccaatttcgatacacatgactcaataaaaatctttgcagcaatgagatgttcatgcaaatattgaataatagatcctgcataatactccttggccacccttcagtctaatgtaatgatcacagtgtgtgtccatgcaggatactaagatttgtgagaatgcaaacggatatgtcttgataactttgtcatgtattgtcacctatctaatatccgagtttcttaaaacttatttttttttaaaatgaaactcataaattcccttttcttcccaaatgtactacagctccttcttggagagtgtttggcatttcatataagtcctcagttttcaccctctatcttccccatatcatggctggttttgttcatacctcttctgatcactctcaactcatctgtcattttgggcttcctgagctgttttgtgatgacggaaggataagaaggaaacaatagaagccatccatgtaagaaacatcatccttgttaccagtctgaaaggatagttaagaaggggacatgcttagaaggaaagccctcagccagccacttgcttttatgtttctggacagccctgttggtagaagctattctgttagctatggtgtctcaccaagaactcctagatactacttatggctgccctggtggtggccatcaaggatcagttggatctcttgctagggaccaaaacagatgaccaagaacaaagctatgtgagtcaaagcaagctccgcagttatagaatggactcaagtatcgtgagtagctcagtggtcgctctccaccacaaacccaactaaaaagaaagaatgccatggagattgtgtggtttcagtttgccaactaaaagcaaaataaatgactggaggtactctgaaggaatggctgaagagaaggcagtttttccacaacaatttctttaactacatgatataaaaaaaattgtctaatgaaaattacaaggccatcaagaacgatcctatattctttctaggggaaaacatagtaattaactgttgcagaatgatggattttacaaacacagctgtcacaactgctactttaaatcatttgttatggtttaaaatgtataatccccaagaaattgatcattactgcaattcaatgctgatttttcagtgccttaccaattttgaggtttgcatcagcctagtagcgaacaaaagtcagtcataaagtacacaactaatggcttatctctcagggatatcttctctccccttttcaacatgattttatttttttcccactgacatttctgcttgtgactaaagcaggtgcacactgaccttccatgttcagttttccccccatttcctaacatttttgcatttcatggttggctgttcctactcagcattgcctgataatacttgcttgtgaagttctatgcaactgagaccaccatttgatccccagtcttttccaatactgtgccagatttacgttccaattggcatctgtactaactcgtccatgaagtttccctaactattctaatggaaatcaacaaaataactgggagagatcttcatcgtcacctgaacaatcccaaagatgtaggagagtattataaaacaaaactgaagaaatgcttactgaaaagaactgtgccaggagctagacttctgatgacacacttacacttacttctgaaaccttagcatttaaattagccttactttatcattttcaggatgcttccccaaagtgtgactagtcttgagtgtagtaatttgacttcccaaagtaattgaaggagtctggatattaagaaggaataaatacatgttttcttgtaacccacacaattgtattcatgattttaccttcatgttttatgtatatccaagtgtagtcttcaattaaagaaatcatttatacatgtatataaggatactatatatgcatatgtttgtatgtgatcagtcttaaattttcagagcatgtagtattttctgttaataagatacattcaaaatgctagtgttaattttcaagctcatgaaaaccaacagcatagtaatgaactccttttcctagagaaagcaaactaaataatgctgtttatttgattaccaaaattaattaagaacacaaatctttgccaagttgaaattaacacatcgagggaatttttttctcttgaatttcttcaaatagatctgtgaaataatgcatgtttagttgtgaaagcattatatgttgctaggaaagttatttaggatcttattaatgtctttttatggtagcctatattcattgttctgaaccctttaacagattctaccagaaattcaaaactatttgattaacaagtccttgaattttcttttccctgtatacacatcttaaaatttatgactcaagacagtatctttctagtactttttgagtactttatattttaaaaatattattattccagtgaaaccagtgggttcctgtatattgttgatatttctataggaaaagtgaatggcaaaatctaatttatatttttgtgtttttcaatactcagtacatcaatgacagttctgattactttagagtacaaaacctatctgctttcttagcactttacatacatttaattttgcataaaaggcaaattatacctgaaaacaaaaaggtcatacctaacccatattacaaatactgctctcctctcactatagcatagccttcagctctcagcagaaagcagcttccacataatcagcaagccacaagatggcactactgaacaattagtttatttctagattctctaattagttagtcaagaataacagtattctccttcaaaactgatgtctgtaacttccaatgatttataatatgacaaggaatgagtagtggagaaacttcacaagtctaacattaagtgatcaaggtcactaccttataagtgttacgttgtgatatatgtgatgatgtatatggggtgagaggaccttccatttatttgttctcctgcaagtgtgtaatctctggataattacaagaaagcatcagataaacacaagctgaggtatattatacaaaatggttgaacataaataaactttaatgcactttataggagcattatgccaatattaattaacttttatactgtaatcatgtaatatatgctatttttgaaactatcgtctgaatttaaaatgacttcataataaatgttaaaaatatcagagcacaagggagaactctgaattgttattaatagcaacaatttataattatgtatttttgtatgcattagacataatggttggttattaacctattatgtgattctaagacctagggtttatttttccttcagggatagtgaataacttcttgaaacagcatgttagtatataattggctgacaaaaagctgtgcaattttgaaatgagagtcaatccctgatcgctgattgagaggatatttaaaagaaaaaaaacctttacatcatgaataccagcacttaatgaagttcaagtacttcactaatgtatattcacaaggataaaagtgatatagttcaaatttttcatattatgcatgattaatatttttgctaatatgccaaatgctttatattgcgcagaatagtaataggcacagaatagcagtttgacccatgaataacctcttagaatcaaagaaaggaaagttgtaattcactatgcctacagagaaattcagggatgaccaaataaggtcacaatctggagtacaaggtgaaattcaaatatgggagactactgttcaacctagtatagtccaagagtaattttctgctagagaactatcatataaggcattctgcttaacttacacataataatacaggggaggaatttttctgtaccacagcatgagatatttttgaaaattaacagccataaaataatctctacttataaaaactatatattcattttaatattatcataaatatatgatttgcatttgggctaagactacattattagaaatcattatgattccactaagaaaaaaatttccagaaatattttgtaagtcttgtggttcctgtgattcaagacatattaaaacatttagagtctgttagattaattatgcatcgctcttatcagtgatcattatggaagaaatgaattcaataggaagatacctttgcacagtactacatgcatatacatcaaaagcgtacagtaaatatcttctatttttgtggttttcaattaaaaattgcactgttcatctggactcttcagtggaacacaaattgagactcttaattatattgcataaacaacatctatagcttaacataagcacacaaatataagctagttaataaatttgcttcattttcactgaagtgctttgtgtttatttaaatgttgataacatagttgtgtatgctataaacatatgtacatattttataacatgctatgtccttgccatgatttaattatatttcactttattagttccttggtggctgggtaaatagcaaacctttgacacctatcaatttcctttctttcagggaatccatgaaaagactggttcattggtggctgttaaagtaatgagtgccaggaaggtaatcaataccatgtcctctatgtattctgctcacttacccactgtacagtggataaacaactccaaaatcattggtttgaaattatgatttcatatactagtgagataatccagaataattataggtttgtaatcacagttgttaatgtattacaattactggtttgttatatttccacattaaaaatgcttcactcataccataaattctaaatatttgatattataaaccaactgggaaagtatcttcctctctatttccagttgatgatctattgtcagggaaagcaaaggagatatttcctttaatattatgttaatgctgctctgctctgtcacattttttctccaatcatttcttctgagaattgaggccactagattcccaatgacaggtagaaggaaagaagttgtcagaggagcacatttttcgtatattttctgacagagaagcaagagagaccatttaattggcactgttcctgcgaacattcataaaactgtgctacggttcataatctgtcgtcaaagaagctgtgaattctgcccattttctttagtacttcattttctcaagacagtattaacacaaacataacagaagttaagacatttttatttcattatatctcaaagcaaaaatactcgatagattaggtagcttgacgcagctgctgtaccttacaatgaactgttactttgcaattagtgaagaaactgaagggtacttttgtttggtcagtaaatcttgcaaaccaatgtgagattcaggaaatttgtccatttataaaactcagttcccaaatattccactgctttttaaagtaagattgtataggatacttaatttcttattttaacttaggagctctagagccatattaaatcttagaatatttaaaagtcatggtaggacattagatatttaatatttactgtgtgcatttgtaaaaggaaaataatgcttcactattgcaaaatttcccattaatgtgtcagttacatccattcacataaatttgttcccagtttacacacactataagaaattgaaatttttagattaatactattcgtgcaaagcaagaaagggatgatgttacattcctgtacaatttagtgctaacatagcacaaagtactttggcataagttattgtaagagtgtactacgaggtctaataatatttttcttggtcttttgttcagactcctttgcctgagataggaagacgggtgagagtgaataaataccaaaagtctgttggatggagatacagcgtgagtacttagtcttccttggcaccgccatagtgtttcccttgattttagctttcaattcatcctttgcattatctcttcgtgggctccctctaaactgctcttggtggaaatgatagcatgcatctcttctactattcctatagatttactcatcagagttaaacactgtcatctgtcaaagaagagggcctttacacagtaaattattggctgcaggggaaaaagagtatgtctacagtgcatagagccttcacactggctagcaatgaagaaagagctgactgtgtcaagaattttattttcctaaaattgaccttcacagaatacttttttatatggtgcacaccttcttgagaatcatcagcctctattgcccagttatgataatcacaaacatcattgtatttgagccaaattcatggttgctttttataatgcaaaactaataatagaaagccaaccaagtacccatgctaacattcttcggatatttgttcacaatacgtggacacaggaaggagtatgaaccacgttctccttgcagaattattgatctctctcctatctcaataatcacgggttttagaataagttcaggcatacagaactatatttatcaaaacactttagttttctatcgaaatgttatataagcttaaaacaaaaattattgttcataatatttcatcaatacaatttttctagttttctttcctgcagtcaaataaatgaggttcagttattttcggtctttatgccttcataaatgcagtgacatgtacattaaaataaaaaatgaaaaaaaaagaaaaaaataaccctttctattaatgcaaacatatttggaatctttctaggtatatgaaaaagtccactgccaaataccttcatgatttatctgttatacacaggcttcttttagtttataatatatcataatagtagaaacatattcagaggaagcagctataaccagcttttatagatcaaaaatccaccaaaagttgaagaaatgtaaaacagaattattaggctaattctacttttttcaaaagtttacattaataaaaaattaaattgtccaaaacttctctggtattctttccatattaaaaagagggggttggttgtagcgttggtgaatttacaaagggaattctggcatccttgagctgcctcttgacaaaaagcaggatattcaggccagtctgggatcagctggcacggagccagaaaaccctgtagaatcatattactgggagatgtgtgagagtttgaaattacccacttggcctgatggatattatgtacttgtgtgtttcttacaagctcaacttcccgttaattgagagtggcaaacacactaatgttttccaaacatatctgatcttcatttatttgttttgggagagtttacatttatgtgggaaacccactcttggaagtttttttttttttaagtcatgtcttttgaattctatggttatgttttaggaaaggaacagcattgctagctaatcagttactatctctaaatcagcttgactatttgggctaaaaagtgtgttagctgcacatacgtagatcttctatgaagacaggacggtgtgcctatcttctacggtatttttaaagtaaatggaatcctggggagagaaatgagtttcttactatggggagtcaatggtaaaaagggaagtataccaatactcagagttggtgttctttcctggctaaggtcaaattctcttttgataaagttgttcctttaaactttgcttttcaccttagtgatctcatctaatcaggtggattcaatgatcaataaattggtaattcttaaaaatgaatagttcaacatcagtcctcaccctgtaagcatcagacccatatatccattaattataattttatgctgcttccaaatgatatacaagggttcactgctataggtaaatgtgttttatgtactaatataaaaattgaaagaaaaaggcaattctttagattaaaataaatgccacatatgcatttctgtagctattgtatgtatcccatgttgcatatgtgtattgtgtatttctcacgttagtctctagctacttcattagcatacacaactctgacagaatgtgtactccgaccttttaacaagagtctgtgcaataatcagagagactaaatcattacatggtttactacatagacatgaggtacacctgttatgattaggcaaacgaaattttattataaacttactttagaaaattaacatcaaatgatcccatacctttaaaatgtattaaaggctaatcacaacattctactactagctctataaatgtacaagaaaaaaaggactgaaaagtggatcaaatgtctaaacataagagccaaaactataaaatgcctagaaaataacgtagagctaaatgtctgtaattttgatttaatggtgaatacttagataggaaacaaaaggcactaactatagaacaataataagttggactttataaaaagtaaaaatgtgtgtgccctaaagaacacatggaagattaggacaactcacagaataagagaagatacttataagtcaatatgcatatatatatatatatatatatatatatatatatatatatatatatatatatatacatacatacatatatgtatatacatacatatatgtgtgtgtgtgtgtgtgtgtatttttctaatacacacacacacacacacacacacacactagctaataagaaattgatattcttccccggagattataaaccacatgatattgtctctgcactatctaagaacagatataatgactactggtgaatttggagcagtcaaaacttcctatatatgtctattggaaggagaaatgatgcaatggctgttgaaaatgagtttggctttttatcacaatattcaacatcccagattcttccgaatgaacttcaaacacatacattaagaaagttgacatgaatgcttatagaaacattattcacagtgcccatcatttgattgtaaaccaaaatcaatgaaacactaatattttatgaatcgctatttcatgtataaacctcaaaaatagctagtctgaaaagaatacatattataaaataccatttatatactttggatagaatataaattagtgctttttaagatgagtgtggtagaattagaggtaagctatagtttcaattgagaggaaatatgttctgtgattgactgtgataatattaatatatagctatgtaatttaaacagtagggcattataattgaagttactgaagtatacagtatatgaattatatttcaatggaattataaaaattattacaccatttattaactaatttcttaaggtctggtgctgctgttcttgggtcacattataagaacttctgaattaagagatctttcatttactctttccttttgctccttttataaaaagatttccattaacttttaatcctataagattttcttttgtatacacattatactttagagactcattgccactgatctgtgctcaaaaggaagctttgctttcactctttaggatgaagaagaggatcttaggacggaactcaacctgctgaggaagtactctttccacaaaaacattgtgaccttctatggagcatttttcaagctgaatcctcctggccatcagcaccaactttgggtatgtttttctttgccctggtcttagtctataagaaatgtcaaacacagtgaaggagctatggtgggatatttgccttcctactagaaaccgtaagtcctcaactggtccagatagtatggcaaaatgtattcggactccctgagacagtgtgatgtaagaaatagagagaataacttaaataccagacaaggtgggatggagacagacacaaatgaacactgctaatttaagattcaaattttaaatggtagctttgctgtttttactttttgctggtatccaggtggcttgacaggctagaaaataaatagatgaagataaacttgaattagcacttgacatggacataccatgttttaggcgttttgacatatatgcacttgtgcataaatgcagctaaatggatcattgatttgtcattgcacctggactattatgaatgtcagatcaatgagacataaatttcagtaactaagtggagcctaatataacaaagccatagtcactcgaatttttcccatgctccactatcctagataagtttcagtcaatgataccttgaaaaacagagtacttgggacataaacttgaataatgttttttttaaaggctcttctagtatcagttaaaagttctcttatgttgtacataatgtattttaggaatggggccattgatactatagaaatgcttaccacacattacattgaaattcacatgttagcatgaatcagaatcttctagagaattttctatatcacagtgctggccctctttcacgggcatttacaccatataggtctggaatgtgtgtgaattttgtgtcctctagtaagtccatagatgatacagatgctgctagtttaaaacatcatacttaatatcgataaatttagaaatttctcaaatcaaccttgtttttctcaaatatccaggtaactagaattctctcttttctgaaaataggtgcgattgtattgaatattgttctataaataataatggttacttatttaatatttaggtgtatactgtatttccataaaatattataaaatttacctttcacacaatatgaaaagttattagaaatattgagtcccattatcaaatatattagtactctgctcattcagtcactctagcccattaaaaaatgaaaataaatctagtataaattagctgtaaattcttgtaagatttcccatatccaggcaaactagtctctcaaatatccattcctctcttttctgctcccatcaccattcaggcttcttctcctcacaaattttttccaaggatatttgttcttatttttggggcataaacttgagtgaccttccttataaaaacctatgagtggaggattaattcaaatcctacctgctggtggaacattatgatgtgtttcctggtttaccttcttccacacattctcatcccactgctgcaactttctaaaatggttcatgtttttgtggctccgttgcagatggtaatggagctatgtgcagcaggctcagtcactgatgtagtgaggatgacaagaaatcagagtttaaaagaagactggatcgcttatatctgtcgagaaatccttcaggtaagtagttaaatcaccgttgacttagctcttaaaagaacctagctcttaagatataactttataatactgcatagctaagaattctagacataacctgtgaaaaaggaaatctagaagaccaaactcctgagatcaacaccttgatctcagagtctttgagagtctttgagactctcactactgtgttcaccagatcatggaaatgacatcatggcttgactctatttttaagtgttgaagtattatcatagattaagatgaggactagtcaggagaagtcagtgttctccagtgtggccccaaactctctgcatcctttttaagagacatatatcttcttcgaatataagccccacatttttctttaacttctaacatctagttaggtgaaagcaatgagtttctcggtcagccaaattcgattgttgttcaataggtaagtcattagggtcaccccaaaaagaatattaataaaatgaagagtaccccaaacactgttggaatgctattcttctcatttcgtttgaatgtatttttgataacaatggaactgatcaagagtacagacaattcaccaaatttggattttagttcatcatatataatttctgtgacctttaatcagtttcttgctttccctagctctcattttccttatccataatatgggagaatagcatattccccaaagggattgtgtggcaacttagtaattacttcatctaaatatttagcacaatggcttgcacagaataaaagctcaataaatgtattattaatgcccaactagtttctggcatgatctcactgaagcataatactacatatcatgtcatggtatagccaggtcatggggttctcaatagtgaatgggctggatccaacatggtaagccaacacaaattatacacactttaaaatgaatttccatagtccctcagattctaggcctacaggccgcaccagaaaatattttggactaaacaaatgtttggataagaaatagaacaaagtagttaatagttaagatgtccaggactttactgtcatccctactcagaaatatagaggctataaaggaggataaagtttcccaatctatataaatattacttttcggtgttctttttcttttatgagtattctgatatattttcctttccttatagccaaaagcagtatttctgggaactggctgtagtcattccagcctaaagaattttgtttaaaaaaccaaatgtggaccatttttcttaacaaaagctcaccccccccccccaaagcactttaaagcactaccaaaaaaactgaaaaatgaatatgtatctaggtacttacttgacttttaaaatatgtctgtctgtccagggcttagctcaccttcatgcacaccaagtaattcaccgggacatcaaaggacaaaatgtgctgctgactcatgatgctgaagtcaaaataggtaagttcgttcttgcagagggctagatgaggcagccagctaagacaacggccttgtaacctatcagtaccaatagagttatttggtttttcttgaaacttgtttggcagggaggtggcatgaaagtagaaaaggaaataactaattatttctttgaaattgcagataacctttaaaaacctgtatttagcattatttcttctagattttacccattgctttccctgcatgtatgggatataccagtttatagccttcatgggtatttcttggctcttaaattcggctgttagagagagtaagaacattgagttattatgtaaagataaacttttgtaaagtctagataatgaaaggttacagcaaagaaaaatcctcaaaaatacttgaaatatttcttccttttcttcgatgctttctgaaagactatctaagactattaattttgcttcatttttctttgattccactaaattattcaagctgcttttcagttattttgttcaccatcttccagattcccagaaaccgttataaatttgaaaatctacttcatatttcatccctgtcttattgtttttggaatcaataaccccagtctacttcagcatttttctgtctgtttctcaggataccatactaaatattttcttacaatgtatcccacagaagaataggaaaataaacagttttagagtaaagctaagctatagatagcccagatattagttgtgcctgattcgggacgcatctacagtaaattaacttcaactgggaagctcacttttccttatcagatttgagtttctgacatcatgcatgaggctttaacaggaatgacattgctaagacgtagctcccagtgccgtacatctccagcttagtggcagatccaagctctacttatgccatatgccacatcttagcaaccagtgaaactttatttttaatattcatgataaacatttatccaaacctacattaaatttataacagtactgttgggcctcattccaacataaatagcagctaaagctcatttcccagtattcctggagaagacttcagggtgaagttctctgggccagaaagaaaatttgttatccattgtggcttttgtattgcctttccaagttaaagcaataacttattgagatttgtgttcctgattaattattttgacatatgtagtggattttggagtgagtgcccaagtgagcagaacaaatggacggagaaatagcttcattggtacaccgtactggatggccccagaggtgattcattgtgatgaggacccaaggtgttcctatgattacagagtgagtatgataattccgacagagaggattcaaatttgagaagaaaatgactacatttattttatttttgagatttcttttactcatgtgtatgtatgcctctgtgcaaatgtacacacactttatgtccaggtgccattggaggacagaacacagtgtgcaataccctgtggctggagttaaaaataattagcataccatatgacatggcataccatgtgctagaatgtgaaccctggtcatcatgattaagcaacaagtgctcttaactgctgagccatctctccagccccagctatatctaatttgaatgataaaagaataaaaagtagatcttccttttaaataaacacaatcagaaatagtagcctgtatttccatatgtggtttcagagtatgaataagaataatattttataataatgaagacaaagtagaacattggcactttctcagaatcaggagggaatatctacttcatattgttgtcaacttctttataaaaatatattaggtggtttcaattggaattttaacttccaagaacagaggaatttgtaaacttgttgaaatgaggccaggactggggcctcaagactgtaatatcaactacttaggcagctaagacaggagtattaggcctgcctgagctacaaaatgagtttgaggtcaggtttttatcacaatgaagagtgacaaacagggctgatgatacagatcaggatagaaattctggcattcatgaagccctaaatttaaccagcagttccacacataaagaatgaatgtatagcaaataatccttgtaagttaaaaataaaaataataatatcattacttggtgtactgaagacaatccttggcagttggttcatctcaaaaaccacagaaaatcaatgggatcaaaaacaacaatttgtgctgcatattaacatttctactgaaatgtctatctgaagtgcacatatacacatccatgtatacaaccgtttgttacagcaagttaacagggaaaggagcaaagctccccgtgtgctaaaaagtagaaaaagaaaacttcattcaaccatggcgtcacaagtcttccaaacaattcattgtgatctctttttgtagcacgcaggactcgcggtctcacatagatcagtttacatttcatctctttgccttttcctccaatccgttttgcttgttttatttatttatttatttatttatttatttagttagttagttagttagttagttgtttttggttttttgagacagggtttctctgtgtagccctggctgtcctggaactcactttgtagaccaggctggcctcgagccactgcgcctggctccttttcgcttgtcatgtaaagaaattatttactgagagcctgttgcagttttggaaagctaggaagatgatgagaataaggttatttaactcattttctgcaaggtgcgaagctttatatctgtataaattttaccatcctctaagtattttaaccccttgcttttcctatttaatctcaaaataattagaagaaaccttaagcttgcaatatcttaagaagcaaagttaagctatctgtaagttgaggctctaaaacaagagtaaagttttttttttttaagagtcagccaatacaccactaataaggtgccctttacacttttctagaactgcattttatttaagtatggtctctgtgctcattgcacctgcctgcatgtatgtgtgtaaaagcacacatgtggaattcaaagggcttgcagaactcagttctctcctttcaaaatgtggattctaaagactgaactcacgtccgcaggcctggcggcaaatgtctttacccactgaactatcgaaccagccccttttccttctttgaaaaaccaagtacagctaatactggtgaagacagtttataagagcttcataatgattctaagctccattgattatattccaggagctagtgaaatatgtatctaataattaataagaactatttcaacaaatatagtttatatgtagcataatttatatacattaatgtttaacttataaatgttaggtatctctacatgtctattaaagatatatattttgtgtacatatatgaatatatttatatattatatgtgtgtatgtgtgtactaatgtatgtatatcaatcctatgaagagggtgctattaagaaacattctacattaaatgaaattgagatacaaagaattaaatcacttactctatatcacacataatagatcttaatactaagacttcattatgacaagttatgcaaaatgcatttacctttcactgaacatcattctatgtgaacatatggtacagtgaaattctggctagtcacatactcaaataatgtctttctgtaactttagtctacaatgaagcttcattatagaaacagatgaaatggctgtagaattgatatccaatcccaaccaaaatgatattgagtctcctaatactaatttcccactttaataggcttcttaatatcttctttttagagtgatgtgtggtctgtgggaatcactgctattgaaatggctgaaggggctcctcgtaagtacaaatgcttgatatatttgatgtatttctaagtttgtaagattatactgtataaatctgtctctctggaacatgaccatttgtaacagtcagtgtttagttagccacacatgcatcatatcatgtaccaaaccataaatggtagtttttcaatgatgaccaaatgctttttttttttacaaaccatcctatgtaaatatatatgtcttattcttttatgtttcttgtgtcttatcttcaatgcctacttctctgtccatctcttcaaattcaaaatatgatacttggcattaattttattttaagattttaagtcatagaaggaaaatggattaaaaggcagactcatagtaggaggacaggagagttttgcatagagattgcaaatgacaagtttccttgaaaagatacattagggtcaggagattttgtactcacaaagagacaggccatcctgcctagataagcatcgaaactggctttaatcctaagcatctctagattgcatccctaagaaacatttctctttcaccactatccttcatttctggagtaagaactctgcgtgaaagcaatactcagcaagttaactgtagcagccttctaggttttcataattttcatctcagaagagatagttttccaaaaccacaattatcatatggtgtcttccaagatttaggtaagaaaatgatcatcctttgatcttttatacatcatcagggtctcccagaaaaacagagacgggcagaggaaaagcttatgagggagaagttgctttaacaatagaaaacaaaaccttttggctatcaaggtcttcttcggtttttatgttataggtgggaacttaagcaatataggggtatttacaccaagtctggaagatttacagcagctttcaaacaccataataacatagggcacgagttgaagagatgtgtttcttaggcgctgcctttgtgtatgtgtgtgtgtctctgtgtgtgatagtatgaatcctctgctagaaacaaagcagaatatggacaaaacatcttcctgtacaccagaagaatttaatttcatctgcaccaaatatttccctttttcacattcccctagatattaataaaattattttaatattgttggccatttttctaatagctgtttctttcatattttattaaattgttagatcaggtaatgaaggcacgtcagttacttcttactgtaacttattactgtaatgttgctattaaagtaaattttgctgttagttattatacaattatttatctgttcatctcttagtgtctatttaacaggatatgtgaatgagactgtgggatgagcagcgggctctgcacttagtcttcctgttcgtcctaaccctatctgtttcccttcacagctctgtgtaagcttcagcctctggaagccctttgtgttattctacgggaagccgctcccaaagtcaaatccagtggatggtaaacaggaatttcttaaatatattgatttaggaatttgtatagaaattttcattgatttgatcattcttgtttcaacatttttgttggacagtatttcctgcaatccagtgtcttaggttgaatgtctaaatcgtcagtatttatttaagtcaagatctaggtgattaaccagaaataagcaacatcctccttatgtgtgatgaggatattgtagtgatttttgttaatggacgtgattatcagatgcttctatagcaatgaggtgaagggagcgatgaggcccatatgtgatgtttgtcatggtgcctagacatgcagtcagtaactgtgatgtacatgcagtcagtaactgcggtgtgcagccctattggttacccagttaaattaaacatccacacacttgaagagccgctctgcattgctgcagacctggcaaccatgagaattgtgttttatgaagcttcatccaactacatgtgattagtaagaagtggcaattgttgttcaattattggcatttctttgcttgaattcggtttaactgtttacatagatttagcttgaatctctttgcatgtgctgttttacaagcctgcttcgtactgtttagcaacaccttctttcggaatcacattgagtctcttaattgccatctgattacatgagctttactatgtacctgctgctgaattcatggacatttctagtgttgagtagaaaaatctgttgactcgacttctatttctgaggtttacgtgacatcatcgtatcatgtatattgttaagacgtgggatatttcctaattgaaaagacaatcctagttctaacaagtctttcggaatctttgaccttgaaatcagcacagtagtgggctaagagtagcacagcaattaaatagtgtcattcatctttctatgctccattcttttcaggtcccgtaagttccagaatttcatggaaaattgcatgataaaaaatttcctatttcgtcctacatctggaaacatgcttcttcacccatttgtccatgatataaaaaatgaacgacgtgttgtggagtccttgacaaaacatcttactgggatcattcaaaagagagagaaaaaaggtagagacgacaaagctttgtatctttcagagttggtatcattcagaatcgatataggagcttacatttatttcttgtttttagttttaaagtatttgttaaagaatttggactgcaggggtggcactagagagttggttcagcagatacgaggccctaagttcatgtcccaccacctatgtcatgtggcccaaaactatccctaactccatggcaagtagacatgtagatctgacacatcggggacaatcccagagccttttgccatttcagtttttcagcgctgtatgtcagtaattcattcaattgcctcttttgtgagcatttatctatgaggctagttagctattcccattatacctatcaagtattcatacttataagacctaaagcctcagattcaaatagaattttggattgtggctgtattattttaagtcaacttctaacaaaagaaaggtaagcaactctttgagataactgtgttcgtaactgcaaatttcatgacttagttttgaaatgatttgtatataccatatgaagttcatgtcatgtcctaatcacaaacttgaggtataattaaagaagctcacctatgtacacaaaggtcagctacacttactgatccccacagtgacaagatgattttactcaatggacaggaaaacactgaggaagcactgcagacaaggccctgattgtggaacctgaaaacaatagaaagcaggctaagatcaaatcaaatgtgagaacgactgcaggattacttgtccggtccacaaaattatgtgccctctttataaatggggagctacagggttcgtgtatgtgcctctgatcatgatgttatgggggccagcatcatacaggtcattcttaagtcgctagaggaacatcagccatgatttgctgaaatctagaggtgtaagatttcaaaaaatgttacctatagcaaaagtcccacttcactggtgatttctccacaaatgcaattatagcggccctaggcaatttaatacagggaattggaagagaactctcccatttgtaagatgtcacatttcagtaataacaccacagttgacaggaaaaaatccgaatgcattaaatatattaaatataaaacaagcacaagcagactacttagaacgctgcatgtagattgcccctctcaaggtgggttacgtcagggaaaagcacttaaacaacttcaaggggaagccaaagtgtttatgtcactctaagcttgggatcttacacataactaagcctctcttggagcagacgcaggtccatcagtgagcatatagggtggatcaagtgttcaaggttctacaggtcaaatccataccatcaagtggtccttgtcctttttcttcctttatcccattctgccttttcttgatggcagccatcagattgctaagatttatttcccttaagtccagaaaaattaatagggctgagttatctctactgtgtttcaaaactatgcctagaaacttgtcaacatcaccagcaaagtatgtttgaagagctcccttatttcttaccttcttacccatagtaattcactcttcgtcctgagccatagaaagctgcagtcactaaggtgaaccataagctgttttttcattacttccttttctctttttcacacaaaaggaatacctgtggcctttgaaggagaagaagctgctaaggaacagtacatcacaaggagattcaggtgtgttgggaaaactcataattagacgatagcatgatacctgagacagtagatttaaatactgttgtcttccgctcaagacgacttaatcctatttgatacaaaacaaacaaacaaacaaacaaacaaaacccgccatacttctgcttctatgagatattgtgagaaaacattgtgaatttttgttactattccgaaatgacatagagcaataaaacaatcaagtagaataccaacctacagtaagggtttaattcatcagtggcattatattacctacaggatatttcagacactgcaagaatgagtacagaattatttgctatctttgttggtgggtctatcttttaaaaattaaagcaattctcagacatgacctagttccagcaaacactcatgaaatgccattcttctgtatgcttattttagagggccttcttgcactcctgagcttctcagagtgccaaccagcagcagatgcagaccactcagagtcctgcatggagagccccctcagccaaggtggctacctgatcaagaagacccacaggaccaagaacttcaacaactgcagaaggcagccggagtgttcatgcctctacattctcaggacaatacatccaagcttttcccaaagcaggttgaggtagcaccctatctccgtggggcagctcaggtggtcatgccagtactggtacaggttgaagcaccgccccaagtaagcaaagcagcccagatgctcaagtcactccccactcaggacaacaaagctacttctccagaggtccaggcccccgtagccgaaggacagcaggcccagcatgaggccttagagacagaacagcctaaagatttggaccaggtgccagaagaatttcaggggcaagacagggcacctgaacagccaaggcagggccaggctgctgagcagcagcagatacataatccggttcctgagcagccgccggaggaggatagggagcctgagcaagctgaggtgcaggaagaggctgtggagcctccccaagctgagatcgaggacaaggaacctgaggtagtgcaagtgcacgcccaggtgctcctgcctttactgtcccagaaccgtcacgtgctcttgcctcttcatttggatagacagctgctcattccggtaggggaacaaaatgaagaggtaccacgagcccaggcctgggatctagaggcctcaagggcagttggtgcagtgcaagcgctgatcgagggactatccagggacttgcttcgagcaccaaatgcatttgtcacaaaaccacttggtccgctgcagatcttcttggaaaatttgtctacagacgggttttacactgagccggaaccgacacagaagaaaaagtcgaaagttgctagtctaaggaaagcaatagcaaaacgactaagacccaagaggttcagagcaaaggcattatggcgacttgaagattttgaattctcagatgtagaaaccagcaggagacggcgccaccgtagatgggaggacatctttaatcagcatgaagagcaactgagacgagttgaaaatgtaagagatttttgatattttttcctgagtgaaaactactgggaaaatatgctcgttgttgcttgcatattttcccagaggaaccaaatgaaaccaatattccatgttctaccaaagttttacacttcaaatgaatcattctgaaatctccagataattgtgatcaaaagaggagaaattgctttaatagtacaactaatggtttaatgtatcgctactaaaggagttgtggcttaattaattattagggttttattttgctttgttttacttttctccaattactcccttaaccagtaaatggataacctacaaacacttaaaatttgaaacattcctaatttaaaattccaaagttgcctccattttttatgtttctaacatataactttccgggactacagagctgactccacagataaaagcatttactgctcttgcccaggacgtaggttcaattcctagaaccctacaaggaagctcattacagcctgtagcctgtctcctgtgggtttctgcacacatttggtacacatgattaaagtaggtaaatacacataaattgattttttttcaatttgaagttgcttatttgttatttcttgccatagaacggaggatggcactatttatgtgaattgcattaatttatactttgggattttagaattgaggttaaaataaaaacaaaaactaaggactagagagatggcccagaggttaagagcacatactttcacagggctcaacttcagttttcagtatcacatgacatctaaccatctagaactccagtcctggacaatctattaccctcctctgatctcttcaaaaactgtacacctatacaaataaaacaaaataaaagcaaatacatctcttgtgaaatgaagacaaaactcatatccaaaacactttgaatatacgtgtcatatttataacttgtcttcttaatattcccatgcttttatgtagttgttcaatgatgtgactgcacagaccagggaacaagtagaacttgacttcccatttaagaatagtcaataaaacttcaaagctcccatatgtaggtggataaaatttgacagacttggttgaactttatgtggcactattaatttaacaatgaatagtttataggtttaataagcaaattattaaggtcaatatagattaggaaagcagctgttttctagtaatttccagtattcatttatataaaaggaaatgtaatatgatgattaatcacatctacctaataataactgatgtagtaattacaaatgaacccttcccgaatatctagatatgttataatttgggtttgtgcacatgaagccaattatgtaactggtaacttcctggcacttctacatagaaaggattttaaaaagtgaaaggagagtgagccaaaagggtaaatggacacctccttcccagaatgtaaggagacagaacttgtatgagtctgaaaccatgatctgtggcctgaaataaggcatataacttgctaatgactattctcaatggtctctctaaaccaattagagctaatgggatttgcattattgaacaagacttgtatttatcctggaaatatgcccaatattagcagcagagaacatacttactgtcattgtttttaatatatatgtgagaagctacttcaaaatagaaataagtcagttaataattgttagccatcctatgagcctaagttctcacatagacatcatatccagatatgtgagatatatatatttccttatggaatacataaaggaaataaaattctttatacgacagaaaacatcacagttcttttgaaatacgtgaaatttaattaaaatttatagacatgtctgagtgctttgccataccagtatgtaagacgcatatattttcattataatctgtacgtggaagagataatagtggttgattcatttgattgaacaatttcttaaactccgagagcttaatttaggaggaatggttgggctctatatcacagatcttcttctatttagagcccaattttagagttataggagcttactaaatgtgaaaccgtaggttgtgattatgtgttaatcaagcattaaatcagattcttaatctggatcccaaagataagcttcaggaaaccagcagttaacccccaaactgtatgcaaatgtgtgtctgcattcagttttctgttggcaatctgtacttttccttagattttaaaagggatccttaaccaaaaattattagaaactgctggtttaaataatttttaagtctttggaaatttttcgtcatggttacaaaataagatgattctgttgttcttatcacttgcacactcataatgatttaaatatttatattattttttttgtttcaaaggacagagaagatgactcatcagacaatgatgaagtgtttcattcaattcaggctgaagtccaaatagaaccacacgctgcaaatcctgcaggaaatgaggtaaagttctcagtatgagttgttatgacattaataagtacctagaaaagtgcctcttaaacttaatggtctcaggatccctttataattttaagtatcgagaattctgtaaagcttttccagtatgtcattcactaacttactgaaaattaaaaccaaaaaggtataaatacattgaacataatgagtaaatataaatgaaaaatatttatttttcccaaaattttattatacagatgtcgttttctcccattttcatatccttttaatctgtcttacttaatagaaaacagctggatgttcatatctacgtcataattcaatctgtgaccatatgttgtttttcttgaactatatgtatgagctggcttagtacctagagatggctaaaaaagaggaatttgatataaatttttcagataattgtgactcgtagattttccttcagagtgtccttcaaatacttgtgcatattcattggtaaatgcccaaactataaaaatagaatctaaaatagtccaagtaaaatattgtgtacctccaaaacttcattgtcctgtcttgtactctgaatagagactccacttctacatgatttctaaattcatctattcatcaattggaaaacattacttcgctgtatatatagattcccccaaatgtttacattccattgcacagtatcagaacagcattttaacagcattaccaatgtttaccataaatgtaactgagtattcataagctgtcaaatgttcagtgacaggtactaatttacactttctcattttccactgagagctcatgtttttatcattgctggcaagtagcctcactttgattttttttttcttcagtttccaaacttatttcatttacgatatctagcacatacacatagttcatgcaagaaagcttttcaggaattttttaaatctacgatttcatattaaactgtgagtagctcactgtggaacatagccgtacatgttttacctcggttctctctgcccttgatagactatttatcatagatctaagtcagtctacgattcatcttctcacacacgaaaaattgaatgatgtcagagtgacttcggttttgatgaccacatcaaataatacaatatttacagcatggatatggtggtgtgagttcacttcttatgcacagacagtagcatgatcatgacttggttggtaacagccaacatttcccattcttcttggtcactggaattatttagtatataaataaataaccatgactttcttctagtgatggtggatcacatttgttgcacaccatcagcacaagatacttcacagaagtccacgataaaaaaaaaattgtcaatgcttttgcaatatagttttttagaaactaaatcttgtgtgactaagagtattgaattataaatactaaatatttgcagagggatcaggagttggattgtgttagtcaatgagaatagtcaattgtgtctctgtgttgccttaactcatacccttctaaactaactctacattttctaaggttatcattcacacaaaagtcaatataatttctttgagaaagtatggcataattggtgttccaaatactttttgcctctaagtcaattatactcatccaatgtagtaaaatattcaagaaagagcacatgcatacaatgctggcttacatcaacaaaattacattcctttctgttagcagggcaggcagagccagagtgctgccttatcacatttagtgttagagggctatttttactcccagtaatttttagctatggcccacaataagccatctgacgtgtaataagaagagtatgagtttgaacttaaattctttgctttttgtgggggagaggaggaggatgtgatttgctttctcaagacagggtttctctgtacagaccaggttggccttgaactcagaaatcctccctcctgaatgtgggattaaagtcgtgctgtagcactaataccctgcatgatttcattttgtaaaattttataaaagctattatccttttctgggctagtgattactcaataataaaaagaaaacttttgattacatacatagtttccagagtctactcttatactaaggctctaagaaaccaccaaaaattattgttaattagttctaagattataactataaaaataatttcagtttataaaggttgtgtttttaagttagatatttgggaaatatatgtgaagaattttcaaataaattagtaactcaaaagaatttatgataacgaatttgatcaatcaattgcactgcatctttaaggtccatgagagatctgctcccatgccttgcaaccggaatcgcacacatcgtgtgaaattttctccaaggtatgtgttcctgttttcaaattatttgcaactgtgagattgataaaacaaaattttgtttctgtgacattaatttttgtgtgaaatcaaaatgcagttgtcactaacatcatgaccatttggcaaaattggcttatatttaaaaacctaactttggtgacccaattacaagaccttccagtaacagtgctcatgtttagtccatgtggttcaattcaataattacttaacaattttgagaatgcagaaatagaagtgatcacaataatttatttgataatattcattttgccatagggtttaatacatgtcaggtgacttgtctcacatgtacaacataataaaagagaaatttttgataaatgcagaagctaatgccacagaataggaaagccaaaaagtgttctgtggtcacaatcaaatatatgaatcattgtcctataaataagaatatatatacatatatatatatatatatatatatatacatatatatacacatatgtatatatagtttgattttttttatatatttgcaaaatccttcgtagctgagttaatagatattaactaggctcttttttttttgtttcctcataatagggtttatggacttttttcttttttattagatatttcctttatttacatttcaaatgatatatgtatgaataaatatgcaacatagaaactatttgttgtaattttaatcttcatagcattcttgatttcagtgattttcaaagattatgttctataagtcaggtttcagtttgaaagacaattttcaaaatagaccagactcacagtggagagaactttagtctatgttcattaggtttgtcattgactaaatatttattgaccgttccttatattaagatattaagacagggtcagtgaggtggctcagtaggtgagaagacatcatttcaagcccaatattgacctgagttcagctcccaacatgcacacagtcaaaggagtgaatcaacttccacaagttgactctatgacttccacatatgcaatgtgacattttttttacctctagttgcatgtacacacacacacacacacactgaaaaaaatatgttttaattggtgttccaaacaatttttgcccttaagtaaattaattttgacttactaattataagctcacctagtatagtaaaatattcatgaaaaagcaataagaatgaacataaaatcaaaagtaaagatactgtacaccatgtacagatatacatactgcaaactgtggccagatgatagagaattcatatttaataagcatagccctatgacataatttttttaaaatcttgtgactttatatctttacacaacacctatgggagaaactttttctttctttgggtttggtttgagtttctttcacagatggctttaagagacgaagataaaatttccctatacgcttatcaggatgctaaatacaccaccttccttaaccctgtgctctctgccattttagtgttggtgaggaagagccttctttggaagaagcccagccgcagcagcagcagcagcagcccatgaacatccgaccgaggaattgcctaaatcctcagaattttcaagctcaatcaggtgagtcaagacgggaagtttcaacgtaggcctaatgttaacagcttatatctcagaactatagaagaatttcaagaaggaacgcatgaacatgttaggtaggccaagtagtattaagacaagatgttgatttggggtttgagtgatcagtggggacctctgagaaatggaatccaacatgagataatgcatgaaaccttgagagaccatccttcaactagccaaagtgtattaagctacttttatgacattaagtcaagtaattgtgaggacaacttttccttgtcatttgatttcacctcttgaaagtatgacgagctcaacattacatatcaaaacataaggaaaacattcctaaaatttggcctgatttttttcaaaacaggatttctatgtgaaaatatactttgaaaacaactgtttcattatattaatctcctaaaatggactaaggttttaaaattcaaatattttaatatctagtcttctatagcccttataataaaaacatttaacaaaaatctctatgacaactttttataaataatgtgagagcttggtaaggaaacatcctttagttaagcatatcttgcacacttaaaagtggaaaacgtcagattttatgatccaatgcacaatttttgcatttttcataatgttcacaaatgtataatagttttaacaatctttgaaatagacagcactgtttgattgtaaatgatactgcaatttttgaagctatcttagtattttgcctatgagatgtgaattctctatcacctggccacagtttacagtatgtacatctgtacatagtgtacagtatatttatttacttttgattttgagttcatcatattgcttttttatgaatattttactatactaggtgagttttaaattacaattattttttcaaatattttgaataaagccataagtttgtaatatttcatatgaggtgatgtttctgcaattgaattgcaaaggatgagagagaacagtgagctattgaattaatccactacaaaaatgggagcaattgtgaaatctctgttgttactaatggacttttggcatttcatagactcatcttctgaggaggacagtcctgtgactaggaggaagtcccagtcatcaccgccttattctactattgatcagaagctactgattgatatccacgtaagtttagatcatgatacacttatatgtatttttatcatctaaataggtttgacctattctttctgaccttccaaccttgaggttatggactgaacagatggctcagcacttgtttctctttcagcgacagacaaggattggttttccagaatttatctgatgactcacagtcatctgtaaccccagttctaggagacttaacacccagctctggcatttacatatgcctggcatacacaagatgcacatatatacatagaggcaaccactcatacacgtaaagagttaagagtttaaatgtgtcgtattagcctttataaaaagatcatattgttaggcaagtattcaggatacaaaatttgcaagttaaaattgaaatggggaaagagcaaacagtactgtattttaactttctatcaaagtgtgttgttgaggggtgctgaagatatagcttggtggtagagtgcttgcctagcatactccggtctccaggttcaatcccattaccacacaaaatagaaatacaatatagaggaaagaacattaacaaatggatacatccagactaatctatgaccaagaagtataaatcacattttcaacttttgcttaatagtatttcctagataaggagacaaataacatattagagaaaaatattgtcttctgattgtataagtaaaaggcctccctaaacattttcaatgtgctttcagatcatattatgtaattttcataatatccctattctatcctacatatatctatacctaccatcagaattgtacttgtatttgcttgcttttggaggcatttgaaataatttaagatcatatatggcctatgcagacaaaactgggaaaataacctatgtatttcaagagctatgccctaatctcagtgttaggataaaacaaaaggaaataactgactttatctagagcatactgcctgacatcaaaagcaaatgtctactcctcagcaggcaagtagggttaataaaacagtgagttaattgtgctgtgtgatctataatgtccactaataactactgaagtttgggtttgggcaactcatttcactaaaattttttctcgatataataggtggacatctctttcaataaagaatataatattaacttgttttaaaatgtcattttggaaagttctgctacccaaatataaaaaaggagagaaacttttagagactaccttaccttttcttgtgcacacaggttccagatggatttaaagtggggaaaatatcacctcctgtgtacttgacaaatgaatgggtaggctataatgcactctctgaaatcttctgggatgactggataatgcctacacgtcccgctcggccacctgaagaagatggtgattatgttgaactctatgatgctgatgccaatgctaatggtgatgaagaagttgcaaacggtgcttatgaagatcctcgtgatggtgccaatggccatgatgacatgaataaccagcttgatcaagcaaatggttatgaaggccatggtgctgctggctacaatggtggagacgttggtggtaatcatggtgctgctttcaatgggccaaggttggttcatctctcttattacacagtagatgcttataaactcagaacgattggcatatttggtttatttcaaaatgtagcataacatttgagaattaatgaattgtacttgcatagtggtgaatgttccatattataattttaaatgttctaagttagaatacttagttctgattttaatatttatatattataaaatgcatatacaatttatagttatttattagactgtatgagatttctcttaaaattaatcccactaaatctccttcccctataaaatcacaattaaaaatatgtcaaaagaatgagggattctactactatttgcaagcatagttaagcctttctcagagagttgagattttgccatgtatatgatcaacttaattatgatctttattcatttaattgctggagaagttacaaaaagatcttccagatttctcccaaaataaataatctataaaaagttccattttcacacagtttttcttttatgatcacaatagggacatatttttaatagtgtattccatgcataacaaggtactagcatgtaaaaaagagtatttataaacactgattatgtgactctcttacttatcctctaacatttgaagcctatattacatgtactttctgatgagagtagttgaccaatgtgtctatagcagagctgtttgtatatatgtaaatgaatgaaagcatatgttcaaattaacataatataaaatactgaaagattctaatattattatggggttgatcattaaatgtgactaaaatttattagtgaattatctatttgagaaaattagcattttctgtagctacccagttatgtgtacctaacaacataaaatgtagttcttttcctctgtttccacaatgatgacgcagacttaacagtcttaaatcattatttagtataggcaaagcattggggactttttcatgtctgtatgcaaccaaaagcattcacaaaaagcaaaaacattcctgaacatggtgtgtgtgtgtgtgtgtgtgtgtgtgtgtgtgtgtgtgtgtgtgaatttttctctttttctttccttttgtggccttgatttgtgtttgtattaaatggccttctttcattaatttctccttgttatcagagcaaattatcccagagcgggaatcttgaaaaacggtcataatgatggacgtgctctaaacaggggagcttttggagtctttggagacaatgcagccagagctttccatggagctgccggtgaagcaggtgcagcctttggaaaccatggagccaataggggcaatggaagaggtaacagaaacagggaggccaatggaaggaatgaagagaatggagcatttggacgggatcaacatgtatttccagagtttgaacatgaggtgatgaacatataatataatgaatatatacttctcttgtaaatgtatgtcaacacatatgtaatattataggtatttaacattgattataaccttttttctcaaatcctgaaattatttaaattataagtgtataggatctttactacatacaatgtgatggttcctacgtacttccaagggagacaatctgatttattttgtcattttatgtcagattatacacttggtatagtatttcaaggagatggcaagattctttatagctgtagaatacaaatactgaaatttttcatttgaagtctgtaaatcactaacatttttggacatggacaatattatgcaaccatatgtatttgtatagcacataaagggatggctttcatgatggcattttcccacatcctttgtctttattgcttttcctcttctttcccttcctcttcccctcaattatatccagtttgcctccatttaactctcaagtcatgtgtattctcttgacacatttcccccattactcttccttaaaatctttctccctctcattcataatcatttctagttctatactatccacacacatatatgtatgtatttgcatgtgtataaattaaaacctaggacctgtgtgtgtatcataaagaataggaaatacacttctgagtagaattgtacccattaatataataatttccacacacagacaatacattgaaattttcatgatttcatttttctttgtggctgaatataattctgttgtgtatatgtacatagcacatttttgttttccacttccgctgctagacatctaggcctatacatttttatcttcccgaataattaactcccaattcttcccctgattattcagtcccctccacagataaaatatagtattgccacgttcggaggcttttatcattaagtgcctactccttaaaaggaaacatgcaaaacttagagtgaaatacgcttactctaagatttttataatttggatttgttttgctttgttttgttttccatcttttgtttgatcatttgtccccatgtctccagaggttcttcttgctctcagttttcctaagccatgtattttttttttggtgtgttttgttctcttgtgtttgttttgttactgttttaggatcagagtctatctctgtaggcccaccctaacctgaaacttgtatagctcaggctggcctaagactctcaaaaacagtcttccatgggccagcattagattctcgtgcctatgccatgagacccagctctgtagatatcttaaactaacaaatgcaatatcctcatgctgtgcttttcttttcaaagtaactatttggcgcatatactttggggtcagagtcttctacttaccagctctctgacccagacaacttttgatttctttaagttttggtttccttataactgaatcagaggcaatggcatgtaccttattgtgttgtagtaactgttcatggagatgcatggttaagggtattagcatagtgcctgatctacttctacaaagattacatcagaaattctacatttggcaatttaatgctccttctagataataaatttacttctcagatgatactgttcaatatttttagtagatatgaaattttaagaatatatatatatatacaaatatatatgtattacagattaaactttcaagtcgctgatagcatttttccaggtatattaaaagttgggtctttggcttccttttaggaatcagatcgtggaactgagacctcagattcaattgccttggagatcacatcctttgatggtgagcaaaacagtggtagaccagtatcatcaacaacaatgggttttcctattggacgctcatctcctagaggttctgattttgggagtgacatctgtgagtatttctgttgtgatctttcaatgctgaatgcttctacttgcttataccataagtcataatgtgtaacgaatcagacatggaatattcatttggtataaatcgagatttatgcatgctttgaaaaaattattcctcagaagataaagtcatttgccaccaagttaagtctaatcccctaaacacacatggtaggagaacagacctaacgtatgtgccttaataataagttaataaggtaaacatacatgtatatttgcatatacacatacgcatactttttccttagatttttggatgtcttgtgtacccaggatggcactgagctcattctatagtacttactggcactgacttcctcatcttcctgggatcacagacccttgctatcctactgacctgtcactcaatctttttggtgactagctttgacctgcaattgagaaatttagtccttcactcaactcttggttttgcactactataaaagccacaaatcacattcatactcagcgttgtattttaaccactataatatatattttctaatgtgttaagaatttgcaaaaacttcatattgttgttccacctatagggttgcagatccctttagctccttgggtattttctctagcttttccattgggagccctgtgttccatccaatagctgactgggagcatccacttctgtgtttgctaggcccaagaatatcccccagtgctcgtgtccctagctgcatatgaatcagaagatggcctagtcggccattagtggaaagagaggcccattggtcttgcaaactttatatgcctaagtacaggggaacgccagggccaagaagtgggaagggggagagtagggggagggcatgggggacttttgggatagcattggaaatgtaaatgaagaaaatacctaattaaaaaaaggaaaaaaaaagaatttgcaaaaacttacataaaagatgaaatgcaataagaaaaccaaactttgagggacatctacatgatggaaatacttgtcacacgtttagtatacagaccagtgatttgtctcaatacctttccccttcacagtatatgtaggactagttgaggtgcctgaaaaagcagctaagctaccatctgcagtcaatgttaacccgctctctgtctctccagcatataacagcccaatactacatgtgtatgaaaaggatttctcatctgaggtctactgtggttctttgtggggtgagtttgatttcttgaactgagggtttatgtatgtatttatttatttatttagtcactttacactccaatatcagccccctcattccagtgcccaggcatgcaagtcttccctgggtccagcctcacctttgtcatcatcagcacccctgctccaaatcctgcacataaaagttgctgtggggctaagcacatcctcttccactgaggccagcagcgggatccacatgcaggcaggccatatgttcagggatagattattttttaaagtccatatttgtgtagaaaactttcaaagcttgtggaagtaaaacatgtttaccattgccaatacattaaacataaatttataataattggttgagggttgatttggcttgttgaattaatgtctttctcttttatgctttgtttagcttgtgttaactagagtgaaatacaaacttagacttcattctaattatttgaaaatttgagtttatttttttctaacttagaatacatttattacaagaaagatttctgtagggtcttaaaatttttaagtctaaagtatgtataatttttctctataaattttcttaaatttaacaagtttttttcaactgtttttggtatgaccttatcagtagggctgagattatatgttgttctaagatagtcttcataggactttgctataaagtaacttaatagcagagaagaggtccaaagtaaacactaacttctaacttaacacttcatagattttcacctaatgtataattgaacagaagatatgctttaaaaatgacaaatagaaaccagcaattttttttcaatttgtgaagaaatgaccttgctgtgcatcagaaatcagtcccaagagagactccagggcatggaacagggtagaaaggattactggaaaggaggagaaagggtcccaactggagtctttggacaaagcactgtaattagaacgttaaaatgtatacatttagttatccccatccctagacatgtggtcttcttatcagaaaccagcaactgtaactctatggttggtgccctcagaagaaaatcatcattctcaatgttttgttactttagtggctcagacaatatggcatgtgccacttcagtctggcaagtactcagaaatatagtccatgtctagaaaatgaactgacagtaattgtctatgtatagactaagtttgcttgaagggaactttcagaagcgctgactgattctagaaatgtttttgacaattaaaaaatagtgctatgatacatacaccattttgtatgtcatatgacacattagacggcaggaagatataatatttgttgtatatggatacctatttacacattttaggggacatactctgatagacatgtacatagttgaataatatgaggttaataaggcttgagatagtatgagataaacatttgcctgaattgataaaaagtcatctttatatagattagcaaggtgaaattacaaaaggaattatacacatatatttagttataaaatcgatagataaagggtgaagaaatatggaatacacatgtacacagtagagtattattcagctggaaaaaagaatagaattatgtgtgtaggaaaatagttgataactgattgttgaaataagccaaatgtgtaaagacaaataacacattttgccttctatgtaaactctaggttgttttaaggtactactggtagaataaagaggaccagagggagggagaaggaaaagtaaggtgggggaggggtaatgagtgtgattttgattaaattttgtgatacatttaaaaacatcatagtgaaacccctttctgtagaattaatgcacgctaataaaacaatcagcgaatcacttttccgtgtctgcatctgaacaggagtcaatttgttgctgggcacccaatctcatctgtatctgatggaccgaagtggaaaggcagaaattgttaaacttataaagcgaagaccattccggcagattcaagtcgtggagcagctcaatttgctgattaccatctctggtttgtttaagacctaaaattaactgagtaattatgtggggtaattgaagtgcaaactgggttaaaggctttcttaggtgaaagtgttcacaggcaaacccttgaaatataatgtttaattgggacagcaggatctcctacctgggttttcttatccatttggactgtgaacagaatccttttgatctcgattcacataacctaggctggagatcaggaaaactacttttgcatccttgaaagctcctttcagagttatctctaataaaactccagagctgtaatcacgtgcacaagggactacaccgatctctcctatctaccttttgatgtgtctgaaacaacaaccaaccaaatggatgactatttggataaaaaaaaagagagaattgtacctgtctccccaccttattacaagggcatacagacaagggttaggtgcaagaatggatgccctaaagacacctacacgtttcccaaacagtagtggattttcatgatcttgatcagtcaaggcctgaaacttgaacaatgaaagcaaaataagttggtgttaaattgtgactactaaatgaatggaaaaagataagtaaaggaggtcgtgactattcctagctatggtggaggagatttattgtagatacaatagagagcatagccaggggcctagacagagacatctgtgagagtctaaagtgaacaggaccagcagactgaggccatatgaagagaggagagaggagaaccttgagtggcagtcatgaggtcaagaggtcaaatactataaaaacatcatcatcagatgtgaatcttctaaggctactctggaaaaaaaaattctttcaaggatgcaatgtgaagttattcagtagtttattttaccagttaagtattaagtaataataagtatagttttggaaccctaagacttctttaaaatttccctattaaaacacagtaaaatcgatcatattgagaattttactttgtaggctgagtgtggtggcaacatgcttttggtgtcagcactcaggaggcaggggaaggtggatctccatatttgaggcaagcatggtctcaaaaataagattcttattgttgtgactttcataacaatcttaaatttgctaagaagaattaataaattcaatagtaggacctttagttcttaaattataagaacttgatagaattatttattaggaaattagaagtaaatacagccccactcatgagcaggatataaaaattttctcaacaggttatttttatatatttaggaatagccatgtatatacatatctgtatataacaacaattaatgacaaatagctcatggctgtgaaagagagaaaagagtgttataaggaaaggcttggagggagggaagggaaaagtgagatgatgtaattataatctccaaatgtaaaagaaagatgtaaacgtctcaaagcaactgagaatagactagttgccaaaggctggattcatagaaagggagaagaaaggtgatgcagacaacaggtggataatagctaaaggctaaataagtacaacattttgttgttctatggcccaataggtaaacataatgaaaacagggcattatatatttgaaaatagtcagaagataggaatttaaatgtactcaccataaacaaaattttaaaatttaggtaataaatatgctcatttcatgatgtctacatgaattaaaataccacatcatacatcataaatatataaaaaagaagctttatagtaataatagtaatggggtttgtttcctaaaggcagtcttaatgtatcccagtgaattattttagatccacttcagacaggcataaagacagctagtagaatccaactgtttcttggaattgagacagaagtgtcttaatatatctgtttttaaacgtgacttttattttatgagaatttcgtttaaagggcagtgcaccctacatctttgcatttctagaaaataaaagaattgaaatgccatcatgttttcctaccaggcaaaaagaacagacttcgcgtgtatcatctgtcttggctgaggaacaaaattctgaataatgatccaaagagtaagaaaaggcagaaggcgatgaggaagaaagaggaagcttgcaaagctatcgataagttgattggctgtgaacacttcagtgtccgtacgtccatttcacatttaatattgatgtatagtttctgctttccttcgtgtggagaggttcataactgcaaaagacaaaatgaggaaaggaaagaattcacagagtgattgtcacagagacatctcccaggccttttctacataatcagacctattggctgaaattgctctgggagttaaatatggttgacttctttcttcctttggtagtcactcgtagtaattgaagtactagtttccacactataaatgtccttgatgtatcttcagcaacttgcagagatataagagatggtattttttcctctctgaatagcaataaaccatgaccacaaaattttatgctgaatctgcaaaggaggttttctgtgatctgttgactcttgctcctaatattttatgtttcactatagaatgttttcatatcctgtatctctccatgaatgtctctgtaaatgcagtaataactccctttggcctctgaattctgttggcagatgtcgacaactatgaactaatgctgcccatttctgaatgctcttccatttctgaatcaaatcctcttctctcagcttcctttttctctaaaacaattgacccttcaggcagaatgggtaatgtagataaaagactgctgaaatcacattatatgaatagcaagagaatatttctcgtttattattattattattattattattattttattattattattattagatattttctttatttacatttcaactgctatcctgaaagttccctataccctcccccgtccctgctcccctacccacccactcccacttcttggccctggagtttctctgtactggggcatataaagtttgcaagaccaaggggtctttcttcccaataatggccaactcagccatcttctgctacatacacagctagagacatgagctctgggggtactggttagttcatatagttgttccacctatagggttactatactaccaagatactaccaaggtcagtttcactttcttatgccctgagatgcacaaaagatttaaattttgatgaagcttgatttatttttttcttgtatcacttatatataattttttttcaaatgtaagaatacattgccatatagaaagttaaaatttatccctgtttactgcttatacttttgtagcataagctctgacatttaggtctttgattcatattggcttaatttgtgtgtatgctgtaaggtagttttctcttctgttcttttgcttatacattaccatatgtctcagcaccatgtgtttaaggcactgtggttttttggttttgttttttctttattgaatggtcttagagctactgagctcatatgtgcagagtatattttctgaaagtcaaatgtattcagtttatcagtactcctattgttttaaaaatattttatttgtgtaactattctacaaataatgtagcttttgctcttaaggttgtgctgtttgtttgtgagaatatatataaccacatgactatccttgttaattctgaggtataaatattttgtatgttgccattacagttcaacatgaagaaacaacatacattgcggttgctgtgaagtcatcaattcacctctttgcatgggcaccaaaatcctttgatgaaaacactgccattaaagtatgtggccatttcactctcatcatgttctttttctcttaagaagacattataagcaaaatagtagtttggaatatagatgtggaaatatataccatttggctacagttattgcaatatgaatataccatgtcaataattatcatttaacccttttttagacaatccacaggtaccacagcagggagagtatgagggaattccctaacccctccccttacaggacattcccaccagctcctctctcccatttcctgtagtcaacatgaagatcttctcttctagaggcccaaaatcaggcttcaggtgccaccccaatgacctgatgtggggaaagtacctgcactctcatcgtgggatgggggtgggattggagagcagagggaaaggaagaagagatgcagcgatactaaggaggccacatctgaaggggggacgagaagaactttgttccaactatcattacaacaccagatgggcggggggaggacctgggggtctatatttcttccaatgtgaaacatgcttctctgaagaactattctggaacacagtgggtaggcccaccagtgcctttgacatcttttgatgaagctgaacttctatggatcagctactaaccatctagtagcaagaacaaatcttgttcactccccataaactgaggactgtggataaattacatacaatgtgccagaactctatttaaataggatagatttttaggaaacccaaatagcttctttaatcttacctattgtgggcatcagaatcagggggagcattttgttaaatgttcagatctcagacccaaccccaggctgagttagtgcgtctgcagtggggcctgagaatctgattttaacaaatggtctcaatgatactgaactacgtggtctacatacaaatttcccagagcactgataggagcatatcctgatcaaggtagtcatgaaatacatttgtatcttatatcaggatctatttatatatctttgagcccaaacattgcatgtatacactgatcatggtataatgcatatgactactcccagtatagctactagactactagatggacagtctaccatggcagatatagcatcccttatctggtctacctaaattgggtcttggctcagctgtcaacatttggatatggaataattcttgggtgtctgctgacttgtcagtgctacctagtatggaactggaaaacaaagagagaaatatcatctgtacatttagcctgttctgcccaagtcctccctccatccttaatgcccatcttacgaccatgttattgtgaatcctacatgctcagtgctttccatcatctgatctcagcaatgaatcctgtttggccttttgtttccttggactgtcaacattaggagtcttagagtagagtctgtctaccatagggttaatgtgtatggcctttttcattccttaccaagtatgcattgaccaatcagcagactccgaaggagactacatgtcctatgaagcctatatacgaatattggcaaaaatacaggcagctgatccagcgaaccggtttaagagaccagatgagctccttcatttgctgaagctcaaggcaagaatttcaggacagctaacaagagaacaaggccatatatgggtctgaggggtctaacagtttgatcgttgtaggttgttcaatgcccaggatcataatcattcaatcaatcattaaaaaaaaagccatctgacttgcatacatttgtaaatatgacaaaagaatagggaaagtttcccttagtcagaatgtcattttggcctttgggccatatttgcttttctgttttcaggtgtttccaactcgtgatcttaagccactgacagttgacctggctgttggttcagagaaaacactgaagattttcttcagctcagctaatggatatcatatcatcgatgcagaatctgaagttatgtctgaggtgaccttgccaaataatgtaagataataccttcactatcctagaagttattgtaaaacactttgaattttcctgattatcaaaattctcaaaagtttaaaggtacaacttagactgcagccaagatctaacaggtaacctgagtatgtcagaaagtgttgacacataaggaaaattcactaattatttcatacttcagatatctaaatgtgctcctcagacatattatttggccataatgatttgtaacctttaaaatccagacttctattgataatctatatatcagacttctattctgataatctcatgcccaaaccatcatctggccactatcaactggaactaattgaggtctgcctcctttaatggctttgtattctacattcactatccatttatctatatgcattcatattaattggccctaagaaacttttcaattggctttaatatttctatgccctgtaatatactaatacattttgttaagaaatcaataacagtattacatacttatatgtgctcccctctttattgcattagctatagatgatagcaacttatgtaaaaatgaatttattatattcattatactccagaatttttgatggaaaaattcagcatttttaaagtaatggcacagtattttcaaatcatgactggttgcacataatataaaaatcttgaccataacatcgtagtccactaaatgaatcatacaaaatattgatggtggaattgatggttttcctgttggaatttatatttaaaaggaatgcctttactagcagttttttgcttcatcttttcttagtattcagtttgttgaacattaaaattttagcagcttatcattatgcaaaatccctgaacaaagtatgtatggattttaaatctcgccatttgtgtgataatgtgaaatttttggtaatataacctatgtctccaataacacaattttcaaaactacagaaaacaagcatccaaacattggtgaagacatctttaaagatcaagctaacaatcattagctaatgatctcgtagttgcctatacagacagcttaccctgcttgtactgtgaaaatattaaatacaacctcagccaaattcacaaagcaattgtgatatattattcttcagttaattgcccctggagcttcatccctcttagatttatcagaacagctagcctttcctcagaagccagtacaacagcgaatattttaaaaatcgggttaagtttacacttattgaaatacccacacaggcatattagtgtatgcacgtaatcccataactttggaagtataggcaaaaagcatgggagaattacagccatcatcagctttttagcaaattcgagccccgactgggatacatgattctctgggttgaaaaataaaatcactgaaaaaagttaaatctaaataataaccagggaaattatttgctttaggaacaatcagttaattaactgaacctagaatgagaaaagacgttacaaatcattttctgacctaattaggatgcctcatatatatgcaaacgtatttttagacaagttccccagtgtcttgacccactaaattagaaaggactctactctaaagcagaggagggtgtcatctgaaagagaatgtcctaaaaatactattctctcagaagtgctacattacaaaggctctggtggtgcaggagagctacacgtgctgaaaagtatccagttgcttcagaaatcatctgagaaagcaagggaattacctcagaggctctccggatttgcagcgggcccggtttattacaaacagattttcttgagaaaactgtatttcttgaattttctttccttctttcttatctgttttctgattcaactgctcatgcacgtacccagggaacgcattaaaattgcgttttgcctctggattcccattttagttttgaggattgttgttgctgagacatggcctcaagcacttggcctgagtacgctggctttggcaagtatagtttctgaccttcccttcccttccccccgtaacttgctaatttggagaaacagcagaacaaatttcttttatttttcagagaaataccaccagtgtcataatatctaagctctaagcagatttcgccccatttatatatctggacgtttacgaatgcttagttttctcataatatttccttgttctacaacaaatacttctgaactctatattgggcttattttagcatgtgaattaaatgagaaaaatctacattttattgtaaaggggacaaatataaaataagccataaacaatattaaaggttgccccttaaaatatttaagctcaagctacttgaggtttaattttctttttttcatgaatttgccaatgagcaagaattgttgtatatgatttattgcttgggtcacacatacattatgaaaatattgcttaatttctgaaataaatctgaaattccagattgtatttgttcccattaaaatacacaataatttgtgtagcatttcaagaaagttctctgtgttagaaataaatctctgttttccccaactgattatcctaaataaaaaaaagtgagagaatattaaaattgatggctttgagccataaaggaaacctacccttctaaaatgtttatttcatgccactcactttagacacaaagattaccttccccccctgcactttggacatcttcttgtcttcagttaagtaatagttgcttcgattaacgtaatagtgataaaatgctggacacaaaaaagtcttcatgaaagataatcctggtcactggaaatcattatcccacagaatgtcgtcattttacctgattgcttgggacttggtgtgatgctctccctcaatgctgaagctgcctccgaggaagcaaacgaacaactccttaagaagatcctggacgtgtggaaggacataccgtcttctgtgggtatgtacaaagctcttttgctctcaagccatcttaacaggatcaaaagataggtcctaaatacgttttcctggattgcttctttttcctaaagcaccgaagggtaacttaacgtcttatccattaaaaaaaaaaaaaaaaaaaaaaaagaaaagaaagaaagaaagaaaaagaaaaaagaaaacttctattttgtctggccactttatagagtggtatttgggtgaagtcatttatacttgtaatttgccacccagatggcaacatgggtataaccctacttttacagactacacccctaaacagtgcaggactgctggtctgggaaattaaaataactaatttgagattttttttatgttcctaaggtttggtgactagatggcagaaaatattcaaatagttaaagtattagagagggtaaagggtataatgataagataaatgacctactcctctctctctctttctgtgtgtgtgtgtgtgtgtttctgtctgtctgtctgtctctttctctctgtgtgtctctgtctctctgtgtgtttctctctctctgtctctctctttctgtctctctgtctctctctctctttctctctctctctctctctctctctgtgtgtgtgtgtgtgtgtgtgtgtgtgtgtgtgtgtgtgtgtttgcagaagcatagtgagttatagaagagagagagagcaaaggaaaggctgtttgtccaaacaggacagaatcctctcaaatgcctatgggtagaagtgacatccatattgttttagtgaccaatttgaaagaaaactcctttttaaacaactttcttatgggatgatagggtttttttttttttttgcattgcatcttcagaatcttttaattatttttatgcatggtcaatgttaaggcttgtcctaaaaacctgctctaatttcttccaacaggtaagaattcacagagggcttaaaaccattatgagtgaaaaacacttaatgcttatagtacacattgatgaatttagggcaaacgaaagtaagcacaatgagccatattatatcttgcatagtgatacgtcagggaacaataagtgaggtaggacccagtgaggctgcccagtgaaagaaagcctgcctaggatgtgaaggactggcttccatccccagaacctcagaaagtacatgagtcagaaatgaaaatcaggtacctaagttcaaagagaagaataagcagaacactgatattcaagcagctcagtgatcatagctataaaagggatttgaaaagttgtctacaacatttcttgtccttaggcaagaagagttctaacctagatcaaaaagcttggttgaatttggacgacatatacataaaataacacatagcacaaacacaagtgttttgtttagcatgtactgaaaatatattacaaaataacactgatatcaaggaaataattcaatttgttttctacatcaacacaacttgctgtttacaaatagcataaaaccagatttccctggactaaaatttacatttctttaaactataatgttttcaataacaaagacaatgtcctttattctcaggtatcacagtttaagaatggcagatagttttgccaaaaatacctacttccagatttcagagtcccatttcagaacgcacactagttcagtaagtagtggcagatctgtgagaacctgcgtactgggttcagaacccagtagctaggctgttaaattgcaacgctttactctatgtgcctgttgagaagaatagtattctagtataatagtcacagaagtaaaataaaagtgaattcatagatgttagacctgttactcgtttcggtaagacaggtcactgttcttcatacttcctgtgcccacttcaattccggcctgattttatactatacattgctcacactatgtatttgctagttgcttttataagattgtatgtagtcttccataagttattttatgtaaatttaatgtacacatacagcaggtaaattttggtttaagtaagagtacctgagagcatttgataaaaatgggagactattttttaaagacaactacacaaatgctgattttccctcttttaaaataaaggaaaacagaaagtcagattaactaacaaattctggtttcaaacaaagtgctatgtttcgtattttaacttcagttaaaatttgtgtcatttaaaatgttataatttactttatatatggaaatttttcctgtaaatttcataaagaataaaaatttgaaagtgaaacatttaataaaattgctctttatactataaaatacttcacagagtcaatggagtatatggacttttcaaaattagggttatgctttcataaattatatttccatgatggactataaaacatgtctaaaaggtttaaaatgcaatacaattttccccagaaggaaaaacctttaagtgtataaaattcccctcagttctgcttatagcagaaaaattgttcaattgaattagggttactaaaatcattatttgaataagatattatttaacagatttagttttttcaggactgagaactgaacttaaagccttgcacataaccacttagctaaatccctactccctgttttcatttgttgaaaagtcagcattccatgttatgctacaacctggctctttattagggaccttccatttgtagctggtatcgtactggatctcacctacaccatgaaaaagagatgtaaagccatggattgatctgagcaactagaaacaaagtcattacctcttgggttgtctgtgatctgacaggacattaatacaaacattaagaacgttctagcaagtcaatgttcatcacctatagaataccagtcctaagcagcaaaatgtccaaagtggtagacttcaaaacaagatgaagaaaagacgggactaacctaacctagagctatgagctcttaatagttaactttagttatgtttttcatatcactgctaccaaaaataaatgttctttcaccatctccaattgtatcatagcttttgagtgtacaaagagaatcactggatgggaccaaaaggctattgaagtgcgctctcttcagtcaactattctcgagaatgagctgaagcgccgctcaatcaagaaactgagatttctctgtgcccgtggtgacaaggtagagtttacacctttcagtaaagtaaaaaaacaaattaagcattaaaattattagactttataccttttcctttggctagtacatatttaggatttttttaagttggcacattattaataaaaacaattttcatttttgcagtagaaacctatttggtaaataatgtaattttgtttcaacagaacctattttcaaagtacaaatctctagttatatcctaattaaactaggatattttctttggcatgaacactttcattagttttgatccatggtccttttcattttcatgccaagaaaatttagtaaagaatatgagattaaaacctaccttcttagagtgatttcagtgttttgatttggattaccataatttaaccacacatatgaatgacattctttgtgatatttccgtgtatgccctccatgtgcactactcagatctacactccttttatctgccccactccccatattgttcttaatctctagattgatttttgtttagctttgatatataaaagaaaccactaacattcgtttttaggttatttcacttaagttctccatttttcctgaaaatgaatgatttcattagttttatccattcatttgtagattggtgcccagcttgactcaaaagttattgtggataatgttcctataaccgtgggatttaaatatctctggtaggctggtatccaattctggtggacagatgctaagatatgtgagaaccagatcacatgacaagtttattagtttgtctgtctgtctgtctgtctgtttgtttgtggaactttcattcatagtattttccacagtggatagaataatttacactcccaccaaccatgtgcgagaggtcttttccagcaagcgccttgccagcatttttttgatggctgaaaaatctttcatttctacttttagcatattctaagactaaaagaaaagtacttacatttattgactatataattatatgttaggatatgcttgctattttagaatcttgtctcagtttatcctcacaaataggtataatgatgacgatttgacaagggtgaaaactaaaattgagactcagaaattttctgtgaaatttgatcagtgttaacaattcaaatagctaggtgggaaagttcaacacccaagttaataatttaagaaataatactgtgaaaaaataaccttgaatataattaagaatcatcaccaaggagtacacagaattcaaattctgtgtaaacagtgaattcaggcaaaacagcaaagttgtcgaatgttaacaaaatatgtgccatttcggggatgtaaagtgtagaagcagggtttgaggtcagagagctttggattgcagctctggctctgtcacctaacaagatgtgggaaccagaaatgttaagggatttttccttttttctttggtcgggtgttgggagaatgctagtcatggactcacacatgctaggcaaacactgtatcacttggccacatccccgacccttgtttggtctctttagaattgaattccttcatcactaaaatagaataactgtttggggaacaaagttagaattctaatgtatcacgtgcctacgcagcatcttccagggtatttggcacataaatggtatgaagggtagctgctgatcttaccctcatcatcattaggtctcctgccctgctacctataagcatcaatggctttaaaaactttgccttctttttgagatttatgtctgggttctattctggttttctttattaggggaagaacccatatttatacaacatgttcttccttaacacgtggcatttacgtcagtgtaccaagggaaggaggatatgaaactcagttacaatctcaaaaacataaaatcgaacttatttcgattcaaattggcttttcttttaatataaggaagcaaattatttctgtgatttgccacctgtgcttatgcttaataagtcactgaaatgttctactttttatgactatttctgtaaaaaggaattgacactataaaatgtagagattttaattacaacatttcttccctccattttctccctccagaccctccctgtattcctctcccaagtcataatagtcctcttattacaatatattatattattatattatatgagtccacagaatgttgcttgtatgcatgtatctagggctgaccttttgacactggacaactaattgttgctctgttttctgggcaagaccacctctctcacttcctgctcctagctttcttcagttgcctgtagttcattatgtagagttgaggtctcctgggctattctccatctagtttgatgtgttcattgatgtcatctttgctcagctaaaggaaatgtgttgctaaccaaaactagtaagaaacttccagagaggaccaccatctactataaatatatggcagttggtagctgctaagggaaggagaatcattagtctttggggagatgcaaggaactggccactggcatcttcccattatccagtggatggtctcacgcctgtgcacagcactgaatggacccaacaagttgtaaattttaaaaagccgacaggagtctgggaagaaacatgttgagggagtccacagggaattgaaagagaagtgaccaggtgatcaaaattcattgtggagatgtgtgaaaggctccacaagaatacactttaaaagtgaaaacagggccaaaataataagtatataaattacaattatgtagaccatggtgaaaatgttactttgaaatatgtaatttaaatcccaaactaatcaaatgtatgttccttaacaaagaaaatttggtccaaataagatggcttaatattttgattatatcaaattatagttatatactggtacttaacacttctgtttattaagtatctagttgaaatgcattagaaacacactgatgatgctttgtcctgtctttttttttaaagatgttctttgcttctacactgagcaatgaccacagccgggtttaccttatgagccttggaaaacttgaagagctccatagaagctatgctgtttaaaggggtccagtgatcgactacaacctttacatccaccacacacatgccattgaatcctaacatcagaattttatcattagagaaaactttcatcagaggcttttaatgtagcacagaatagtttggataagaaatgaagctttataaagaaaattaactatagcaagctctatgtactccagtggtgtacaatctgttttgcacaaactttgtaacttttgttactgtgaattcaaacatttctcttaggacagtttggacagtatctgtattcagatttacagcatggagtaaagaaacctgttataaattgcatcaccagcaactttcaaaggaattggccctaattaagcttttccaaaacaaaaaaatagatacatgttttttttttccaagtgaaggttagattaaaagacaaaacataatgaattttgcaacccagactaaggttgaacaacctgtgtgcgcaaagaaaattacatagatcaaggggaacattctacccaattctttttcacaataaatacacaactgaagaccaattgtgacttttttccagccccttgttaaatttaatttttctatatagaaaaagagaagaaaacctcagatgcttgcttctgcccccctaaaagccccaaatatgtgtaagaactgtttttataaagtaccaaacaatatatttactatcttgaatacaggactgaactccaatgcacatgtactgtagaaaaaaaattttaacacatcaaacgaggcgtcaaattttgtcccccaaattggctaagttttgaattttattatatagccaatgctgtgaccatcagacaacattaaatatttttaaatattgaaatatgttttaaatacattaaagtatataaaatgtcctccaagttattaagcaaagcaatataacaaaaggagaagaatgttgattggcaataattatatttttacatttttatcactacaaattcaaaattaagataatcaaggtgataatccaaatttagagtcattcgttctaggtatgaaaattacaagaattttagaaaaaatataacatccactgtatactaaagtctgcaaaactgaagcagtgaaattcatgccagtccatatccacatattttatagacgccaaaaataggtgatatttcctcacctatggtaactgctacctgatttttttaaagcgtgatttatacctatccatcctcaatgacatggttagttctggggtaataggaaaaactacagaacctaccacaaagtatacctcaataagtcctctagctctgcttctcaaatctgaagagtgtgctagcaggataataatttttaaactacctggttaaccaaaacaaaaagcagctgactatgtgtgatttcctgatagtacatcatttcctggtacctttgtgccagaaatgaatgaagatttggattttcctaatgactcctatcaagagtgtagtaactcagtgttcagattataggagaacctgaatccacaagttaactgtgattcgcatttctgttactgtgacacactaatgtgacccaaaaactggcttatccttgagtgtttacaattcaaattactttttttaagttcagtagttattttaaataagcaaactttaatgtcaaattaatacattagaagtagctttctttaaaacaaaaaaaaaaatgtacaccaaaaggccatgaggaactttgtgcaagtaccttatcgctgaggaaatggagcttgctatgttggaggttcagaactatttctcatttaagtagtatgtaggatcaaaccttttaagaatttttttcttcatatttactcaaaaataagcttacaataagttttatcttaaaatcatatgtttaaggcagtaagacactaaaccaaaacaaaaaacaaaaaacaaaaacattttaacaactcaactcccattgttctctgtggcatttattccagcaagcacaggaaatagcaaagagaatctacaatgctgtcccaaagcaattacacatgaaagattaccaatgcagggctgggctttgaaggccaaagtgttagtgaagaaacagagcttgacacctagcaagaagaaaggagtttggagcgttgggtgctcaagtatgaaagattgaaatatttgaagtagttcattagtcataaaggtcactaataaatagttgcaacttaggtgtaaatctgtgtgggagttttatagcctttggcaggtgaaaaagcagactgggactatgtcctttcctcctcattatactttgtaatagaagaaatgacatatgccctataccttgtaacaggacctgcaagggccaatacatggcagtagtgtggagaggcagtccagaaagccagttttaatgagaatcctggttggaagtgtgaacattttggcaggttaggagccgtactggagagagaatggtttgattttgtggcagtttagttttattaccaaagcactggtaataaaatgcatcatgtaagatgtctgaaaactagaatagggctggtaaacaaatttctgaatgaatgagtaaattcaaacaaaggcagatcgtaagggcaaagagcaagaagggaaaatcagccactcaatgtcccttcgcatggagttcagaatggacaagattaggtactttctgtatcaccatttctgagataaattgatagctaagtgatgttttcttccaagtttcatttctttgagtgctagagagatagctaggtaactaaagcccatgccttatagctgtaaattccatccgcagacatcacatacaaattccagtcagtgatgaatactttcaattcctgtgctaagaggatagacaagtagatctctagagcttgctggccaatgagaagccctatctccaaacaggtggctagatggcactcctgaggatgacactggttgttatcttctactccccttctccctccctcgctttcttcctccattcctccctccctccctctcccccctcactcatacaaatacatacatgctcacaaaaaaccacaagtacacacacacacacacacacagacacacagacacacacacacacacacacacaaatacacataaaacacaatctattcatctgagatagtctctgtacgatagagagtaagtaatgccacacactctcaatgggatctttgaagtacttttccggttgttccaagacatgttccagtttgcatcatttatattcaacttgtactgagttaacctttgaaatgaattgtttgaccagaaactctgtaatgaatcattgtttggcttctgaaataaaaatttgcagtta

SEQ ID NO: 297 - DNA, 10248 bp, mus musculus
gagaggctgtgtggggttaggctccccagacaagggactctctgctgcaaaagggagtcctccattttatgaaaagctgggaagagccatccagtcatggtatctgcgagggagtttccccacggtcagggcaagtattttataatagcaagaggatactgaaccaaggccttcaagtactcactttagaatatttgtgtgtgtgtgatgcttacatgtttgtgtgtgtgtgtgtgtgtgtgtgtgtgtgtgtccgcgcgccggcttgttcccacctgtgtgtggaagccagaggagaatgttaggtgtcctgccttaccatcctctgttctatttcttgacagacagtctctcactgaacctttggtttatggatttggccaagctagctggccagcaatctctcagattcacttggcttcaaggtcccaacactgggattacaggcatatataaccatgcctggattttgcatgcatgacggggatcaaactcaggtcttcacattcgtactgtaagtccttttacccactgagccatcttcccagcctcctcactttggaattattaaaaataaaattttatgttaaaaataatgaagaacatgttcgtataaggctcacccaaagtgaacatgaaccaataacaaaataggtagatggacaagggtacagcagattttcacacagtgcaggctcttagtgatctcacaagctgctctttggaagaaaacggtactcataataatcttggatatttggagtgcataaatcagggaactcgggaaaaagccagctccctcgcactatcactgagtatgcacatatgacattatcttcgacatttccagactagaaaccattgattagtaaaatgctaattcactgaaaacaggtctttgcgaagacagccctgcccccttaagaatctgagatcgcttttactgaataaacatcatccatttctgcaatgtgagtaagatgctctttctgcaccttgtgccacatattcagccctgggaacagatgtgcaagaacaaggcttaggtggaattggcacttcataccatcaagataaggcgatgtggctttgagcagagaacataaacagtgtggctcagctcagaaggtcactgtgagtaggctgcttttcttaaatgaatcgggtacccctggaaggaagagcccaccactctggagaatttgctccttttgacttcatgttatgctctttagggagttgaatcagtgcgtttctctgaggctcccacctggctgcttcctccctgtttactttttagaatgtgtatcctttaacaccgtatcctgtctggtaacatgcatgcaccgaatcactgttttccagcctctgggggaaaaaaaaaacatgtgtgggaacatccattctgcccgattgctgctgcttctacttgcttcagcagtgggagaggtaagaagggtgtatgtgcttctgacagactgggctgggctacatgtctgcaggaggcccctggaagttgatgcctgagatgctgtctgctgcttgagacattgctatgttctgagcatagggcatttcctgatgattggcagctcccacgttcaagtaaaatcaaggctgcaaatgaggctgtggttcacggggtctagacaggtgctgacaggatgtggtttccatctgagagcagatttcaactcttctattagccagagccttttgaggccattgagctaacaatgtaaaatatttcactcaataacctgaccggccacactccccaggtgcctccgcacctgcagagtgagtggagcaacccagagacatccagtctttaggctttttgcttcacccatccctccgctttcatatgtacaggtttttagtcctttctctgctccttgtgaaggtaccaagccaaaagtttgtgtgtaaaaggaacataacatgcagatctagatacgtagggtacattctcaagccagagttttcttctctacttgttatgcactataggacaggcacttgggcacacattctttcgaccctagaaaaacctctgactgctcaatgtttaatgagctgctatttggtgggaacttagaagatgctgggagtagtacagatgatggaggcaaggtctgtgaagtttcagagggaagtgtaagagttccttaaatactatcagctatgtctgatgttttgagcattaagaatctgtgtttcggatcaaacagggcttaagaatttgctgtggtcaatgagagaccagatccattaaagtgaaaccctggctatacagagtcaatcaatgctggttagctagagctgaagaattagcagtggtgaaagagaccagcatcattgggggctgcaatagtcttgaaggatttccagagtgtcagcacatagaaacttatgtatggagggtgtgtagggtggttaggctgtatctcatggtggcagccaaagttcgatttcagaattgaaggagagagagggagagaaggggggagaggggagacagggcgtggcatcaagcagcaagttcacagtccccaaagagagtccaggagaagttagtaatgaaggtgtgacccagttgcaggtgttattagctgcttttattttctcaaacagaatagcacattatgccagtaccaagagatcaccaacaagaacagcagcagctgtggagtggagctaacctgagcctgggagacaatgagcgtaagggggtaagccgtttggagtccagaaaattcataagtgaatcctgggtgtctgacattgagttgtttttaatactgttgggctttagttttgctttatgatgtgacagggcaagacaatacagtcgtttctccatcttatattcctactgaagccatttcaggtttaacagaaaatccaatggaaaattacccaattctattctaggaaccggaggtcaagataccatgattaacttagcttctgttaacttgcctgtttgtgcaaaccatcctctcaagagaattgtatattttagcttgttaaactgcctgcctgggtggtacctcctctggctaactgcttatcttagcttctgttgcactgtttgcttctgtaaaaccccttgcagctcccgagccagatgccaggatgtggtttttgcctttaaaatccccatgctctagacattcaggcttataacttaggttctgagtatctgagtgtagtcccaaccagctggaataaagaatttaaattgactgcaaacagtgtctgagtggccaactctggcggactccccaataacaatcatcgtgccttggttatttctgtcagatcctaaagaacctggggacagatggctaactatggtacctattagcatacaaggcttgctcagtacccatgactccccgaagttccgttcacactgacctaaccctctccagcccatgggctttggttccctttcctgagcttctgactgccacttttgccacacaaaaatatctcttggttcccttggctttcccctttgctccttcctccctttttgttccctccccctccttattaatcttcctctcttgctctcccctctcctgacctgatacagtctactcccctctccatgctctggactcttccagatgcctctggtggtattcttaactcatattgataacaaaaaccacctcttcaaccatacccagggacagtcatgtcttcatttcatttcatttccacttggaataacagagtatttacttttattttgattttataagagagcacaataaaagacactttggaattttggagagacgatgggtattgtttttaaagatactttgactattttagagaggcaaactttgaaagagactttggatgctttaaagagattgaacttctaacccgctcaaatgtgtaaagactggagcccttttaaaagttgcaatgcttcttattgtgatattattactactactaagagactttaggggtgatcaaggaaggaaagttcaaagctaattagaaatgcatttgtatgtcaagttgaaatatgaaaatggattaagtgtcctggctagtttttgtctacttgacaggagcttgagtcgttttgtaatagagcacctcaattgagaaaaatgttcccaccacatcagcctgtggtgtcctgtcttgattgatgtgggacgactcagttcactgtggctggtgccactcccgggctggtggtcctgggtgctataagaaagcaggctgagcaagctgtggggaacaagccagtgagcagcatttctccgtggcttctgcatcagctcctgcctccaggttcctatattgaattcctacccagaattctttcactttgctcagagtccacaggcaaatgcctaggtgactctgtccttgtcattttcaagtaggaggtttattgttttcttgagaagaggggctggagcaatgggtggagggacaggagcagataagaaatcaaactggattgtcacagagctctgaaaagcagctccccgaggcttcatttttagttcttggtatggcagagacactacaatgttgtagagtgagggatgcttcgtgcacctaccctttcagcactgggaagaaattgttcttgtattgccctcttaagttccttggggaggactgcactattaggctgaagccatccttccaaagaaacatttaggtaatttatctggaggtttccattcaattatcccattagagatgtgggaatacttgagttatttgctagcacagaaggtgtccactcttgttaaggaaatatttttatggcctacatctacatggtctggagaagcacatgtcatttcggcttccatttgctccttcatccaagagcccttagccagggctctgtgtttgaactttaaggtcacccagagttccaccaaaagggaccacagattttttttcttcttcttaaatgacacaaaatgatctatgataagaagtctgaccttgggattgggaggacagagctggcaatttaatctcacttactaactgccaaacacagctacaattccatacagccatgcaaggggcctcaaaagttattctcaagaactgtgctgtaggaagcccttataactagatagcacttctcaagcatttgtttacaatacccctgaatactgaaatctggcttttcccctcacatggggaagcattcacttcacaggagtcatttagacactcatgtccaattgcacttgctttctgaagcactggacttgaaataacccatttgtttctgcagctcagcttctgggcagtcagcctacagtgaagccagcaggcagagtgatgagggtcacgcatatttccataacagcagtatgatgtaatacacacggaagaatggcttggctttagacccagtgatagccactttgaactgtcaaaaaataataaacatgcgctgtgaattcgctttatggctttatgcattttaaaatctgtggtcatattttgagtcctatcgctgaaaggcaataacacagaggctggaagaacaacttcaaaaggaagaatcacttagattccattcctagatattcaatcacactctcacattgaaactacaacacacagaagtagtcatagattcacttacatatgaacacatatattcacaaatttgcacaagtcattccatactgattttcaaatgaatgttcattttagtttaaatataggactacatatcaagatacatatactaataagcttattttctatatgcacagatattttgctcaatatattttaatttaacatacacataaaaattatagttatgtgaaaatgcccatacaaatacccaatttcttcattcacacacataactcaagatactcacatgcacttgaaggtataacatacttacatatttgcaaattaactcacacaaatgtacacttaatctgataccttcatttcacttaaaattatttattgtcacactcatacacatgagctgtatacagttttgaaagtactttacttatatttattttatgtgtatggatttttgtaactatatgtctgtgaaccacatttatagagtgcctgtagaggtaagacaggaggcattagaactagaattagaggtgactgtgggctaaccatgtgaatgccaggaattgaactcaggtcatctgcaaaggcaacaggttcctttaaccactgactcaactctcagctttgagcttgtttatacatcaacacatataaatacacttagaatatataggcatgcctgagatgaacgaacatacacacaaatttgcagaagtcattccatactgattttcaaatgaatgttcattttagtttaaatcacccatataactatgcttataagtcaattcatagaaacacacgctacataagcaaaacatgaatgctcaacttttatccacacatacttgtgctcacacaaaactgatcaccaacacataaacatactaaatattaatatagaagaacatgaaaatcctcatgcaatctcttaaggatacttgcctgcattttcattcacattattatcagacttacactgatacatttttgtgtactccttcacacagataagctggttaaacatacaaatatatcagtaatttggacacgtacccacccaaatatttactgtttactcacaggcacacattcacatctatatttgccaccataattctttccaaatcaagaatatatccacatgcagaggatactttgtggatgaaagttttcatctacacaagattttgtttataactacaatgcacattcactcagaaacatgatcctgactgtatattaacacagtaggagtcattcacataatcattcatcataaacatattcacatcacttctatgcttattcccttccacttgcacacaaccagacatccttctgctgttatgtttatacaaatagacatttatagtcacatgagaatatacaaagttacgttcacatattcacacacatgcacatattatatgcttacatttagttactaatatatctgcacacgaacaagcttacacatttatccacaaataaacacatactaggatcagtacacatgatttagaaactgactcacagatgctcacatattaacaacacacaaaacatgtaatgcatactcagagacaaaaaatagccaaatatatgtttatatattcactcatatacatgaatatgcatacctatatagtcacacaactacaagcactcgtactggagcagacccacttatttacaacatagacattggtatataaaagatacaaaggacttctgcatactgactctatgtcgttttctttttcacggcaagctagaaagcattagtgcaaaagctggctggcaccaaactcgaattttacacactcagttgttttcaatatattcaaaataagcagattttagccaccgactgcctgatttgcattccccacaaaactgcaccggacagctgttacccatagaggagttaaaggttatcattataaaagcccccaattacaccgctgtgtgcattccttgacccaaagacttctcaccctgttgccaaattccatcaaggagacatataggtccactctctgatctccctatcatcttgggctttttcttttcctggaaggtctctgattatgtgggctatccatctcgtgtaaaccggtcaaagtgtactctaagtaaatctccttgtgtgctattgccaccttggagagcctatcttttgcctccatcagccctaaaatcccttaaagtcagcacaagtggtgctgaggaaaggagagaatttgggtgttaatcaggaaattaatcagccagcagaacaatcaattgaccgatttctcctaggcggtgttttatggttgggaatcaaaatttggtatgctcccaggtcagtgcagcatcgctccatactagcaactttgtatttgttatggcctcctcctgtgcctcattagcctaatgaggcagcaacattggcattttagtgaagcaatgcttctgcaactgattgggagccagagacatggagcttcatgaaaatgtcagcctgccctgtgggcccaaatagagaaaggcggggcggtgaacctctgatctgacagtaggtcattcttgactccctggacatttgtagagaagacatttctttgttcctggggattgctgtagcatgtaaataagataacaagtcactttgtcaggccaaggcttctctcttaatcatagtttggagagagaactgtataaacgattagtgtcaccttattgttctctaactgggatttgctgtggcaagaaggcatcatttgaaatcatctgtcaaagggcatccttccccagatccttgggctaagccagtgactaagtaaaagaaagtttttgtttctgttcctctcaaccttctgaattaagtggtttaccctactgaacaggtactctaaatcaccagacccattctgggctttgctcagtgtggtagttaactaaagtgttgccaggtgggaggtaggaagccaagagtctgaaggtgttatgacagtggcaaggtctcttgatgcccttcagaagcaagggcagtaaagtatcactatggtatggatgagaacaatttgccctcaactttcttgggccccttaaacagaacatgcaaatgtgaacagtcaagaatgtgagaccgtatctctagtggaggagaaaatagattttctttctttcacggagaccaggtctttccttaaggacctagctctaacccctgatgagcttcctggcttatgagctatatagaaggtacctgctgggatgtaagcttcacctaacagagactaaaaatggagtagtgcactgtatcatatgatatggaaagtgatatcattcctaaacgattccacacaatagggaaagtaggagtaacaggatttggacaccgacacacacacacacgagtgcgtgtgtgtgaatttttatggctaagcaggtttcacatactatgttaggcctcctaacagctctcagatagacaacagagactgctaccttgccatcagctgggatattgggatgggctcattggtcaatagatgctatacagcatggtgagttggcaagtatggagaatgctgaattgagctgagtccactcagttgtttctcgggggcttcctaacatctataatcccttcttactggcagtgatgcctaatgctaaaacaagtcaagaaatcacagtgccctggatttagcagacttatggaagaccaatcaaatcaaaggcttctggttaaatctataaacatggcctgcaacagcaaacaccgttactcacctctaatcttcattggccctatatactgggtcttccacttttcagtgggtaccaaagcaataagaggcactaactagctcacttgttctcaaacctcctaatgaaaagactcttttaatacagatgtggtgacccccctccatgaaattattttcatagctgtaaaattttgctactgttatgcattgaaatttaattatctgatctacatctcccaaaggggttgtgacccacatgttgagaactgctgcagataaaccactctagctctcactttgcctatcccaataataccccagcaacaatcagtgccacgactccaagactgcctgcctggatcctctggaccaaataggcaagtaaacagttttacccacacacttgggtgtaaacaaccctcagactcagccagatgacacttttttttctagggtaaccaacctccaacctcgggagatatgctgggcacttactacaactgaagtccttacctgggaagatccagtggccctgtggactgatacttctattacagcccaagccatggaagagttccccattcatttacattaacagcagaggcttcttcattaaaatggaaatgatatctactagatcgaagagaactcagccctaattgactgtcacaattacatgaggaaacatgcatggactctgctattatgctgaacgtattaagccctcctcccaaacggtctgccttttgtgacatgcagaaagtaaaaggaacgatctctttttacctagagtctgtacacggggtataaggaagcaaatctctcaggactattaaaataaaaaccacaactc

SEQ ID NO: 298 - DNA, 10248 bp, mus musculus; identical to SEQ ID NO: 297

SEQ ID NO: 299 - DNA, 790 bp, mus musculus
gacttgtttctcatgatccccggtgccacaagaccaccatctttaaggatgccaggaagtggagcactgtgttcgaactgaagcgcatcttcgagcgcatcctcaagcggccgccagaggagcagcggctttacaagggtgaccagctccctgatgatggcaaaactctgggcgaatatggcttcactagccagacagcatggccataggccccagccacggtgggcctggccttctgagtgaaaggaaataaaacttgagacctgtcattcatgtaatgtatgtcaaatagcccaaagagttgtttatgagctttgaaacctggggctgagaacatagcagaacagaccaggacatgcccgggcaggcccatcgcctccctatctcccacccctctgacctaagttaaatgttaacaggctgctgatgtttaaatggaccaatcatgtgaaaccgcgccaattcctcccccagccccactccttttctataaaaacccctagcttccaagcctcgtggtcgaatccactgtctcctgtgtgagatacgtttcgacccggagctccgccattaaaatacctcttgttgttacatcaaggtgttatgttctattcgtgattcttgggtgcacgctgaatcgggagttgagtgggggtttccccactaggttctttcacgagcagatgacaccttcgaagctcttcgcatcgagcccttctccagccctccagagcttctagaggtgataaagccacaggattctggaggcagtgccaatgaacaagctgtg

SEQ ID NO: 300 - DNA, 68425 bp, mus musculus
tgggagggagttggcactctctctgcctacgtgggagagaaggcacggttgggggaagtgtggaaaacctccggaggcgccgccgccaacggaagacttggtgggaggagaagtagaggggtaaagacaggctgggagggtggaggtgaggaggacaaataggtcgcctccgttcccgaggcggcacaaagttcttcaagatgtggctgaagcccgaggaagtgctgttgaaaaatgcgctgaagctgtggctgatggaaagatccaacgagtactttgtcctgcaaaggcgtcgaggctacggggaagaaggaggagggggacttacaggtaagaggttgtggccagctacacctgcgttagggctgggtccgctgtcactgaataggtggcaaggcaaacagttactcgtcgctgcccgctgcctcatcttaaacccagggcgactgactggggaattctgctcccgccaccacctttcctctgctaccaccgcgtcctgactgtcttgcacaggactcccagttgctctttgggtcttaccgcgataggagaagctaagggggtttccagtacctgatgggtcgcttcccatggcgaagggggctgatgggcagtgcagtgcgctagctagactagtcccgttaagacaggcgaggagagcgggttcgcgggtgtggacttaactttttttccaaaacctatacaaataatcaccaccctagggagtgagtgcgagtgtgtgaggggcattgctaggacatgggaatcctaaggagaacgaagtgccccaatcacaccttgagagagaggctgcaagtgagatttgggtcggggcatggggctgcttgatgctggggaagtgaaggagtagccctcagaattactcacctcctctcagtttcgcgtcttttgctatatccaagttttcaacccttggaatccctgtattcttctaagagtacatttctctccagtgagtttggctctgccccttctttcaaagatgtgtaaaccaaaccaattaaacaagaaggagactcaactcttctaagccagtctcccacagttgttaatcttaattcaaaactggtccatgtctgaagattacaaagaaggctgtttttagatccttagtcttccataggggctttttacaaatttggaccttggagagacaagagctgtttttcatggtaattcttagtttggtattagggctttgaagtggtggagcagcttaatttggggagggtgatgtagagggaagaagcaaaaatctgaccacctgaattttgatcatatccttacctcttgcctgttggatggcattgatcaaattctttcatatatgcaatcttttttttttatggtgggtttaaactgcttttctcttctgagattctttttttattgatcattttatttgtttacatttcaaatgttatcccccttcctggtttcccctccacacccccttatcccatatctccctgcccccctcctctttgcctctatgagggtgctccttcaaccaatcacccactcctgccttaccactcttgattccacctatgatggggtataaagtctcatatatgcaatcttaaggtaccactttgtgctagaattataattttggtcactgcctttaaagtgctgggttgagagaggagggtggaagtagactaggaagattaactagtttactagaaaaaaatagaatcagaaccaaaggactactgaagggttgaaggaagaagtttcgtggcttatgtgacattgatcttctttggctaaaaagaatggtgcttactctatggagatatgcgtgtaaactgtaagataatgttcataaaggtatgtttatgttaaggcgagcctcctctaatgtggatagaattcatatgtcctatgagatatatgactttacaactaacaatcatctgacttatccaacttctaaaaagggccttcaggcagtatgggaacaaaaattgcccctataataaaagtagcattttacattttttcctgaactttaaaaattacaagttgttttagagaaaagttttcattgaaatgacagtttcattcaaatagaaatttctttttaaaattaattactttctttatttacatcccaaatgttgtcctcctcctggtcccccctcccaaagttcttcaacccattcccccttcacatctgtgagggtcccatccccctttctctgtggtatcaaacaggtcaattaaaatggattttctctttaccccactcacctcttttattagttccccattgctagaacacaaggaacttcgtctgaagaaataaatgaaaatttctatcacttgcagatatgtgctgtgatgagtaacttatagtcaatttgtatctgcatgactgttttccttgtgacaataacatgcctgaaataaccaccaaagtcatataaatttaacaaaataactcaaaaaggagcaaagagatattttaaatgtttttgttgttgttgttgttccgtttggttcagagcaaaagtgtatgctgattttcatggctgcctaactactgccttcttagttaaacttgtggagctaagagctgtgctgtcctcatttccattagctttcatcagagcatcagtataggccagcataaacctgcctttgcccattttatgtatttgatatgttgtcgtgttacgtactatccctttataagattagtttatgtttggtataatggagaaatgacagtgacctttgagaaatgttaataattgtactttaaaatttgttttctttgatatgcgatgattgggagtaatccccacccccataatattatatcttgagtatagatttgatgaaatttagttgattccatttgagtgggggagtctaattatatagctcaggccagcttcaaactgacagtttttcttcctcatcctcccaaatgctggtatgataggtattcactaccacactaagcttggtgaactaatttttctttcataatgatgattctctcaaaagaatcttcacattagagtcccaaggtcccttttctagaattataagatatttttagtgggcatctggttagattactgatcatttatcaaactttgtctttcttagttatcctaggttacagcagaatggaacttttgtaaaaaattttttgttatacccaaagttgttattgttgctttggtttcttgtttatttagagactattttaccctgggtttttctagttgcctcacattctcccttggttgagaaaggtaaagactgcacgattgcagctaaatttagccccttgtttgatgtaattaaaataatttatgcatacttggcttattaagcacaaatcagcaattttctctgcttggcagatgagagccactacgtagactacctcctgttaagtactctcctgaatgtggcttagggagacctgccaatcaggaagtcttgggtgtttgttgaaagaattttactcttgaagttttcatacctgaataatggtaagaaggatcttagacactggatttatagttaccatcagcagacctttttatttttaatttcatgtagaacaccggttgaaaacaaacattaaaacaaaagagtataaatagttctgtttccttatctcctcttttactttggtactatccctttgaaattaaggcatctgtgtaattagagcatggttacatttgaaaaaagcactttattttaaaatatttgatgtaatctttcattttatatttgtgtatactttatgaatcactctaaatgattttctctaaacacacatgtaataaagggaatttttaacccttttttgtccatgtcatagaaacccaaagcttttcttttgcttaagcccccaactcaaaagtctaactctggaaatgttcatattacatatgtgttagcaaaatgttattggattccgtgctcacaaagaaatctcaaagggtaaacataccattttatgataggtctggaaagtcctactccccatacacatgcaactcatactcagaataaagtatcatattggcttatcaaaaagaaagtcccagcaggttggtggtgatgcacacctttaatcccaacactaaggaggcagaggcaggtggatctctgagtttgaggccagcctgatctgtagagtgagttccaggacagccagggttaaacagaaagaacttgtctcaaaagaaagaaagaaagaaagaaagaaagaaagaaagaaaagaaaagaagagaaaagagaagaaaagaaaagaaaagaaaagaaaagaagagaaaagaaaagaaaaaggaaaaccccacatggtgaacagtagggaggacaaatcatattttatgctccttccccaatcctttaagcatctaatccctgtaaaatcaagtaaaaagtatccttaaagatctcttgagagttggggaaatggttcaatggataatagcagtgactatttttctgttggagcacattcaattctcagtacccacatggcagctcatagctgtctatgatttcagtcacaggacaccttctggcttctgtaggcaccagacatgcacatggtgcacagacatacatgcaggcaaaacactcatacacatagaaataaataaaatttaaaaatccttggaataagaaaaaagcagccttgtaggtttcaagaattaaaatgatcagtgttatcaattttcttgcttttaaaattaagctaaagggtacatatgtttctatttaacactataaatctgtatgtctcccccaaaccctttacatataatctgtataattatgactttaatttaactcttaaggactgcaggttcatggccctaaggtgcataggagcaaatatattctactctttgctgcaaaggaagagaccctaggagcagataggggaaggaaaatggtgagagacataatcagtaagtgcctaaaacagcaaaaggcttataggtaggcagtcaataatcctcccttctatcaagaaaacaaaacgactaaaccgaccgtcttcattgctcaaaacttcaacctgtcctttcatatttaaagatatgttatatacctttggaatatatatacatatagatatcacacgcatacaaatacacacacacacacacacacacacacacacacacacaccccttcagaagaattaagatgttccaggcaagcaggcaggccccaactctggatgctatcgtgtggaacgtttgcttcaataatcttgaagccagcattcatagtgtacagatgcaccatccagtgatacacttccttcattaaccctgcttcttttagctttttacctttttggttgttgttgttgttgttctttaatatgtatttggtccctttagagttgaaaaaatttttttaataaataaaagcttagcttactcatctgtgaggtgaagataacattgtcttctctatctcaggtcactgtagtgtaagtcaaatgggttttgaaatcaattctcagtacccacatggcagtacccaaatgtgacacctttcctattaaatgctattttaaggccctaaagaccaaagaaatcagtcttagtcctctccctctcttcctcgctccccagtttccccatattccctaaccatttcccctaatagttattttccatgttgtatatagaaattgatttgaaggaataatattgaatatgtccaacataatgataacactgcaagagcacaatcctgataatcactagggaatatgataatgctgactatacatctgttacttataatcaggataatttaagagaattagaataatttatcatgaccaagtttcctttgatctaggatggctctaatcccagcagtttccaaatagcacttctacagatctaagtaccactcgtactggagaatgttattgaaaaacaatatacaattttggttctcctactagtatttttaaagcataattcttgaagaaggaataccaattcagcttatgaaatctctctctgcgtgtggacagttcaggaaggaatatgggtataaagtaagctgaaaataataaacagcatagttgccgtattgctgtgatggtggttacatgggctttgtgttgcctttttgttatgaattttgtcctgtttgccttttttttgccactgctatgtaagtacaaaggataatacaaaatcttaaatgtgattgcacacatatttgctgaacaagtatttactaaatgccttctaacaatcaaggattggtttgcttgtttttaattgtatgtgtatgcatattttgactgcacgtatgcatgtatgagtatgtggtgcctatggaggccagaagaaggcattgggtgccatggaactagagttacagatagttgtgagcctttgtgtgggtgctgcaaatcacgtccaagtcttcaggaagagcagccagttctcttaaccactgagccatctcttcagcccccaagaactgtttttaattgctgaagatagagcagtaactaaaacaattttttccatggggtctcattctagctgagagggataaacagtcaaaccctgtgtgatacgagtggaggtgataaccaatatgaagaataaagtaagatgttctgatacacaaggaaggggttcaaaaattgatctatgagcagagactggagggatttagaacatgtgagccaattgtatctggtaacagaataaattgtaataattcttggaatgattttactgtaatcagatacagtgaaatgtattgttactgattttggttaatagaataggcatggttcctacaaagtttgcagtcttctagagcatttgacaaacaagtaaacaagtattttattactgggatagtagctcagtttgttgacttatttaatctatgaataaatagatatttaaaacctccagtccagttttctatacctagctctgatatattttatgattagcagaggtgctataaaaatgaaaacaagtcgggcgtggtggcacacgcctttaatcccagcactcaggaggcagagacaggtggatttctgagtttgaggccagcctagtctacaaagtgagtttcaggacagccagggctatacagagaaaccctgtctggaaaaaccaaaaaaaaaaaaaataataaaaaataaaaaaaaatttaaaaaaataaaaataaataaaaaaaggaaacaaaatttttctaaaatcagaaataaataacaatagctgggatacttgtggcagaattccagtgtggcatctgtggagctttttgccaaaatccaatttagatcatttttaattaaatcatttgtctataagcactatcagtatctgagaggctgtttgctagggagaagtcaaaaggtattctaactgaggaatgatattataaagcaaaacatagcagttgttggggacagagtagatattccagatgcatttatttggaattagaaacgtgggactcaagatacgatgctgttaataactatataaaggttgttgggaaagaacatcttcatctataccagaggaaaatttgaaacagtgagttaaaaagatctaaaaattgacatttaattggtctttgatgatatttcaatggaaagtataggggcttgtttttctcttccttatatagagtaaaggagtaaggttttaaagcaatggataatcataattgttgggttttattatctttgttttcttcttattttaaatgaaccaaaatgtttttttttaaatgttcaaggatgaaaaaatagaacctaaagaattattttttattaactgttttccaaagctcctcatgtaaaattggcagctttcaaaatgccatgtggccattgggttattctaaaataatcactcacagttctgtttgaagggtttagatctggtagcaaaataatagaatcgggaaaatttataacctccgttgaaaatacttttctcttacttgaatatgtttcttactaagtgcattggcagtttactaattagttttctcattaacttttaatgagactgacattataaaaaattcagtaaaggtgtactggctagactttgtaagcatgacagcttatgattaaagaatcagctgtaaggttacaacagtcattactatggaccaaatatataatcaaacattttatagagactagaaatgaatcctattggtaattagaaagtttgtttacactattcttctgcagctagaacagtgttgtattacacagtgccctcaatctactttataaacagaactgcttccccaaaaaagtacacattattttgtgtactaaactagcatattggtaatgaacactccatagtttgctttactgttgctgtaataggacgctctgatcaaaaccaacttgggggtaggaaaaggtttatttcatcttatatgttacaacccattatctggggaggccaaaacaggaacccaaggcaggagcttgaagcaggaactaggaagaaacactgcttactggcttgcttccagactctttcttagacaaccatggaccatctgcctagggatagtatcactcacagtggactgggtacttgtacatcaaatagcaatcaaaaaatgcccccacagatgttcctacaggctgatttgatggaggcagttcctcaattgatgttcctccatcctagatatgttaagttgatggccaacattagccatcaaaagcaccatcttcaacttgtagctattccaatggcctttcctttaacattcaactcttcataattccttgcttatcaaaatcattgctccagtacagggaaaaaaaaaggcattcattattaagaaattggaaggggcaatcattgatctgtgtactttttattagattttatttgtttaccctgatgctgtgtatgtctgtatggggaacaaggggacaagtagaagtcagttctcttcttcaccatatgggtcttagggatcaaactcaggcagatttggcagcacgtacactaacctactggctgtgttcttaacactggctgcctgttacatttgactgaggaacttttaaaagctactaaatgatattgctgtatttatggagaaattgatgtcttggatttaatttaaaatatttctggaaagaagacaaaataaaaatgttgattattatggatatacatagacaaactgctatattgtaagtaaagaaaaatagaacaacaatatcttaggatggatcaattaagtcataatccttgggcttcagtagtttcaaaacttaagttttaaaactcttctgactgactcaaatttgttgtttgagttgagaatcgttatcatggaatataaaagggaaaaaatcaagaatcagaaagatctgggtggtttggagtgctcaggtaaaagcagtgatatacaaccaatcaaaactgcagagtgtggaacccagttagagatcattacagaaaagggggtgaaaagagtgtaagagccaaaggaacagggagtttgtgtcttctagaaatgtcagaagctacacctatgaggtctcaccaacaacattatctactcatcagctgaacaaggtcgacagtaaacatgccaaagtagatggatctttgtggtcattacaaagtcttaactctacacaaagaacgatgggtaattaaagatgactgagagtgggagcaacagtctttcctagggaaaagcataccaattggttatagaatacaaaatggtagccctgaaaacataatacaactgacattatacagaattatttagtaacacacacaaaggtaacaacagttaaagacaaagaggccatgaatttgaaagagagcaaggggatatatgtgggaggtgttagaaggaaaaaagggaaggggatgatgtaattacattataatctcaaaattaacaagttatcaagaagaaaataaagatttcatttttgaacaaaagctgatgacataaaattaaaatgggtaaatataaacatatattttgttgttttgttttgttttaatttagatagtttcactatgtagctctggctatcctggaactcactatgtaacccttggtctcccagaggtccacatgctgccgctgccttctgaatgtcagggttaaaggcgtgcaccactacacctggctcacatatatatttttaaaaacagtctctactataacaagtaatactaaggtcagtgcttacatttataaaaaagggtcaatgtatttttatcacaagcataatttcatagtaatctggtatccaaacatctagccatcttaggctacattaagaaccatggggtttaactgcagatgttgctcagtgttagagttcttggctaccataaacaaggccctggatactgaaaaaaataatttaaaaagaattatggagtccataatataatggttcagaccttatttggtattgaagtagtttatttttgacctattttggagctgggtctcaagtaacccaacttagtcttcaacttgctgtgtagcagagggcgactttgaacccatgactttcctggctccatctccaaagtgttgtgattatagaaaggaactactatatctgttttagtagtctagtttgagtgacacttttaaccattatttccaggataggctatgtagtaggtagaactaactgcaaaatgaaaacaaaatgacccatgaaatcataaggattttagggtattgacaacaacattaaccaagcagagtcgttctgcacagagttctgtttacagatcataaacccaaataacgggccctgactatgacctttgggaatacaatatcttctttagtttaaaaataggaagccttaaagaagtaagggcaagggatactgtgaggaggtaaatgtgctagagactagattatatgactaatcaggatgtttttcatctccaaagtctgcaattctttatctagccaaaaggattagcttgtggtagtaattattattcataaaaagctgcctttaaaaatatcacgtaacttggcattttttgtaatcttactctattaaataaaaacatttcacattaattaatgtacttattatttccttaagaaggtgggtgtagcttatttttccaggatgctgccaaactccatggacattctagaacattgagtgatatcatagttatagccattcaaaggctaattcgagtatcagtattttcaaatttcttattctaccatgcagctgatagtgtctggtgtcttttgaatttatgatagttacaatggtttcccatgagcaggctcatttatgagcctcaatgttcaggcagtcagatgatgaacctctgtaatatggaaaggcaacccattgctgctggcttattttcttgtacttttagaactcacacattggcacacattaatccctgcctgacttggagggacttgatgatcccaccttaatgagctggaagagttctcccaagtgactagaaatgtattcaagtgctagcgtcccagttgcttgttgcacagttttatattaactaactacttcatgcacttataaaatcttagcaattcccttttgtattatgtaagacataatgttgtcaatacttctgttgccctaccccccaaaaagtaataaacctttctggtcagtgattttggctaccttgtccctagtgtcacaacatatcagaggactgatgtgtcatttagaaatcattttgtgttctcttcctgtgctctctgcacctcggacaacattgcccgtgttctttctgtcagactttacctacttatcttttcaccagttcttctaataattatctttcagaatgtgtgcaaaaaaagagaaataacagttgagctagttttattaaaaatctcataaataaataagtagctttccttgcaattatacatttttcttttccccaaaccttgtttaaaatgaaactcttggaagatgagtgtcaagtaaactagcagccagactgccctgttgaaaagaaatactttttttttctcctttgagataggacatatagctcaggccaacctccaacttggtatggaaccaaagctggctttgaatgcctgatcttcctaagtggtgagattccaatataatttcagaagttttaatttcttgggttttttgtttgtttgttttgttcctttgggtttttttgttttttgtttttgtttttgtttttttgtttttgtttttgtttttcgagacagggtctctctgtgtagccctggctgccctggaactcactctgtagaccaggctggcctcaaactcagaaatccacctgcctctgcctcccaagtgctgggatcaaaggcgtgctccaccatcacctggctaatttcttaaactagacaacttcgtcaatttgttgtatgtatttacacacgcaaacaaacacacacacacaaattgattttcagtccatctcttttggttgtcttttgctagttactcttttgtcttttgaatatgttcactgtcctaccttcaaattgagaacattcttcctttcttcatttcttgggtaatttcactcacattcctctgagaagactatctgcatatgttcagctctgctttctttcatccttgactacatgtccacgtttttgcagcaactactttgatgcttaattatctttctttgtatactgaactcctctgtttctttcctcactagttgaagcataatcatttcccctgcctcattccaatggtctcttatccagtacctcctcttaaataatatccatctagattttttgatccttggttcatcaataaaatcttcaattcataccttccttttgtttttcttttgcagcactgaagaccaaaattcagggtctcatgcatgctagccattcatgccatcaactatatctccagcccacaccttaacttttgactgtattcgatttatttctttataacctacatgctgccattgcagtactctttttttttttttttttaaaaaaaagatcttgcttcgttttcttatgtaaaggatggacttcttgccatatggctaggaaagtgtgccactacacaattttaaataggctcaatttaagcccactacagggtgctattctaatttgttgcgtgtcagtaggtgacaatttgtcctgttttattattttttaacttggtttatttgaagatttttttcctttatttttgagactataattacaccatttcccccttcctgttcctctttccataccttcccatgtagccctccttgctttctttccaatgcatgggctcttttttcaataactgtttttatatattcctagatataacttgctttgtttgtatgttatttgtatgtatattttcagggcctgcaatttggcatcagagtgtactggtgtcatgtatgcttccttttaaaatgtatgtacaatatatttgatcatattttttcctcttccaacaccttccagatcttcttcacctctccaccccccccctctctcacataccccaaatgtcaaaacaaaagtttttagatttactttatttgatgtccatgaacctttttctttcatgtctgtatgtgcaccgtgtgcacacttatggatagttgtgaaccatgtgggtgctgagtcctctgcaagaacaagtgctttttgttttgttttgttttgtttcaagtcaattctatttatttattttattagacattttctttatttacatttcaaatgttattccctttcctaatttcccctccggaaatcccctatcccctcctctccctgatgaactctcaattctgaacatctatgctccaaatgcaagggcatctacagtcattaaagaaactttgctaaaattcaaaggaacaagtgcttttaactacccagccatctctccagtccctagaaattattgagagatttttgcactttccaaatccttggtcatgttactaactgacattataccacattcctaaccctttttatcttacatttagtccatattctcactcctattttttctgctgagtcaattttcctatcttttattctctattttgcttccatttatgattttgatgatttcctatcccatatatgccagcatacttatattttcattcaaagctaatttgaaatctgaacacatttatagttggtaaaaatatgaaaagaaccaaaagcctggtttgtagttgtctttaattttttgaaattatgtatgctaagttaaaaagaaatgttcatagagcagaaatatcactcagccaaccaatgcttttgaaaatagaaaagtagttgtatatagttgagccattccatgacatagttaaggccatacactatgcctcattgtatttagagataagatacaaacccaaaggtaggtaacatagttattctcagggactgtatatatatgaaatgcttagaaagtaattgtaataaccaacctaagaagtaaatacccagttatgaagtataaaattgaagtattataagtacccagagaagagggaaaatattgcttggcattgctactaaagcttttatagggaagtaggtcttaaagaaaatacacagtttggattagctggactgggctagaacacttttgttagcatttctcagtaaaaagataattgttcagcaaagaccctaagggaaaaattaactggctatttaagagaacagaaaattttgttccaggaagtagtaggaaatataatcagataattacaatggaactaattgagcaagatccttgaattcaaaattgaggaattaggaattgttgaaaagaaaatcattttgccaaaacattctcaataatgacgatttcccccttatttacatatttaaaatgttcttatataattcaaaataactaatattgaatgttctactgtttactgaacattgctctaagtccatggctctcaacctgtgggttgtgactccttacacaggggttgcatatcggatatcctgcttatcagatctttgtattataattcataacagtagtaactatagttatgaagtagcgatgaaataatttcagggctagaggtcatcgcaacatgaagagttcccagcattaggaaggttgagaactactgctctaataactcatttaatctttgtggtaccctttgcagttcattctggtttgtctcccttattttacaaacgaggatatagaaatggaaactactttaacatgttcaaattggcatacgtgacaaagccagaattcagctcatctagtattctcgggtactagttctaccttcttgtctaataaaaaaatacacagccttattatacaactttccaagtacttcaagtaagagacttggacaattgaacctcatgtatttttattaaattatcattttcccaaacaccacttatatttataaatgttggtttttccattccaaatatatattcttttttgtctgtgttatgtttgggtaggtgtgagcatgtgtatgtgtgcacatgcgcttggagtgtagaggacaaccgtggatgttgttccttaggtgtcatctacctttgttctctttgaatcctggtcttctattggtcgggaactcaccaagcagactaactagtgagctccagggacccaagttgtctctgcctctccagtgctggaattgcaaagcaggtgtcatcattactgacattttaatttaggttttgggaactgaactcaggtccctgattgagccatttccctatcctccatacatatattttaagaaaaaaaaatctcaataacaactctggagtacatttaaaaaaaataagtccattaattcgacatataaattgatagttattttatctcttgcaaagtctatactgtaatctctttttctattacaacagggctcttggttgggactcttgattctgtcttagactccactgctaaagtagctccatttcgcatcctacaccagacaccagattctcaagtgtacttgtcaattgcatgtggtaagtatggttgtttagaaagccctacaattcaagtagaatcaagatgctaagataatcatattaaaactaattgagcgtcccattccaaattgaagaattaatcattactgaaatgaaaatacttttactaatatattttaactaatgaagattttaatcatatttaaatgtataaggtatcttacttatataaaacccaaatccaaatcacttaatattgaatgtcactatatactaagcacggttgcatgtgctttggagatagtaaaactgaatattaacttgtactttgcagttggtttgagatttggaaggcagctaaatgcaactattctttgagaggacctctctttaagagtgattacggtttattgctgatgaaaactccattgatgggagataactgaagtatgtggtcgagcagagcagattctgagcatctttggttggtgctcctgttacctgactccttttatcaactctttcatttcttaccaaacctctgggaagattggatattcccccattaagtattggcattcttttcttcttcttcttctaataactgaggtgaagagaacttggagtttatgctgagcctaaacttaaaggtagttccttgaagaagtggaagcctgaatatttgaaatgtatttgtgttcacatatatgctatttcacagaaggcactgtaaccttaaaatgctaaggaatggtttataagtagtgctacataatcattcatgctcaaattatccagatcttcctaataatacagatcagattttttttttaaactcacagtgacagtttggtatcttttctataattccattgtaatagtaaacagaactaaaacctaatcatttctggtcttttaaattttttatcttttttaaattgaataccttctttatttatatttcaaatgtcatcccctttcctattttcccctccaaaacctccatcccatcctccctccccctgctcacaaacccacccacttctgcttcttggccctggaattcccctttactggggactagaaccttcacaggaccaagggcctctcctcccactgatgtacagcaaggccatcctctgctatatatgtggctggagctatggatcccccccccccatgtgtactctttggttggtggttaagttccagggagctctgggggtgctggttagttcatattgttgttcctcctatggggctgcaaaccccttcagcttcttaggtcctttctctagctccttcattggggaccccatgctgagtccaatggatggctgtgagtgtctacttctgtatttgtcaggcactggcagagccttttaggagacagctctatcaggctcctgtcagcaaacacttgttggcatccgcaatagtgtctgggtttggtggctgtccatatgtatgtatatatgtattttactttgcacacattgctgttttgcttgcatggatgtctgaggaagtcagattctctggaacaggagttacaggctattgtgagccgccacatggctactgaaaattaaacttgggtcctctggaagaacaacaattgcttgtaactgctgagccatctttccagcccctatttctgaccctttaagtattggattactgattcctttttttccaaagagtgtgtgtttttgaaaaaaatgcacatgaatttgtgaaagtagagtgcacaattacattattaggatgggtggctttaaaagaaattcgctaaatttccgtagtcttgctgctgagtcttatctcttggtcttttaaattagattccatcagaactaaatgcagataatagtaagagaattttgtaatctcagttctgaagctggttgaccaaaattgttttaaagaaatgtcctctctactctaaaagagttaaaggtgactattcttgcaaatgaagctgattacataaatttagctcgtattcataacatgaataaaagtctaactggattatacaaaataagcaagttttcagggtcaataaaattttactgtgttcctctctatatatcatgggaacattctatgcagtcaagattattcattttaatgagatctgtataatccatatctctaggaagattctttttattggatattttatttatttacatttcaaatgttatccccttccctggtttcccctccgaaaaccccatatcccatgctccctccccctgcttctatgagggtgctcctccaacctacccacccacttctgcctccccgcccttgcattcctctacactggggcattgagccttctcaggaccaagggcctctctgcccattgctgaccaataaggccatcctctgctacatatgtggctggagctatgggtccctccatgggtactttttgactggtggcttagtccctgggagctctgggagttctgattggttgatattgttgttcttcctatgggttgcaaactcctttagctccttcagtcctttctctagttcttccattggggaccccgtgctcagtccaatggttagctacaagcatccttttctgtatttgtcaggcactggcagagcctctcaggagacagctatatcaggctcctgacatcaagcacttcttggcatccaccatagtgtctgggtttggtgactgtatatgggatggatccccaggcggggcagtctctggatggcctttccttcggtctctgctccacattttgtctctgtattccctctcttgagtattttgttccccttctaagaaggaataggccgaggagtgggtcttgataatgaaactttctacaagtgaaatcaaacctagaaataataatatttaacatgatctccaataagacagctaacactgatgcagtaggtcttatggtttactattgccgcgaggttcctgacttctattgtaaattttctataagtttgttaggtttttaaatgagtggtctgattgttaccaaaggtttcttctgttttgtgaccatagtaaagagtcctcatttgcacagcaatatgaaggactgtcatatgcttactatttttagccacgaagaatttagacagaatactagtagttgtatttgaggaccaaggggtaaagtgtgcgtgcacgtgtgtgtgtgggggggcgcctattctgtgtgtttacatggttttttaaggtaatgattactttgtaggcactaattactgttcagaattattttaatattttcttatgagctacaatcactttctcccattttattaaatattgcatttttcatttataataactatagctctactgttcatgcttatatacctagatggaatagagaataaatgtactatctttgtttttatctagccatcatttgtggaagtggcaaatttcttcttaaactaaatttaagtatcatgaattttattaaggagatttcttgaatttttcttttctatattacaaatcaggagccaacagagaagaaataacaaaacattgggactggttggaacaaaatataatgaagactttatctgtgtttgattcaaatgaagatattaccaattttgtacaaggcaaaataagagtaagtggaatggatgagtatataagaaaaatgtagatattctcagaggagtttattctcccagaaagtaattatagcatttgcagaagatatatagcattgaaaataactttgttaagcaaagtaagctagattcaaagtcaagtattccatgtttctttcatattcagaatttaaattacacacacacagacatgcacacacatgcatactcaaagtgagggacaaaactacatggaggaaggaagggaactaatggaaacagaaagagaaatgggaataaaacaaaagacatatattgcatttttctctcatacacagatttcaatgtatattaatattcagattataggagcagaaactgttgcatatttcttgtgcacaaatataaatacttattaaaacttacattgtatatatatatatatatatatatatatatatatatatatacacacacacacaatgtcattcatatatacatgtatacaatataagttttagtatatatatgaatgacattgaaattgaaagtaagaaggggtttggaggagtagagtggtgggggacaagagagggctacaggcatgaattatgagcaaagtacagtgatatacatgtatggaaatgtcataataaaacccagtattttatatctttttttttcaaatagtaagaatttatggaaatcaactcaccttcagtttcctcattgcttagacagttggtatgagttctaagggccccaaagaaaatgcacatgactccaaaaaaaaaaaaaaaaaccaaggtgtatgggcatattctgtgagtggaatgctaaaatcttcagccctcttcgataaagattggaagtgacatgtaaggtcatgcttactggcacttttcgggactttcaggcacacatgtgtgaatgccaggataagtgcttcagaaaattgcacaatggtttgctctcagtgctcttgcgaatctccctgttggtcttctcctttcactatctcttaaattagattgtgagcaaagcttttgttcattcagatgatgtttgatgcctacatttgtgatattttcttacaaagagaaaaatactagccatgtgcacatctctatcctaagagaagtatgcgtgtgcatagtaggtccatttgatcaactagacctaaaactaaataagaaaaagatttttgttgataggtgatggaaagttttcagaaaaattttttctcttctagggactaatcgctgaagaggggaaacagtcttttgctaaagaagatgatcctgagaaatttcgagaagcccttttgaaatttgaaaaatcttttggtttaccagagcaggaaaaattagtaacttattattcctgcagttactggagaggacgggtcccttgtcagggctggctctatctaagtaccaactttctgagcttctattccttcttgctaggatcagaaagtaagtgtttattgtttatcgtggcttttgattttctgactgtcttcttgactcagtggtgttaggttgttgataaagtaatgggattgatattaaaagtaattaaattatacacatatcaaaaaggtttcaaccacaggaagaacccctttaaggctctttatgtagcacagggaacaattacaatggtatagagaaatcttcgacattatgaattgcaggtgaattttaaaagataagcatgtagctgggcgtggtggcgcacgcctttgatcccagcactggggaggcagaggcaggcagatttctgagttggaggtcagtctggtctacaaagagagttccaggacagccaggactatacagagaaactctgtctcaaaaaaaaaaaaaaaaaaagataagcatgtattatcttatagaggttagctacctactggctttaatgtgtattttaattcttgtcttaaacatacaacataaactagtacccatcatacctcatgagctacatcttaatttgcagccacaaagaatcaaatgaaactacttgtaacataagtatagcttttttatcaatggttgtacaattagataattatataaagatagttatatataaagaaaaatattgaaacatatcgaaattgctttctaattctttaaaatgatatctgtttcaaatattggctatatagctcagaagcagagcacatgtgtgttatgcataaggccttgggttcaatcccaataatattcaaaacaaaacaaaacaacaaacaagaacatatgtctatttttagaatcactgactattatatatttatgacactgcttcaaaaaatactgtggcattttgccagtggtcatgataaagtaactgaattacaaacataaatcaatatgagaatttaatcacacttacttatttgcagttaaactcattatctcctgggatgcaatctcaaaacttgaaaagacttcaactgttatattaactgagagcattcacgtatgttctcaaggagagaatcactatttttcaatgtttttgcacattaatgagacataccttcttatggaacaactggcaaactatgccataaagagactttttgataaagaaacatttgataatgacccagtccttgatgatcctctacagattaccaaaaggtattcaatcattaatatttacttctcttttcatttattattttaggggttgtgggggagtcattcatgccaagacatgggtacagaggtcagaggatagcttgcagaagtcagttttttccttccatcctgggtggcgtctggcgactcagacttggaagcaagcaccttccccctctgagccatgccactggccccagtgtttacattttaaagtattttgggttgtaagaatcataacactgattagcattaaaagttaactgttgtttattatatgataattttgctctgggattgatccttgatgtttacatttgtaagcttatttgaatatacttcagaagttttcctccatgaaattttattctaagagataaccgaagttaggtttggaaattattttttaacttaaatatgatttctattagaggatgtcttaagatttctgttgctgcaaggacacacaatgatcaaagaaagttgggggaaaagagggtttactggacttacacttccatatcactggccatgatcaaaggaagtcaggacaggagttctccaacagggcaggaacttagaggcagcagctgaagcagaggtctttgaggaatgctgcttactggcttgctccccaaggcttgctcagcctgctttcttagagcacccaggcctacctgctgagatatggtaccacccctaatgggcttgaatctctcctctcaaccgccaattaagaaaatgccttagaggcttacatacaacccagtcttccggaagcattttcttcagttgaggcccctcgtctgatgattcagcttgtgtcaggttgacataaaagtagccagcacagagtagtttcaaaaatgcagagagtttaatgtgtttaggtaactctaaatttgcctgtttgtagtctagataattttaagtctagagtagttaaacttattgcttatgatttcaaccagtttagtgatactgtaagattttttatgtagaggcagcttggtagagtcagtggagtataggctttagtttgagactggagaaatctcttgatttcttggggtttcttttcctcctctatggttctacctctgtggacccttattaggaaagagtgaagtgtgtggcggttaaatataaaagagctatgtaagtactaatcactgttagtgcctacatcagaagtatctgactaggtgggaatggggacatatgtacacaattccggctattggcaggctgaggcaggaggctcgctaattggttctagtccagcctggcctacacaaggagaccttgtcttcagggaggaggaaaaaaacccaatatctgactgaacgttgttcatcagtatattcagtttgctgaaactgaacagagcctttcattctgctcaacacttaagcagttgactgaaaggaacttgccagcggggaggaggagaggaaggatccagaaatagctagtgcgagctgctttgggcaaggaagatgaggatatagagtgggaaagttcaacagaggcctaatcccgagtcctgtggatagactagaaagagatatggaggctgttttatactacccacccctgatcacgtagtcattctcccatggttcttaaactattcctaaaattcagatgcgtaaagattactctgagagtctgcttttctagaaagtagaataatgaggtgaatttttacactttattaccaaacttacatctctgatgatttctgaatggagctacctcattaagaatttaaagctcagggatggctcagaaggtaagagcactgtctgttcttgcagaggaccagggtttgattcccagcagccatacagtggttaacaactgcctggaactcctgttccaggggatttgacatgccctggcctcctcaaacacctgcatgcacatggtccacatgagctcatacagccacactcacattcacatgaataaaagcgatttaaaagttcacttcatattccacttttttccttttttattaggtatttatttcatttacatttctaatgctatcccaaaagtcccccacccactcctccacccacccactcccacttcttggccctggtgttcccctgtactgaggcagataaagtttgcacgaccaatgggcctctctttccactgatggacgactaggccatcttctgatacgtatgcagctagagacacgagctctgggggtactggttagttcatattgttgttccaccgatagggttgcagatccctttagctccttgggtactttctttacctcctccattgggggccctgtgatccatccaatagctgaccctcaacagaggaatggatacaaaaaaagtggtacatttacacaatggagtactactcagctattaaaaagaatgagtttatgaaattcctaggcaaatggatggacctggagggcatcatcctgagtgaggtaacccaatcacaaaggaactcacacaatatgtactcactgataagtggatattggcccagaaacttagaatacccaagatataagattcaatttgctaaacacatgaaactcaagaagaatgaagaccaaagtgtggacactttgccccttcttagaattgggaacaaagcacccatggaaggagttacagagacaaagtttggagctgagactaaggatggaccatctagagactgccatatccagggatccatcccataatcagcttccaaacgctgataccattgcatacactagcaagcgtttgctgaaaggacccagatatagctgtctcttgtaagactatgctggggcctagcaaacacagaagtggatgctcacagtcagctattggatggatcacagggcccccaatggaggagctagagaaagtattccattcttgttggcatttgcttaaatgccaagtaaataatgactgctgagaaagggagagtcagtcttcttcagggagagcctctcaatggttacctaataccacgtggccagccctaaactcgtgggtatacaagcgacactaaagagactcagcaaattgtatttacctctttatctgtacatcatatatccatacaaccatgtgtatacacacacacacacacatacacacacacacacatatatttaaagaggggaggtttggggttggaaggagaggtgatataatagtttagttaaatataaaacttgtgggctggagagatggctcaatggttaagagcactggctactcttacaaaagacctgggttcaatatccagcatgcatgtaatagctcacaatcatctggaactccagtcccaggggatccaataccatcttctgacctcaagtactacatgcacatggtatgctgacccacatgcagacacacacacacacacacacacacacacacacacacacacaaagtagataaaaataaagaaaaaaatctaaaatttaaaaaattacaaatttaattcccttaaaataggatgtaagagatcatgtttcagtgagtttatccattgctgagtctttatttaaatgagatgtagtaaatttgtcttatatatttttgactgagcatattaaaagtcatatatgtctaaatcatttttctagtaagttaagtataacctactaggacagactttaaagcacatttttatttatttattttttattagatttttttcatttacatttcaaatgctctcccctttcctaccttcctctctgaaaatcccctatcctctccccacttcccctgctccccaacccacccactcccacttcatgcctctgtttgctttaaaaatatgtcctctataatgtaaacaatctagaagtcctattgcagacatttaatgtatattcattcatgtgttttattccagaaaaattttaaatgtcagcaaaattagggcttaacacaacatacttatttttattttgtagtaatagtgcacagatttttttttctattcacacgaatgggctgtgattagtcatccatttaataataaataacccaccaaattacaacttaagtagagtaaaaatatacatgggtttctggttatatatatatcaggattattttgccagacacgatgaagtactacattttcaaactgttgatgcaggaaggatgaatttagtttcaattttgttggctttgagttagaacttgcataatttcctcagtaccccagatggcagtgctgcttagcacaaggtatttagtgcccctagaaaaatcatgctatttagagcaacagctttgtatttatatatttatctgtcagttaacaagattcatctgtttatcaactccagtcctctgcccagcatggtacaagcagtgttgtttcattctgcttcaacttgaaccttgatattctgttttataatatgctctttctctttaaactttagtgccataaattttcattatttaattttgttttatttgtatagctgcttgattatctaataaccaaatatgtaattactattttctaaggttggattaaaccataggaacgtattattaatgtattataatagtagtcctccagaaaatcacccctaacacatcatcttgagacctatattatctctaatttttgtgtatccttatcagtggataaaatgagattggaaaaaaaaaacaaaaaatgaaatttatcgagaatctgtgtgttattttatttttccaattaagaattcattgaagagcagaccacttaatggttaatttttctgctttctatcttatataggttaaacactattggtgtatttgtactttagaattcatcccttgagcccctccctccctttttttcttttcttttctttttttttttccacagaggtttggaatatcgagcccacagtgagcaattcaaagccttttttaggctacccaaagaagagacattgaaagaagtacatgagtgtttcttatgggtaccattcagccacttcagtagtcacggaaaaatgtgcatttcagaaaactatatttgctttgctagccaggatgggaatctatgcagtgtaatcattccattacgagaggtaatatcaatttgggtacatataagtttttaatttctagaacaccctctaattctgtgaattagtgaaaaactcaggaaatgtatcgttttagcaatttaaataatcatttgagtacaaaattactcttcaagttaaaaatagtagcttatggaatattttaaaattccttttagaaaagctttgcaaaaagtggggaattttaaaaagtagataaagatttagggcagtagttctcaaccttcctaatgctgtgaccctttaatatagtttctcatgttatggggacccctaaccataaacttatttcattgatacttcataactataattttgctactcttatgaattataatttgaatatctgatatgcaggatatctgatatggccctcctagggggtcacaactcgcaggttgagaggtgatgatttagggtcacacaagataagtttgatcattctgaccccgaagattatgattatcaaagtttagactgtcacatttgatgcatttgatcatcaggactagaatgggtaactttcatgtcagtcaaaacttagtattcaccattgaatgttttgtttgaattgctgacgttgaaggccatgttaatttagctctttccttgaaaagtaaagtagcccgagctgaggaattgtgggtcatccctagcacagtccctattcctgaatctcttagtaagccataccacagactttcaaagaagcacatagctgaatgccagccctaggagaaaatgcgactgacttctttatctttttactccccaggtcttagctatagataaaactgatgactccaacagatcggtcatcattagcatcaaaggaaaaacagcttttcgtttcagtgagcttaaagactttgagcaactggtggcaaaactcaggctcaagtgccgggcagcttcaactcaagatgatgttagtacagaggtaatctctatagcaatcaagtagtttttaagaaaagctttgtctttagaatagtctggtcttccaaaaggaatccagggtaattttcctctttatacttatctgtcttattgtaaaaacctaagtctaaagaaattatatattctatattatatgcagaagtaacaaggactgtaatttttttgtagtttcaccatgctgtttaatctagcatgaatgttgcctagaaaggcttgtacaaacacttttccagcatgtctcctagagacatttcacccactgctctgtttggccgcaagcctcttgtctctcttcagcaatggtgaggcggattccttttcctcgtggaagagagatccatgatttgttacccttgccaataacaaaaatgttggacagccgagtggcaaagctcttgccattggcatctttcacatgaactacatcaaaagagccgggatgtctttctctgttggtgattacaccaattcttcccaagttagcacctccagtcaccatacacaggttccctgtgtcgaacttgatgaagtcagttactttgcctgtctccaaatcaatctgaatggtgacgttcaccttgatgaggggatcagggtaccgagtagtacgagcatcatgggtcactagatgcgggattccttttgtgcccacaaagatctttctcactttgcacaatttgtacttggcctcctccggtgtaatacgatgaacagcaaagcgacccttggtgtcatagatgagacggaagttctctccggtcttgtcaatgctgatgacatccataaacccagcagggtagatgaaaccagtcctgattttcccatcaatcttaatgaatcgctgcatgcaaatcttttttacttcatctccagtcagggcatacttaagtctgttccttaggaaaatgatgggaggcaggcattccctcagcttgtgaggaccagtggatggactaggagcaaacacgccagtcaacttatccagcatccaatgttttggagcagctacgcgcttcaggtgtttcttgggaccacgagccatggctgcgctgggaacggaaagagagccggactgtaatttaataatttaggaactactgtaattttatcttcctactttatttgctgtgtttcaataagcacaccttgtatgttcatacaacttgacttttaagtcaatctatatttgagaacttaataagaccttaattgttgtctcttattggggctggagacaaggctcagtggttaagactactgactgctcttacggtggctcttgatctcagcacctgcattgggcagcttacaccacctatcaccccagttccaggggatctaatcccctcttctggcctctgaggttattgtgtgtacatggtgcacataaataacatgtagacaaaacacacatatacataaaataaaagcaaaaagaataaaacttttctttttattgctatagagatagcaattttaatacctaactgtttagctttattgacataatttagtcccaggcaaaacagtgatgtaggtgtttattatgaaaatattaggggagaggggtgatgagatggcttagcatgtaatggcacttgccacacaagccctgcaacctaaatttgattcctagaagcaagtaaggatgaaagaagaaaataattccacagttgtcctatgatctctgtacacacatacctgtacacatacacacaagtgtagcaaaaataattataagttttaaacatatacaatgattttgctgacagttttaagttataaaaatgttagagataataaatactctgaataaagagtagttagaaacctggtttttatttttagtatatttttcaagaaaatgtagatagattgacagattgaattcaaatgaattttcaactctgaatccaggagtgttgtatttttacagacttataaaatgtaccaaacataacagtttacttttaattaaagattcacaggtaaataatgaacattggctttgctggttaggttattttatttaaattgacagagaaagccctttatcactggagaatgaaaactaaataatatgctaattcattcataatgcagtattggtagactaaaccttcccttcaataaacctcagtattttaataaatgtgtgtcatctcagtcccagattcagaatctttatataggccatgaagagtttttcttgcctatatttgctgtcacatattttttagaatatttttagccagaatattccttaacctaatgcaaggacataaaatttaaccagtcttgataattacttccttactagtcccatatccctgcttatgtcaaatctgcccgacccttttttttttttttttttttttttaatctcaggtttagtctatgttagatccggtgtttattctgagtatccttcactttcctttcatgtcccactagaaattttcttgaaagcctcacatgtctctggtggatgagtggcctccattgtcaaggaaagattttgtttcaaatgttcatcacttgtaggtgcatcaaaatgttaaggatttctagttgttctttcccatttcagaggcttactatagggatgttcagaatatactaatcagtatattatatttcagcttgcatggaaatatggtttttgaattttcatgttttattttcactgattttaagtatgtgtgtggtgtagggggggcagtttttcgtgtagttgtcactatagagcagcttgtgggagtcagttctttgtttccaccatatgggccttggtgattgaactttaactgctaagctatttcactggcccataattgaagattttcatcatagcaatgaagtatttgggtccattttagtattatctgtatataccttgtgatttctgtatgacataaaaattagtgaaaagaaacctttctaaaacaagaactaggggctagggccacatctcaatggtaaaccacttatttatcatgggcaatgtccagtattaaatgcctagcattaaaaaaggcagcacatttgatttctaaataacagaagttgtcactccattcttttatagctgtaatcaacttacctaaacattgaaaaaagtggattatgtaattttaacaaacccagtgacttttatactataaaactttttaaatctaaatctcaagagtctaaatgaacacatttaaatctgagcacagaaaggaattcaggaagttttacccatgtcataggacctgtgaggacataaaaatatgttacaaaggacaaacacttccagaagtaattgggattatgcagaagcatcaatactgtccaaattataactaggtgtcaattaccatgttctacagtttaataagttacactaaaacatgcgcacatgaacaggttttataaaattctggccagctgttttttgatgtgtataataaagaaaatagtgctagataaactctgacgctactaagtgtgggaaagttgggctcttttagcttagcatgaggcaaagtggttccaaagactagaaagaattctcagagattcctttattttaaattgcattacaaatgaatcataaaacactggttctccacctgtgggtcgtcactgctttcgagatagagtgaccctttcacaggagtcgcctaagaccattggaaaacacacatgcttacattacaattcacaacagtagcaaaattacatttatgaagtagcagtgcaaataactttatggttggggtcaccacaatatgaggaactcttaaagggtcacagtgttaggaaggttgagaaccgctgctgtagaatgtcaagaaaaatagaaaagtagaactggatttatgccttaacatgtttaggtaggcaaatattttctgcagataatcaaagcatatgtaattagttcttggctttgtttgaatttctaagtttttaattgtaagtattgagttgtggggacataatgatgttgcctaatgctagatttgcaaagaaaagctaatagagccaggacctgtaaccccagctccctgggaggctgggcagaaagattgcacagcctaagcaactaagggagaccctgtttaaggattaaaaaaataaaaagggttagagatacggttcagtattactacttttgcctagcatgcttgtatccctggattcgatctatatttaaaacaaagaagcaaagggggtttctttttggcaaggacatttctattttattagtagtatattttattatttgaggacttcacatacgcacacagtatattttgatatattcactcttctccttcccaacttaatgatttctcttttttaaacatccttcctaatccaactggtgctgctcatatgtacatggatgtagagccgtcggctgtgcttggtaccacaccagtggccacactcttcaagaaagctgactctccctccctcagaaaccatcaactttccatagctcttcatctagaggtggggtctcatgagcctctccccaatttcgtgctagaatattgattggcttgatgttaatcaagccttgtgtaggtacctacaggtgctgtgagttaccatggcactgagtggttctgtcatgcctagaaacactgttcttcttcctcttctaagatgtctcctgagccgtggggagaagggatatgatatttatgtctcatttacacatacacatacacacacacacacacacacaggagaagggatatgatatttatgtctcatttacacacacacacacacacacacacgggagaagggatatgatatttatgtctcatttacatacacacactcacagagaagggatatgatatttatgtctcatttacacacacacacacacacacaggagaagggatataatatttatgtctcatttacacacacacaggagaagggatatgatatttatgtctcatttacaaacacacacacaggagaagggatatgatatttatgtctcatttacacacacacacacacacaggagaagggatataatatttatgtctcatttacacacacacaggagaagggatataatatttatgtctcatttacacacacacaggagaagggatatgatatttatgtctcatttacacacacacacacaggagaagggatatgatatttatgtctcatttacacagacacacacacacaggagaagggatatgatatttatgtctcctttacacacatacatatgcacacgtgtgcacatacacaaatagagataccatgatatacaaatactcatacacattcccatcatgtacatacactaaataaatataattttttaaaaaataaaaagggtgttttctgtaggtatcttagctcaggggtagcagatttagttctgagtaaggaaaccagaaattttgttagaaataaaattaacaatctattgtaggttatggatatgaatgggatgccaattacaataagcttcttgtatttgaaagaagtctttctctgtatattttgtgttaattttttattttacagctgaactctgtctcttaatcactattgattgtgctgtttgtaagtattttaagtctgttactttatagaaaggttatacacaaagaaaatttaacctttgccctatatttccttctctgttaaagacatattctatttctaaaatcagtgcttgatacagaaaagggaaaaaaaaaggataataacctatgttactttctagatgggagtggattttgctcaggcaacaaaatatctgaatgccaagtttattccttccataattgtgagcacctaaatcggtgcctcttagaagtggtatagccatgaagtaaaagtcaggggaggaaaaacagacttgacaagaattcatctttgctgcttaagtagtctacttcactgtgctcttttaacgattcaaacattcagttgtttcaagccactgtcactgtaggtggatgtgatcttatgaacacttcagaggcagtaataaatacagctagggtagttttcgttgttcttgtaaatttatatttagggttttgtcatgagctttttttcttcctctaaattatttttctgatagtttgagtatattatcagtaataattgctgccttggccatatggatgtgcattacttgagattcagtctgcaaacatcaacttttctatctgtatttacaaaaggaggtgttactttccgtctgcctcggccatgggcattatctttatctttcttaagctggtaaatttaaggggttaaatgagttttcttttcaattacttaagatccctggaatagttaattttcagaagaagctgggtaaatgatatattataaaagtaaaaccagagataatgaagatcacatggaaatacaaatgagttaggatagataaatcaatactgaaaactgggcatgacggtacatgtttgtagtcctagtactcaagagactgaggcaggaggatcttgaggcccaggccagcttgaactgtgaaactctcaaaagcaaaagtaaaacaagcaagtaaactcttagaaaaccaagacttcctgatttaaaccatactgtgcagctatagctgtgatcaacgcatttgcattaacatatataaatgtaattgaatagtgtaggaagaaacctcaacatttgcaatctattgatttccaacaaggacagaagttaattcaggaagggctaaagtcttttcaacaactgcttctaggagatagctgactgtatacaaggaatgcacttggactctttctttaaagcacttatagccctacctggggatccatcctgtctgcagacaccaaccccagacactattgctgatgccaagagtgcttcctgacaggagcctgatacagctttcccctgagaggttctgccagagcctggccaatacagatggggatgctcgcagccaaccatcagactgagcacagggaccccaatggaggaggtagagaaaggactgattgcaaccccttaggaaggacaacaatatcaaccaaccagaccactcagagctcccagagactaaaccaccaaccacagagtacacatggagggacctatggctccaattgcatatgtagtagaggatggccttgtcatgcatcaataggaggagaggcccttggtcctaagaaggcttggtgcctcagtgtaggggaattcgagggcagggatgcaggagtgggtgggttggtgagcagggggaaagggatggataggggattttcagagggaaaaccaagaaaggggataacatttgaaatgtaaataaagaaaatatctaattaaaagaaattcctaggcaaatggatggaccttgagggcatcatcctgagtgaagtaacccaatcacaaaagaactcacacaatatgtactcactgataagtggatattagcccagaaacttaggatacccaaggtataagatactatttgctaaacgcatgaaactgaagaagaaggaagaccaaagtgtggacactttgcccctccttagatttgggaacaaaacacccatggaaggagttacagagacaaagtttggagctgagacaaaaggatggaccatctagagactgccatatccagggatccatcccataatcagcttccaaacgttgacaccattgcatacactagcaagattttgctgaaaggacccagatatagctatcccttgtgaggctatgccggtgcctagcaaacacagaagtggatgctcacagtcagctattggatggatcacagggcccccaatggagaagctagagaaagtacccaaggagctaaagggatctgcaaccctataggtggaacaacaatatgaactaaccagtaccccagagctcgtgtctctagctgcatatgaatcagaaaatggcctagtcggtcatcagtggaaagagaggcccattggtcatgcaaactttatatgcctcagtacaggggaacgacagggccaagaagtgggagtgggtgggtgggggagtgggtgcgggagcgtgtgggggacttttgggatagcattggaaatgtaaatgaaataaatagccaataaaaaagaaagcacttataaaattaagtcaaaatgagttaaagaaaactgtaagcctgaaactttgtaagtcttagaataagtgtagcagtgagtctttatgcctttaaattgaggacagattcaaataagtatttctctaaacaagataatgaaatgacaaataaccacatgaaaagattttctctattgtttgttgctaaggaaattcaactcaaagccataatagggcattatccattcatacctgctagcatagctattatttaaaaagttgataataatgggtaaagaagaataaagcgcttgaaaagcccgtagactgctactggcaatgttaagtgctgtgctgcattggatacatttgggtagctcctcaaaatgttgaacatagatttactgcatgcccactaattctacctatacctattgacccatgaagactaaaattttctcacagctacccataatggatgtgcccaatgagattacctgtaattattaaaaaatgtttaaaaacatcattgtctacaaaatgatgattaaatataatcacttatacagtggcatagtatagggcagtaacaagaaatgaactggtattatataacaggcgtaaactttgaaaatactatgccaaatgaaatcaaataagtccaatgcaatataacatgtatcataagattttgtttatataaaagccagtttttatctagaatctgagtgagatgatagtgaatgactacaagtagtaggggctttctttggatggtttaaataatcttttaactccagactggctttgcagttgatctttatttttattttagccttttttttttaattcatgtaataggtatttcaaactggtataattttgtgcttctgtaaacattcaatgaggatcattgaactgtatgttaaaactgtgttacctttggaagaactgccaaaccaaagtagctacctcattttttttttttaaaccggtaatgagtaagagttcttgtttcacatcctcacagtcacttggtattgttacctctgattttagtaggtgtggattctttcttaaaatgtttttagctaatgccgtatgatgccagatgtttttatttgctatctcttcctatcttttgcctactacttatttgcctactatttattttccttttgtgttctctcagttctttccattcaagccacaaatagttccttaaaaattatgtgggctttttatgaatccttgtaaatactttctacttcctatgaaaccaacatcatactccaagtctctgtctccttggcctcctgggcaaggtcattcttttctaaaggtttacagaaagagttgctaacatattcttagagaaatggtctagcatacaccaacttgatctttctgatatcttaccaaaaggttcttcagttggacccttaggttttactattttatgaattgtggccctggcttttatatttgcctagaagctagatcttgttctcagaattatcttgtcatgtatgaaaactgagatgaaacatttctaaagcctgcaaattatagctcatttgcatttagtagtttgtttcttcgcttcccttactgagagagccaggtttgagtccatgcctacctatatagcccccaaagcttgtccttgagagcttgtgatgtagcctgtggtagagtgtttgtcctgccaggaggagatcctgggtttattctccacatgccaataaattaaataaacaaatttgtactcttgccaaaagggcctggtggctctttgtgcagtggagcaaacagacatctcatttaattccccaaagaaggagagaataaatgtcaagggttccacttgggtcaaggtatagaaatggagagaaacgttatattagcagacagccaggccaccaagataacagtgtacttctaatccttgctctgttattagaggtcactttgttgacaaactttgacaaaaaaataaacaatgctttttaaaatatttaatatatccatagattgtggcttatgaacgacagaacatcaagacatttttcttttttgatttattctctcatatattacatcctgaccataatttacacccttccactctccaagttccaacctccgatccctactcttccccagatccattgctcctctgtttcaatgcagagttggttttttattgttgttgttgttgctttttggggatttttgtgggggcgttttttgttgttgttgttgtttgtatttgtttggtttttttgtggaacttgtgaacatatatctgactgtcacactccgacttttctttctaggttgctgttagttctgactcgacaggcccatctgagaattttgaggagcagcctttgacatgtccaaaggaatgcagcaaaactgtgaacactgaagccttaatgacagtatttcaccctcaaaatctggaaaatcttgattctaaaatggtaaggaaacaagatcattaaatctatggattagagcagttgtttaagaacagttggaaaacagctagagccgtggttcttatccctcccaatactgcaacactttattacagttctttatgttctggtgacccccaaccatgaagttatttccatggctacttcataactgtaattctgctactagtatgaaatgtaatgtcaatttctgtgtttctggtggccttagctgactcctgtgaaagggttgtttgacctcaatagaggttgcgacccacaggttgagaaccactgatctaaatcgtatcagaacagaaaggtttacttctgagatttgaaacatgccttgtttggttccacaacactgtcttttcttttcttttcttttcttttcttttcttttcttttcttttcttttcttttctttcctttcctttcctttcctttcctttcctttcctttcctttccttttcttttcttttttcttttttgatttttcgagacagggtttctctgtgtagccctggctgtcctggaactcactttgtagaccaggctggcctcaaactccaaaatccgccttcctctgcctcccgagtgctgggatcaaaggcgtgcgccaccacgcctggcaacactctattttctattattgactattatcaatggtgaagataaaggcggaattttggatataaagttttctttgcatagatttcgaatagtctgtgtgaaaatggaattgattagggaagagtaatggttcgaagcttttaccacctgggtgttatactttggcaacttttaagagttgaactgctaatgatagtacattaaaactgttaggtttgccggggtttaagatttttgtatggtaacagtccggtgctttagaatatgaatatgattttttggttttctaaaatttgctctgcatatagtgtttcatggtaaaccaaatgaatgagttattttaaagaaatgaatttttcactgtttagttgtcttgctttttctgttccagttgaaagaaaagatgaaggagcaatcatggaacatcttattttcagaatgtgggcgaggtgttagcatgttccggacaaaaaagactcgagatctggtggtaagagggattccagagacgttaagaggagagctctggatgcttttctcaggtattacatttatttgatttcctcactgaatagacagtaaatatgccccttcaaggaattaggctctaagcacaaagatgtccaggacatgagttcagactattcaaagagagaaagtggtagttacatgtgcttgcctaaatatctacatatctactgtctgacaagttgaatatattaggcagaatgtgtataattgggaatataaggtccatatctgtagcatcaaggaaaaattaaatgaaaaaacttcctgggaatgttattctggggaatagtattaacttgcttcccttttcttcaatttctctttttgtgttcagatattatttaagcatagagcttgacttcaagataataaaaatatgccactatatgcaaatcgtagctttagtgtagcattctatttgtatgtcaatgcaattatctttgcaggtgctgttaatgacatggcaacaaaccctggctattatgctgaagtggttgagcaatccttagggacctccaacttggctactgaagaaattgagcgtgatttgcgtcgctctctgcccgaacatccagcatttcagagtgatactggcatatctgctctgaggcgggtactgacagcttatgcatataggaatcccaaaataggatactgccaggtataacatcattgtgattcccaaatattatgtgcatatttcaaataatattaccaactgcaactccagaattttgggacattatgataatgagaacagaggtaggctaagattgatagtgaatattattaaagtaaggaggttgacagcgggaacatttgaaagcactgatgtttcattaatttcttttttaaacatttggtgttattcacctgtatgtgtgtgtctttgtgagggtatttgcacatgtgtataggtaccctaggtagctggaagagggcattggatctcctgccactggagctacagacagctgtaagctgcccaacataggcactagtaaattaacttaaatcttctgagctcctaaccactgagccatcttcttttttcgtttaacaaatatatatatatatatatatatatatatatatatacatacacacacacacacacacacacacacatatgtatatggattatttggctaaaaaaggcactgtgttgcatacttaaggctatagaaagatacatcacataaagaccttgtcattaaaaatgcatggatcaggtctgagaaggtatagctcggtggttacatccttgtagtgcaaacatgagggcctgagtttgaatctctagcactgatgtttaaaaaaaggaaaaacagttatggcttagcaaaacaaaaacatgtctcaaaaaaaaaaagatgaaatggaatatcaagtgaagaagaacccatagcatcaaccttcggccttcacatgggcctgcaacgggagggcacatccatattttgtatatgtgcatatacacacaatagaggcatagttaaatgaatatttattgggaaattgaaaaacaagggagaaaaaatattagatgaatacagagtgtgcagggtctgtaataaattagtttcatctgggatgatcagggaaggcttatgtggaagaggttgcacttgcaggtcaaggcagtttgtgaattttgaacatacagaaatggaattttaaagccttctaagtgaaaaggtttgtacggccccatgagaatagaggtaagtaaagaatatgtataaagtcatatactgttttaataaagtgaaggatgactaaagcagcaatgcatttaaagaaatcactgggtagtttggagttgattaggagtatcttagttagggttttactgctgtgaacagacaccatgaccagtgcaactgttataaaggacaacatttaattggggctgacttacaggttcagaggtgcagtcaattatcatcaaggggggaacatggcagcctccaggcaggcatggtgcagaaggaactgagatttctacatcttcatcagaaggctgctggtggaagactgactttcaggcagctaggatgagggtcttaagtccacacccacagtgatacacctactccaacaaggccacaactcctaatagtgtcactctctgggccaagcatatacaaaccatcacaaggagtttaatttttaaatgtattcttctctcatatatatccctactgcagtttttctctccctctattcctccctgtttctccccccacctctcctctctcccacatccacttctctgtttcctttcagaaaagagcaggccgctcaaggatatccaccaaacatggcataagaagttatgataaaactaggcacaaaccttcatctccaggctggataaggcaaccccgtaggaggaaggaggtgccaagagcacgcaaaagagtcacaggcacccccactccctataagagcaccaagatacacaaccgtaacatatatacagagaacctatcatagccctatatagattttcctgataggttcagtctctgtgaacccctatgagcccaggttagttgattctgtgggttttctcctatccttgacccctctagatgctccttcaatctttcctcctgcacttctgcaggatttccctagctccacttctgcaggattttcctagctccacctaatgtttgcatgtggatctctgcatctgctcccatcagttgctggatgaatcctctctgatgacaataatcatatcattcattactttttttttttttggttaggtttaattctaccctaggtctctgagctattcagtctctagtttcaggccatccagacagtgttggccatgggccatgatgtgagcctcaagttagaccagtcattagttggtcattcccacaagttctgcatcagcacatatccaagtcccaccactgatggtggtggtggcgcacacctttaatcccagcacttgggaggcagaggccggcaggtctctgtgagtgcgaggccagcctcatctacagagctagttctgggacagccaaggctacagagaaaccctgactcaaaataaaagggaatccttggtaaagattctttatgatatgggttcaaaatatcatcttagaaaagaaaaaaaagctaagactttgatgccattacatggattctacagatcaacttggggaagagtaagtacatcttgagaacactaaatctttcaaactatgaatgtagggtgttttcctctttctttaagactctagtttctttttattaaaaatatcatttgatagctttcaatgtacaaatcttaaaattttctttggataatttttatctctaagtattttaatccttttgaaattatagtaaatggattttgtttctttttattatatttttgctagtgcattaaacaaaattcattttatctatacctatcttgttttctttagccttgctaaacatattagtggtcctaagaaatagtttgtgggtttctttcaagtttcaatattgaaatcacaaaatctgaataatgacatggttttctccaatttccatctgaacggtgttctgtcttttttccttgccaaaatggataaccttcaatataatgctaagtgggattgttaatattattattttactgctttagatgtatctcattattggtcagtcttgtctagttctcctgggcttcagtgatcttctcatgtctgcctctggagcagctgggactacagatgtagtcttctaagaaccagtcttttgctaaagtatgcagttaactgtgaagggttttatatgtagatcattggttgaagaatttcctttatattcctagttttggaatatatatatatgagagagagagagagagagagtatagaagttgagtacagtgaaaatacacctgtaatcctaacacttaggagctaaggcagggggatcttgagtttaagtctagactgggctatatagtgggctctgtcttaaaatgctaaccagggaaaaaagagtatttcattttttaacttttttgagattaatttttaattgcaacatttccccctcccctttcctctctccagaaccctcacaataaactcctttctactctctttcaaatgtatggcctctatgttgcttagctatatatgtacatacagccatatatttctaaatataatgtgttcagtctataatgctattcgtatgtatgttctcagagccaaccattaggcactggataagcacttaatgcgttctttcccggggaggctacctctcctattcccagtttcctcagatgcttgtagttctttgtgtaaggttgaagcctctggaaattttgtcaaatgatttttttttctttgtgtccattgagattatcatgttttttttttttttgttaaaatgacgtttcattatttgctttttatattttgtactattcttgtgttcaaattataaatccaagttgcttttactatatagtatttttgtatgatcttgaggttggtttcttattattttgaggattttgcattcatgttcataaaatacattgatatgtagctgttttataaaatctttgtctaatttttatgttgggatttctagaacgagttggatgatgtttcttcctcttcggttttacatggtttgtgagagactggtgttacttctttaaatgtttagcaggctgtgccaagtaaagccatctgtccttcattctcatgtaggaagtatttccattactaattcagtctcttattgtatctcgattctgggttttctttcctctatagctgttttttgtaattagtatttttaaagaaagttatacattttatccaatatttaacaaacagttgttcaccacattctgtttctgtatactgtttgtatgttacctcttttcatatggtaattgttgaagttcagcctttcgggttttatatagttagttttaaagagtacagtttttaaaatattttggtgagcctaacttatttgttgtaattactttttaaatattttcattagtcctttgagaagtttgtacattttagacacattcaccctccctgttccaactctttccagacgcaaactctttcccttcccacccaactttatgttctttgtccttccctgtctcatcgaggccagtttgtgctacctaaatattcttgggtgtgtcactgtccactggcacatggtagacaatcaagacatgcatagagaaaactgatactttcttcctgagcagctaacacttgccaataactcttcagctagggatggaactttgccccaactatcttttccatgctgagatttggtctggcttacacttgcataggtcttatgcatgctgtcagaacctctgtgagttcaagttcacagaagcctgcagtatccagaaggcactgtttccttgtagttgctcactacacctcgctcttacactcattctttccagtgttctgcagtgacctttgagcttctggagtaggagcggttccagttaagcccagacattatgtagtctcttattctttgccctttggctagttgtggctctttgccacattcatcatcatctactgcaaacagtttctcggacaagggtcaggagataccttaatgtgtgggtatgatgatatcattaggagttggcttaatactatgctcatttagcaaaacaacagtagtaggttctttctacaatcaatgatctctctagcaagaatttcttggcctgataatggtttcattttgtgaagtgggtcacaaatatactaagaaagtggttggttatgcccatatcatttgcaccacctttgcactgagagatgtcttgcaaggtcagctcttaatgtagtttatagctgagtgagactgatgatgttgagttttcttatcttttcctttttctgtttcctatcactttatgcttgcctagtggtgagaacttggccctttcctttcttagcatatatacaggctagaatatagcacagtaatacagttcttgccaaacttacacaaagccatggctttcataccaagcacctcagaaaactatacataaagctataaatatacatggacaaagacttctagatttttgggaatatgctagagtttttcagagtccccagatttccttcaaatgttttgtttggtttggttttgctaatttctcatttggcccagcagcctcaggcagccacatgctcagtagatgactctgattattttaacaaacactcctgaggaaaaaaacttctgtgctacctgaacttggtgtcaggtcaagtaaagagagctttgtaaatggagtcttcaggggagtatcagacagattgaataaagacagtcctctacaaatggtactttgaaagagctccgaccccctttctctttcctccagtataggcggaaagttaagtaggaatggaaatagagaagaaagaatatatccttaaaaaaaacctattttgttagtagaaactctaggatttgaatcaaaattagcatgtatcagataatgagtttctacagtgataaaaatggaataactaagaagacaaagtatttaatagggggtgatatttcattttgtgcatagtgatgggtgatttgagttcatgtccaaaggatagtctccactagagaaagtttgttttctgcagtattaggacatcattcacaattatgggttttgttttaaaggctcataattattaggacttttaaccaatttaaatcagcctaattagattgtatctatgatgcttctgcttcattttcctttactattatgatagaaaatacgcaactcgcaagtgtttgcctgactgcacattgctgttttgaactagcttcaagtccttatgataccagtatttactctttttgtcattactgctgttgagaagttctatacttgaaaaagaaatgcagttattacctgagaaatacttatttatttttcatttctttcctatgaaatttaggcaatgaacattttgacttcagtattgctcctatatgcaaaagaagaagaggctttttggcttctggttgctgtatgtgaacgaatgttgcctgattattttaatcgtcgaatcattggtaaaaacaaacacaaaaaaaccatacacacacacacacatacatgcatatatctacacatagttgctgacttaatctattttgctgttctcaccaaatggcacaggcaatgatttataaagaatagacatttattttaattagtggttctagaggttgggaggcccaagatcgtggtgccagcatctgctcagcatgttgtcagggtcttactgcttcatagtaacatggcataaggtatcatatggccagacagtgcaagttcactagaattagcttgcttttaaaaagagcaaaaacacttccattataagtcattaatccatgcattaactcacctattcattaatattgtcacttcattaaggcaggagccccatcacttcccaaaggtcctaactccgaatactatgaatatatgaatcgaggagtggtttaggttcccatgaatttttcaaccacagaagacttaatcttttcaaaacaatttttaatgcctgttgtctattgggtccgagagtgcttttgtttgtgaactgcggagcagggtatttgttgagacaaggtctgactgtaaaactcagtatgtggcttcaaccagcagacttcctgcctcagcctgccaagtgctgagattacagatatggaccaccatgcctggctccttacctgttagattacaaatctaattgaagtgttggtaaatgagattgagaaagacagcaaactcaagcaatctcacaaagccttggctgatgctttggggaaaggagcctctgctactgaatgtatagttgggaaaatgttttatatgttactattttaaaaatgaaggacgtgctctcctccacaatgaaagggaaacgtacttagtttataaatactatattgcccaaataaggatttgagatatctagaactactaagggaaatttttaacagtttcttgatgagaaagagattttaatcaacttaatgtctccatagttatatgaatttacatataaaataattgagtctttctttgttaatttgtgatattatcttagttatcaaatatataaagattacctattttaacacctatagatgatctgtcctttgttccttcataagttttcagtattgtgcctagttttttattatgttccctttaatatagttctatatgtgcatttacctttatctctgctcactattgaattcttttaggtggaaggatgtggcttaatgagagcacatttgcctagtatgcatgagctctgaattacatcctcccaccacaaaagatactacattctttgaagaagagctcacaccattagttatagtatctagtacatgtctctgattgctagaaggactcaggaaccctccaaatgaattgaaagttagtttcccaagtgattttaagctcatgacactgaactagcagttgcagagatgtgcaaattatagaaaaggtactaatgggctcctgtttggagaaagtaagatgagctctgtcctgaagctaatgaaagtggagaggagtcacaaagaaagtctattgaaaggaatttcttttgatgttttccaggtgccttggtggaccaggcagtgtttgaagaacttatcagggatcaccttcctcagctgacagaccacatgaccgacatgactttcttttcctctgtttctctttcctggtttctcacacttttcattagtgtgctacctattgaaagtgcagtgaatgtggtggactgtttcttctatgatggaataaaagccattttacaactgggattggcaatacttgactataatttagacaaacttctgacatgtaaagatgatgctgaagcggtgacggcactaaacaggtactggaagaactatatatattgtgttgaaatctggaggtggggctagggagatgaattagcaattgaaaatgtctgctgctatcccaaatgagttccatttccagcacccatgtcaacctgctgttcaggggatctgatagccttttctggcctccataagcccctcaacatgtctggtatgtagacacacatacgcactagtaaaatgtttaagtcttttttaaaaaaaagatttatttatttattttgtgtctatgagtacactgtagctgtactgatggttgtgagccatcatgtggttgctgggaatttgaattcagggcctctgctcactttggcttaaagatttttaagtaccctgtaactgtcttcagatgcaccagaagagggcgtcagatctccggatggttgtgagccaccatgtggttcctggaaattgaactcaggaccttcggaagagcagtcagtgctcttacctgctgagccatctctccagccgctgtttaagtcattaaatccagtggagagctaagtgattacattattcagtctgcttggtttaccagcaaggaaactgaccttagaaacgtcaagtgattctcgttaagtcacataactcattgatagataaagtcaagccccaagtaccctcctttgtttttagacagaatgcagtgaaagtaaatcactttgatgtgaacacttagattcctaacacattcgtactaatatcattaatttagtaaatcataacaataattctagtttaagccagaatgtctctatataaaaatggcatctcgggggcctaggtagtaacattaaagcatccagtagggaaaataatcctggttcccaggtggtagcagtcgggtaggttggactttattgtcctgcttcattttgtatggatgctgttttgtgttggagtacatgagattttgtgtatatacatgtatttgtatgagttaaataaatgaaaattaattggcagctgttgtcaatgcttcattaaactccattctgtacagaataatatagacacctccctttggcattcagaactcttttgttgttgtcgttgttgttgttgtttgagacaggttttttttttttttttattaatagctctaactgtcctgaaactcactctgtagaccaggctggcttcaaactcagaaatccacctgcctctgcctcccaaggcattcagaactcttaagataaggcctcagttttcctttttaaaaccgatttcccatttcatccctctacagccctgatattcattgcattctcaatggggttggagttatttgctgaatatgtgccgaacctattttgtagctgctctttgctaccttgtgggttcttccttttcttccttgatccccatggttttccccactatcactaggtaggaaagaaacaaggatggggggggggagaattaggaaaattcctggatctaatttcttttctttgtttcttctttgctcatggatactaacaagtcacaaccaacctccctgaatgaccagcaagcacccacccctcagggcctagtatttgtataccctctgaaaacctcccagaatttcaaacatgatacaatcgcagaaattatctgcagctggcaaaaaccacacctctctgagagcacgacgcaaatcacagtcagctgctgtggacagactgaagcagcctcacatctctacacctgggattaaacaaaagcatataaaagattcttataatatttctgtggtttttaaagaaaccagagttccagaattctcaaaaattttgctatgcctgttcacttccctcatgttttttctcccaaagaaatgtttgcatgtaattccttccacttattttcctatctcccaaccatcttcatattcttcttcttcatactccttcccaagagttctcagatataaaattgatctctgacaatctcaggagacattagccgtggttttctctgctacaactgtttgactttcactaactcttatattattgtcatttttggataggttctttgacaatgtcattaataaggatagcccactgccttcaaatgttcaacagggttcaaatatcagtaatgaaaaaagtgatcatactaaagtggatattacagatttgattaaagagtccaatgaggtaaggtttttataccataaatatgatgacatcgcgtatttgaatgtttataaataattgcatggcatacttatatattaagagtaagataacaattcaaagaaacaacttaaattttaactttactataaagttaagagttctgtaaactgaacctaggttgtataactgcctctttctcaattgatttttcattaaatgatattaaattcacttgctttcacaaatgatgatcatctttaaatatgtatcaatgtataaaaagttaaaatgattctcttttgcagactaagagttttaccagtgttcttagtcaaggcacaagtagaaagatacaattttctttggtgactatatgtctatatgtataaatgcacgaagaaactgggatgaaaatgtgcaaagtcactgaacagatcatgaaaatagctagaaattgaatcaaggcctcagagaattgagtctgatgaaatgcaattgtaagagaagtggatcattattatgaatgagtatccactgaaatcatttcttgcagaaatatggtagtatccgctatgaagatatacatagcatgcgctgtcgaaataggttgtatgtgatccagaccctggaagagacaacaaagcagaatgtggtgagtatccactctgtagggggaaaccccaaagtaacttttcttttactttgtgtaaaattccatgtgaataaaatgagaaaggctaatttagagctgagttcttgccttagctggactcattgtaagtttttggaggagcaatgttgttttcttctagatgaatgactgtgtttacttaagcatgctttgtattacttggcccacaacattactgtgaagcaatactgaatgctgtggttagtcacctaacatttactaacacacatttgtggcacgctgcttcaggaagaacagtttgggctggagagctcagtggttaagaacgttttcttctggaggacgcaagtttggttccaaaaatccacattcagccgttcacagccatctgtaccgccagctcagtgaacccagcaccttcctctgacctccatgggcactgctctcaaatgcacaaacctacacatgtacatatacacataacaaattaaacccaaaattaaaataatagctgaccctcataatagtcagtgcttctagtaaatactatttctctgtaatgcctataggaaagtgtaaagggtagaaaacggaatccattcttagactatttctgtgcttccataggtggctgctaatattgttttcttctgctctgtgagatgaatagattgctgatcccgtggagaaaaactttactgtttatgttgatatatactgtttgactttttatcattatgatttattgttttataaacttacttaaaaattaagtcctcagagatacaatctaggaggattaatattcctaaagatcctaggtttaggttccaattaaataattctgtcatgttactatgacataagacagagagcctttggttttgtttctaaatattatttaacttaaaatataattacatatattatagataattaaatcatttcagaaatatttttaagatgaagttttcttaccccacaatttttaaattatttgaaaggattcttacatttctttttaccatgtaatatgataaaatatattcatgttgataggaagagagcatatacatttaaaaaatgaaaccacacattatatcagtcactcaaatatatagttatcattgcatatcagcacaattaaatcaactcattctttttagtacacaaagtagtataccatggtataattcttggaaatttcatacactatatattaatcatattcatccccttctaccaactcctcccagattcgtcctcacctgccgatccactcaacttcatgttctgtctctcttaaatccaatgagtccagtttctgttggttgtgtactcctggcaataggctttgtcctggagcccaggcatcacactagaaaacagatattgcctctcccagcagtcatcaaacaccaagagctcctcagctaagaataagattttgtgtctgcctcccctcctacatgctgggattttttatggtttgagactatatgtgtactatcataaccactgtgagttcatatgcacatctaccctcttgtgtctgggaaagtttccatgaagttatctgaaacgtttgcctcttacaacctttcttttccctcttctgcatagacctctgagccttgtgaggcaaggtgtgatagaggcatccagtttagggatgaacactccaaagtctcttattctcttcccattaaccagtcgttcatttctataccaattgctgtctactgcaagaagcagcttctctaatgaggcctgagagacacactgatctatgggtacagcgataagtgattgggaagttatgggttctatcttgtggatggccttaaatctacccaaaatgcagttagccactgttgcaccagtgggcagatcttaccaggcaggtattactgtggcttacagagttcacaactggattagactgcagtcatattgcactctccagcaccagctagatctgtcaatgttctgtgacttgggtgagttaaaaaaaaggggtcttagtaccaagttctgcagcatagacaacctagtgctttaaatattttactaattgtttattagtttttctcacttcttaattgattagttgtagcctttcgccattttctatgacattatctttctatccttggtgtataagatctcattgaatattagtaatattaattctttgaaagttatcattgtaacccaacatttctctcttatcttgtttctgtcatgtttttataatgtctgtcagagtatacaaagcacagatttttttttgttagtcaagtctttcctttttcttacataatgcctggttttcatgtaaaatttggcccttttctacccaaattatttctattttagtatttcatattttaacatttaactcacaggtaatatacctggaagattttatatgcatgttaatatttttaactaaaaccattcattatctgaaaactattaaattgtctattactatattatactttttcatattctgtgctcttttatacatacataaaatcacttctatatttctgttgttgcaattatgtcatacatttttgtatctttatagtatactttgaaatcttttttcttttcaatatccattgtagtcatctgacttttcaaatgtccattagcaagcatttgtgggttcgatcctgtacattatcttagttagggtttccattgctgtgatggaacatcatgaccaaaagcaacttgaggaggaaagggattatttctcttacatttcagtttcacagtctgttatccaagcaactcagggcagggacctggaggaggaagaaactggtacagtgtccatagaagagtactggcttggtcctcatggcttgctcagcctgctttcttctgaaacctaggaccactagctcaggggtatccccacacacaggctgtgccctctcctatcaatcactagttaagaaaatggcctacaggcttggctgcctacagcctgatcttatggagacattttatcaattggggtaccctcctctcagatgactttagcttgagtcaagttggcataaaactaactagcacctaggtcgtaaatatttcttgttgattttgtcctaatacattttgtggctaaagtgaatgagactcgtttctttaaaatttccaactatttattggcataaatgtaaaagctcttgatttgggttttttgcatgttgttgcaactacagccctgacttactgattgtactatttgtcacttggcttttttttttttgatatcctaaataaagagtatatagtttccagtactaagagttttgaccctcctaatatgtgtactctttttctttgtgtatatatatatatcttgaaaccttgaagaaatattgaataatagcagaagtaggctttttagtcttagttctaaatttaatagagatgcctctcatattttattactattgatttttggaggatgtcctttattaaactacggaagttttattaggtttctaggttgaaaggtaattgtagagtgtttgctaagcacccacagaattctaactggaattcagaacaattattttttaaaaaaattaatagtgaacattaactttgatagaatgttcatttcctgagattgtgtggatttttactttattaatatagtaaattttgttaaagaattaattagaattctattgcatttttaaatgaaccttatttgggtataatatttattcacagtctgtttcgataatttaaatcatttagcaaggttctctgcagctgtgttaaaattacattgatttcagaatttcttttgctttttgagaggcatcatgtcactatgtagccctagcgagcctggagcttgctatgtagaccagactgccctgacactcacagtgagctgcctattcttgtctcccaaatattgggattaaaggtgtgcaccaccacgcacagttaagagtttcttttctgtgtgtgtgaatgctaatttttatatcagttttgcttatcttatataataaatcttgtagtaaactcattttttctatgctctggaatactttaacttccatagaaagtttaagaaaacaagactataaatatacaaccttttgggtctactgacttctgatgatggtagtagctctttgcttatcatttctgttttgtctattcaggggtagatttttacacatttggatttattttggtgatatattttccaagagagttatgtattttacctcaatttatgccattctatataatgaacactgtaacgacttccatactcatctttatatattgcccttttagttctttatcatatttatttgttggagggtgcacccatgtgctgtaacatccctatggaagccagaggacacgttatgacatttgcttctatcagcatggcttcctgcgattgagctcaggtcgtcaggcttggtagcaagtgtctttatccactgagccattttgtcagtagttataattttcttctcgttgacgtttatttgtgattttttttattatagtaaaaatgtattttactttttcaactaattaacaaagtgttaatagtctaacactatatagtgattgcactaaagtcaaataatatttttatcagaaacacaaggttaattcaacaggtcaaactatcaagaactaacttggctactatgaaaagagctgcagtaaaaaattgatgtgtagatttaaaaagaaaaaaagaaataaaaaaccattttctcctgggagagggaaactggtagtgaattcaaagaaagagttttgaaacagaaatgttacggtctaatttgtttttaatctttttaaagctacgtgttgtatcgcaagacgtgaaaatgagccttcaggaactggacgaactttatgtcatttttaaggtacagctgttcctctgtaacgaaagccagtctcttagcagaagtttatcacaattactcttaaatattttttacgttttaatggacatgtttaaaaggaatattttacttctttctgatttaatgatcttccttttttatttgtttttttgatagaaagagctgtttatatcttgttattggtatttgagttgtccaggattgaagcatcatgaccccagcctgccatatttggaacaatatcagattgactgccagcaattcagagtattatatcacttgctgagtccctgggctcattctgcaaacagagactcattggctttatggacattccgattgttggatgagaactctgattgccttataaacttcaaagaattctcctctgcaataggtaggtggatgtcctttaacttcctaaatcaaaacataaatttcttccctacctccaaaaaccatttcatactgctgtctattgctgctagtttagacagatgtttcactctgggttacattatcttcaggtttagtaattttgggggctttttaatgtgtttgttgctaaacctatgcataaacctttttatggttactgttttattgtctgtgcattggtgttctgcctgcatatctgcctgtatgagggtgttggatcctcagaaactggagctccagacagttatgagctgcagtgtgtgtgggtgctggaaattgaacctgggttctgtgagaaagcagctactgctcttaagcactgtgccatctctccagccccacatattgatctttttgccccaaacctctcaaagaagcaagctgttcattgtgactattttaatgctttaaaaggcaggaagagaatgtccagggtttttccacaccagatatatagatgcaaagaagggatttctcctcgggtaaaaatctatccatatagcctggataagtgatacagaaatagtaaatgaatgagttgtgcctatagttgctatgttggaggttttgtttctttggttgctatacgctcccagcaatgatttcatgggttatcttgaagagtttcttcctcaagtgaattgtaaaccctcattcaaagagaaagacaaacgtgcggttggaagaaaggaactagtgcagtaagcatgctgtgtgcctggtggagcgtttttttgcttccatgctcgaaagagaagcgtctaactgattgagtagtttgtttaactgttatcttaagaaatacaatggtttggatcctaattcttagctgcttctccacaccagctatctttaatcatttgatcgagatctgctgaatatttcgataacatgatttttctaattgaattttattgaacagatataatgtacaatggaagttttactgacaagctcaagctgctttttaagctgcatattcctccaggtaagaatgtaactgtcttgacgggtgtgtagtaagagctcattccattgtaaccggcattgctgcgcagctaattctatttcaaaagattattttccatttgtcacaaggttattgtttcattatgaccatcaggtagtatcataagtattttcactggtgtgtatatagatatagatggaataaaatctatgagagagattccatataacaggtggatcctcagtttcctattaggcacttacttatatatgtatgtataaatgtgtatggtttgatataggatctcagtatatatcccaagctgacctcagcctcagaagtgcaagaataacaagcctatgccatcctgcccagctagctatatcttaaatgatagcttgtacaagaaattatgtatcattgaaatattgggacaatgttgaatttctgctctcattgtccttagaatagtgattcactgtaggcaggttaccaaacttgcaggtgatgcagatcattcagatactaggaccagatggaaggtatagtaaatacttaccaaaagaagcagaacagaagctatggtattgagcataagctatgtcatgttatccacttcatacacagtatcagccttaactccacatgcgtacaagggcacatgaatgaacacatgcattaccatacacattataaaatatgtctatatgtactcacttattttagcctcacagtctctgaaaaaattatgtcatccttccaatttttacaaaaaggaagctgacagttgggaagattcaagtatgtggcagatatcacatagttgatatgagatccatctgactccgttctactatatttcctccaagttaccttgccttttcatttctcataaagttctttccactgacctaagaaaattactttcaacatatccctactctataaaagaaatattgtaaaatgtagcttgggttgggcaatttaaaaaaaatcaaatagcacctcataatttgtctaatgctctccctggactccttttaaagctttttagagccttttcatgttagcaaggaattgttatttagcagacaaaaaaattaaaaacatctttacccttcaaacacttgaatcacaaatacaatgttaaaaataaaagataaaccacacaataactcaattataagaatactttttgttattatgttaggttaccatttgaaggtttaatttttccatttcatgtatttttgtagagggattaaaagtaataatattaaatagaataaaatataaaataggaaatattgtgtttctgttaaataacaggtgataagcaaagttaggcacctagctttgtgttttactttattagtacaggagttttaaacatgctgagatttcatgttcagatataacctaaatgccagattttctttgttcaatgtgtaatgactctccgaaatttatttaaagagtataaaaagtaggctactcctgctacggtatgatggccctcagcatcaaatggactcagtgggttgtataaaagagcccatgaagttagaagggaatagtggtagtgaaagagggaacattacaggaaagaaatggggagatggatttgatcaaatacagaatccaaatacatgacattctcatacaataaaaaggagaaatcagggaactcaaagtgatcgtaggcttatttggtggacagcagaggacagcaatattatttccacccaagtcacctaaacttagtctgaggagtaagaactacttttctcttatatgttttcagcttatactgaagtgatgtctaagacgtcttcaaagggcgatgagctttcaacagaagaattactttatttcagtcagctccagggtaaatatttgtttaaccttttaacagaatctgggttgatttggagttggttcatgctctatttcttagaccagtctcaaactcttgggctccagtcatcttcctgtttccgtccgtctcccaggtagatgggactaaggacatcttgatgactgcatactcatggagatcttcctgacttggggctgctgcactttcccctttgctcccacaataacagttagcaacgcctctgaatattggactgatccgacagtatttaacaatttttatgttttgaaatttcttacgaaagaatttaagagacagtatatataatacattttgcatttaattttattaaagaaatctctatgctatatcatatcatgtttgtgctttgataaaggacaatgaagccaatcagatctttgatgatttacaagccatggctcttatttaacgctatcgggatgaatgtgctttctgacatgagttggaagtgatacacacttgtctgtgtcatttgcttcattttcatagctgtcagttgtcttatagagaacacctatgtgtgcctgtgtctgtttggttgctatatatataatgagtactataaaaatctaaaaaatatatatctatttaagtcttccaattgtatatataagggcactgagtacagaaacaagtgacttgtacagggtttcacaataagttgttaccatacttggaacttttggcttgttctttagactctcattatatgaggagccttcctcccattaataaaaataatacaacttaatttgaaagcagtcaaagaaggaaactatcactcaggaacaagtttaaatttggtggattgtcctctaggatatttttaatattaatctacagtgttcttttttactatgaatgtttctaatactttacattctcatgttaggaggtcaggttccataagtgctttggtgggtaagaaacccaagtgcttgtaagtcttcgtacagaatgctgcttttcttttaaaagatgcctgttaaacagttcaccaatatgcactcgcctctttccctttagtttctaagcctgcagatgagaaggaaacagaatcgggaagaaatagccctgaaaaaggtactacaatgacaatctaggcatatcattcagtttattgaatgacttattctataagtatggatagctgtaaaggggggaggtagagttctttaaaggctgtagatgtgtcccaatgaaggttttagttacatcgtattagtataacagtttattgtttcttcttgtgacacttccatctcagaagttataaaaatgtaacactaagtgatccatattcagctttattattttaaagattttattttaattacaatgtaattggtaatatttgcggctggaattcagacagtatgtagtctttcttagctccagataaacctaaccagaagtaaaggctgcaataattttgccaatatccttttcagacttctttctttttatacacaaacatgtagatatatttctttttaaaacattcataaacagtggtctactgggtgctattttcttattttgaaatatatcatagataattttccatgtctattcatttgattttcatttttaactttcaataggaacagaacatttcacaatttaattgcaagacttttttttcaatcactaacccaatattgatggacatttaatatgtttccaattattttcactgcaaactatgatgcccaaaatttacatatatatttcagggcaatctaagcgatatttctttacaataagataaatacagagaagtataagaatattgaataaagtagtattcacctttgatattttaatagagactatgatattatccagttaaagctcatcattcttcattttaaaacatttaattaaaaataattcccgaagatctagttgaacataactcttccactattttacccagctttaaagaagatttaaataagaatttaaaggtcacagaaatatcatcttaactgaaccctttaaacaaatgaatcaataagcagtggttttaatttttgaaaaagagctaccattagtgactttcatatgtgcatatgaagaactggatatagaaaatattaaggatgataggatatatgggtatatagtgaaatttatcatgggatcaaagtgtgctattttaatctaaatacatcatttttactctttgctcatatttttgctattgcctaagtttgccaaagaaaaattttgatctaaatcagtgactctcaacctttccaattgtggtggcttgaatatgcttgtcccgtgagaaatggcactatttagaggtatggccttattagagggggtgtagccttgttagaggacttgtgttactctgggggttgggctcctagcgctcaaactccactcagggtggaatcagagactcctggctgcctgtgggacagagtctcctcctggctgccttcaaatcaagatgtagaacttttaactgctcccacaccaagttcaccaatatagttcccaccatgatgataatggactgaacctctgaaattgtaagccagacctaattaaatgtttaaccttatacgagttgcctcggtcatggtgtctcttcacagcaccaaaaccctaactaagaaagaagtaggtactaggagttgagtattgctgtgatgagcctgaccatgtttttgtttggagggatgtggattttggcatttgagatttggaaagcaatagaatgcttacggtcagacctaataggccactctggaagcattatggaagattttagtgatgagggtgatttgaaatctggggtcccggttcaagaggtttcagaggagatgaattttagtatgatgcctagagattgtccttgtgatattttggcgaagattgtgactgctttttgcccttgtctgaagagtcttcctgtggctaaaataaagagatttagattaattccattgacaaaggaagtctcaaaaagcctagcattgactctaccctatgggtcacgcttatgaaaaccatttttgatcaagcatagcaagcttagaatagaaaaatatgaaatgtgtggttcaagtattaaaggggaaccaggaagtagaatggagatattcaagatattcaaggagataaatagattaagggagtggtaaccttggggcaaaattccatcaaactaagtttattgtttatttgtttgcagttgaacaagggatagttatattaggtattattattatgacttggttattgttttcatttggacataaagagatatgattgacaaattgacaagggatggattgtgatggctattctcgtttgtcaacttgactatatctcaaatgaactgcaatgcagaaatggagtgcacacctatgacccagatcttgagtcatagtggccatgcttataaagatcttgtgaaaaggaattaaagaaaagcttaggtccaggagtgatggtacgtgcctttaatcccaggagacagaggcaagcagatctctaagttcatggccagtctggtacatagcaagtgccaagtaaagaaaatctcagttccaagagtggtggtatatgcctttaatcccagtactcaggagacagagacaggcagatctctaagatgtaatagaatcagagcctcctgcagactgccttcagagtaagatatagaactcttggctcatccagcaccaagtctgcctgtacaattccatgcttaccacctctgaacctgtaagccagtcctaattaagtgttgtcctttgtaagagttgccttgctaatggtggtgtctcttcacagcaataagatacaaatgctgtgaccctttaatatagttcctcatgttgtggtgacccccaaccataaaattatatttgttactacctctctagtggtttgaatatgcttggccaaggaaattgcactattaggaagtgtggccttgttggagtaggtatagtcttttggaggaagtgtgtcactgtgggtgtgggctttaagactgttgtcctaactgtctggaagccagtcttctcctaccagccttcagatgaggatgtagaactctcagcttctcccacaccatgtctgcatggatgctgccttgttcctatcttgatgataaaggactgaacctctgaatctgtaaactagccccaattaaatgttgtccttataagagttgcattggtcatggtgcctgctgctcacagcagtaaaaccctaagacatcttcataactgtaattttgctactattatgaaacataatgtaaatatgtgtattttcccatagtcttaggcaacccctatgaaagggttgtttgataccccccgaaagcgtgacaacccacaggttgagaaccactgatgtaaatggaagtggagaatatattctgaaggccagtgagtgagatcaaagctaaattcagatcatgtcctggactgaaagagatgggctgttttacctcggtgaaatagctttcagtttcagtttttgggtttttttgttttttgtttttgtttttgttttgttttgtttttttgagagttggggaaatgttgtgagctgttcattacaaaattgtttatttctttcattcaggcaaaggaaaaattgatattcaagcctatttaagtcaatggcaagatgagcttcttaaaaaagaagaaaccattaaagatttaccaagaatgaatcaggtattcatttttccaattcaattttctaagtgaaaaattcttaatgttttttttaataatgtgagagcatggcacccatggttcagttaccagtatcacaaaaggaaaagaaataaaaataaaataagctacatactataatcaaaagtgttaagtaatctacatgtaatctctataagagtcaggaaatcatgaaagaggtgaacaatcttttaaattattttacacttttaacacttaagtgtatttagtgtttctacaggaaattttgtacataggacatatttccaacgttaaaagaatatattaaccgagtagacatttagttgtctaccatatgtcaaatctattgctagttactaaaatatgactaagattgatttcactttagtgcccaatattcttatagttgactctgcataggcaatactaaggactaggagatgtgattgaaattgatctctttgtataccttgcccatccgtatgtttttatactctacaacaaaagactgattgatgttctcatactcaagtttcccagaactttacaaaaacaaaaacaatcaaatagcttagagtgtcttaatgggctttccagtttgatagttaaataaatcctttataaaataagtatattacatatttattcttcaatctttataaatgattgaagtacattataaatgtactatgaaaaggaaagaggaaagcatgtttataatacattttatgaagcatattatttgtgcttggtttatatccatatcaacctttaaggttagatgactgaattgtagaacacttggatttgaatagcttttaaattgacaagtattttctaggactatctggaatgctctcaggacagttagcagactgactagctcttcttaactttggccctatgtctgcctttaaagacaagcaatccaaagggatattttagattcctttcactactaggtaggtctcaaaaagtcattcttcccccccaattaaatcaccttcatttagtgcccagtgtagctttttgagatcagatgaagtccataatccttttcttaaaattggttgatgagatatacatggaggaaaatatggaattttgaataaccaaaattgtcacccaacactaaataatcctggaaatccagtatatttcagccaataaacctgtcagaaattagtttggatatgacattctttgattaggcagtgtgtgagatggctttagtggcatgttctttcatggttcatacttaatttccttgagcaaagatgtatcatgaattcagttctatgatgaaggttatagactataaattttatacaggatgctatgcacttctgagttccacttatatttgctaagtttaatgttaaaatattctatttccaacttgtgtcttctagtcacaatttattcaattttcaaagaccctgtataatttatttcatgaggaccctgaagaagagtcgctatatcaagccattgctattgtaaccaaccttctgctcaggatggaagaagttggaaggaaactccatagcccggcatcatcagccagtacagctcgtgattctggacccagtgaagggaatgcagagagcagtgtgaagaaagatcttccctctcccagggaagaacatcagtggtcgtttgcatttgagcagattcttgcttccctgttaaatgaaccagccttggtgaggttttttgagagacccttagatttaaaagccaagctagaaaatgcgaaaagctcccagctaaggtctagaaccaagatgtaaatctctgccatcatcagctttgccaagattcctgcactatcagcctgattcctgggaatacttctcagggatatgttgcattactgatgtgctccaaggcagaagaaaaagatactcagaagcacaatggttcattcctttgtattaaatgcacttttaaaaaattctccccctgtcacaagataagcagcatcagggtcacatgctcagtgggaccaccagagggcgccaccatatcactttagtgagtcagtcacaagtttgtcctgctgtttccatgagattgctggtcttttgaaaggtggtaggatatttattataatgctgttatggcaaattggtaagccttgtttttcaaatgaccccagtcttataaaaactttacaaaactgggctttagaactgtagccttaattatctaggaagttgccttttagggccctgatttccaagttatataactaaaagatttacttctaaaacgtaattttattcagtacagtaatacatggttttacagtaatacatgcaacttctgcattctctgctctcgagggattgagcactcggtgtttaacgctactaactctgttgctgataaacacaaatcaagaagtctaaattctgggctgatataaagaaaaacaacaccagatttagacttaaatcaaataaagccagcattttgaaaagaaaggttagaagacagtttagttaactatatagctctttcagttagactgagacacaaataaaaattctctagagtggcattgtttattgctttggtttcagaatagcttctgattgcttgtgtcccagctttgtagtttgaatttttacccattgtattttaatttatagtaggtagtgtggaagagtttcactaagactgaattgctgtattagtctggcaagcatgtaaagtatacttcatgtaatacttactagggtactatatagaattgccagcatctacctaaaaaggttagacttagatgtgcaatttttacatactttatgctttttctatggcagtccatttaaatatatatggacgctgatagcactttcaaaagaacaaaacaacaaacaaacaaaaacaagcaatccatgcagacctgacctgtcttctgccgcttttgaagagggacttatttagcagttgacttgggaaatggggcaggaaccagtgtgtggagcttctgtcttcacactagacttggatttcgagcctctgacttggctagaagggaaacaatgaaaggatagacttccttcatggtgaccaaacaagtctccctttctgggaaagaattggcatggtcagtctttgacaagaacgtactgtgactaaaacctaactgtgttaccataccacatactattttcagtgaagctaagcacttctcaaattgtgtctttgaaaattcctatgtatcaggagatggcctaatcggccatcagtagaaagagaggcccattggtcgtgcaaactttatatgccccagtacaggggaacaccagggccaaaaagtgggagtggcggggggagggtatgggg

SEQ ID NO: 301 - DNA, 8830 bp, mus musculus; identical to SEQ ID NO: 100

SEQ ID NO: 302 - DNA, 8830 bp, mus musculus; identical to SEQ ID NO: 100

SEQ ID NO: 303 - DNA, 3141 bp, mus musculus; identical to SEQ ID NO: 102

SEQ ID NO: 304 - DNA, 586 bp, mus musculus
ccattttcagctcgagcgccaggatcctgaagcccaatggtgagaagccggacgagttgagtctggcatctctcaggcgctgctcgctgctcgagctggagatgaactccgatctcaaggcacagctgcgggaactcaacatcaccgcagccgaggaaattgaagttggtggtggtcggaaagccatcataatttttgtaccagttcctctgcttaaatctttccagaaaatccaagtccggctagttcgtgagttggagaaaaagttcagtggcaagcacgaggtcttcattgctcagaggaggattctgcccaagccaaccccgaaagccgtatgaaaaataagcagaagcgcccagaagccgcaccctgacagcagtgcacgacgccatccttgaggacttagtcttcccaagtgaaattgtgggtaagaggatccgtgtgaaaccggatggcagccggctcataaaagctctcttagacaaagcacagcagagcaacgtggaacacaagatcggaactttttctggtgtgcacaagaagctcacaggcaaggatgttaattttgaatttccagagtttcagc

SEQ ID NO: 305 - DNA, 586 bp, mus musculus; identical to SEQ ID NO: 304

SEQ ID NO: 306 - DNA, 42200 bp, mus musculus
acctaggtttagttactatgcataactttgttgtgtgagcctggcaggttttgttccctagtttgatctattcatctttctaaggtgtggttcttcgattcacagggtcccatgggttcagaaggaatacaaggccatccagggagacaggtattttgagtaacatccataaagccttgatatacaaaatctaatcaaaaggtcattttgctttccttaacctggccaaatggaaatattgcttataatgcaaatcatccactctttaataacataattttataattctagggactctcttttttgttgttattttgttgtttttcacccaaaaggatagataaccactgttaggttacattttctgttttgccatgccatagtacagtaatgtatggtagcatgttttcaagggctagcaaggctagcctgcttgtacctacactccattgactcttgtgcactttaatatgcaagttgactaccagatgctatattgtcatctggagaaatttacaaagctgtacatactctgaatgactgagaaatccctgtacaaattgccctagcccaaaccacaggccagcagacattatgtactttatgtggacttggtaatacctatgtttctattacagggaaagaaggggacttcaggttttcctgggattaacgggttcccaggaattaaggtaatatcattgggaagtacaactcccagatttgagaagtgaaaaaatgagtgattcctataaatgcctacttatgaaatagagtatttttaatatcttgatgttttagatgtcatcttattttcaaaagaaatgcatataccccatgctgtacataaacctggtaaccattccccagatgtcaccaacacttagcatttaaaatcctctactgacaatgcatcctcttattgcttaccttaacacccactctgggtatttctctgaataagattttagttgctgagtctgtatttgcggagattaggactctttcgactcccttgccattattcacacaagggtagtagcctttagaatcttgggcctgctgagagcagaagaaaaagattgacattcagttttctccttagctattttatctgtgttgtgatacatttcccaggtccagaaacagactgtcttgcagtggtgttgcaaaacaaaactgagtgcactagttcttggcaaatttgcagatcaaatttgcagatctggctaccttatgttaccttcatctttgatttattgttcttagaagttaacctctggaaatcaggagtcaaggagcaaaggactttctacttttctggggtcttgctttgaaggcaagtagattttaggtgatggagtcaagacatcttttgtgttcaatttatttaatattttcagggtgaaaagggagacattggtgttcgaggcccagacagtttcactgatgcagatggcgctgtgatctcaggtgcaattctttgttgatttgattggagaagaaaagagaaagtgttcaattctgtatctcctataattgttgaaaagatacattgtcagccactggattgactggatttctgacagtatcaagggccactcacaggtcctgaatttactgaatgaatgggattacaaattcttaagcagacaagccaagtcaagcctccgtttgtgtgtgtgtgtgtgtgtgtgtgtgtgtgtgtgtgtgtgtgtgtgtgtgtgtgtgttgatccatcaagatgagattttggactttcctaagcctgaattaagttggcagaaaggttcccctggcaatgcttagagagggattgatatcctcctcagctgggttgcctttagcctaagactatagagtatgcagggtttcatgtagataatcccaagcaggctgctgatctagttgctaagagacctgagaaggatgatacttagaaagtttgttcttcagtccttatcctagtcactgggtatggtctactcttcctttctgcctctaccaaagatctaaacactcaatgttgataacagctttgtgagctctactcccaggaaacctgtggcaataagtgtttgctaaccatcttaatctcaacagtagacatttaaggcaagaacagtagaagaaccttcctagtactttctaggtcttgtcagaaaagtaaggctctaacaagaccaggtttgaggtactaatagtaacttgctatgatgatttgtgtttgtaattccagaccttggaagtctgaaacaggaggaaagtaaattcaaggattctatgagatccagttaaaaagtaaaagagtagcagagccttctctctggtcaattaagaccattagcatctcttatcaggcattttgcagcaagtgtgatccactatttactccttttttcactgtaatgtcaggttatcctggagaccctggtgtgctgggccttccaggccttagaggagatgaaggcgtccaaggccaacgtggcccttctggaacccctggcctcccatcattaacaggtgaaacagactaatccactctctgcattgaatagtctgtactctaaatcctagcatcttcctctgtaactgggaatccaataatatgtctagccaaggtcaaaagaaagatagactggtcagtaaattctccaatgactagctcaaagctagtgtatgtgtagagagggcctaggtaagcagcttcccttgagataaatgaggatcacagatggaaagacaattccagagtgccattgaggctggaagtaactagagatctgggtggggtggttgaagccctctcactcttcactggatatgccatctaatcttatacttgccaagagtttttaacagacgagaagctggccatgcctgaatcctcaaggtggctactaaaagccttcatggggcgggggtgggggtggggactaaaggtatagctcagttgaagataattccttggcttgtgcaaagcaatgggttctattctcaacatgagacagttagaatatagagatatggatgttatactagatagatagttagatagatagatagatagatagatagatagatagatagtagatagatgatagatagtagatagatagatgatagataagataggataggagaggagaggataggtctgtacccaggccctcctatggacttagatgtagcacaaaatgcccccagcatcctatggatgatacccttgaaccacacaatgcaggagctgtaagccattccatatggcagagaaagagcatgccagaatctagaagacagagctgtccctagtctaaaccctcagatgtggatctagtaacatcactagtctctaaattccttagagaggagcttctgtaaggatatttgtgtttctaaggcagccattcataggagacccagctggacccagcacctaagtagaacaaatggaacagtgagagactggaaacctagctttccctcacatgttaacaaccacagtttctcaggcagttaggctaactgatccccaaaaactttcctaactctcatgaaagagaagagcaattggtttcccaaattcttcccttgtgttcttttgtaaacacactgctgatcagaatctacccaaatagtagggtgctatggtgagcatttttgtgtgggcttatccttccaggtcttccaggtgccctagggcctcagggatttcctggcctgaaaggagaccaaggaaactcaggacgtaccacctttggagaagctggcctacctggcagggttggtttaccaggtttaccaggcctgccaggcccatcaggcccacctggtaagttattccttctttaaaaaaaatttttgagacagttatgatctagaaccactctgatttttaggggttccctcacaggagaaacagttcagccatgatagctaattgcagtgggacagtgtatcaattagaggtttagtccattatcataatgcaaggaagaatggcagcacccctccagacaaggtgctagagaagaagcccggagttctgcaacctgatccaactgcagccaggaaaaagactgtctgatgggcagcttagaaggaggatatttttttgcatagggtttagcctgagcataggatctcaaagcctatgtgacacacttcctccaacaaggccacacctcttactatagtgtcatttcccatgggccaagcttattccaaccaccacaggcagcaatgagaagtcctacttcatctgtgttggcttcacctttactgacagcaacagcactggagtgtgcatttggttacaagatgaccaaggtggcaccctgatgagggagcaagcactagcttctgtactcatcatccttctgtcgtacacagctcttagtgcccacagcaccccctgcaccactctctacccgtcccactacatacccccctcaccaccaggactttggcttaccaggttctagggaagcagaactggattttctgggtttgctgtactcaacagagttacaggtaggtgggctgagaatctgaaggaggagaagctatgcctagatcctcaaggtatctgctaaaatcctttatgaggctagatatgtagtccagtttgataaagttttcttggcatgtgcaaggcaatgagttctattcccagaatgagatagatagatagatagatagatagatagatagatagatataaaatatgcatagataatagatatgcttatctacgtaggtgggattctgggttgtgagaaaaaggctagaagtattgcccagtttatttgcagtctaatcctctgacaactgctactggcacctgctccctctttttcccagaggaaactttctgggatagagactggcactgctgagttattgagttactatgttcatctctgagtgcccagaatctactacagtgtgtggaacataacagtcatcattctgctagtagagtgaatgaagccaaatgagagttcttccctgcagacttggcaggaatcttaggctgggatttttttttccctcctactctactctgtgtgttgagcttcaaggacccaagtcttcaagattaaggtgagtacttaggcttacatcaacctctaaccttttgcattctcttaaactctgcaggtcgcacatttgagactggacatctgtccaacatagagcctgggttccctggtctccaaggagaacaaggtccaaaaggacatcaaggcctcaaaggagtaaaaggtcattttgtttgtctcctcccccccccccacccccccccccacacaaatccctagagaggctttaaagggatctatcacagcaatagccttgagaatctgaatgtaacctcttgagaggttatggtataagactgttagaagtgctctaattagggctctcagaatgaagctggcaatggaggtcacacaggacaaaaagaagttttccacccctcaagcctactgaagctattgttagcatctcagggtgctgaccatcacctctaatcccaatttgcaagactttagctaaacactgcttcccaacaccattaatgtgaggactctatgtaggttaagagtgaggcatagaaaaagccacctggctccaataaagtgaacagggtcctggcaagctgccttataaaccagtatcacaagtgctttatccaaattgactatgcctattccaaatgcttgggatcagaaacgcttcagaattagtagtctttggactttgaaatatttacatagactttcccagataatcattcctaatatgaaaaaatccaaaatctcccttgcttaggatttcagagcatttgtgctcagtctttctttactagtctgaagaacaggaaatgctctcagagtttccaagatctcagttttctaagagtaagaagagatcctttggaatcagaggggaatgcagccatccacagttgtcacttctcactctggagacaatgctcatgcaatctctgtagattgttaggttgcgtacttatgactcctttgcctatcttccaaagtgctttgctgtaactgagttggatggtgcacacttgtaatcaatcctgctagaagcagaaggatcagaaattcaaggtcatcctcagctacatgagtttgaggccaaccagcacacatgagacctgttttgttttttttttaatgcacttctctgaaactcatatcatcaagtatatacataagtacatgtatagaattagattctagcttccaagttacctaagtagcaatttatggtcctcagcatgtgactcactaatagccggacctcatctcagactagtaaaaacagactcagtaacacagatgccttctgatggcactgagcttggtctgagtctcggaaagctgtctgatttccacccaagggaggctaactaagccactcttttccatgagtttatttgatgtagtctgtttttccttcaggagactctggtttttgtgcttgtgaaggtggtgcccccaacattggaccacatggggaaccaggtctgcctgggatacaaggtcccattggtctacagggttttaaggggactaaaggagatccaggctcaaggggagcatctggtcctgcagggacgccagtaagtcttccgtaaggtctttggcacagagggaggaatggaggatttcaagtgttcttcgctccctatcaaccactttcctaagacacatgaaacaaagaggagtaaaacaaatctgtgacaacaatctcagggagatttttgcttaaactcttgcagttagtcaaataaattcttgtttacccttggcaagtaacaaattgcagtgttaatcgggtacacaagaaactccctcaacaatggaaaagctacaagcactcatttttaagtctaagctctaattggaaattgtgttgctggaggaaatggaggaaaatttttcacagggagcaatttgagagcaacttagaaaatgaacaaaaccaaaacaaatctatgggcttttgatgtgtcaacatgaagaaatctgaccagaaggtctctaaagtctctttgtttccctccttcctttcctcatgcctgactgggtgatgctgcttaggggttaacataaagctcagtcctcatagatttcaaaatttagaaaagatacaggaaatgtgaagtaattacccaagacagcaacataatcacatgcccagaagagtgttaacaatatcctcaaagtacctgttttaggtcatatctttgctaagctatgaaggctgtacctcccgattattgtcttttgtttcattgtcaggggctatttggacctagaggtcagactggcctcaaaggaaagaaaggagaaccaactgtcagtagaggatcaaaaatgtcaggggacaaaggtgaccctggtcctcagggtaccccaggtttggcaggaactccgggcaaggatggaagaccaggtttaccaggcctcccaggcattcaggtaaatggatcattcttggatggttagccctatcaaccaccctactggacttagggacaatctgctggttatcacctcatggaataagatagactagggaacttgagtcccccgaaatgttgactcaatgctttattttctataaatatgacatttttttcccagaatacttattgataagtgctaggaagagttgaacacgttcatttaaaacaactcagcttctcaatagctccttcctccaagatcaacagttgttcattccctgctttcttcccctagaccagcagttctcaaccttcctaatgctgacaaatctttaatacagttagttcctcatgttgtggtggtccccagccatagagttatttccattgctactttatagctgtaatttggctactgttatgaactgtaatgtaaatatctgagctgtaagtactctgagggtcataacccacagattgagaaccactgacttagccccatctagaaccttttataaagctagattatccagagttgataagatccgttttctctaagaaaattcagaggttgatcaataaacaactagagtgatggagaattttcacaaaacattgttcactaactatctctttcctgtggttagaagccttttcagataagtcttaaaatgatcttttgtcttctttttctttgttctctagggagatggtgggtctggcttcccaggtgaaagagggttaccaggacttcctggtgaaaaaggccatgatggtccaattggaccaccaggaattgggctgccaggacctcctgggccccgtggacttcctggagataaaggagtagatgggttaccagggcaacaaggcctccgtggagctcaaggtgagtcatgtaatcagatagttttggacttggaaaatcaacctttgtaaaatgcctctgactcatattatgaaatgcgtcataaaaaaaaaagagagatctggctagctgtaatcactccagtcaatcctcaagagttttaaaataggaaatggatcataagtgttatggtaagttcagaaggtagaacaatgtggatttcagctctgcttaatgaggaccctgctacttgagctgtctgaaatgtcacagagctatctagacactttatgagctcatagtccatagaaaaattcaaggagagggtggatgactgtgtttctaatcaaagtagtttgtggagagtttgataaatagtcctctaagttgtatgatcagcagacaaaaatgctttcctatctgacagaatctcagattggtcagagattctaacctaatctttatatgatacctaacttcctccctttaaataaattattttcccacttggcattttgagaatataataagcaacactcctgattgtatattatgaaggtcccatactataacttgtattttgtgcagtcagtacactccttcattgtttccagtagtgacattacacttcttactattagtggcatcacacttgtaattgtcatcaaagtttaaaaaaattgaggttatctattctcacttggaaatgcctcccattatttcctttatcttcttgctagtaagttctcatgatcccatacttagtttatcaaatacctatgcgcttttggaaaagaaggatggatggatgggcaaaagaaatttcctaagtagtttctcttctattccttgctgagtttccccaattaaattatacttatacacattgtagacgattaaataccttttgccatctagccttcctttgacttctacatgttgttattattgaaattatgcccacttctactagtggtttcccctttaacaacgtttcaaagtctctagcttctaaagatgatgatacatcttactctcacaacctgccaacagagtagaacattccttcttgcagaagaaaagcccttcctaataaccttgaatgattaagaaataaaaaataagatattatatcttatgtgttcatattttaaaatctatcttgatataataatcatgatggcataggctaatactgcattcaagattcttgaaaccaaagcccttgaacaagtttgggaagcattctacttccctaggccatatcttatcaaacaatattggttttcctttgagaacttctggtttcaacaatagatttacttctactgtattcctcagggatattagtcatgtattttctattgctcttcagctgttgatggatcaatcattctaggtcagcccattttaaaggcaaccagattctaaatttagttacagtgcatgatacctataaacttgtacatcctcaagtcttttggatattatcaatgttctatttcttggtttgagatgaggctgcatcaatgggaagaaacctatgggatcatttctatctcaaatattactagttcctgtacacagaaagttctcaggaagacagagctagtgagcctagcctggaaggaaccttatatagaaaaatccactttttgaagtacctgattttcaaacaaatactttatttagattttgtgttggggtgttatatggttggttggttggttggttggttggttggttggttggttggttggttggtttgagacagggtctctctacatggtcctgggtgtcctggaactcagtattacagactgggctgaccttgaactcacagagatcagcctgcctccacctcctgagtactgcgactaaatgtttataccactccacacagaaaatacttcatttagaatgttaccttgttttttctctatagaagctgaatataactcactaaaaatagtattctttccaatcatttaaacataaattttgaggcttctagtttatgtgttatagccatttctgttagcacaaaaagtaagatgttgttcctaaatgttgcctacaccttccagtggtaacccagtattaaacatctccattggtagtgaagggcatgtagtcaatcagaagctcttcagcccagtgatgtgaattattacaaacttgggtacattgatagcttacggtccccatagaggctatggctccatcttctcaacgtaatctatcattcaagttatttctccaagtgacttctgtatacttgatcgtgtatgagtaccaacactccactcaatcctcacgattgaatgtggttgacaggcatatctgggctgtacacaagacctcccttaggattcagccaacatgtcttggtttcatttttttctttccttgattggtctaggtgattattgctgtagcaggggggaatattatttacctattcacctttgtctctgaccctcagagtgtcttaaactacattgcacttttttttttcttttgaggcagggtagttgtgaggctgggatgcagaggttgccactggcaactgatactactttaatggttctttagcacatactcctgggaactatagaaatgggtatgcagactctgagaggagctgatttcctttatctcacatgttgatggttacccatctcttaactaattatattctctgaacttatggggtataacttgctttccaagatgtatgtgcaaggagtcaaataattctgatctctattatttggtctcagaacaaatagaaaggatagacttgaaaactagagttgctttatattctaaagatgaattttggcattaatggtgaaaaatctgaataatgtggtcatctgttgcacttctaaagtataatacggctagagctgacttctgctttattgagagtggtctgaattcagaaatgggaatcccaaaacatggcaataagtgataaaaaccagatctggtacaatgtaaaatctttaaatttcccaccactttaaacccctccttgtgaaatacaatacagtgtagtctatgtccaaattatgagggcataattttttcctttcattaaaaaactctgggccccagaagaatataggattggagtctctccctctctctccttccttccttccttccttccttccttccttccttcctcccccacccccatctctctctcagtgaagcacctcaccaaaaggtgcctttcaatgccacacatttgtacaatgggcaaataactctgagaaacagttttgccacctcagtgtctggcataacggaggtgggtgtgacgacacatgcaggaggattcatgcttcaggccatctttagacctgtgggaatatggccacaggagcacaatgactagcaggcaggaagctggggagttgacttacaggagcgcctctgaagctctctccttaaggaaggtaagacctgccattcaccgagcatgcagcaggatggcaggcactacatcaagtgcctctgtcttggtctcacacacttctcacagatgccactggacacacaaggctcagagaccataagttttccccacacaggtgtattataacagaagtaagttctgttcggctcctaggtccagtataaccagtacattatactgttcaagtctcgatgttgacttagaactaaagcaagtgatttttttttcaaagcaagatttcatattagaaagcaggagtgagtggaaggaggagtggcagctacttgaatgagcagtctgaatcagaggctttatgcacagttttcaaaaataatctgaggctgtgctggttacttttagagccatgtgtttggttttttgtttgtttattttttaatacaaacaaatgctacagagttttattggaactgttggctctgtggtttaagacagaccttggtggattgttctaatagaacaggctaattttagttagcatagcacttgaggaagtccatatgtacacagtctgtcactggtagtttattaaacttcccatctgtgatcctatagactctttatttgcagtatgaatgagcaaagaatttcccacagaaaagactgtgcatgctaatttcaacattttaaatactaagattgactacttctattcctttagtagcagagtttatagtttccaataatgatctgaggagtcataatttgtcatgactaggggtcttatgtgtttccctagtttagatatacacatatctgaacaaggatggccaatacatttcagtagactcaaaatgaactgcttttaaaaagctccatggtttggggaaaacctccttgcaagaaaagtgttagggctagagttagtggtttcaagcgttgtctcctctcccagaagactgggcatctagtcccagcacctacatggaggctcacaaccatctatgactccagttccaggagattcaacaccttcttatggcttccttgggcaccagtcacacatgtggtacacagacacacatgcacgcaaaatgtccacatgcatgcaaatttaaaaataaaaaagttcagatgtgaactctaattgttatggcttcaaattatccactctaataatacagcatcatggacccttagtgctaaaacccaagtgcccacgctagagagagagtttatctaagggactggtgaacggaaaattgctgctcactgctgttcctgtgcaggccacctctaggagtacttgttaggtaacaccctctgcctagatgactgcttgtctgtcaggcaccagcggttcaataagtaatattctggaaccctgaacactcagaacaaagataagcatttgcactggtattgtctcccaaaagcttctcatgtcaagctttctgtgtgtcctactagctgctgggtggggagaatacaattttccactaaatagaatggggggggggggaccatgtaaggggaactcttctctgacttgctgagctcacagttccacatgttatcatttccaggagtcaccttgccttgtatcattcctgggtcatatggtccatcaggatttcctggagctcctggattcccaggtatggaatgtggccagagaaagtgagcacactttaagggcttttaatccaaggaagcaagaatgccaatagcacatgagagtcccactgatggattcctcagcaactgaggtaatggcttacagagagcgtgttatgaggaaatgagactcgaggaagccagcaagagagtagactacttgatcagacatcataaatctaacttatccatgctagcgttcctttctactcactatacacatttggggtttcaggctctaagggagctcggggcctccctggaattccaggcaagcctggcactcacggaagcaaaggagggcctgggagtccagggttaatgcatctcccaggattgccaggtaaggaaaagggtcatcaacttcctcctgtgttatgtttggactgttttcattctccatcgaggactgtaagctaggtctgctccctggattagccgagatggtttgaatttacttccaagcaaaaatgccatagagcaaagaacagaccgtggcaagaaaccaatggaagcaatcccttaagtctcagataaggaaactgatactttacaaagccactagtgacaaagccaggaggctgcagttgtctgcttaccactccagtgataatatcctagataaacttcttagaggccaaagaaggaagttcacaacagtccaaaaaatgctacccatttcttttccttgccagagttgttccaacctgagctccacaggactgcagtgtaccactggtcctccagctgcattccctggctcagcacctacatcacctgggaacctgatagacatacaaattctccacctgttcacaatagctagtgagcagagactttaggagagagccagtaatctgtgtgttctgaaccaccattgccctagtagtgtttgagtcttatctggatgtatcattgcttcatttctttctactctcttctgcccactcaagaagaggaaggccatggcagcaaaaggtttaaaactgtaggagatactgagctttggccaaaagacttggtgtgactgtgttcttagcaaccattgagccccaggaacagaaaagaaagctgctgagctgtacctattcctagtctcaccaaactagagcctccttccactcgtgtggtgtagtccctacttctgtacaagccctccatggagtgaagatcactaatcatgattaatatatgggctttgtattagagaaatcggtctcagatgtctaccgagatagcttggttctaagcatccatgttctttttaatttttgcctctttacatttagggtttcctggagttcgtggggagaagggattacctgggtttcctgggcttcctggaaaagatggctaccctgggaaagctggcagtccagggttaccaggtttcaagggagctgctggtgacatatttggtgctgaaaatggtgcttcgggggagcaaggcctacagggattgccaggggacaaaggatttcctggagactctggccttccaggacccaagggtgactcactctacttgaccccttacttagcattatacagacagcattctagtaactgctgtctttgcatggatatgtgtgtaaaatgcatgtctggatctggtatggttaattagggagcaaaaatggcattctattctgtgtctctttggggggcgggaggaatttccttatgtggttgcagtccattttccttttgtagaaattccaagaatagctataaccaatagtcacatttcttataatgctgttgttgagagaagacaatgtcatctgaggtgaatcctggaccaagcccttctattggaagatggtttgatgacccagcacctccctgttaaccagactataaacatctgccacctcctttttcttaggtttgaatgggaaacctggtatgctaggccccaagggtgagcggggcaaccctggaacatcaggaccaccaggacagccaggaccctcagggtctactgacccatttggcatcaagggcacatctggattcccaggagcaccaggccttccaggcatctcaggtaaatccattgaaggaagaatcctgacttggcagggccttacttagacaaaggcaccccggggactaagagtggcagtatgatatgctcagcacctaggatatttgactttcctaatctctctagtttcaaatcccagatcatcctggctgggccagaccagaacacattgctactgtttaacttctgatccatgacaacaaatctctgtcacctcccttttccagggcctcctacatccttttggtgtttttggcctgctgctggcctttttctattaaagaaatcaccctgtgttgaatggtgttaaaccctcgctgtggctatgttaagcctgctttgagctacagagaaactggagctgattgtgacctcttccctcccccaccagtagcctgcctgtcaggagaaaatgcctctgagggtccataggcaaatagtggctttcactaagcaatgaggactgacacccactggtttcagcctaacatttgcagttcacctttttgtttgtttgtttgtttgtttgtttgtttataccatcatccttactctgacacctagactgcatcactgaccaagtgactgaagctgggttatttgcagagctgttaatatcccttttatttcctctatcctgtttctggggccttcatataagttgctgaggtgaaggttaaaaacaacaacaacaacagcccacaagctcactgactaagactccccatggggaattgtgtgattgtctgctataacaaaccttgcttacaaggccagagatccctgaaccgctgctataaggtttgttcccactgcattcccttctcctgttgcagacttatcctcattgcttcctattagattcctgcggctcacagctacttgatgcttttcatttcatggaaagctaagtcagccattcattgaggtccttgggaacccaaatacttctgtcctcagtgatgtaagcctttggatttttcatttccttgctttgtacctggacattcaacttcggcagcagctcaggaggttaatcccattgaccaacttcaagccctggtgaaagaagactcagaatacctaagagaccaaatgggccttgggggtttctacaatacttggcactagggggtctttcaaacctaatgccaaagaactggctgatttaactgcttgtttgagggattaaaagggcaaccctagatgcaagactccctggaaagccagaacaacagttcagatttaacctctatttcatgaattggctcaggaaacaaccattggaacttgattcagggttgaagtcccagggaaactagagcccacttgccaccctggcttcccagagctccatttagaggctcctctgtgaaccacattcataaaggaagaagttataattacaaggtacttgcttttcctacccaccactgtgccatgctggaagtgatgagcatttagggaggtgctctgggtggtaggtactaatgctctgaccaactcagcaccaggcttcttggcatctctttttaggtagtgttaaaggaccgtggacaaacccctcctagccagccaaagagaacctctagaaataaacagtggcccaaacctgaccagagcctgactaagctgacctgtgtcctcttctataaccattcagggcaccctggaaagaaaggtcaaagaggagacataggtcagcctggatcaactggaaaaagaggtctacctgggataaaaggccttcctggtcctcaagggtcacctggcttcctggggagcccaggtttgtcaggcgtcactgggttgccgggcatcgaaggccaaaagggtaagtgaaataattaggaagaccagtaaagtagtcagggtttacccaaagggagtgtgccacaactgcccaacttgcctcctcccctcttctctgcccaggaatagaaggtaggcaggggtttggggggggcaaggctaatactaaaggaaacctgtcacctaacatgaatcactcaacctgcttgctgtgtggaacaatgggctgatcaacagaaaaggccagctacacatagatcactcagtctgacacataccaaggagcctgacaactctcacttcccgtgactgacacagcagtggttaggtgtatggcatctgtgtttcaaataggtgaaaaaatggctagtctcagagcagcacacacagctggttagtacaaagaggcaagatcacacactcatctcttccccaactacaactaggtgtttcttttctgtgcccctacacgcattctgaacttaatgaattcaagcagaagtgcccacgtcttcatttctgtctggtgttcagtgctatgtggctgtttggaggaatcctagaataggtaataactaacatgcttggtaaagactcagactttggagttagagaaacctatgttcaattccttcctcttcaccatcttagctctgtaacattgtacaagcaattcaacctttctgtgcttccttttctttacttgtatatacaatggaaatgataatgaaagaaagtcttacttttcaacaggtgaaaaggggtcctctggaccagtaggatttcctgggttacctggtcttcctggtcttcctggagctgatggattaaagggattttctgggtcatttggaaaggtgggacaacctggacagactggtacttccggagaaaaaggtaagggggtatggggagacagaggcagagagacaaacagagacacatacacacacacacagagagagagagagagagagagagagagagagagacagagagagagacagagagagacagagagagagacagagagagataaagagagagagatttcaagacaaccactttgtttttcaatatgcattttgcttgtcaacttggtcattcatctgatgaatgccacatattaggcaaaactttggacttccaaattaagtcctttgagaccaaaaggctactcactttagagtcaacagtacatgatatggactatgtgacaaccgcaaaagaaaatcatagcataaatagtttttaagaaggaaaagagttatattatatatatatattagttatatatattagttcttggtttcagaggagtccattggtgatcagttgaccttgttgattttgaacgggtggtggcccagtgtatcatgggacagagcttccttcatggcagctgggaaaacaaaaccaagaagatacattcaataacttgcctttttcccactgagctccacacataaaaggcccctcatctcccaatgaagtcagtgcctgagaatcaagtctttaccaaccaaatctttggggaacacttactcaaattaaaatggagccctccacaatatactctttccttgaaagagaatttagagtagggcctaaagttattggtgactttgggtctggagaaggagagagcagactcagaaatgcaaagttagaggctggggtgtgaaagaggacaaaaaggtctcgaaactcggtgtgtgtgggaagaaacaatacgaaaggtcatatttgtgtgtaactttgtgcataaactgtgactttgtgtgtaaactgtcactctcctgatgactgtctgatctgccttccttcaggagacagaggggatccagggccagttggcatatctagtccaagacctccaatgctaaacctttggttcaaaggagaaaaaggctctcgaggttctgctggatcggatggatttcctgggcccagaggtgctgaggcaggggatatttgggagtgattctcatgcaaggatttgtttatagccatcattggtttccttcccaagaaaagcaaagctcagacccaggaacagcagtatgggaacaacaatgaggttcaaggaggctgtctttcttcttcctaaatttcccttgctcgttgagactgactcatactattgtagaactgaaggttttggcccatagtctggtacccctgaaatagcctggtaggtagcaaggcatagatactgattgcccaatactagagctgagatgataccaatggaaccactttccaccaccactacccccaagccagcctctgccttagctaagagcacatctggactatgattttgagcacctgcacctagacaaataggtcttttcttgcctagcctttttctaatagattttgcttctttcccaggtgacaaaggagagcctggcatcccagggttaccaggtccacctggagctactggacaaaccaataccatcaaagggctcaatgggaggccaggttctcctggatctatgggaagaaggggattacctggcctgaaggggtctcttgggattgcaggtttcccaggaatgccagggaaaagcgtaagtttatacagattcttgtttttttaccataactgaacctttaaagcatgggcacatgtcccacgtccccatgcccaacccctgtcctcaagataacctcaaagtgcttgctctccatgtgtatatgacacagcttcctacctcagtattccctcctttatgtctttgttccccttattgatcccacgtggcaaagcttcctgcctacttcctgcagtctccaacacatctctgcctgctcttaaaggcaccatctcatcatgagttgctgggctcctgctaggttggcacttttcactgctcatatcaaagtgctcctagttggatcttcagagaatctcacttcttcagtgagatttctgggacttaaaaatagccgtttaagtcttaatttgcaccccatggccagcaccccacagcccacattaagctggacatattgtaaaactgtacagaccgtggagaaggttgttaaggcaaggtcttgctatgttatcaagggaaaccttgacctcataatactcctgcctaacctttgcaaattacaggattagagagaggtatgcaccaccacacccaataagaaataagtgtagggtttttgtttttacttaggattaaatatatagcctgaaacattctaggcaagtactcactctattgtaggcttagatttttcaaaacttacttttaataggggttcttaaatgttttaccctcccttctagcccatcacccaccagaggttgtggaaaagaaaagttattaggatatgggagaagtgaacctgttttcaaattgttttttggagcaaatccaatctgtgttgtcaggatatcagcagctcagttcacacaaatcagcagcggcagctccatccactctcaaacaccattcacaattcagaaacagcaggtagagccaggaaaagctgcaagactctgctgtatgctattgagaagaagttccttggggcaatttcaatctccaattgtcaggatactagcagtctagttcagtagtgtcaggatagcaaacaggaatcagcagtactggcacaatgtagaagaaaccgccaggctaccaccaaatcagcaggagtcagcaggagtgatcagaaccagcagttctctgcagtgcctctcttaaggaaggggaagatccgcaaagaagaagacaaaagacaacaaagcactggaaagttagttgtgcaagcccaccctcactgttccttgagtcctatttatactccctccaaacctccaatgggtcttgcctcagaaaaataccacgtgagtctgtattagctgacatattcagaaacttccacttcactctgccaatcagccatgagtccacagaagtggcaagaagctgccagaacaccaccagaagtttttgggtgcttttctctctgtggagtcatgacaaatgatgaccaataaacaatgaatggcaaggcgtaccaatatcatccagcattgtccactgtctgttgggttatattccttctaaataccacacgccctttcacctgtgtgccccagcaaatatcatttgacataactgacttttcaaagaaaccagaagtttccacttcactctatcactgagctatatctttcagcctagcattcagagatttcttgatagtttaataggaaggtacttgaagtaccacaggggacaagtagcaaagaatcaagtctagattatctggtcttttaaaaggcaggataggggctatagagatagctcagtggttaaaagtgcttgctgctctaccagaggacttgagtttggttcttagcacttacaacaacctacagctccaggcgatccaaagcattcttaggccatgagcacatgcacatgtgatgctctcccccctcctccctcccgctctcactccctccttcttctccctcttcctttccttttacctttctctctcactcttactctttctcacatacatgtagacataaatttctctcaacctactttaataaggattcaacctctccttgagctcgctacccaccagaggtagcagaaaagaaaagttatcaggacatggataagtagacctgttaagaaatagttccttgggggtgagtccgatcttcattgtcagtgtatcagcaatccagtcctctagcaaaacaccaacataaatgagcagtggcagtccagttcattcggcagtcaccactcataaatcagcagctgcagaccagttcactcagcagataccacacaaaaatcagcaagggcagttcaatccagaagaaactgcaaggctcaccaaccagcctgagtccaccatggaagtggcaagaagccataggatcctcatgagaagtcctttggggagcttctctctgtgatgtcaccccaagtggagctcagcaatggaacctaaagtgaaccaatacgtgcatatccttagcgaagaatagtgaagtggagcaaatcgaaggaaggttcgagctcccactgtctgtggggtcagatttattatattccttctaaacatcatccatcctttcacgtgcttgctatagcaaaaacatcctttcacccatgtctgcttcagcaaaacatcctttcagctgtgtgccccagtaagacatcatttgacgtaactggtttttcaacgaaaccagaagtttccacttcacactcacgtgcaaatgaaaattttagaacataaatcttaaaaggcagagtaaactagagtaggtttgacacagatggacttgaatttgaatgtcagacacctccattactcatctgctctgtgatcttgtgtaccttgcttaattaacatcactgagccttattgttttcttcctattctttttgttttttaaagtagactaatatccaaacttttttggacagtagtgaaggttaagtgagatgagacatgcaaagaacattgtggtcagacacattgcatgttctatataaaaaggagtctgatcactgggcccagaatacctgtagtccctacaggcaaattcttgtctttcaaaagcatcagtcaatctgatagagagactagacttacatggttgaaacattagctgaagaaatcattctagatttaaggtcctggcaactcacaaaggagggatagaaataaagtgggaataggtttggggaggtgggagtcccagcataagcagagactcacattaggaacatctgtgtctacagcagtgtgctacatgaagccaggccagaaaacaagcagaaaaatagtagggggcaccctgggtagtggtccaaagaacacagtgacccagcccattactcggcctcctgttcaaagcattacttgaagcacatttttactgggtacatctccaaatacctcaactcatacaaggcaccctgaaaacagccgaaagcagctgacatgaacactccccagattcagagtgtgtcagaaacctgccaataactgtaaataaagatctatccatccaaatgcagactagcacctgcgtgtttacagcctgttacctggtagcagggcgacctcatgttctttgtggcgcctgcagcagagttctggcacagcttagtaaaacaagactgctgctgtttcgattgttttgttttcccagttttgacagagtctcaataggtaacatgaagtttctgcctttgtctcctgactgctgagataatcagcatgtatgtgccttcactcctggctgaagcaatgattgtgtgagatgactctagagctatggccagaaaacctgcagagcagattgagtgccttgctcaggggtcatgttctatgattcctgtgacttaataattaatgcagccatacatttgactcatcaagatgggatattccccctgaaaactctaagcgtgtatgtggctcagcacctgcccatgtctagaatatacctcctgtcctgcctaacacagtgtataaccagcatctcctaggcaatggctagggattgggggagaggaggaggaggagcaagagcatctctgagctctaggcagaaataatggtttccatattgctttcaagggttcacaggggctcactgggacttctggcctcctgggagcaactggtatcccaggtttaaaaggtaaggaacattttgtcttctgatgtgtttgcctagaccaaggtgatgttctaccaatccacaactcaggagtagtgggagctgtgttaagggagaaaatgaattttgtttgtatttcccgtttggctaaacacactcttcactccttgttcttcaaagacattgcaaacaacagtgtcacatgccaaaatctcttccccgggctttcatggacaataaacaaacaaacaaacaaatcaacattccattcgcttcgtattttgatacaccgaaacagcaacatagaacttcacctcgaaacacctcttcccctgatgagcacagccccataggcaggaccaattctcttgtttaaatgaatcaccattccattctggtagtatttcagggctcacttaccatcttctcacatgtgctggaccatgtttccagtacaggggtgctgtgtataaatcatctcattctagtagcttgttagcatcccgggtccttttacccagtggatgcttttgtcaagaagcccctctgactgttttgaatctgaatcgagggggaaaatatattgaaaagactgggtgaaaaaaatgaataattgtttcttctgaccatttgaaaaataatatttttcatacctgcaggagatcaaggccaaacacttggcatttctggaagcccaggacccaagggacagcctggagaattaggttttaaaggtagggctagtacatttttgtccatacctcacaaatgcttcagaactgaagactggagtgacttttggagatcattcccaagttctttagcttccatccagtggatacctatagttttcgaaagcaaactgatttacaccactgatacgtacctttggcatggtctaccaactacctcaaacttcatttacctattttcctctaatgtttactgcaaaatatttcagcccatcatttttgattctagaaggaagccagaaactgtctactcacttctcagatgggtaacactttccaaatatgaaaacaactgccataaatcttttcccgagtttcttcactgaatcaagttccctcaacatctcaaaatgtttttaccttccaacttatgttttcccatggaggagtgcaattccagaaatagagattaatcattcagcaattgattgatcttctaggtgtcaaaggaaaagatggactagttggtgatagaggttacccaggaaacaaaggtgatggtggaaaagttggaattactggagatcctggcttccctggctccccaggtaccatgctacttgaaaactttattttgaagaagttaggattcacttcaagccatactgtattctaaatgtccaccttggtttcacacttaggacttcaagggatttcaggtatgaatggagacccaggcctcccaggttcctctggccatctggggtcaattggccgccctggaccctcaggcttaataggacctaaaggtatgtgtgtttgctagcaaggagtgggtgaagtgtctttcccccaataacagggggcaactcctcaatcttagaatgtagcagctaggcctaagccaggtaaaatggggtgttatatgaggattaattaaaaagatgggtgtagaatgagctagagagatggctcaggggttaagagcactttttctttgcagaggatctgagttggattcctagcacccacatggtgactcataacaatctataactccagttctaggtgatccagttccttcttctaaggcaccaggcacttgtatagtacacagatatacttgtagaaaaaattctcatacacataaaattaaatgagtatcaaatattaattgaaaagccagagaagtaaaaaggagaattataaatcagaatagaagaatgtcatacgcctagcagtggtgacccatgcctttaatcccaaaacttgggaggtagaggcaggtggatttctgagtttgaggccagcctggtctacagaatgagttccaggacagccatggctatacagagaaactgtgtctcaaaacaacaacaacaaagatgaagaagaatgtcagatccatgaagaaaagaattaacaagaaaaacattagttgcccattactaaaatgaaatccctgtggttgattacttagaaagaaaataaatttatcttataatttttgaggctctaattccaaacagctacggcgctggctttatggaggaatagcccctaacaatatcacctcacggggatgccatctatgtcaccccaccccacctcatgggtgatggcatcatggcatattatgacagacagagagagagagagagagagagagagagagagagagagagagagagagagagagaagaaaaagaaggaggaggaggaggaggaggaggaggaaatcacaactcaacagaaagccaatgtgaggggtagggtgagtcatactcttctgtagcaattcataattttgagagctcagggtccacgagaattaccttattaccttattccttctctgtggaaaatcccagtgaccaaagtaactttcactaagcctctcttgttaaagatcccaccacctcataatatcatcaaaatgggaactttggggaccacattaaaaccacagccaagtgtgatggttaatatcgtcaacttgatcagatctagacaagctttggggataccttttaagggaaaatacggattaggttagcctttggatatgcccgtgaggaattacctagattgggttgagttaggtagaaccaccttaactttggccattcaattggtagtggtcagagactgaatacaataggagaaagtggtctgagaaccatcattcaatgccatctgcttcatgattatggatgcaacataaccccctgcctcctcaagctgctgctgccacattttccttgatacgatagatagtcccctcaaactacaagccaaaataagactttccttttttaagctgtttataaagtatctgatcatggaaatgagaaatgtaactatgatatgaagccatagcagaaagttattactctggcatatgttgtctttctctgctttaatggtagaaccagtttcggggagaagacaactcaagggcctggcattgctactcctacattctattaaaaatacctactgtaggtggggggagcaaggttgtggttcaattggtagagtgcttgtccagcatatacaagtcccccccatgttcacttcctagcactacataaagcaagagtgatgacacatctgtaatctctgcactctggatgtagatgcaggaagatgaaaagttcaaggtcacactcacctacgttgagagttataggtatcccgggattcacgagactctatctcaaacaaacaaacaagcaagcaacatcatcaacagcaaaaaccaagaaaagcaggaagtcatatttatttggtcttgtgattttagaggttttagtccacagtcatcccttggcttcattgtgtctggacctgtggtcaggaatggtatcatgatagtgtattgtagagctgagctgctcactgccttgcgatcaagaagcagtaaaatgcaataccagaaaaaacaataccccctttcaagacatggacccaattaactacttcctccaattgcaccccactttgtaagttctaccactcaagaactcactaatattttaagtcaaacttgaattaatacatttctaaagtcaggatcattgtaattgaataacttcctaaaggatctagagaataaaccttcaatatttggtcttttggtagatatttcagatccaagccttatcagctaattaactgccatcttactctaaaagctacagtagcctttataagaatatgagaacccaaggttgcagggtgtatgttagaaattggctattcttctagagaacatcaagtaatgtctcaataaagttagagccatttctgatgttttctctccttaggattccctggagctcctggtttacatggactgaatggacttccaggcaccaagggcacccatggcactccaggtaagaaaggccctgaaggtcaaggtcaaggttaagggcataaagctcttccagaactgggaggagttggccatgtgttcttgactgtagtacaccccatatcctgggagttagatctcctcacttgtcttcagttggagaaggaaagaggatgtttcacctttctgtaggaatgagctcttcttctagaccacagggaagtcaactaggcctaaggactgtctccctctgagctctgtctcctccctctgcatttcttcctaggagccagtatcactggtgttcctgggccggctggcctgcctggtcccaaaggggaaaggggagtgccaggaattgtcatcggagatccagggaaacaaggttcaaagggacaaaaaggtgaccaaggtaagtaagcccaaatcaggacttgcagaaactgattgaggccttggcagtggatcagagtttgggattgttttggagccaaatggttcgtagggtagacttgtgcttatctaagaacccttaacaatgactgtgaagaaaatgatgatgaatagtcctaccaagtgccctcctagccttcagttagttccccctggctctttccaattcagctctggaccactttttcagacttgggcaaagccaagatgaatgcttctaaggagcagagttattccatttagtaagatcttaggtccaatttccttcgtgatccatgaggatgctagactccacctggcagaagaaacccaagaccgagagaacatggatctcctgaggccaagcctacaggctacactcaaccaggataggttgtgttttcattaaccaaagtccaccctgacctcagcttcccacactgcttgaagttttcctgggtgtcccattctagaactctctaaaatcatgaaaccattcttcagcttccttggcagtgttctggagactcacctgtctcccactatatataaagcaaaacatgactgcagtcagtcaggactaaagcatattccagttctccctctcattgagctgtatgtccccaagcaatgaacttacacacctgtctctcaatgccaattggacttaggttttttttttctttctgtaaaatggatataacagaactgtctcacagatatttctgaggactctgtgaatagtaaggtaatatgagtttgctgagcatatctcagtgcccagcagatgccccagaaacactgggcaccatgctattacatgccagttgggaagtagtaactgcagtatatttggagcctgaggtctcatcgtgtgtgtgtcccaggaaccagggtcatacattcattcatttcctgctgcaatttgatttgaggcatctgttgtttctgtgtttaatccttcctttggtctgggcaaacgtgttcttttggggaatctagagaaggctcaaaggacggtctgagcctgcaaagcaactgtggcttctttcccaggacacagagaagagggaaccagatggaagcatatggcatttctccttctgtttgtaaatcttgactgtgaatttctggttatcaaattattcacttactttagctgacataaaattataattacaattatagtaaacagcacacatcaagatggatatattatagaaacataattatgaggggcagcaagtcacaagggaatactcttggtgtggttctctcattagatgttcaaaataagcaaaacaaccaacatactgtctagggatgccaatattcatgaagaaattatgacaagaaggaaagaagtgaacatagaatttggaaatggttctctgagaggagggagtggaatctatggagactacacacataattaccaagataatgccatcttcgtttttctttagtgggacaatgaagtacagatgtgttcatcatacttagattattctttactgaagcaatttgtttaaaaaagaatacagcatgtattgtgcccaccagaggaaacgatctgtgatttggtagtggaagtaaaacagactgagcctgagaacactccgttccctgtgctcacaatacctttcactaaatgatttgcaattatattgttgttttcatacttgcattaaatctttagagcctacatttatgtatttaaagtttctcagggtttggcattggaaggagctagcaaaatggttatttgtcatttgcagctccttatttagaacattttagttttaataaaaaaaaaaaacatacaagcaaggactcacaatatggctcagtggataaagatacctaaattataagcctgacaacctgagttccacttctggaaccaaagtaaagggtgatggagagacccaactccacagagtgactatctggactccactcatgcactgtggcatacacacacacacacacacacacaatagtgataagtttttaaagacatgagcttttggcactattttagtttagtatatttatttataaagtcaagaatcagataaagagcatgtgtgtcttttaaaaattgacatggaggactctatgattctgtgagcagctccattatatggtgttatatggtatttcgcttgttggttttgcataattctaggtgatataaatacatacatcttctatatgcacatatacacatataagcctctgtttcaggggggaaagcgtgcaaaacatatctttctttcagttccttacctcaatgaaaaagaaaagtacttcagaaactcgtcacgacacagcggacaacacatgtagcttttttgtgtgtgtttgtttttccctaaagttaacaagagtgttttctcaaaatcaacgttttcatctctagtttcccttgtgattcaaaatatcaatgaactacttttaaacacctgctttggctaatctaccatcttttgacacatttacaaggttgtcccagcttttaaaagatcgatataacaaggaaaattgggtaacaatatttttggatttttcctctcacacacaaaaaggaatctcaaccaatgggtttttatcaggcagattccactgaactttcttttttctttttttaaatatttttattaggtattttcctcatttacatttccaatgctatcccaaaagccactgaactttcttattggactctccatcagaatatgccagttaacacatttgttccatacttagcatacagcaggaactttcacctgtgtatagatagttttgatgtttccccttcttatcatacatgtttttagcatacattaaataaatatctcgtcgtttggtgtaagtttttgtttttataacatatagtagaattggttccactaacgaaaaacatgtaaagtaatatggaaacctaagcaaggaacataactatatactttggccaaagggtgacaggtatctagtataatgagatatgttcaacaggcgactaagcagtaattccactaagtcacctacaaaagactggttgttgttgttgttgtcgctgctgttgtttgcctagatgtgccagaagagagcagggaatcttagggcacacatgagcatccataatctttttgctgtctccgttctggatgatctggtctcagtcatacataactttggagcagcatcagccagaactggcagttaggaaagtttgatgaaccagtgtgtatactaacaacactttgaaaacttaaattccagctgctcagccaagctttctttctgatctggaggaaaaacagcctaaaagatttccatccccggtgaaattggggagctagaaatttccacagctccgtctcaggaaaatgaagctccagctggaaacgaagaagctgagcctggtttactgttgtcagcttgctggaagttcggatgaatggaagacagccctctactggtgtcttctggtcttgcagctatttcatggcttccatttttctgaatgcacttggccatttccaggacgtgggaagcccaccgagccccattttatttattctttgcaggttccccaggtcttcaaggtcctgctggtacccctggagccccaggcatctccttgccctcagtcatagcaggacagcctggtgaccctgggcggccaggcctagatggagaacgaggtaaaaataagaaaccccaaacacatctggccaccttactttaatgtgggcagacatgctgtatataacgcagctctttccctattgctggaaatacatggatctgcttggcctcaatgtattccctctcatcaagatttgagagactggaactgactgtatttttgctgaagtgttttgcaaagtctggacatgtgcgcttcagggacctgtactaggagtgggctttggctacctgactccctaggccttcagcagcttcctatctctttgcacttccttacttctcccatcttatccctaggccgcccaggccctccaggtcctccaggtccccctgggccatcctcagatcaaggcgatcctggagactctggcttccctgggattccaggccttcaagggttcaagggaaaccaaggacttccaggtttctctggcctctctggagagctagggctaaagggtaagtctgttccaccagcttcaagacccatcagtcaccactgcacagtccagtcgccctgaagaggctctcgatggtgctttttctgactggtccccctctgtcaccatcatgccaacacctcacatgttttcctttggcccttaccaggcatgagaggggaacctggcctcatggggactcctggcaagatcgggcaaccaggagacccaggatttcctgggatgaaggggaaggcggggccaagaggtgagtgcagggccaagcctgagcctcagagggaaggggtacagcatgaagttgaggtttttcggaagccatgttgtctaccacaccacaaaaccaagtagggtatcatgctcccaagcccaggaggtagtttccctcctttggagataccaccatgccaatctactgccagaactgaaggtccctaccattggtacctgacctccctctgtattacttctgcattgcacctagaccactaagctcactttctaagttcaaaaaagaaacaaaattctttctatcctcgagccaaatgtcaactattcagtctatcagccaccccagagggctccttctcctagcatgccttgtatctgctcactttctatcagttctgctgctcccttgaggtctaagccatcagcagttctcatgtagcacccttcctcccccaacaacaattatttgtcccatatagtcgccggtaaaaagcaaaccattctattcatggcatagacaggaaccatggcccacaaaatcctgtgtgacccctccctctttatctcatgccagctcatgtcccttttactgtccattgacatctgaaatattgtcccaattatcctttctgccctcctccccttcctactagttccctttcccctaattagcccctcctctgtttttatgtcagatatgatgttctccaattgtatccatttgcttgtacatggcgtgcttcacttttcatcctgactgaagaaagttccttcatgtatatgtgtcctatttcctttgtccattcatctgttaatggacatttaggttgttcccaaaccttggttattgtgaatactacagggataaacataaatgtgtatgctggcttggagtcctactgggaatggtacagctggatcatatggaaattctagttttagagttttctaaggagtcctaatattgatgcctgcactagtttaccttcctgtcagtactgtatatgttttctgatgcttgcttgcccttcaatctttaaatgtctagctccccctgatacgtctgatgtttgaatagtttcagtgtaactgtcattggttataagaagccactggtagctctgaagcagacccctttacccaaaccactccctgctccctctcattgtcactacagcacttatttcctccccagtccttcttataagatttgaacaatggggttaacggtatttgccaaatggtgctttgttcatcttcatcactaggccttaggctctataaaggtctatcactgctcttgtttctcatctcccagaatcttggcagatagtaaggacccaagaattactttattaatgaattagtgaacaagctattctatttgtaaagtggctgacttgggtgggtctcttagactgggatgccaactgcacctctgaagttgaatacatcgatcgctacagtatctttggtagtgcattctgaccagtgtgtaagttataactgcttcatccctgacccaaagctcagcttgctagagttgcagtagagatttcctaactgctttccacctagtgaattctatactgggatatggggagccacaataagtatgacttgctccctgccttgcctacaggcactaagaagaagatgggaaaggaggttctatcaagggttgtgtattctatactggaggcctcaagtggggattgtgagcacaaaaagaaagaaaatagttggcgactgccaggcagagagaaggctgcctttgttactcctccagcctgacaggtgctgtttcactacctgtcttcaggcttttccggcccacagggagctccaggacacacaccaattgctgaagctatgcaggttcctccaggacctttgggtctgccaggcattgatggtatcccaggcctcataggagaccctgggtctcaaggctctgtgggtctgcaaggtaagaatggcaccagagaacaggtactcactgggaagctgaaaggccttggttgagagactgaagctactggcttgacacaggtctgagaaagtgccttcatcaaacatttcccaagctacttcccgaagctcccaaactctttgccagggaaggaaaaagctagaaagccagtggggcagtggttatacttgtcttcagagaacatgtgaatctctcccctagacagcttgccatttctaaagagtgtttggagctagagaagacgtgagtgacaaaggagaacacagggtagtggagaaagcaaaagactctggacaggaaatgtggtttccaagtcttagctttgccccaataggagtaagttgttattctccctgtgacttcacatgagacttccatattgagtgctcctctgccttgtgcattttctctcttacaggttccaaaggcctacctggcatccctggtaaggatggccccagtgggcttccaggcccatctggaatccttggtgatcctggtctccctggactacaaggacctccaggatttgaaggtcaggttaacaaaacttggacacttagtcaaccatgtggtaaatttgccactatgaggtcgctcacaggctgagttcttgtctctctttatgttctattactatgaagagacaccatgaccaaggcaactcttatgaaagaaagcataccaggattggagtattgctgtgacaggcatgatcatgcctttgttgaaggaatatagaagactttgggactttggactagaaaagtgattggatacattaagtagggtgtaatgagccataataacaggaacagggaagatagtattaagggcaatttgaactttaggggcctggctgaagaagttccagggggaaataatattagtaagtaggctagataccattcttgtgatatttggcaaagactgtggctgctttttgcccttcccataaaaatctgcctgaaactaaactgaagagttttggattaatgaggttcgcagaggaaatttcaagatagcctagtactgactgtgctgtgtgggtttgatagcgcttatacagatccacaatgaaaaggagcaggggaagcaaggggaaaaaaacaaaatttacagtttgacgagaaaaggagtaccagtaaatgttttgttggagccaattctagtgctcaagaagataaaaaaaaaatttttttaatcctgctgctaaatgaaataaaagaagtaacatcagggcaagaccccacttctggcacaatcttatgtctttctcactgttctattcctgtgaagagacaccatgacaaaggcaactctgaataaaagaaattatttaattgggggctttcttgtagttacagaggtttagtccattatcatcctgaatggaacatggcagtagacaggtaggcactggagcagtagctgagagagatacttcctgatccataggaagacagatatacagacacacatacacacatacacacatacacacaaacacacacacacacacacacacacacacacagagagagagagagagagagagagaccctaagttgggcgtgagcttttgaaacctccaagcctatccccagtgacacttcctccaacaaggccatacttcctaatccttctcaaatagtgacattcctggtgactaagtgtcttagttagggttttcctgctgtgaacagacaccatgaccacggcaactcctgtaaggacaacatttaattgggactggcttacaggttcagaggttcactccaacattgtctaggcaagagcatggaggcatccaggcaggcatggtgcaggaggagccgagagtactacatcatcatctgaaggctcctagcataatactggtttccaggcagctaggatgagggtcttaaagctcatacccaacagggccacaccttctaatagcaccacaccctgagccgagcacatacaaaccatcatattaagcatttagctatatgagcttatcacagtctttcttattcaaaccatcacattgttcttctcttcacactgcacaggctccagcctatgatgagaagtccttcatacttcagtaaggcaacagacttctcctccttgtctgggctctcctccagctatctatctatctatctatctatctatctatctatctatctatctatctacctacctacctacctatctatctatctatctatctatctatctatctatctatctacctacctacctacctatctatctatcccagtatcttgctgcaagcccagtttgccctcaaagtcactatgtaagccaagttggcttcaaactcttgatcttctgcctttgcttcccatggctttctgtcctgtcctgacatggatgaaagaatacaacaaattacttgtccttggtatagaatccttctaaagctcagtagtaaaatattgaagtacagtggtcatatccaccatggacaagagaggcagatgcaactttgcccttctaatgctaacgttacttataatgcttctgattcagcagctagttatgtcctgtgagagacgccaagggtggggatgagaaggattccactccatttactcttagaaccgaaggccgggaggctgaagaaggggaatggatagtgtactcttttaaaatgggaaatatttagctgggcacacacatgacttggagttgtaactccattagcttctagctgtggcagctcagaacctcattttcctcaactgtagaacagggggtatcaggatcaagtgtttgaacacacgcatatgatgcgccttacaaatgtttaggatcaatgagtgggtagtgttattaccatctgcagcatgctgacttttatgtccttttcttctcaggagctccgggaaatcagggccccattgggcagcctgggatgcctgggcacggtgtgagagtgggctacacactagtaaaacacagtcagtcagaacaggtgccactatgccccactgggatgagccggctctgggtgggttacagcttgctcttcgtggaggggcaggagaaagcccataaccaggatctgggtaagtacagctagtccttgctccctgaccctacaaggattgagaactgaccacttttcttctcacagccctttcgactcatggttatgaaataggccacagctctggggtcaaaaggattttgattcaaatgctggtcctactgcttcaaagccacaggccctgggtaaattattcaacctctccaagctttcatcctccctcaatgggactaagctatttctactatctgtcacatagagtgctgtaaggaattcatgaatcacccaatgtacaatatatttaagcctccattaagtattagtgattagtaataacaatagtaacatgacctacagggcattgatgattgcccaaggattaattgcattagcagcaggtgtgctacctcttagatgtgaattctgtctactaaatgtaggttttacaaagcagattaattagggagtaattattcactttatcaaaagattctcatcattattcaactcccctggtaactttatgatacaatttgatcctcagactccagcacctaccaaagtcataggactgtaagagcgctgtactctccgagcaagcatttagaaggaaattcacatctttggctactccaggccttgtgcctctgccctttagccagcacttagctgattcttgtccatcttctcttcccaggatttgctggctcctgcctgccccgattcagcaccatgcccttcatatactgcaacatcaatgaagtgtgccactatgccagacgcaatgataaatcttactggctctccactactgcccccattcccatgatgcctgtgggccagacccagattccccagtatatcagccgctgctctgtatgtgaggcaccctcacaagccattgctgtacacagtcaggacatcattgtcccacagtgccctctgggctggcacagcctctggatcggatactccttcctcatggtgaggccttgaaccattctgtccctcaatggagaaacagagatatatagggtaggggtgaagagctcaggaaaggacccttcctttgatcccaggctcaaggggacaaaggatagaaaatagtttaacaggaagagagatgaagatgggaattacaattttgtggtttgcagggtagaaggtggggttagatagcaatttgaacctggtgttctggactgagaacctgtatgtgtcacaagtcaaggccctactctatgtgtccttcagttttctcactacgaagggaacactagaactgtaatctgaacagatactgagagaaatactgtcctcaacagaggccaacacgtaattgtactgatcaggctgagaagaatatttaccaccttgcagtctgccctcccagatctgtctagcttctactatctctttttgatatctcctcttaaagattggcaaggaggcatgctgcgtttgtatggccttcattgcttctccagtttttgtggtgtgaaggcatgctgtgtatctagctaggaaagagaacatcagtagtaccgaggagatggtcccataactatctggggaggttttttcaaatgaaatcaggagtaagactaaggcaactcccaggaaaactacagtgtaaagctcactgaagtcccctggttgggcagagcttctcactgaatcaccaaagactctggtacaacagctcccacccaaaactgacatgttttcgtaagccagagccatcagcaaagtatcactctctgaaagttaagcaaactgacagcctgctagccacttgctgatgcagattgcataaagcctcctcttggcctcctgtgcttccagctaatctgaagggagatggctggagtatagacaggaggtctggaggtctagtgactagagactgccagaacaactgtggcctagaaactgaactccaagtaagccctctgaagtgaggcctgagacattttaggtcctttgtcaggtaacaaatattgtgtgtcactctagagggtatggcacaggttgaaaatagaaatagttctagtagaggcagtcttaaggatgagaactataggggacatgctgttacaagaaagagcattggggactactatatgcttttccttcttagaagacagtgcccagcaatgggcttaaagctttgttaattccacaacctaaatccaacattgttccggtgtatatgtctgaggaccaagaagatggacccctaggaaaaggcatttaccatacacacacacacacacacacacacacacacacacacacacacacacacacctgtggaaatggggagctgaaggtaaacctcacacagctgtgaagtccgagggaaacattggttggaatgggatcactgatcacggaggtcccaaaggagctgcttagagaggatggccagtacttgcctccgaagcccaggttcatcaggcaggctagaaactgagtgatctggaggggtccagagttctagaatggtgcacatatgaagtcctgtagaaacaggccatggagcatctctgtgttgacttctggcagagctcacacagacccctcccttctgtttcagcacactgctgctggggctgagggtggaggccagtccctagtctcccctggctcgtgtcttgaggacttccgggccactcctttcattgagtgcagcggcgcccgtggtacatgccactactttgccaacaagtacagtttctggctgacaacggtggaggagagagggcagtttcgggaagagcccgtgtctgagacgctgaaaactgggcagcttcacaccagggtgagccgctgccaggtgtgtatgaaaaccccgtagggtactgcccgtcatccagcccacctcacaacactcacctcaacagtctgagaaaggaaggcctgagcccatctgcctgtcaagttgtacatcaatgcctcgtttggactggactactggacaatggtcatcccaaccctcagacccaacagatgagcccactgtgctaggatttgctttcctgtttccatccatctggtgctaacattccatttagatatgtgtgtgattactcatggctaccttaggaaggtgtgctaagctgtcacttgcgaagatggctagagctctcttcactgccttaagctggaagttctttataacagcgaagttatgtctttatgacaagacgtcaccacacatcatttgagtcaaactaaagctcaggatttccaccctaaaaatacgtttctggctgaatatgatagataattcaagtctgcctagggctagccctccctactgaaggcagcctattatatttagacaggcagtagtgttggaatgagaaaccagcctatagccagaactgagctgtgattccttgcagagttttgttaagcccatgccccatcttgagtaggaaaggctgaaaggccagtatttggtcctagacaaatcactgtcccctggtcccacatctagagatataagacaagttggcccagtccaaagtggaaccaagaattcgataagtgtgatcaagcttgtcacagaaagacatgagaatcacttctccttcttcttggcctagggcagaaggagaaatacatatagaggtagcagttttgcttctgagtccaggaaccaaaaggtaaagctcatgtccccattcctcagaagtccctagttattccaaatgccacccagatttatgcagggtgacaaactgaagctgcagtgtgttggctccttgcatgctgaggctcttagaggtgttctgataaaatggccatccaaacaccctcccacgggtagccttttaaactatttgacagggttttttttttttaatttcataaaaatctagcacacaccaatgttagcagacccgaggtacattctgagctggccatgaagtatactgccttctgtttgaagcagttcattttaattaccagttgcggagaacacaatcagttccactgacatgaagcgctcccttgcaggtgattggcttccttgagtactatgtaaaccgtgcccacgcaggcaaagcataacaagtacattctgagctcttgttatcacctcctagataagtaacaaatggtgtcagctttgtacatagcaaataaaattaatgaaatacgaa

SEQ ID NO: 307 - DNA, 164432 bp, mus musculus
ctaacaaaggaattaactaggggtcacctcaaggtgaattctctggagtgacctaacaaccatcaaaatgagacctggcttatataaagaagccataatgaaagaaaacccatctggggaagagcattctaagaagtgacactgttcctgtagcaaatcaagtccttaaaattttatttagcagctgaaagagtcagatgcagacatttacacccaaccaatggacagaagctgctgacccctgtggttgaatcaggtaaaagctggaagaagctgaggaggagggtgaccctgtataaagaccagcagtcttaactaacctggaccctaccccagagatatctcagacattggaccaccaaccaggcagcatacaccagctgttataacaccctcaacacatatatggtagaagactgccgggtctgtgttcattcagagatgatgcacctaaccctcaagagaccggaggctccagagagtggggaggtctggggggaattgggggatacagggtggggacatccttgtggagacaaggggtagggatgaggtgtggggtggggaacagtcagagggtggaccaagaaagggataaaatctggattgcaaaaaaaaaataataataaagattaaatacaatttagaaaaaaattattttgaaataattctttgacagaatattatttttttaatgaaagcaaatttccatacttaattagacagacatacttatttatttttctacaaagcattaagtctaggctgaatatttgataattcaggacatacatcttcaatattttccagaattgatcaatgttttgattttgtaagtggcaatgctgagaacactgggttgtgtaaatgtgtacaaataaatggcaggcacacatttagggcaaattcagaaatagttggatactgtgccttaataccaagtcaaatttcattcagtcagtatttataaaccttacgtcagcaaagttaaagaagaaaatttaaaaatcaacgttctaacatgataaaatccaaagacactaatctgatacatgttaaagaatgatggcagggaaccattgaaagtctttgttttctgtaattaactcatcacatgtctatgaaagcaggaacctttccaagtcttatgaaaacactgaaattcattatgtacaatagtcttaagtctgtgcagaggtgtctcaagcagtgtttgttaaccctgtgtagtgtggcaacatacacaaagcaaattatctgtgctgtgcgttcagacccaaggctgcagtgaacccactgatacagcactggcaagtgtggtcagaaacactttagacttgttgcatgtttaattttgaattaatttttgcatggttgcatgttcagaagcactgtcctgttgcaaaatcttttatgaaaatgcatattctcagtcacatgtccccagataatgtcgcagaagctgtgattctgttggcaggaaagtttgagaacatgaatgaaggtactaaactgacttgaagaaggagccaaaacaccagggaaaactgttttatagcatcctattctgcagtgactaatctagtcccttggaacttacgctagtcttacatgtggaggttttttaaatagaatgagtgtctgcccacatgatggaagctgaatgagcaaggaagagactaagaggagttttttttttttttaagcatgctcacatatcaggccatttgaaggactcttgaacatcaattagtcatcattgctatctcactgacaacatcatcaagcagtgtagagaggggaatgacgttaaggatttcccaaaatagtgtgcatgggatgccacctgagcactttgaagctgactcatgaggtagaggagaagcactctaagtttgaatgatgctttgaaaatagatcttgaaaagatgggaacaaggctcagggtcactactttcatctttctctatatttctagcatgttctcctaggtaattagcaacaactactgctctgtcaataagtacaaatccataaatctctggacaccttcttccataccagccccatatgtaacacacattctcttgtattctgcaactggaatttctactaatgaagtaatgtctacgtcaccatttctcaaccagctaccacactgggtatttgatgaagtatagactttacctaaagggatgctagcatatgtctttcattcaaataatggcatcaatgtatgcaatcagtccattacttggttaagaagaatgtgactaaaggttaatttccctggggtaatgatttcccctggttcacatgctctactaacatctcttttttatttaatagggacagaagatgtcctatggaaagccatgtgggagccgagattgccatggagtctgtacatgctttcctgagaaaggagcaagagtgagttgcttattgcattgttgaaagacaaatagtcacaggggaggttatctgttttatctgtttcctttagaattaaatagtgtagaatttgctcttctgacctcatagcaagagtaaagcgctgagagcaagctggaaaacactttgcccactgctaatactcagaaagagagtggtcaaatctctgagggactgggaagaggtttccctcactgacttaatgccaaggctcccccaccgtctcgttgaaatgactccaaaagccagttagcttgcacagaaccagattgtgataatgtttgtagatatgtggagatgttcatggctcatttatatccacttagtttctccctgccactctagggaacaggtgatccagtttttaatctacagattgtgatgcaatttgtcccaaatcactggcttactggggatagaatgaagagtaccgggaatctgtaaagtccagaaatacaggcaactgtaaaaatggtttgtagacactctattgaaataaaaggtgttatttttaagaggtcttatgctttaaaatatactgtcatgtgaattgaaataaacacagcattttcccctcagtccctatatacatttagccacagtgcgatttctaccaaataatcctgcatagaaaatgtattcaaggatatttattcaaataaagttatagatattcctcaaaacttatggctgctgggtaaaattcagatcatctaacttctaggattatgttatgtttgcattctcaccagattcaactgaaccaaagcgcctatactgtcaaaggaaagcagtagcataggggggaggtcaaccaaaccttcaaaaacatagtcaaacagggaacatgttgactggtccaccttctcttccattatcttccatttgcagtaaagtgaaatgtcaaactctgccagaatctgaaggaaaagaataaaaagccatctcttcatctgaaaggaccgtgcccattattaaggacataaacttggagaatcataagctatcagaaaaggaatgcattttagggagctcttcatctgattgtacagagaaaacagagttagagggacaatgacttcctgggggtcacacagcaaagtaatggcagagcccttttgatgtcttacctgtacacttccctcactcaaagactcttcctgtcttctagtgaatctacatttattgtagccactagggccaatgagttcttttaaaaggatttttattgcattgatttattttgttggagggcacttcatgcatgtggaggtcagagaataacaactggaagtgagttctctctttatacaatttgggtcatagggatttaactctggatgtcagtcttggcagaaagcacctgtagccactgaaccatcttactggccccaattgacttttaatcaatgtgctagaagtggagacaaagtgaaggctggcttcatgacttcttagtaccactactgtttttgtgactttcctctgtatataatcaacattgtgtacatgtctatacagccactctccatttttttttcaattctttttaccaaatagaattgaaaagtgttgtgtgaggggttgttttaagttttgtttttggtttagttatttagtttagttggttggtttagtgtgtgtgtgtgtgtgtgtgtgtgtgtgtgttatccttaagggcttttcttctatctctagttgaatgtatgtcccttttgctggtgacttttatttgttctgtgtttttgtcactccataaaggcaatacttcattggcaatacttaaactgatttccttgtgcagatagctacataaatactaaagataagaattattatgtatacattttaactttcaaaactattgggaaaattacccccacaaagtatcttcaaagtttccccattcactttgtatctgagtgtgccagttgccagagttttgctaagtacttgacagttttgctaatatgaatgatatgcatccccattcactgacaatctgtgaatctcagcacatgtccacatattgactgaaagcttgccagtcttctgtgaatttcctgcacacatcctctaactgattttctgagggggggggtgattcttacccatgcaaagaaatattaaataaaaataacctttgtggaagcagatatgatgtgacgtttaacaaaatcttgatggaatgtggtgggtagaaaatggtgggtggccctcaacaatcagggacctggggagccctaagtctacttgatgcactgggatcatttaataatgactgatctgaaatggggcccaccctgcatcaggcgcaacatgcctggagctaccccactgcttaaccttggctggggtttgattttttttttcaagattctgtgaggagtcctaattatggatccaaacatctggacctcaagtctgtcctctcccttgtaaacatgagtggttggatggaacagggatagaggaaaatgaactatcactgtacagagtttcttttgggcatttagaagagacagactacactacacagttaaatgtgtgcttaatttttatttgtgatctctgagatttctgagagtgtttttcagtcttactgaaatgcaccaacctcaattttatgagtcaagagcaagaatgttataattttacactataattttacaaacaggtaaggcccatgctcttgagacaagctgtgaacataagtgcttaatgcctcaaaatcactgcatcctgttttgtcacccttccagccctcttaagttcccagggccaagcagcgttgtttaatgtggcctcagtactattaaccatgcaggacaactcttggtccgcttttgtgcagatgtcagaaagatttgagactgttttccttagctgagcagacagccccatttggatttcaagctgttcctctccagctgggaggggagcagaagattggatcaactcctgagcaatgttgcagcccctggcaggcgcctcctgccctgaagagacatcagctacataacttgctgggcagtgtgtacttttcctttgccaaaggcctcttgaactgactgggacatttccacaacacctcacatgcctacaaacaggaatcaatccctttttggcttcaactagagtgaactgatgtctccaaatgatgccatgcttggttaaaagctttagccaaatgcgaaggaactacactttctacatctaaaacatttctgtacttcttttcttagggatcgtactacatcacttgcttaaatcctattattgaaattttagcctaccataaaagtgacaattgttaaatgatggcatagattgccttgtgttaaataaaaatggttacctttacaacaaaactggatatttaaatttatatttaatatttgactttcacatttctttcttatgaataaggttttgttatccagaagaaccattcttcctgccatttggttaaccaaaacattttaggttgtcaaacccatccctttcattttacatttatgggatttgaaaactgcttctgcattattgcctattgtttcttgttagtgtgtatttgtctgaaattaggaataagagtaggttgggtgttattgttgttgttaatatatttcagagttttacctgttttgacaggcttctggtgtttatgtacaacatggtaaagttctcactatccacagtatctaaaggatcactaacatcaaaatcaacaggatggtgatgaaacaatagggaatgtagtaggttaaaggcaggggtatgcagagtgcagagggaggaagaaaagatgtacacagcaattggctagttcacaagaaaatggagagacatcttggtagccacagcagaagtcaacagatacaaggaatactaactgttcccaggagaataccttgatcaactagtgggcagagcatctgggttctgtacaccatggttaacatgttttgtgacaggagaagcaacagaagtagaatgcacattgacaacaagaaattgagccatttgtgaaactctcactttgtaaactctcaagctgggtaggatatgacttcccaaaggacaaaatgaacaaatgacccttacctagggaaatccaagcattctctgtaaacaataacaccaaacagttgcttatgccagaaaactagcagccattcctgggttctcatgataatctgtttcataaaggactgaacaacttactgtgtatagttccagtccagcttaacatgtcctggattagctgtgagatctctataaagccagactgtctcctacccagaaagcacacagcaacatcaaaaatgaggatctgatacaggcatttcctcatgttcattggatctcactggttgtcagggtttcacattctggttcttagtgtttgttttcctaactcctctggagtttttattttactttggcttttcttatttcctgtcacttcttattttgtacttataagagattttgtcacaagagttttctttaactaccagcaatctgctcttccaccaagataaaagcattctcaaatcataattttttgacattgactgtcctttgcaccaactttttccttaaagcctcttaatcttgtgaaaatttgatgggcttccatttcacttgtttcttccccttgttggggaataggagaaattgaatctgagcagggagctatctccttgatggcagtagggaagggaagctgtgcggtccttcagtggttacatattgttatttaagttcagggtgattgatgataatcttagttagtgtctatgctctggctcaaggtgcattcctagccaagcagatgttcacagatgctcttaatcatttctttgatcatattggaacatatatagagtttctttttcttactgggagggaggctcctactaaaatgaagccatgtggctgaaggggtaggtaaatacatagttataaagacaaaaagaatgctttggccccctagaggcctaagtagtctacaccaactactgttttctcctctaaggaattcagtatacttcaaagtagtgtgagaacaatggattgtggcatggatctctaaggacctacaacttcccatgatctaacttcgacaccccattactgtgcactgaagttgtgcttgcctcagactatcttatagtgctttctagtatttcattgataaatgcagaacaatgcatggcagtgccttgattttggggtggctttaagaagctgcctcagtatgaagtcacagacagtggtggttttgtttgtttgtttgtttgtttgtttgtttgtttgtttgaaggcactagggttcaaatccaaggttccacatatgcaaggcaagtgccttctatcattgaattatgtcttcaactgtccaggctcagccattgtttctttcctgcagctaccaggggctcttaccactgaagttgagtgatttaaagatagtcacaggaattgctatatacagtctctcctgccttgctttagaatcattctgtctccagttttagctttgaaaattcactcttgcttcaacacaaccccatccttgtagtgtctgaatacacctccaactctgaagagaaggccaggggtcaccctattcatctgaggagttgtaagcacaagtcatttctctttagaaactgctcagttttcgtttcactgactctagtaattcatatgccagagacaatggatatcaaaaccatagctgagcatctgtacatcaatctgtgacagattcttttacctgagaatctactttctttgtcccttgccagttatttgtccccacttttgtcttcgttctcttttgtgactagtccctactttcttcctatccccttccagacctccctcactctggctttagtttttctaactctccatctctctttcccattctccccatcatggcctcctcacacaatttccctcttcttttttcaatttcatgagattgcttcccaggccactagtctctgcaactatctcattattctttgtcatcaaagaagcataaacatttcctcatcagggttttaggaaggagtccttgaaatgcactttataaaagcatctcacttctccaaagattctaagtctcagagtctagatttgtggccttcaaaatttggaattaaatgtatagaatgcaagacaatccactgagtgtgcaaaaaatattctattaagattaagattatggtaagaaaatctagaaagatactaaattctaaggctaagagtgtgtggttaaaaaggagtggatgcaagatagcatgctgaggccctaagtatgattctgagcagaggaagaaaagaagaaatggtggaaggaaagaggatactacctgtcctggttaattttacatcatcttgacactagctggagtcatcaaagagtacggaacctcaatcaagaaaatgcctccataaaatcgggctgcaggcaaatgccagtaaggcaatttcttaatttgtgattgctgtgtaaggacccagtcaattgtgaattactgggctggtggtcctgacttctataagcaagcaagctaagcgtgccataggcagcaccttccatggcctttgtaccaactcttgcctccaggttacaggcctccttcagttcctgtcctgacttcctctgatgctaaacagtgatatagaagtgtaagccaaataaaccctttcctcaacttgcttttggtcctggtgtttcatcatgttatatattatatgttatatattacacattatatgatatatgttatatgttatgtgtaatatataatgtgtaatatatggtatattatatatacataatatataatcatgaagactcttaccttaaacaattccttataggtattatttcactatttattaaagatcaaagcaaatttgcaataataattatgtgggtttgcttgtttatttttacataaaagagaaatctttgctggatatttggtactgcaggacatatactatgatgatctatctttgagaatgtttgtaagggaccatctaggtgaatggtgatcagaagacccatccttcctgataggtcaaataaaaaggagagaataatctgagtattagactgtggaaacaatgtgaccacccacctatagcccttgtctccacaccctctctaccatgagagactgtaccctatgaactataagccaaaataggcccttccctaaattgctgttgttaggtactttgttatagtaaccagacacgtaaatgatctatagtgcatctcaacttttttttcagagttgatggatattttaattttataactgttgatgctgagaaaggccatttcacataaatagtacaaagaagtgtgtgtacagccgtttcaaagattcttggaaataatatcctaatcctaagccaaaattcaattaataaccttttatgaaactaaagtcagtaacttaagcatcaattctaaaatcaaacattctgctacaataaatccaaggatacatgctgaagaatgatggtaaaatatttcttttgtttgttataattaaaccattctataagagcaaacaactttgtatgtatataaaaactctgcaattcataacatatagtaatcttgaccatggattgaattgattcagacagcatctattggctctgtgtggcatgatcagaggggtcaaggacaccgcaagaaaacccacaaaatcaactaacctggactcaggctcacagagactgaactgtcaaccagggggcactgacctatgccttctgtatatatgctgcagttgtgtagcttagacttcatgtaggactcctatcagtgaaagcaggggctgtctctgactttagctggctttgggatcctttcgttcatactgggttgccttgtccagccttaataggaggggagatgcctagtcttactgcaacttgatattccatgtttgattgatatccctgggaggcctacccctttttctaatagaaatgaaggagaggtggataagtgtggggcagaggagaggtggggactgggactggaaggagagaaggtaaaaacaaattttaaacccatatgcccatatgcataaattatatattcatttatttgttgaaagattacagaatttcaagtttggggagattggacccagcacccatgttataaattgtaatttgaaaagactttcaagacaaatctgggaatattcttctcatgttaactatgaaggtgcttagaagaaagcatccaaaaggttaagagacatccttgggcttccttcctgaagctttgaaccaagtatctcatccccacacttgtcgttcttcctacccatgtccataattattgcaactccctacctcatccttggtgcttggacaattgtgaacagaagaatacttggagtaaagaaaatatgcttagacacagaccagatagtaacaaatcaatcacctttctttttctaccccagtgagtagtaagtcataccactaggacagcatcatatcattgtctgcatttaaaaatatttcctaatatttctgtctattaagggctaaatcaatgaacttcatgcttaaggaaagcctgattttcctttgtgatgagaattttggggagggatcatatcatatcttacagctccaagcaggtctttccctttttgcaggccactcactatatggaattcagtgaattgaattgaagaatatggggataaagttactgaatatgtgtcagagaagatatttgatatctatttcagaggaggatcatgtattaatggaagtcttccaagaattttcaacaaaactaattgcacagcatctctattgcacactagtaaaagtcaatgagaaaatgtgcatcactttgcagaaattggatttactgtcatcttttcagtagggtttttattttagcaaatgtggcacctgtccaattatttaatgacctcttccacttaaaaaaattacagaggtgggtatcctaggctagattctctatttcattttcctcattatgtaatgtgcagttcaaatccactagcaaacatttatgaaagtgttcagggaactaaacattggtgcagacattgtaggcagtgaaaatgcattgcaaacaccaggcctctcctagatgaagacacggtggagtgcttagctacctagtaatgtagatggttagaagtcttaaagcatagaacacaagacccactaaagtagagagatttgtatgatatggtatggtatgattaagaaactctttaggaaggttgagttggtaggaggaaaataaagtgggttgaaatgaaagacataaagaacaaataccaggctccttgtttgttgggtggcatgcccaaaacctctagtgtagagaaagtgaagtttacagtgtctggggttgagatgctaaattcctctgaatgagtctattttatagaacacacataaaacattcacctgaactagtgacttgaaggagcttggcttctatgtggatgaatgtatcatgttgttactctttgaatgctcgaaaaaagagtgctagttccttttcttcacattcctctaaccccttcaaagcattgcagagttcccactgatcccattcgaaagcatccatcctcaagccaaatggaatccatatcactaaggtagactggctgttaacttttctctgtggaacacttaaacctcccaagattttctgtggtattcaaggagagagagagagcaactcagtggtttctccaaggtcatctgtttcctactcaatgaattttgttgtagagttgctgaatgaaaaacagagtttggagcatcttgagggtctcttttcctatgaaacagattttaaagtttggttcagtgggaaaaaaatcagccaagtacttttgtcccttgtgacactaatgtggtctgtgaccacagtaggatcatactgtggagttactactttatttttgaaaaaattaaaagaaatgcttcttcagcctacagaaagattaatgtatatgattcattatcatttatatcaaggaaataatggtttctgtccctgtgcatgtttttgcttgttcaagtaattgtagtgacttggcaatgtcctgctttagttgggttccctcacagagctgacaagagtcaatgatttctgtccctttcccatgttgctgggacaaatgccaataaatctatgagcaaagaagggagctatagagaaacatgctatgtggcagggaatggagtaagagacaaccagggttcaggaaccaggtttccccagagagagacaaaatgaaaacaaacaaaaggaagacacaggtcgaaacaggctccccagacggggcctatttgctgcaaaaatggagccttaaatttcataaagctcaatgaagggaagaagccagaagttaaacatggtctttgtaatacaattgaagaattattaaccaagtatacagaggaaaggccacatatttggtgagcaacatttgtttttcttaaaaacctatttaggcactctgtgaactaaaatatgttcccaaacctgtctagccacatagatactaatattactctcccaagccacagaggtacccaaaagaactcaggaaaaagtagagggaagctaagcagtgggaaatcccacagaggctcaaagtacctaacatgggctgctttttgaagcatgtgacagggagttgagtgacctagtaaaatttattatcaaaaacgcagaagttgtggctctagttacttgtccagaataatttaacttcttcctgagtttcatgctttaaataaaatttaaagaagattgagctccaataacagaaggatcttcccagctccactcctctaaggataaggagctagatcccttcttaccctattatttatggccatatgacaagccccaggcttatagttggaattgctccatcacagcctcctgcaagattaatgacaggaatctgaaaaaccctgaaatatgcacatagtattcacaacatcaaaaaaaaaaaaaacctcactttgcagactccctgccccccactaaacagctgctggtcccaccagcagctagcctaacaatgctacctgcctgtctcaggtcacctctcaggtcaatggcaaccttctgagataaggagtctgacagctgatctcaagagaggtgataataattttctgccatgctccccagggtggcactgaaccactgacctggtggaaccactgccctaacttgcccacctgcagcccaagccagactgtcccttggtccttagcagtggaaaaaaacgggttggaagaaatatgacacgaaacaaactcagcctgggaacttggcaccagtttccaaactggaagttctcaaacatcccttgttcccttcctgtaatgtttacctcatgaaaacacggaggatatttaaacaaataggacaaatgtcaaggcagaaggcccccttaggtatagtatagtctaaactttgcatcttatgtggggagaccaaggcacatgctggaaatgagatttaaactctgaagaatgttaaaaaaaaaaaaaaccctttcattcattatgatgaccagatgaaacccatgtgagtgagggacagaggaaaagaaaggaaggaaggaaggaagggagggagggagggaggagacaaggaaagaggagagaaagacaattgttcgaatcccagtaaggaaagatgtgaggcggaaatcatattagagagcaaataaaatgaatctgtgggttttaacatgcattcaattctagtggccaaagatcacttccatttccaagggactcaggaatacctaaatcatggtagggaaattcttcttcatggaagtctaattgaggatggtagttgagagcatatacttttgttggagttgggtaaattagtcttttaagtcctgcctctaccatgtactagatgggttttaagtagttctcgacaagaagaagtgtctcagggaacatttatcaatatctagatatatttctgcttgtcacaagtggtgaaacatctagctgctagagtactgaagcccttataatgcacagtcatacaatacaggactgtcccagcccaaccatttagcagtggcaaggctaagactctctgaattagatatatgtcctaaacattctaatcctcagctcctccatttgtgacttgaaaataatagtactctcaaaggactgctttgatcattaaatatgctgacctccataaagcaaaatctttcccattaattttgggtattcttcccaatacgcattttcaactctttctcctgcatagctccgtggatgggttgttcacaatcaaaatctccatttttcatattttccctttaaccattctcttgttttaaaggtcagcagtcctttgagataggacctagacattctattttcatttttacttaatctgccttcaacattagaaaagtatttttgaagttagagagatggcttagtggttaagagcacttgctgctcttacaaaggaaccaggtttgattctagcacctgcatggtgcagccatccatagcttcagttccatgagatttgatgccctcttttgatctggtatgctattctgacttccacaggtaccagacacccacatcccacatacaggtaaaatatttacatcaagaaaagaaaagaaaagaaaagaaaagaaaagaaaagaaaagaaaagaaaagaaaagaaaatctatcaaaaattttgtttttgttttgtttttctctctcttagtaaaccaggaaacaaacataaaaatattttggcttaactttcaagattcctttgattctcctcctgtttttatgaaccaagtttcccatctcttttgcttaaagaagagaagagcttggcctgatttgtttgtggaagaagttaataaattaatatttagaatgcaaattcaatgagatggtgtatataacgtgcttagcacacatttaacattcaataaatagccatcgtcactaccatactacaattgttattgtcaatgttactcatactattattagtctcctttactgtcctctaagtcctttgagataggattagtatatattttgctctgaaccttactttgcagttttacctactacaagatatatgtctagagatatatacatatatccagaaaatattttccaatagactggagtagctgataagggtatgagaagaggagactggaggaacgccttggcggggggggggggaacatgtaatgaaaagcttaactagggtggggatggctagtggctcatgggaacagggttccagaagggagttacacactagctatttgaactccccttttcattaaaaaaaaagtgggaccataaaatggagggagtagtcattcctacccattaatcatgcaactactttcctccctgggtttggaggagaaattggatgatagccagatgttaacaagaatcgtgcttatctattgtatttgacaaaatgcacatgaattcacttttcttatagtactggattaactatatatctattcatcttgtacttggagcaactttgtacatttatcagttactatggacatctttataaatttgcaaacataatttatattaccctgagaccatggtaccttgggtgatacacattagaaaaagtacagaaattaaattttactagaaaatttatgactattcaaaatatctacttaatgttgatgatctaataacatattttttcagtatttttagtgaaaatgaggtgattactaaataggatctttgatccaagtttcttttaccaccaagaacagaatagctattttttgtaataattaaagccatcgagtatgtcaactaagtcaactatggcattacattattgtctcttccttttcctctcaccactcatgtacaaaaatttgacacattgcactttgactttcaaatgtaattaaataaaacccatatgattctgaaagtccatggccatccaaaccaaagatccctgcttggttgttatatatctgacatacaataaataactggctttctaggtgagtcagcctatttgtacattgttagatagtccttgacctagtacagagaaaaaaattgtaattggtcttacatgaaaaactaaagtggagaaaatgaaccctcaaatccaaattattcactttgaaaggagtaataattagagcagcttctatttctgtcagtaggggtggggtagagagaaattttagtaatatttcaaaatggcatttttccttccttgaagtttaagcttgccaatcaattcaaattgttctaaatattaacttaattgctacatgttcttaacttttaaggaaccatggccctgtatttaagacttccagatgatagaatagttagatagatagatagatagatagatagatagatagatagatagatagatacatacatacatacatacatacatacatacatacaggcataaatacatagatagatgcatagatagatacataggtagatacataggtagatacatagatagttagatagatatatagataagtagataggtacatagatagccctccctcctctcacttcccagcttccttattagggataagatataggatcttaggatatgctgagaaagtgctctaccccagcccttcatgtcttccttttgattgattgaaatgtttgtggagactaaatcttgtcagagctactagagatgatttttgctatctctttcatcagcaccaacatcatttaataataaatataacacataacaagaatttagtaatttttgttaccatgtataaataaagctttgactctatcatatgttgttctaggtacgaactctcatgtaatttttaattagatagaagtgacagatcatagagtttaccctttaaaggcattcggttcagtggggtttagtatgttcaaaagactgtacagctgtcataatccactaattccagaatacaacatcagcttatctcattttaaatcatagcagcctttaagtgcagtgacttatttaaaaacatcgttttgcaggggtttcaagtataatttacagagtttaaatagctcggcagattccagcagcatataggtgatggagctgagcatcaaagacagatctctggtccctaaactatgaaatccccttttaaaaacttcctttgtctctcatttgtgccatgaagcattcttattcttattaataatgatacaaaaggggagacattttctgtgtctgtgttgacttcttggcctctttttctttgtccctgaagagactaacagattttgtagtagtagtagtagtagttcctcacaactacacatatctggcccataacacatagataccttgacaaaaataaatctctctgagatggtgatatgaatttgcatagattgtcttgtagtgctaggggaatgttagtggtcccctcaaaacccagacaggagccgatatgatacaactcacagcagggtttttattctattcaagctagctcaggcctcctcagtgcattgctgtcatgcaggcagttttggtggtggtggtggtggggaagccccgaatatctattggggcaaggctttatagtaagcagcaagcagggagtatgtgtgcaagcatctaattggaaagctcctgtggtctttaacataattggctgatgctgggagtcatataataaacttaatttctgctcccctctgcattggtgggtccttagtcagggggtgagcttgtaacctggggtgcaggtttgttggagaaatcgcctggagacgctggtcttgttgagggtgtaacctgaaaatgctggttttgttaaggtttagcctagagagtggagctaagcttggattttgttggcggacaacttggaaactaatgctaggtaccagcctgtcagttaacctgagttcaaacttaggtcaggttctctaaaatggagactgaacataaaagatttggcctctcagtcttaaaggtatagttttgttagtttgttttggatttttgagacagtgtctcagtttgtaacctaggttgcccttcaaccaagacaagcttcctccttcagcatggtaagtgctagggttataagaataagccaccacatggcaaaaagaggtgtaaaaaactcaaatttgatagatcttccaagtcctactttcagttcccagtatatcattattcagcacagtgataagaacagaattacattgtgtgtttatgtgtgtgtgatgttttatttaacaaatacaggcaagatattgtagcatgtaaccactgtaaaaatccttattagagataattatacatattttatgttctttctgtctttgcagtcttgtttatgtcacaaagccacttttattttattttattttgatctattttaaaaattatttcttttactttttatattataatataattataacatttctcttttcctttcctccttccaaatgctcccatatatggcttcttgatttctttaaaatgtatggccttctttttcattaattgttatatgcatatatgtatatacatatagaaatacaaccttctcagactatataatgttacttgtatatttcttttcatgtctgagcatttggaattggaaaactagttggtgtgctcttccctaaggaagactcagcatttcttagttgcctatagttctttgtatagaattgagatcacctggacttttgcctctatttaaatgtctattgttgttgctcttatgtagctcatatttaggcagtaatgttggtgagactttatgtatgttgcttcttacattactaggaagtacaatctcacaatgaactccctgttcccctggcccttgcaatctccccaccccatccaccccctttgcaatgatctctgatctgtaagtgcgagagtaactttgtagatccattgggattgctctctgcaactctatattctaattggttttggttttctgtagttatctccatctgtaagagatgttttctggacatgcagtaaggaatacggttatctgtgagtataagtacatgtatttagaatgtaattagggactattcttgattagtaaagtggtagttgtagtttctcctccaaagtccatgacttcggttgccctgagtagttggctaggtttccagtaccagacatgatttccctctagtcaaggaggtcttaaatccaattagagagctgttggtgttggttagcatcaaagtataggtgctactactacattcttaaggtcatcatgccatgctagccattgttatggttcatcaatatcatagcttgagtggacttttggttgtctctttcttttagaatcttgtgccatgcttctggtactctgaaagctggtcatcagagatgagacattcagatcagtttcagctcatgagtctttgggctgaatagtatctccagaaatatggacttaccttccacttctggaaagacagccgactgcaatgttttaggagtctcttggacaaccctgaccagcaactcaaaacaaagttgaagtatctttgttacatggtctttgtctcttagaaggaacctgtcaactcaggtgggaaattttcatttaaactatatatgtataaatatatgcaggcttgtgtaaattgtagtagtttttggtagatagtttgagtttaaattttaaattatggtctggttaccccatgataattatataattgtataaccttggcaatttaaaaacaacaagcctcaatttcctcacaacaatagtacacatatcacaagattgcggcaacgtctaaattaaatgtgcatggtatatgtctctcaaacaatgttaaaaaaatagtagcatcagagagtggataaagaggggcatgatagagatcccattatgttatacggtctgtgctatccctaagctacctccctccaaggcaaattataaatatgcgtgcgcacacgcgcacgcacacacatacacacacacacacacacacacacacacacacacacacacatccgaaaacacaaacatctattaaatgtggctatcaacattgagagaaataacaacagacagcatacaaattcatgaaagctggacaactctccactggatactggatagttgtataagtaaagaaataaattaaagaggatcaggaaattgaacagaaaaatgaagtagtgggaaatggtgtacttggcataggccctagaaagtcccaggctccaggaaagctagaggctcccagaactcaatggtgatgacttaagctaaaataaacaacaaaaagatatagaacctatagaggccatctccagtatataggcatggctcctagttgagtgatggggccacccatgcatcccaaattttttagcccatacatgttcctatctaaaggaaagacagggacaaaaaatatctgcagacaggaaatccctatactattgctgatgccaaaaagtgtgtgtgtgtgtgtgtgtgtgtattaagctaggaagtacctgccatgtagtataccaatcaacttaaattgttctactaattcttgccagtttaatcaactaaaagcataaagatcattttttggcattaaatcccctttgagaaaagcattcatgtcattttccatctttaagaattagcagtggttcccagttgtcatcaaatagcaaaactctacttggcctggagtatacatagcatgtgtaggagtggcacaatgtcagctagtgtatgacctgcataactggaccacatcatcctggcagagaaatgtgattgagtagaagccagaggcccaaatttagttgagataatgatccacacactactgagatttaagagactgggaataagatctcaaataggacttaagacagattatccctttaagatttacatgggtgcagtaagcagtcaggagatctgttactattcatgctaagagcaaagaaacccaaatttgactatcaatagaagctatctttaagtgcttacttacaattagtgaggacttgactactaattgcttcatctacccagtatttagtttgctcaattatttagtactatatcttttttattttaaaaaggaaactaaggatctatgctggaacattgtaaagctaggcttcaattcctgatcggtctgattcaaacatgtgtgctctcaaccatcgtaatacctccaaaacacaatgctgatagtaactaaagagcattcacttggccactgggacacaagaataaaactgtctcagcaatgaaactgacttgtagtgaatgtctcgcttgttgtctactgtgtgctggcagcaatgagccaagtgcatattgaaactttcagggaaaggctaagaaattcttggagtagcattgaaacagactgcttcagtgatttgactcaagatttgattcttttgttgctgctaacagttcactttggcctatagagccattctgaaatttttgtcctgatcaccccctacagtctaaattttcagtagtcccaaacagcataatggttcctaacatcctacctttacattctgtattttcaattcatctctaaaagatgatatagcatgctggagtaggtggcccttccttccactgaaaactcccattaaaacaagtgacagccgggtatggtggcacacgcctttaatcccagcacttgggaggcataggcatgcagatttctaagtttgaggccagcctggtctacaaagtgagttccaggacagccaggcctatacagagaaacccagtcttgaaaaaccattttttaaaaagtggcaagtcctttcagagatattccacttttcaagatgaagttttctttttacagaaataggacaagcaagaaataggtaaaggaagaggatggtattaagaggcagcctctgttgaaaacttcctggatctctttggagtttaaagaaagctggggaccttagaatgttttctgctctttagtagtcagtgggaggaacaaagaatggtggcataaactgttgcccaatttttttatagtaaatgcaatgcgggaagtaatatccaaagaagatggatggcttctttgagaagtcagacacaatggtatctgtgtttctgaccaaaggtagtgtactatagttaaattacattggaagatactttaaagttaatttctaaggcaaacaaattgttagtgaattatttcctcaatgtgtatttccttgttcattgtggggggcatcttagacacattataaaggcaaggcagtactgcagaggtctcttttataatcattagtagtatctaaatgtttaccatgcagtgttttagatacaaaattcagggttggagttttaagagtacttgctactcttacagaggaccagtttggtacttagcatttatgttgggttgctcacaactacttgttacttcagcttcagggaatcagacactttcctttgacctctacaggcgcctacacatgagcagtcttgtgaatgcaagagagagagagagggagagggagagggagagggagagggagagggagagggagagggagagggagagggagagggagagggagagggagagggagagggagagggagagggagagggagagggagagggagagggagagggagagggagagggggagagagatataaatagaaagggtgcaagaatttcctaaaagggaacattctttgctatactttggactggggtttagtatccagaatatataaagaactgcaaaaattaaacactcactaaaaatttagtccaatcaataaatggactaaagaactaaatagacatttttcaaaaggattataactgattttatattggctgagcacagtgcactgcctacaagtaactcaacagattggagagagtcctgtccaaatgtctcagttattttgaacctcttgcaggcagctcagctggcttttgcttattccaggcaactagtttgttcactgaatctcctttgcagcctggcttgtgtgagagtgaatctcgacagcctttcctgtgcacttttgggagagaaatcctaatgaatctggtcagtttcaagaacttcctgaagctcattgtgagttgtttacttctgtcttaaagagcttccctgcaggatggaatgtttcagtatctgaagtcactgttaaacaacagagctaaggtgtggacaaaatgcacatagcttatttttaataccagccataagaatgggagaagtaagtagaaagaatagaaagtagtaagttaggatatacatttggaatcccactgaagcctccaaaatttagaacaattacagcttctctctctctctctctctctctctctctctctctctctctctctctaacacacacacacacacacacacacacacacacacacacacaaacacaaacactaatcatcaaatccaggaaatacaacatttacacaatacatagaaaatctgcattccagtctcaatttttcccagtgtctccaatgatattctagtagctgtgtgtttcatttgtttgttggtttctataaggttgaatccaataaaaaaaatactgggcaatgcatttagtttgtcagtttctttgatttccattaatctagaagcttctctgattctacttttttttttcattttctctttcataacattgatatttttgtgaatcctggccagtattttgcagatgtgtctcaattggatttgtatgattatgcctcatgaatacattgtgattaaaaaaattaccacaatgttttgctctcatcaggaggaatagaatattattttttgcctactggtggtaacgttagtcattcattaggactgtgtccaacatatttctctattgcactgatatcagtaaagcttttaatctgtgtgaatatatcctgttcagaaacaggctctttaggctgaaagtataaattacttggttcactacagaaccacgagttgaaaaggcattatccctaattaaaagaaaaaaatagaacagatttattttaatcaaataagctgtcattaagcttcttagccaaattcaagagctattcacatgacagaagactttatctatataaagtcccttatccaaattgtgaaacgtttgtgggtgattttgtttcactccttttggatggctcttgccatcatctaagttagttgccttacacatgtggtttgatcagtatacgtgcctatattgttagatctgagcctagtgcctaagctacagtagaagctcaaaatctgtggagcacatttttacccaattacaactactgtcatcatgaatgagaatctaatcacactaagtggaaagtatacttgactttgtcagctggcaccagctgtaataaacttggctgctttcagaccgtgcttctcatgggaaatgacagagctttcggttttcatccagatctttgaccttcttcttcaggtgttggtcaagtctatagttgtcctgaaatggataacttctttatgttgaaattagaagctgtcctaagtaaaccaaggatcaaccctatgcttgttaagattcagtctaagcagaaatgacagaaaactctaaattacaatgggttaaataatagagtcatttattcctctctgatgtaacatttctcacttctggccaagataagataacaagaaccagatttactctcctgccggaaacaaggcgaaaaccagaccaaatgaaaacaatagccctcagacattggaaatgaggcaacaacaacaacataccagtgacccctgcaaaacaggaaacactgaaggcaagttctttatgtttttaaagcttaattcctggagggcttccaggcaataatatgtagaaaggataccaaagcagagttttacaggtgaggagatgatctgtgctccaagtccaggaggaacgtggcaactagaatttacacagccaagtccagaagaagacaagactatgtaaaagaacttaagatcgatagcaagtctccagtgaatctttagcagagtactgatcaacatgtgtttgtatggaatctaacatagaccaagagggaaaaacatcaaaaagaaacagtaataataatcacagttctaagatatgacataaggctgaaaatagtgcatcaatacctaaccagggtgaaaaggctccttttgcatagagcatcagatagagtattcaaaagagcttgccaaaatagcctttgattcatggatacaccagagctggataataaaacaggcctggagtgactcccttacaaagtccaaggatatttatagaaatacaaactgtccagcaacaatcaagataaaattcacatctggcatcccatgcaaagtcatcaggcatttgaataagctggaaaatactgatcactaatgagaaaagtcattcattcaaaactatcctagaagtaacagatgacagaatcagtagcaaatttttaacagttaatgtaactttttacatacgtttaaactcctagaggaaaaactgaataagttaagatatttagaagatctacatagaactcagaaagatgaagaatgcagtgttgagctgcttctcaagtctacctacacagttaaatgtttgaatgacagctctattgactctttatattgtcttacatctcaatttatgattttcaatttgagtctacagttgttgctctagcttcaaccaacaaaacttcattgaaaaaaagcaagagactagtggaaaataagaatgcccctccatttaaagaaactcatacatttcatggtttagatgtttgcatactatgactgtaataaaacactgagcaaaaaccagcttggggaggaaagggtttcattacacaattttcaggttatgctctatcatggaaggagttctggtcagacactcatggcagaaattgaactagaggctatataggaacaattaatggcttcttgcccacagcttcctcaacttaccttcataaatcatccagaaccatgggccaaatggtacttctgcacacaatgaactggaccgtctcacatcaattatcaatcaaaaaaatgaccccatcaatttgcctccacatgctctcatggaagcattatctcaaatgatgttccttcttctcaaataactctaccttgtgtaaagctgacaaagaactaattcagatggcatcaacttttgcttgcatcacataagccaaaactttagtaccactgacccattctgaaagtgaaggaaaaaaatacagtcttatgttgcccttactgcaagaacaaagaccattcccagcaacaagagtgttgattgtctagaaaatgttaacatcactcaagagcaacatgcagtcattttaagggtccccagaactctctggagaggttgcagtcaaatgagacttcttagtctccttagaagaagaagagactgagttaacaaatagtggagaaaatagaaaggagttgataactgttcatactctctgcagttacataaaaaaaaaaaaaaaaaacatggtcagaggtgttacaatgagattctgttacaagatgaggactttttacactcaattcctcatcaataccattttttcacagtagaatggatcccttgttgaaatccaaatgtcttggttgaaaaacacatcttcagggtttggatgaatacagatgctgcttgttaacgatcttaagtccaaaatgatgagtgagtccttgaaagacatgatattgaacttgtttcaaattcagcttctttggtttagcaagccacaaaagttaagaacaaggtcattggaacatttcaggatagtatttgtttctaaaaggggaactgtgcagctggttcatgaagatctcagttatccagctacataaagaagacagtgggttgttaggccaatttgtggtattttaatgatgcaataaaaaaaaatcctattgctttgggatacattcgtaatctctgtaaaccggttggcaaataaaacaaatcaacccaaggaaaacatataaaggaccattaagacacctcgtggcataaagctgttaatccctttggcacacatggcagaaggagagaactgactccctcaagttgtagtagttgaacctccatatgcccaccatggtggttgtgcacatacatacatacatacatacatatttttataaagaattggtcttagttctgggtggctactgttcccagctaaaagaccagagttctatcagttagcaaagaataaaagagtaagaatgaaggggaaagaagccacaacttgtccagttgaaagccttgtcactgttctggagcagtccttgtctgaggatgaataattatgacccttgtctttaaaataatcttaataagactccccctaggtatttttaatatctagagaatttcaatctatgtaatttgttttcaaggatttgttttgattctaggccccacacctctgcatatttgggggtttatctcaaacaaactgccagagttgttccattttcagtcggtggcaccaagctagaagtggaacttgcactttgtttaacttctaactatatttatcatttctaagacaccaaggtcattcagtgtgtttacaccgtagtcctgggtggctcactttcttccctaataaagtcactatcacatacatctgaagccacctttcacaagccccttcatgtttaatgctgttgaacttcattcccttcttcccataggtacaactttttctctgaactgtgtaacacctatacctacaaccttcttctggttgtccttataactgattggacaaattgaataacctggttgctacaattcattggatatttgaacagctttcactattttacatggtctttattgctctcaccatgtcaaagtaggtactgttctctttctgagatgataaatggtcatatagctggacaatttttttcctcgagccaaaaaaaaatattactgaaaaaaatgctgcacaagacacatgtcattgctggctcactaatgttcctgcagagcatttttcactagctctgtgtgatatcttgagaacacaaaccaaaagctctgtaggaagtcaggcctgggtgctttccagttactaatggctttgattgctttacaaccttccattcagacactgcagtgtgacattttcactttccctcataaaagctctctcctcctgtaatcatattgcttctgtgtgattagcatccaaaccatcattattctttaggccaagtcagattgaatctgcaacttaacatgcataaaggtttggaatagcaaacgaacatcttaaagaaatgctttagtggaataaattaggatgaaactttcagtgctgatttagattccagattatgaactcagaggaagatggtttccctgctggatcctgagggctagcctactgtagacctgtccacaaaggtcacatggaatctgtctggcagacattctacttgccttgctgtgctctatctcagttgatttctttttttttttttttatttttacttttattttttattagatattttctttttttaatatttttattacatattttcctcaattacatttccaatgctatcccaaaagtcccccataccctcacccctatttccctacacacccattcccatttttttggccctggcgttcccctgtactggggcatataaagtttgcatgtctaatgggcctctctttccagtgatggccgactaggccatcttttgatacatatgcagctagagtcaagagctccggggtactggttagttcataatgttgttccaccgatagggttgcagatctctttagctccttggatactttctctagctcctccattgggggtcctgtgatccatccaatagctgactgtgagcatccacttctgtgtttgctaggccccggcatagtctcacaagagacagctacatctgggtcctttctataaaatcttgctagtgtatgcaatggtgtcagcgtttggaagctgattatggggtggatccctggatatggcagtctctagatggtccatccttttgtctcagctccaaactttgtctctgtaactccttccatgggtattttgttcccaattctaaggaggggcatagtgtccacacttcagtcttcattcttcttgagtttcatgtgtttagcaaattgtatcttatatcttgggtatcctaggttttgggctaatatccacttatcagtgagtacatattgtgtgagttagaatcaacagtcctggataacttaggaaagtgaggatttttgacttaacaaaacactgttttttacttaaaacagtgtgtcaaaagaaaattccaatttctttttgggaagacagtggcctcagggaaaaggaaagataggaataatgagctggtgtgaagcaaaataagttatgagactagatatttttataatgataaaatggatattaagaagttcagctttattccatgtgaaaatggaaaggaatctttttttcaacatggatatttgaaacttgatactgaatgatctcaaaaactcgaacttggttccatttattttaagaattatctccttggccatgactatcaaaagttggcatgacagcttgaacgtcaaatactattaatactataaatagaaaacaattgctagctaagtatctcactttctgactgctttctttttattgatttgtaaagtgtatcattctttgagctggattgcactaaatctgaagtgtctaaatccaagtagtcattcttcccagaggaggcaaatcaaggaaggttttgtggtctttcaggagaaaaatcccaagaaaacaacaacaaaaaagcaaaacaccttgttgaaaatttcatctaatgacatataaaaggccaattcagctttaagattctgtgcctttcttttcagtggattatatcgaaagcacaagagctctcagtctttcggcagtgaggcagggtgatgaagtaggattaccaaatcaataaatgtaacattaagcttattgaatgtagtacattttttgatgcctctgtatttcaggcttctttgttttggtcacctttctttctttctttctttctttctttctttctttctttctttctttctttcctcttttgtgactcagggtctcgctatgtcatagtgacatatagactaggctagccttaaactcacaaaaatctacctgccactgttgcccaagtgctgggattaaggcctgtgtcaccaggtctggcatttgctcacatttcttaactgtgatcctttttttagatctattagcagaacacttttttaaaaaattagtcttcaacaacctttcctccactcctccatcctgtctattttgaagagtctctgtcttcatcccaagtcctattttaccttggaagtccatatctaatatattcttgccactcttgtatgccacacacaccagggtagttcacaggctgtctatctcccctttctgattctgctatttcaacctctgacactgtgctgagcttttaaaaacttccaagccactaatctagtcaaattcctgcaggatacagatgaggaagcagccccctcacccccaaaaaggagggaagttttggaggaagtcatgtaacaaattagaggctgggagcaccatttctatggttctagtaatccatttctccatgccacctgtcaaccaaacagaaaacactccagaatgtcagagtgatttgctgtgttaaaaataatcacttgtttgagaaacaggaaaaaagttgctttggggcatccttggccaaaaaaaaaaaaaatccaataaagaagagctgagtaacactgttcaatccctacatctatttaactgttcacaaatgtcttctttcattgttgtctaagattgcctaactagtgaagttgttataagaacttaagtcatacaggcaaagtagttaagacataatagatgtaaatgaacaatggtacttaatagtatagttatttcttggaaatgtaacatgttttctttcagcattatggtttctgattagtctatatacaaagaaaattcaaattttagctctctgaataaatgagctcaaggtgagttcatctggtttgccaccagaatgtcattttaagatgtagattgatagccatttggctgtccttttttgcccctctgtgaaaaaagcaaagtgcaaagtagaggatggggtatgagggttattttaagttcaagtctggaaaatgctattcttagctttgactttcataatccaactggaataaatgaaagagaaaaattgtcataaggaatggttatttttcttggagacgttcacttcttgagaattcacaaacaaattgtccttgcctgtgactaaaatggtagatttctacagagggacttcaaccgaaataaatgtccattttggaaataaatattcagaagcaacactgctagcattgcctggtttcatggtgcatttatttcctatttgtttctatgcctttccccaaaatattttccaaggcaaagtttgtaattggggcttgaatcacaaaacccagtttatttacgtctaccaaaaatttgatttcccaaaccccaattccaaacaactatttcttcctagaggtatacagcttctactgggtttttgttttagagattttaatatgcctactcttccactgatccttggagtttgaaatttgctctctcttctcttaattcccctgtcttctttgagcatcagttctggattattaaaagttaatcaattaaccatagattagttaatccagctagaatttcacaagagccaagagtataaatgtaggtgcaatggccttagagtttgagagcttgtcttttctgccccattattcagaaatttctaaagtgagctgagacttcctgggaatgagttcatagaggagactgtgatgatagtgacggataggatttttgcagaaataaagtggtataatgtgagtgtgtcatttaggtagaaaagcatagggtagatgtggggaagtacttactttgacttgagtatgagattgttttaaggaggggctgttcaataataactatttgaacatagttggaattatacaaagataacctatttgacaagatagacttgtacttatttgaaatgttgttccttttattttttgttcacttccaattttcttccctttttgaatagtacatgcattttataaaataaaattaatatgatctaaaattaatagcatttgaactccctaaatggaactgattaatacacacacatactctctctctctctttctctctctctctctcctagatttctcccttgaaaacatagtcatgcaaataatttcatattgagaaagacagagttctgagattcataccacttcttatatgatttgtataatcccaccttgtcaatattttatctgcaaatatgatgtggtctttttcctttgattaacttatattacctggtaaaggtgtagtcaaaaatgtatgatgaacaaccatttccatgattatgttatattatgtaaaaaattttatctgatgttgaaaaaattcttcatgttttgaaagagtcacgtgacaaatacctgagaagacttcctgagaccaaatgccagcaggcaaccagcaataaaacagcctccccctaaagccacaaagaacttaatttagccaatgacaaatgatcttagattacaattctagttggttctttgaatccagccaagtgagtatattaatgctattttcttatattctacatttttttattctttggcaagtgtccctgatggaggaatgactccccagggcaaaccaaaccttagggatcacaaatagcatatcccagaccacaccataccaatacaaactgaattatctggtatataagatacctcttcttcctgtcttttatgtgttaggagacaatattcctctctttcagccattttagggccaggtgcaagaaaagtagaaataacctcatatcacagtgcccagtgaattatccaaactaaactagtcaagcataacctgctaccttgtcttgcatttctccatagaaaccatagaagcatccctgctcatgatgttcctccctcttatctcctcacagtacttggtacttccctacgtggctctgtgtggcacagcaaacttactcctcttgggaactataagaaactacattttaaatagcagtcacatcttcatctgaagggctcagagaaaaaaaaatgaattaataaattgaaagccctatgttttaaaacagtgatagtccttaagcagaggcccagtgaaattgtgctgatgaaaactgtggcttcataaaacttcattgttaattaatctttgaaatgtgtaaccatttgttttgcagtaacagaaaacctgtccaacatgtaaaaattctatctaagcatacaatagtcatttctaatctatttgcccacttactataggatgtatatcaccatgccattgaaagactttgaatagtgaatgaaatacagggagctgagcatgaaatagcactaaaatttggggcagatgagaagcaataagtggagaaagcttggcaggaagtcttgggggtaataaggatcaatggttcttaacttggaagtcacctggaacagatttttggacacagatacccagggctcaccactcctagagattttccttaattttccatagatagaatgtggataaacaatgttttatctccctgagtaactcctttgcacatcaaagtttgaggctttgagatagagttagtgtcattccaaataaaggtagttcaactaaaggagaaagagaagattggctgaaaaagccattgctaaagaaactaccaataaccaaatagtaactcaactgggaacactacagattgtgtttttgttatttatttgtgtgtgtttaattaggttcttattcttctagtgggtattttttttaaagaaacttcttttttattattttaaatactttattttaaaacagatggaatataaagagaacagaagctagaaattctcactgcattatttttattgcttatacaaataaatatatgtatgtagattatacatactagatataagtaaaattagtcaataaattatgacatgaaaatacagttttaaattatgaagggggtaaaaattgcatgtttaaagtggtgtattcattcacatactctctctcagggaggcagaggcaggcggatctctgagtttgaggtcagcctggtctacagagtgagttgcaggacagccagggctatacagagaaaccctgctcaaaaacccaagagagagagagagagagagagagagagagagagagagagagagagagagagagagaaagagagatttttaaagaaatttcttgaagaaacaaaaactttaagctaactatgcatacatgcatacagttactagaaagaatgctgaggtttcagggatacttctagccaaatgaatgaatgaataaatgaatgaaagccttaggttgacaagcactgctctacacactggcttgcagttagttgacacagtgagctaaattcgaataactgagccaccattcagaggcactgactggtgacttttaaaagaaaggaaataagctgattttacaaagcagtagctaaggcagagaatctgagatatactatgaagaaaggcatagaaaacctagggattggatacttcattcttccttagaatagggaacaaaatacccatgaaaggagttacagagacaaagtttggacctaagatgaaagaatggaccatccagagattacccgacccggggatccatcccataatcagccaccaaattcagacactattgcatatgccagaaagattttgctgaaagcaccctgatatagctatctcctgtgaggctatgccagtgcctggcaaatacagaagtggatgctcacagtcaactattggatggaacacaggacccccaatggaggagctagagaaagcacccaaggagctgaaggggtctgcaaccctataggtggaacaacaatatgaactaaccagtaccccccccacacccctggagctcgtgtctctagctgcatatgtatcagaagatggcctagtcggccatcagtggaaagagaggcccattggacttgcaaactatataccccagtacaggggaacgccaggaccaagaagtgggagtgggtgggtaggggagcaggacctggggggaggagggtgtagggaactttctggatagcatttgaaatgtaaataaagaaaatacctaataaaaaataaaacctagggatcaaagaccttagatttcaagtcctcttaggtgattaggtgattaggtgatacctgattgctactggacgacacagaatccatccactgccgagtcttccttgttgaggtgggagcatgaaaaaatggatggaaacatgatgaaaataaagtagttctcaccttctgcagtagtagttctcaaccttcctatggctgtgactttttaatacagttcctcatgttgtggtaattcccaaaccataaattatttcattgctgaatcataattgtaattttgctacttttatgcattttaatgtatatcagaggacagttgcatgaaataagaattagcaatacaaactgataagtaagagagcccaggatttccttctttacagatccccaaagggaaactttctgatactatttctggttctgattcatatttctggctgtatttcaagatgtgccatgtgacatgtaagctggtcacttgtagcgagagcaccacatggccattcctctctgccttaaatggctgagtcgtacccacttccttaagagtataaataatttactctctattcgactgaatccagttaatatcatttcccaaaataccctgcctgtgctcttacatttactaatacttttcttgccaaggtcttctaaatatcctgtatatttattttattggtaaaaataccacctgacccaaactctgaagtaaaggatagaagcatcattactcagcccaatgggtttgttttagagtcaaactgtccctctcccttgggactgaaaacaactgtgtgagtccctgcttttcatcataggtttattggctaatgaggcctgtggctggtgtggttttcctgtgtttagcttttggagctctcagagacagttgcttggaacagagagctgacagaattattgcccagcaagcttgctggccacagctcacaacattgcactaccaatgatggattttatggctgacttaatgagcagaacaagtatttgaagaagcacagtgaagagctgttggcatcccattctgctgtgtgaagaggtctgaaagtcttcttattaagccatcctttatctatgtctttttgctcaagactttattatcctttctgaagtacctggacagtactttctgtgcaactgtagattcatgtgaagtcattgggatggaagacttgggacatagctctcccagtttccgtgtgatgaaagaaaacatagaacagaaaatgactgaagttcttgttacctcaatgtttccagctatcaaacttctagtcacacttagactattgaagatatgtaggtaggtaaggagagagagagagagagagagagagagagagagagagagagagagagagggagagagagagagagagagagagagagagagggagagagagagggagagattagatagagataaagatagagatattcttaaagcatttacatcttggctcacaagtttgctgaggattggccactctgggccagcctaggctcagtattgagtctgtgataagctagaattttttaggctggatgcagttttgcatcacatttttcctcttcttcctcccccttccccctcctccgaacatcagtgagctagactcactatgttctcttcatatttgaggctgaaatgcaaaaacagttacacagagtacctcttaggcatagactataaaagtcttagagataatttccataacattctgttagctaaagcaagttatatggtacaacccagaatcaatgaatgggaaatagccttcatctcttccaggaaggaaatcactaaagtgcaacagataaagacccaacaaagaaccaaagtcaaaagtgcaatctaccacaggtggatagggcagacatgatggctcccaagttgtaggtgaaaagcacaatgctcaaagctaaatgtgactcaaggtcaccacaaaaatttgggaagtgacaaaacgcaaatccaactctcaaaacttttcattctagttcctttgtgccattctaagtatccctactatattcccacaacttgttaaagggctcgaagtatttgggagaatgatgctttgaggccgtgttttcttttctttttcaattttattttatttttaatttatttttacacatattccattccccgcccctccccatccaccctcagactgctccacatcccacacctcctccccatcccacagcatctccacttggatgtccctacctccaccccacctgacctctaaactctctggggcctccagtctcttgagggttaggtgcatcatctctgaatgaacagagacctggctgtcctttgctgtatgtctgttgggggcctcatatcagctggtgtgtgctgtctgtttggagatccagtgtttgaagatctcggggggggtgggtggtccagattaattgagactgctggtcctcctacagggtcaccctcctcctcagcttctttcagccttccctaattcaacaaaagggtcagctgcttctgtccattggttgggtcgtgttttctttctgtcatttttccttaagatttggaacattttcctgtttcacagtcatcaccattcagacatgactgagcaaggagtatgaatgaaatcacatcggcacacacacacacacacacacacacacagagagagagagagagagagagagagagacagacagacagacagacagacagacaaagacagagagacagagagacagagacagagatggaaaagtatatatacaaaatctactgtctggaaaaaatgagtaaaatcttcctttttttttttaacaaaaatgggtttaaaaagaaaatccaaacctcacatagcagttgaacaataataactttaatgctgacatactatattcctttgaaaaacaagaatatatgccgggcatggtggtgcacgcctttaatcccagcacttgggaggtagaggcaggcagatttctgagttcaaggcctgcctggtctacagagtaagttctaggacaaccagggctacacagagaaaccctgtctcaaaaaacaaacaaacaaacaaacgaaaaacaagagaagagaagagaagagaagagaagagaagagaagagaagagaagagaaagaagagaagagaagagaagagaagagaagagaagagaagagaagagaagagaaagaagagaagagaagagaagagaagagaagagaagagaagagaagagaagagaaagagaaagagaaggagaaggagaaggagaaggagaaggagaaggagaggagaggagagaagagaagagaagagaagagaagagaagagaagagaagagaagagaagagaagagaagagaaggaagagaagagaagagaagagaagagaagagaagagaagagaagagaagagaagagagagagagagagagagagagagagagaaagagagagaaggagaaggagaaggagaaggagaaggagaaggagaaggagaaggagaaggaagagaagagaagagaagagaagagaagagaagagaagagaagagaagagaagagaaggagaagaaagaagagaagagaggagagaaaaccaggattattaaatcaccagaaacccgtcagcctctcgagttccgattctgagttttactcagatgttactaggcccacagtagttcttggttagagccttccctgctggactttagagcccagtggctctgatatcatgaatctgtcccattctgccctgtccgttagggtagaagttcacactacatgttctcattcctagcccagagaaatttaagctgatctttctgacactgactaagaatttctctagtgtaagtctccatgacaactctgtgcccttgtctttcaacatgtttgcactcctaaatctagcctctggcatcctataggtaacagataccagctgacctgaaatttacccactctgggtttatggttgacctatactgacaatgtgcttgcctcttataaaccatctatacagaggggttcttctaactccaggctctgaaatcctcccaaccccagcccccatttctttgtcagttttctttcctgatctattttataacacaactagcagcagctgtctgatatggctggctggctagctctaacattcagtaaggtgcagcttcatatcttttcattctcatggttaacgcagctcagccacagccaaaaggcagagttctaatgttctatttcccatgatttcttggaagactaaaagactgattaattacttgcggtgattttttgagacaggaggtaagttagtattctctataatggtagaaccaagagagaatgactgcccatgagcctttagaaatgacagctaaatccagggtgggtaggtggggataaataaataaggataaggttgtcagggggaaatgttgctactagaaaaatattactgctgcttctgaaagtctataaattcagacagtgtctgcttttggccctgatttttttatgctgcctcatcactcaggagagagcttatagtggccatgtcttcaaagatcaagagggagaaaagtagagctatggaccttgtatatggaccccacatggatatggggcctcctgctttggaatactgcaccaaatactgcatacaaatacacaatactgcattatggactgtgggatgagtgtaaggattctgctgtgtattcccaacttgcttgcctcatgcttggcaacacaatataatagtactgagtggcagcttcagattatctagacatgaataaatctcttttactgtgtacaatttggcaagtttcttaacttagtttattcatccataaaatgggcattatatatattacttcatatagggcttcatgaggaataaatagaataatgtccataatgttcttgataccatgctgtgttcatactaggcactataaaatattagtaattattatcttagctgatgtacatctcagagaactttcaaaaaattaactacagtagtgaatctagacagtgatatccattgactgtacctttttagataaccgttttaatatataacaaaagctttccttactcacctccacttaactgaattgatgggttaacttgatgcttgccttccttctgaaatacacatgctgactaatgcttgggatacactggacgctcaagggcagtttacctgcttctattggctccttatacttccacttctacacacagaacttaattactaccaagaaatacttgtgttccttccaaatccattctgctagttataattaagcaccaggatatacacttgtgaagtatgaaaccatagaacaactgtctccatgaaacctgagttcagggtttcgaaagacttgataaagaaagtttccttaaacccagctctactgctcaaagaaagcagaagctggaaatcaaatggacatacagttgggctataacttattggggaacacacctgtgaaatttacatataagaaaaagcattacagcctaaggccagactgtgtgaattagtgagcttgaatgttttagggccctttgcaccacttttatcaagtggtgcactttgatattctttgcccactgtcttgagaagctcttttgacacctccagacctgctatgttctcttcaatcagcctttgagcctcaatgcacttgtcatcatcttccccaaattctcatcatctggttcttctcccactccctccaagtcacagcttaacaatggtccttctctgtattaggccttccttgataacaccctcttaaacccatagcccctagcaccatgtgtttctttgtaacactaactgatctgtcaattacttgaattctttttgtctccttctagataaaagttgtattctcattggaagtggatttatgactcaaaataatgaatggaattttagcctcagcttcctaaattgtctgtctctgccattgtgagctcagggaaggcagaagtgttctctgtcaattcactgatgcaatattatcagcgcctacctcatagcataaatcaaacctaatatctaaaatacctttggcatctttgttgtatccagacaaaataggtcttattagtcatcaattattattattattgtatattatattgtatatatagtacaatatacagtatggtatattgtataatataataaaaaatatattattgtagatgagtatggaagtacattgcttagtagttcctcaaacttaaatgtgaaacagaaccactgagagtgtttgctaaaataactggttctcaaacctaagcccagttttgattcttccagtgcagaatgtcatctaggaatccacattttgagatgtgccttcgggctactcagaccctgattgtctaagaatcactccccacccacacacacacacacacacacacacacacacacacacacacacatccagaaaggctaatatgaatttgagtgaaatgtctacagtggcctgcatatatactatctaccagacagtcttactattagtaaggcactgatccaatcaaaggggctttatagaaaggcatcattttctaatttaaaactatgtaatagaatacaaagaaggaagtgttatgagcccttcaagtaagagaggtactttactcgaagtcacatggcttctaagtggtaacactcatcatatttacctccaaagaccacactccttgccttcgtccaggttacccgccttcaggaaatttcctccattgtagacttgtgggtccttggaaggtttaatgcacacttaccacttggttatgcttggttttcttctttcagaagaaaaaaaaaagcatattctttcagaccttctcaaattccatataattctcatctagggaagagaaaagaaaactactgaacctttgggcttacttggcccttcttcaaaacaagaaaaaccatagtaagagacaggttttattcttttttctttcattttttttccttttttttaattcggtattttcttcatttacatttccaatgctatctcaaaagtctcacatgcccttccccccactctcatcccccctccctactaccacttcttggccctggagatccattgtacttaggcatataaagtttacaagaccaataggcctctctttacactgatggccgactaggccatcttttgatacatatgcagctagagtcaagagctccggggtattggttagttcatattgttgttcctcctatagggttgcagatccctttagttccttgggtactttctctagctcctccattgggggccctgtgatccatccaatagctggctgtgagcatccacttctgtgtttgctaggtcccagcctagtctcacaagagacagctatatcagggtcctttcagcaaaatcttgctagtgtatgcaatggtgtcagcatttggaggctgattatgggatggatccctgggtatggcagtctctagatggtccatccttttgtctcagctccaaactttgtctctggaactccttccatgggtgttttgttccaaattctaagaaggggcaaagtgtccacactttggtctttgttcttcttgagtttcatgtgttttgcaaattgtatcttatatcttgggtattctaagtttctgggctaatatccacttatcagtgagtacatatcatgtgagttcctttgtgattgggttacttcactcaggatgataccctccaggtccatccattagcctaggaatttcataaattcatttttttatagctgagtagtattccattgtgtaaatgtacaaattttctgtatccattcttctgttgaggggcatctgggttctttgcagcttctggctattataaataaggctgctatgaacatagtggagcatgtgtctttcttaccagtttgaacatcttctggatatatgcccaggagaggtattgtgggatcctctggtagtactatgtccaattttctgaggaacctccagactgatttccagaggggttgtacaagcttgcaaacccaccaacaatggaggagtgttcctctttccccacatcctcgccagcatctgctgtcacctgaatttttgatcttagccattctgactggtgtgaggtggaatctcagggttgttttgatttgcatttccgtgatgattaaggatgctgaacattttttcaggttcttctcagccattcattattcctcaagtgagaattctttgtttagctctgagccccatttttaatggggttatttgattttctggggtccaccttcttgagttcttcatatatattggatattagtcccttatctgatttaggatagttaaagaccctttcccaatctgttggtggcctttttgtcttattgacagtgtcttttgccttatagaagctttgcaattttatgaggtcccatttgtcgattctcaatcttacagcccaagccactgctgttctattcaggagtttttcccctgtgcccatatcttcgaggcttttccccactttctcctctataagtttcagtgtctctggttttatgtggagatcttgatcatcttgttaggtgctgagaaaacatttgacaaaatccaacaaccattcatgataaaaagtcttggaaagatcaggaattcaaggcccatacctaaacatgataaaagcaatctacagcaaaccagtagccaaaatcaaaggaaatggtgagaagctggaagcaatcccactaaaatcagggactagacaaggctgcccactttctccctacctattcaacattgtacttgaagtcctagccagagcaattcgacaacaaaaggagatcaaggggatacaaattggaaaggaagaagtcaaaatatcactttttgcagatgatatgatagtatatataagtgaccctaaaaattccaccagagaactcctaatcctgataaacagcttcaattaagtagctggatataaaattaagtcaaacaagtcaatggccttttgtacacaaaggataaacaggctgagaaagaaattagggaaacaacacccttctcaatagtcacaaataatataaaataccttggtgtgactctaacttaggaagtgaaagatctgtatgataagaacttcaagtctctgaagaaagaaattaaagaagatctcagaagatggaaagatctcccatgctcatggattggcaggatcaatgtaataaaaatggctatcttgccaaaagctatctacagattcaatacaatccccatcaaaatcccaagtcaattcttcaatgaattagaaaaagcaatctgcaaattcatctgaaataacaaaaaacctaggatagcaaaagctcatctcaaggataaaagaacctctggtgcaatcaccatgcccaacctaaagatgtactacagagcaattgtgataaaaactgcatggtactggtatagcaacagacaaatagaccaatggaatagaactgaagacccagaaatgaacccacacacctatggtcacttgatcttcgacaagggagctaaaaccctccagtggaagaaagacagcattttcaacaaatggtactggcacaactggtggttatcatgtagaagaatgcgaattgatccattcctatctccttgtactaaggtcaaatctaagtggattaaggaactccacataagaccaaagacaagttttattctgatggtcaagtgctctcttggaaactatgacctgaatctgagttatagatttagtgcatgatggatacatgagcactatgaaacaaaaaatactttagtggatgaaatgtgtatggagagcagagaggaatgtgtaaacaaggtcatcaaggagtcctgtccatagccattgagtaacctctcttcatgcttgccctttcctatacacttgatgttggaatttccattaacctgatttgaataaaaccagaagcagcatgacatgaagtgtaaagtttttcaagtgctagatatgatgacagatgtctgtaatggcaacactctcagtgctgaggaaggagaatcaagagtttaaggccagtcacagatacattgcaagttccaatgtagtgaaactcaaagcaaacaaaagtacttcactgaatagaagaggtgattggatgatagagcttcctcttgtacccacctctggcttctaccttctgctgcagagcaatattctggctgacaatcatcatgatatttaagtaatatgtttggaaataaaagccaggggcagactcaccaaaggtcattagattttttgccagataggatttaagataaagataacaaatagaaggttgcctgcccactccacccatgactgtggctagctaccacagagcaaaaatcatgaggccaaaaattggacactctgggaaagaatgccagaattgactagtgatgcctgccatgatcatgaaggctgactatattttcaacattcttgctccaagccaatagttcgaaagtctgattgcacacagaattacagggaacattttttaaaaaatactaatacctggggtctggttcagataaatgaagttctctagaggtaagttctatgtactatagcaaccagaaatgctgctgctctgcatgattacagatttacagatgattgaattctgtagtttcaaatggcattctattctctcctaccaggacttactacattacaaccatctgagcttgtaaaatcatgaattctttgcactaactcctcaaacttttttatttatttgtttattttattagatattttcttcaattacatttcaaatgctattccgaaagtcccctataccctcctcctgccctgctcccctacccattcactcccacttcttggccctggtgttcccctgtactggggcatatgaagtttgcaagacctaggggcctctcttcccaatgatggccaactaggccatcttctgctacatatgcagctagagacacagctcttggggtactggttacttcatattgttgttccacctatagggttgcagatcccttcagctccttgggtactttctctagctcctctgtcgggggccctgtgctccatcctatagatgactgtgagcgtccacttctgtgtttgccaggcactggcatagatttgtaactataggggaaaggcccaagaatctgcgggtttaaaagccagactcagaaagacatacatttaatgttttctctcagacgatagtatctagatttaagtaagtgtatgtgtgtgtgtgtgtgtgtgtgtgtgtgagagagagagagagagagagagagagagagagagagagagaatcatgatagcataagcatgacaagttagaagaggaagggatctaatgaagagaaaggggaataaaagagaggggtaatgggtacataaatgctagcagaatagatatgtgtgtgtgtgttctagtgagacgcatcatttttacaatgaatatacactaattaatttttttatttttttaaaattttttaattaagtattttcttcatttacatttccaatgctatcccaaaagtcccccagaccctcgccccccactcccctacccacccactcccacttcttggccctggtggttcccctgtactgaggcatataaagtttgcacgaccaatgggcctctctttccactgatggctgactaggccattttctgatacatatgcagctagagacacaagctccggggggtactggttagatcatattgttgttccacctatagggttgcagatccctttagctccttgggtactttctctagctcctccattgggggccctgtgatccatccaaaagctgactgtgagcatccacttctgtgtttgctaggccctggcatagtctcacaagagacagctatatcagggtcctttcagcaaaatcttgctagtgtatgcaatggtgtcagcgtttggaggctgattatgggatggatccccagatatggcagcctctagatggtccatcctttcgtctcagctccaaactttgtctctggaactccttccatgggtgttttgttccaaattccaagaaggggcaaagtgttcacactttggtctttgttcttcttgagtttcatgtgttttgcaaattgtatcttatatcttgggtattctaagtttctaggctaacatccacttatcagtgagtacatattgtgtgagttcctttgtgatgggttacctcactcaggatgatgccctccaggtccatccatttgcctaggaatttcataaattcattctttttaatagctgagtagtactccattgtgtaaatgtaccacattttctgtatccattcttctgttgaggggcatctgggttctttccagcttctggctattataaataaggctgctatgaacatagtggagcatgtgtctttcttaccagttcgaacatcttctggatatatgcccaggagaggtattgcaggatcctctggtagtactatgtccagttttctgaggaaccaccagactgatttccagagtggttgtactcacagtatgatgctctttggagctttcatcttatcagaaatgatgcccttggtttgattcccagcacacacacacacacacacacacacacacacaaaggtggggagaagctagagacaatccaatgggtaaagaaagtacttactatgaaagcataaggaccagagttccaaacaaatcccagatgattgtggtggcccatcttgtaaaacagaggctggggagtcccagagctgggagactagccatatcagtgagctctgggttggagtaagagatgctacctgtgttttgcaaattgtatcttcagtattctgagcttctgggctaatatccacttatcagtgagtgcatatcatgtgtgttcttttgtttttgtttgtttgtttgtttgtttttatcctttttattttttgttattttatttacacttcaaatgttatgccctttactagtttcccctccaaaaatcccctatcctccttccctccctctgctccccaacccacccactccagcttcctggcccaggtagtcccctgtattggggcatagaacctttacaggaccaaggccatcttttcccattgatgactgactaggccatcctctgctacatatgcagctagagccacgagtccctccatgtgttttctttggttgttggtttagtcccagggagctctggggttactggttagtacatattgttgttcctcctatggggctgcaaaccccttcagctccttgggtcctttcccaagctcctccattgggggacctgttttccttcccatggacggctgtgagcatccacttctgtatctgccaggcactggcagagcctctcaggagacagctatatcacacttaagagccttgaagatatgggcaaaggggggaaattcctggacaaaacaccaacagcttgtgctgtaagatcaagaatcgacaaatgggacctcataaaattacaaagattctgtaatgcaaaagacactgtcaattagacaaaaaggccaccaacagattgggaaaggatctttactgaagggaaggctatccagagactgccccaccttgggatccatcccatatacaatcaccaaaccctgacacaagagctccctgtgactaaaccaccaaccaaagagtatacatggagggactcatggctctagctgcatttgtagcagaggatggcctagtcagtcatcaatgggaggagaggcccttgtgaaggttctatgccccagtataggggaatgccagggccaggaagccagagtgggtgggttggggagcaggaggagggaggaagggataggggattttcggaggggaaactaggaacgaggataacatttgaaatgtaaataaagaaaatatctaataaaaaaaaagagagaaagatgtgccaggcagtggtgggtgcatgcctttaatcccagcacttgggatgcagaggcaggtggatttctgagttcagggccagcctggtctacagagtgagttccaggacagatagggctacacagagaaaccctgtcttaaaaaaccagagggggggggggaagactacctgaatggatgagttataagagaaaatgagaactcttcccaacatcatcttcagtgttccatatattcatgtacacatggttgcacacacatacagaaaagggaaatacagaattactgttttaagctatttgtgatattttagatgaattaatggatttttgagctgctccttgtgctctggggcactgcattgcaatcctgcctgcatattagaacctcctgggaaacattaaaaataaaatcagtgcttagcttcaatgctagtccaattaaatcaaaatctccaaaggagaatctataatactccagttaaaactgagaatcgctgttctgtgtagtgggacacaggggctctcttcgaagggccttgctggaatggcttcatttctctctctgtgggtttggtttctgagtcagtcaagacatgttggcttgatactagcatctagccacattctatttaccaaaccaggtttcatactagactcttatcattagtgactgtttggggtagagttttggggtttttcctggacttggtaaacatttgctaaaatgattcatccatctgtgggacaatatagagaagatattactggggattaaaccaaagccttatgccagctaagaacccacttcactaatcttacctccaggccttcatacatttctttttcattttattttgtttagttttgtgtgtatatatgttattcctgcatgcatgtctgtataccacatatgtgcctggtacccaaggaagacagcagagggtgtcagataccctggaactggtcttgcagatggtcatgagccatcatgtgggttctgggaatcaaacttaggttccctggaagaacagccagtgctctaaacttctaggccatctctcctgccccattcccccatccccatgcccacatccagcaattcattgcttaaagcacatagttactgaatgtatcagtgtttgttaaatttaaacagtccaatatcttctgcttgcataaagaagggtttattttttccacaaaactgtagggccaccaacatttcattctgtaaagaaaaatgaaatcacaaaatttacaaaaaagaaaaaaacaaagaaaaaaaccagctggacttataatctataatatggatcatggatggtaatgttgacagaaagcaagaagatttacctcttcttcccaacatatttttgtaatgttgtagttgctgttgctgttattatttgagtaattagttgttgttggtagtggagatggttggttcattgattggttggttgactggttgatggttattttcacatttttctcggcaaggtctcaatatgtagaccacgttggccttgaactcactatatagtctggcctcaaaatcttagtgatcaatcaacctgagcttctcaggtattggaattaaaagtattcacctccatgcccagctctcaaaacacattcctgaaggttacactcattttctaacttacacttgaatttctaccattagcaataaatgtatttgatttacatattttgtctttgactgactggctttcaatataaaaagaaagaacacattaagctgcaaatgcttccagtcctttggaaagtaaccgtgagcacaacttagtagaggaataattgagaacaatagcttgaggtcaatatggaaacatacctagaatgtcataagaactgagtggggatggaggcaaggttccctgaagtagacaaactgatttgtctaagaaagctgagcttctttgcatgggtacttgttctgggtcacatagttgaaagacaggacacacattcatgatatgtagcccttaggttttactttagccacccattcttggtagtagagaaaacggaagccaacaaaactacactaccatagaactgtcaaagagcttttggatcttcacttggacccactcaaatgaaactatgcttccagatttctcagggcaggggagagcaccaattggccttataaacatatctatttcctttacggggcccaacaagctccttgctgatgcaatgctatcagtgtacactaaaaacacagcattgtgtttttgccaggagtcagctacccagtgagtaatgtgttcctatacatttatactgagagtggaatagtctaggatgtgtttatcactgagaaaagctagtattaacattgtcaggggattaatccagtttaattgtaaatggcaagaagaaacctgcttctttgggggcccagatgtatgactttagttaaatatttatagattagttggaatgtttactcttaatcctggagctaggtatttacttgcatattctaacccatttctggccctatccaacatcctcctgatgtttttctctctaaaatactggtatgttacgagaggagtgatggaaacatctggtcactggtctaaagctactgatgctggtgggagatggtaacaagccaaggaagctcccattaaaattagtgggaacttcaaaatcaggaaacctgtattctaatctcaactctgctacaaataagctctgtaaccatctctaagcctcagtttcctcatcatgaaattaaagagataaagttgcgtttttaagatttcttatagatatgagacatggcagtttatggatgcctaagacatttcagaatccatatccacaaaaggaataatccttaaagcatctagacaatcaccatacagtatagatttctgcaatgaagctaatggtctagattcacgatgtcctgcacagtagtctcttgccactattattgaacactctaggattatggttaggattagggctagggttagggttaggtttagggctagggctagggttagggttagggttagggttagggttagggttagggtgagggtgagggtgagggtgagggtgagggtgagggtgagggttagggttagggtgagataaaaggttaaggaattgaattgaaaatcatgttattccattatactatgtagggccacacaatgttaaatggttagttcccggaggaaggatgtagtcaatgttaatgatggcttctaatttgggtaagggttatttagtagaaactacttgggtatgattactttctccaacatggaaggtaggataaaaatctcataatctagatgcattgagatttttttatttttaaatatttatttattcatgtatttctttaattagttttaaccatttctcacattgcagtcattatccctctcccggtccaccctcccatagtttcttataccattcctcctcccctgtctccaagatgtttccatcccacccctccaaacctccccactctgtggtgccttaagtctctcaagggttaagtgcatcttccctcactgagaacacaccaggcagtcctctgctatatatgtgttgggggcctcatatcagttagtgtatgctgtctggttggtggcttagtgtctgagagatcttgggggtccaaattaattgaaactgctggtcctcctacagggtcatgctcctcctcagcttcttccagctttcccctaattcaacaacagaggtcagctgcttctgtccattggttgggtgcaaatacctgtatctgactctttcagctgtttgttgagtcattcggagggtagtcatgataggtccctttttgtgagtgctccatagcctcagtaatagtgtcagaccttggggcctccccttgagcaagatcccactttgggcctgttgctggaccttcttttcctcaggcacctctccatttccatccctgtaattctttcagacaggaacaattatgaatcagagatgtgaccatgggatggcaactccatccctcacttgatgccctatctttcttctggaggtggactctacaagttccctctccccactgttgggtatttcatctaagatcaccccctctgagtcctgagagtctctcacctctcagttctctggtacattctagagggactccccaccttctgaggttagctgtttctattcattctgctggccctcagagcttcactcctgttccctgcccccaatacctgatcatgtttccctttcccctcccccttccacccaggtccctccttccctctgcctaccactgtgactgctttcttctccctcccaagtgggattgaagcatcttcacttgagcccttcagcttgttaaccattttgagctctgtggattgcatcctgggtattctgtaattttggctaatatccacttattagtgagtacataccatgcatgtcttttgagtctgagttacatcattcaggatgatatttcctagttctatccatttgcctgcaaaagtcagaatgtccttgttcttaatagctgagtagtattacattgtgtaaatgaaccacattttctgtatccattcttttgttgtgggatatccaggttgtttccatctcctggctatcatatataaggctgatatgaagatagtggagcacatgcccctgtggtatggtggagcatatcttgggtatatgcccaagagtgttatagctgggtctgcaggtggatctatttccaatttcctgaggaacatcaagattgatttgcagagtggttgtacaagcttgcaatcccaccaacaatggaggagtgttcctctctctccacatccttgccagcatctgctgtcacctgagtctttgatcttatccattgtgattggtgtaaggtggaatctcagggtcatttttacttgcgtttccatgatcactaaggactttgaacatttctttgggtatttcagccattcaagatttctgttgtaaattctctatttagttttatacctcattcttttgagtgggttgtttgagttttttcttttttcctttttaattggatgttttctttattaacatttatttagagaagcattttatttgattagtagtcatcaaatgcagtccaaatgactctttaaattaatttaggtttaggtttgagcctgcaattattgcttgaaagatgtgatctaagtatatctacacagttccgtgaatttggggttaaagatttaaatgcccagtaactaaaactagttctgtatatatgagctgcatcattgttatacaaaactttggacatgaatatgctcagtgctgatctttattagactgaatcagggacgtattttatgaaataaaaatttattaaatgttagtgctagaattgatgaggaattatttattgctagtggttttctttaataatttgtggtatattttctttatttacatttcaaatattatgccctttcctggttccccctcccctggaagtcccctattccctcccccctcctcctgctccccaacccacctactcctgcttcctggccctggcattcccctacactggggcatcgagccttcacaggaccaaggacctctcattgatgtctgacaaggccatcttctgctacatatgctgctggagccatgggttcctccatgtgtactctttgattggtggtttagtccctgggagctctggggtattggctggttcatattgttgttcttcctatggtgtcctattgactatgtactttgccttaccaaagcttttcaatttcatgtggtcccttttatcatcatagcatctttaaacatcttcatttcttccttttcaatcttatttgcctttatttcttccttgcatcattgcactggttgagacctccagtgaaatagcaacctggaatcattcttaactcttgagatttttcaagattcacagagcccaagttattaattccactaaaaagaagaaactcgttgttgaactaatgtttctctttttttcctatcataaatataaagacagttttaatcacgttgggttaagctacaaaaccagcatcactgtagggcatttggggacatatacagcaaaatcaacttccatcaccccaaattaattaaaccttcttcaaacaaaaaggcttgtttgcctaatttgcaaaatgtttcttttccttttaatagcttattgacctatatctttattcattgaccacataaagttattaatctatctgaaacaataggtgacaggtccctattacaccactcattgagttgaaaatcagttttgtaccagcacctacatgttcttctttgacgtagccaagagattctactataggttttagagttcacagcattcatgggtaaggtttggagtgtaggaaaaaaaatacttgtgtccagttccataaactcgattaacctgttgatttgtttaataattacatcgaaagctaatatttgacttattttctcatgagtaggacttgaatattttgtagacattggtgttctgtgccacctgattagaaggaagatatagcaccccattcattgaatcaattcagtctagcttagcaaggtctactgttagaatataggtctggttaataaatacaatctttgctcttattcttagaaaattcctgaatgtgtgcctttgttagggtttctcttcttctcttttttccttgtacttatctctgaaactcttaatagagtttattctataccaagattgtgtttaataactatgataacactgaaagcattttcagactgtttctaaaatcttattcttcacaatttcactagagaagagaggaacatattctactgttcccttacaacaagaacctagaagtctttgctactagttgttttggttggcttgatagcctaaaatttaattccaaaatgattctttagattcagtgttaaatggtttgtaagatgaaaaccactattatccattaaataatataattattagaaatgaacaatcaggagaagggtatatttgtgctccatggcattatcattttcctaccagctgcatctcatctgcttcagagcgaacagtcaatgcttctgtttagaaaacatgtttacatcttaaagtttctcctgctaatcaacattccgatgaagatgtattaggaaggcttcctagtagtgacctttcttttcttctttttttcttttgtcctccatctccccctcttccctctctcccatactccctcctccctccttccctccctccatccatccatccatccatccatccatccctctccctctttcttttttctttctttctttctttctttctttctttctttctttctttctttctttctttctctctctctctctttatttctttctttttctttcttttattttttttacactccagactttattcctctcccagtccactcttccatatcccatacctcctccgtgcccatgtgtctccacaaggatgtccccaccccacccaaaaccacctgacctctaaactccctagggcatccagtctcttgagggttaagttgcatcatctctgaatgaacacagacccagaagttctctactatatgtgtgttgggggcctcatatcagctggtatatgctccctgtttggaggtccagtgtttgagagatttcagggatccagattaattgagacttctggtcctcctacagggtgtccttctcctcaacttctttcagccttccctaattcaacaacaggggtcagctgcttctgtccattggttgggtgtccattggttggtctccccaacctcctacctcccaaggttgcctgtttccattctttctgctggccctcagcccaaagcccaagtctaagggggtcaatggcctcaacataaaaccagatacactgaatctaatagaagagaaagtgggaaagagctatgaactcttggcacagggaggaataatcaggacttcattggctcaggctctaagatcaagaattaataaatgggacctcatgaaactggaaagcttctgtaaggcaatgaacttagtcaataagacaaattggcaacctacagattgggggaaacctcttcactaacccaacaaccaaatagagggctagtatctaaaatatgtaaataaaccaaacaaaaatggggtatagatctaaatcaagaattcacaacagaagaatcttgaatagcagagaaatacttaaagaaatgttcaaagtccttagtgatcagaaaaatgcaaatcaaaacgagactctaccttacaccaatcacaatggataagatcaaagactcaggtgacagcagatgctggcaaggatgtggagagagaggaacactcctccattgttggtgggaatgcaaactggtacaaccactctggaaatcaatctggatgttcctcaggaaattggaaatagatctacctgcagacccagctataacactcttggacatatacccaaaagatgctccaccataccacaggggcatgtgctccactatgttcatatcagccctatatgtgatagccaggagatggaaacaacctagatatcccacaacagaagaaaggatacagaaaatgtggttcatttacacaatggaatactactcagctattgggaatgaagacattctgagttttgcaggcaaatagacagaactagaaaatatcatccttagtgtggtaactcagatccaaaaggacttgcatggtatatactcactaataagtgaaaattagtcaaaaatatagaatacccaagatacagtccacagaactcaaaaagatcaacaagctagtctcacttctagactttgaattaaagcttttcctatagaatctacatacaaaagtgagccttccaaatcttaacttcataaaaaatgtgatatttgtctccaaattgctgagggaatctgaatgaaaagatcttctgtttgatctggagggagggagggggagggtttctgggaggggtggaaggaggagaaactgcagttgggttgtaatatgaggaataaagaaaaaatgaaaactaaaataataaaacatctgggattaagtctctgtcaacactacccctccccttttattttcctaacattttacctcaaatcatgcaactgtgaaatagtttcagagtctacagtttcactcatatagaaaatcataattggagaatatattattagtttggtccttctgtaattcagactcaaaggagggtgtgtgtgtgtgtgtgtgtgtgtgtgtgtgtgtgtgtttgctaagtcagcttatcttaaagtagtaacaataactaaatcaccactgagaggcttagaactcagtagttactgggtccttgaggttggatatcccagtttctaagtagtcccaatttggcactgaacatctggatttttcttgaagaactcctgtaataggctaagtgaactctaaggcaaaggagcagcagaccaagtgagcaaaaacataccctcttttacctggaccactaccagaaagtctcacctacaatcagcatgggtcttccagcatcaattaaggcagtcaggacagtttttcaggtgatgctccctactcagggattctgacttatgacaagttgaaatgaaaacaagcagcaatagcaaaggatgtgtttatttggcttatacttctctatcacagtctgtcattgaaggaaactgaggcaggagttctggacaggaacctggaggtaagaatttaagcagagattatgggagaattctgctgactaagttgctcagctccccttaaacaagtcaggaccaactgcacagtggtggaactgttcataatggactgggccctcccctaccattcattacccattgtccacaggccagtctgatggaggcaattcttcaattgtggttccctgttcccaggaaacactagaactaatttgcacttcttatttcactaaatacatatcttcagattggtcctcaatttaagctgaattaaaaattaattttaaaatgaaactattttgtcaatgtaaaatagaattatagcaatcaactaggaaaaaattatcttgtactaattcaagttaaatatggtttggccctctcagaaaacttacagttatatatttattacaacccttgttttcaaataaggaagctgagattcaaagaaggatgggcttgcttatgctcacataaagttggccaaatctctgatttcactggatagcatgcgtaaagaataccccactctcctctgcttctatcttctgatgacttcatagtagccaggactctgatagtgaggattaattactaattttctatcaaggttttgacatttaccctacttttatagattgttcaaagtctgtatgtttatattacaggtattttgcctatagatgatttttatcataagaaactgggtttccagggaggccaaatatgctggctgacaggtataatgaacgaacattagcaagcagactcaaggtttgttaacaggttatgttgtaagaaccaagagagaactgaaaatcagactcaagactcatagacttaggatatggacaaaattaagggaaagagaagagacaggagcatctgaatgctgtgttgcatccagcgggcctttgggaggacaagccaagtatgtttttctacttagaatcttaagtgaatctcatttctccctctcaggctctcccatcttcccctcctccatccaggccttccctttaggaaattctgctttgctttttagaattactagagtgataaaccctagccactaccaggtccttctagattatgtagatcctctccttggtccaattcacacagcaggtcattagaacagagagaactggtcaactttcttcaggaagtaggatcccctccattcaagagtgctattctttttttttctctctctctctctttttctcagtggaacttagtgatttgactaatcagcaaagctgatactgagagctctttgtaagtatgcagcttctatgttaggcttccctagcatatctagagaagaatttctacaaattttggccaaaattttctcctcccaaggcaccattttccagtgtggctttaaaaaaatactagagttaggaattccagatttgcctagatataacaaagtaaacaaaatgctttacctcactgctgggatcctccgagcttaactttccctccagtcttcttacctctccagtccagcatgacaaccctggcatataccaatctctgaagcgtcttccattctacacagctctcccagataaaaagagcttaccagcatatatgtattcacagtgcccactggtgttaccacaactgctgttacaagatttataaaagtctgtgaactgtgtaatgtgaggatccaaacaaaacttttcttccttaagaagggctcattattcttcttgtatatcagcaaattgatttctactatattagcactagaactgtaaaaacagtctcctggaatcttgcagctatccaggacctcttttgttgagactttacttagctacatcagagaatactgaaagtgatttgccttaaatttaagtgtgagactaagattacagacacccaccaaagtcttagtgatagtttgttgctacctggagtttttgtggtattattttttttttagggagagttatatatgatcagaaaaattatccataaaaaattggggtatatccctgggagcaaattaagcaacttatagacagtggaaaatgttctatgaggaaatgactcagagatccaggtagtcttcaaacagccaagaaatagtttgtgtcatctctgcttatctgtattttatgaggcaggaatgttgcctctagctatttggaagaacttttttttaaataaatgttttcccccttaggctttagtggatcaaacaattctgtaaatgtctatagtctattctccaagagtcctcattagatttgttataatctccaataactgccttgagcaaataaatgacagggcccacagaaactcacaaatcatagaacaacactcccaatgggctgagagggggcttagtgatctatcccagcctgacctggactcaactggcaagggtgcatcattgttatctgttcttcctagactctacatgaaaatcactgaaaggtctcaacactgatgataggaatccaggattttcatttcaacaatagttcttaaacatctggttaggttctagggaatgcaaagatgattcaggcatagtacttccttttgggtaggtaactactgggtaacaggagcccaggagattaatcatcacaattcagaaacgtaaatgttattatcaagttgcaaacagtgcaatgtttggatccctagcacagacaaaaaaaaaaaaaaggagtagtgttatgtgcatgtgtttgttgacataacagtgacaacagataaaagatgattcttttgttcatgaccattttgttgttgtgggataatgtcagatttatttaaactagaaagaagtagaaataattagctattcatgaacatcatagaatattcatgtaaaatattgtggtcataaaatttcaaacttgaactttaatttactgttaccattcttttgtctcttctactatgaaggaaagtacatgatgacagggaacttggtcagtttcattaactattgtagctacagagcctggacctgagccagtaaatgtgaaataaagatttattgactagatgaataaattaaatatagacaaattatggtaacactaagattggagaccatagcatgagaatctgaaattgtttagggcattggggtaattgtccctgaggaagatacactggagcaaacataaggttaacgtgaggagtgcgctaatgcaggagttttatcctgcgggcaactgaggagatttttgttgtgaagtgatttaccttcccagaatatatagttggagtgttaaggagccagttcaaagtggaatttttttttcaagtgatattctcagtctactagttgtacctaaatctttaggtttaaaaccaaggaagaaaagttctcttctcatctcagatcccctttccccaagtaggattctgggtagaccaaactccctttagggtagaagctctgctcaggaggcctttccttcttggtttgcctgacaagagatgagctcaccctctagagtgagaatccactaaacagtgtagcctgggctctggacaatgaaagaaaggacaatagccaactcctctgcaatttgctgattctcacaccccagggtgtgggactgtacagccagggctgctttgctctggctctcatcaaggcaggatgaacacagatcctgacaggtcaaatcttcccccggacctcagaggttgccttacaaaggacctggcttaatctctgaccaagtgtgtaattcattcatctgctaggtcatgaattctgagctctcaaggcaggaagtatgggcattgggaggggttctacaggtccagggagtcacttcagccctgattatactatagaggaaaggattttctagacaaaggctcctgtcctccagagagtgagcagaatgaactaggagactatgtgcacaaaagaatggtgcttcagggaaagggtgacagcccatgaatttctttagatcctgtaagtaatgacaagggagttagaattaattatttttataaactgtagccatgaggaattgagatagatagagttcatctcaggatgtttgcctgatgctcacccaccacttggtagtaaagggaagtttttaaacactacgttatttcctcctactggatccctctcaaagttgttggaagttcttaatctttgtagctaccaaagctcctttagcatccaaaagactaagtaaaatgcagtgctacacatcgagaaaatacttgaaagctaatttgaaattgtttggaaatttacaatttcctgacctgaccagctggctttttctctgatcctctggacttcctgccaaacaaagatgggaagggatcgacttttctttctatgatcctgaagtttcatttgcacaattttccagtcttggggtcgtgacccatcacagtaaatctagcttcaaacatagagttatttggattttgagatattgtatttcgagtttcatgtcttgcaaaccacctggaacttacaataaagggtattttaaccacggattgtattttatacaactgcaggctcctggaaaggaggaggcaaatgttatgggaggcaagcagcaacagagagaaatttgactaataggactacagagttttctctgacctcagagagacactttgaaggtctcttggtgtggtaagaaattcctgatgccatatttacctttttttttttgactcttcattttttggaatgtgatgtgcagtgtataagaaaacagcaagcccagctctcccccagatcctgttagtgcctacactgataattctctatcactccagcaaaggtctccattatggtttttcagccattatctgcaatgaggttatgcactaaatacattatcagtcattaatactttcccctgaaatacatttgtcaaattagtctcaacagaaaactgagacccctggagaaacagactagaaggacaaagttctatgaggtgacagaacaggattttgcttggacttttactctttgacacctggtttctagatcatcagtattacttcatgggagttcgttcaccctgccagccaatagctttataattggaagaaacatgggaggagtccattccattgcattgcaagcagcttattgctttgtctccattcagggagtctttgtcaaacactaattcaagctctgtggtaggtcctataaaggatatggaaagtatttctacagtcttcctttaatgagcgtgatgcctccctccattctttcccacacttttcagctgacctatccctctttacaagtttctaatgttctgctccttttctctctgggaaaaacctatatttattctgattccctactcttctgtaccaggccacacagagacagtatctaatctttcatcttacccggcactccacacgtatgctttctagttgtgggagataagtctgtaaaacatgcaaagaacacagttaagtttggtgacaagtactgtagagaaaggcttgcactgggtgtttcagatgggacagtccagttgggcttttgaataaaggtaggaatttgcctaaaaccttaaaaaatgagtatatttttagtgtgtacagaagagaatgacttcatacacagcacacaaaccttgttttagacctgagaaggaacctgtaatatgtatggaggactcaaataagagataagggtaaaggctagagagggctcagcagttaggagctctggctatattttgtgaggactgaattcaattacagcacccataatgactgttcactatcatctgtaactccacctccagggaggaatctaacaccctctcctggcctccctgggagccagagagccaggcacacaagtgatgagcagacacacacacatcacccatacacataaaataaatttaaatttttataagaaaaaagaatagaaaaagatagcttcattaccagagagtgaagagcagaggacttttcatttgaccctttgtaatagtagtctcaaaatatttgtgtcaaaagtgagcatgccccaattatatatataatacttatactaatatattaatatattataaaactagtaaattataaaacatacacaaaagttatgccaccaccttaggtcatcagttaaatatatggtaccatgaattcttttgagagtctggtgaaagctacatatctcctttcctgtcaccaaaaatcatgcattgatgccctacttcttcatacagtcttcagggaggccgtggagtctctgaagcccattttaaaacctcagtgtaatttgctctgaatacacaaaggcaccagaggtttctgagtagtttgctggcctgtacactttacttccaggaactctgaatctggcctctatgcatgaagtgagttgacaacagtgcgggataacagaagcagaaactagaaacaagaagacacatttgtaaactatttccatgcctcatgccagaagtgcagatgtaatgacaggaagtatgtctgaggcctcaagttttatgtaggaaaaagaagagcaatgagtattcaggattataaactggttcaagggacagtctcccatctcagtaaaaatggtctgcaggcaatgagaaatcggaggataaaattaaagggaataattggctttgaaactcagtttgggaactgggagtagggcagttatgagaaggaataaccacagtaggcattttgttgccaggcacccatgtgaatcaggcactgtgccaactctctgattgctaagataagttttgccattcctgctgttataatcactgaaaactttctgtgtggaagacagtatgccaagaactttgtgggacatcgtgggtatttgtcatttgtaattgcttagcatccaactgtctttcaggtttggaaagattctccaattatgtgacatttagtgtaaagttggatcctgcatctcatagtagaagccagatactccccatctctgtctttgagtgactagaatgtgggcacaggacttattctgagtcaacaagatgcatcctgtaggactttcagtctgaaccaactgaagccaatatggtgagacaaaattcaatcacagtattaggcagtgttagttgtgacaatgatactctggccagattctgtcattcatttacccattctggaagtctttatgttgcagattggcaactacaaatctagcctattaaggttttatatgaataaaggggttttagatcaccatcatacatagacacatgaatgttttctctgtctgcttttgtactacaatggaagacttgaatagttgcatcagatatagtatggcctggagagctgaaaatatttactatctggccattagcagaaagagtttggccacctctgctgcatatatatatatatatatatatatatatatatatatatataaacacatgcagagttaatttctgttgcttacagtcaagaactttaactgatacaaatgaattagctcatccagtccttataacaatgttgactaatctatcccaagcatgcctccactatccccaaacagaaggtaagacaactgatgcctgcagaggctatctgcccatgagcatattagctagtaagtgctactaattgacactgcataagtgccaatatagctatgacactatcagacaggaaagacattcagaaaatggagatagaacaattaatggtcccagacctattttgagatagtaggaaagacaatcatttctcacccagttgttcagagaggcactcaaatgatcagtgcttcagaaacagagaaaaagaagaaaaagaagaaaaagaagaaaacaaagacagcagcagcaaagatctaacaggtttatctccttcttggctgttttgatgcagttaattagcatgctggtagagcctttgtcaaaaatttatactgacctctcaattcttaggtcctccaccagactttggtttgctgacaaattagaatgtgttcaaactatgatccagactatgttataggctttggagtttgaagtttgtccttttagtctttggagtctacactgaattcatataacagtagccaaaataacaattgataccactatgaaaagctgcaccctatgaagacaaggtagaaagtttgccctttaagtctacttaaatattgaaatgtgcaatctgtgccttctgttaaggaggttcacacgtatgtccacagaatattatttcacaggaagtcccctgtcttccccgtgtaagtgtgctgagtgatcaacttcatggcatgtgcagggtcatgatgtttttgctaaatgccaagatactgaccaataagccacagctttatgggagtagggtggaatctaacacatgtaaccagatctagagtctcttgagtgtgagtcttgaaaatgctgattatggtatattctctgcgctgtttaattgggctaattcgcaacaaaagtggtgaaatttctattggaaatgtctgtggagagagagaatcacatttcagattggtgaaggaggcttcttggagaaggtcaatagtaatgttattgaactagtctcatgtgaccacatactcatatatacatgtgcccttctgttaaaataaaatacttcttatatgtagagtgataaaattttggaatttttttttatcttatcacatgttctaatgtattttcctttatgatttttgcacctcataacttatttctgtcacaggcaaagaaaatattttaacattgacaattgggatctgggaatttatggaggtcttatattttgttgcatatgaacgttctccctggagtatctttttttttttttttactgtttcttgatgcatccagaatgtatattaaaggcttctgaaagtagacatgtctttgttctggatcaagccaattactatgaccatttaagctggctatttttctggcgagtttttggagctatctaccaaagcataaacctgttaagaatcttcattcttctttttttatgtgcttcagacagttgagacaacctgaagttcaccaatattaaccacttcaacaccttcaaacactttttatgacctaatcactatgctactaccatattgaccaagttttgaattcctttccagagccctctcaaagtgaagcttctctcgaccttctcggcatttaaagaaggtacgatgattagaggtcactttcgagatcagatgttcaacagctgtgtctttcaacagggcaagtgcacaggtgtctatgctcagatgccctgaacttgaggcaatgtggtatagttagcccaagcatagcctgaagaaactgactgcctctagcatgtttttataatttttaaatgtctgatgagagatttcgattcatttgctctcatccattgatttttctgtaaaagtcttgatttgaatcaagtctattctttcctgaccacactcaatgttgatccttggcctctcaaatcaaatgctccttaaaagtgaacttatgaatgttatggaagtacaaagatgcttgatgtgatctgagaatagtgggaaatagctctcatattgttctcccagaagggaagcaaaagtgttggcaaaacgtaggggaatggttcatttttcatgagattcccacatgctgagtgggaaggcagtcacatccagagtgcagccagcaaacagaagatacaaatcgtaacactatccataggcagaactccaaggtaatatgagcaccatctctttgtagacatcacatgaactctaagatttttggggaaggtacacgtgtccatggtagatatgactccatgactccattaaataggaaagggacttttatctacactggaatgaattgggcatgtgattccaggcatgatggatgaactcttataatcccagcacttggaaggaggacacaagaggatcagaaaggagttacagtcgtccttggctacaagaatttgaggccagcatggaccaaacaagactgtctcaactacaaagtggtgatacaagttgatgttttgacaaggaaatttattaacgtttgtgataatgtgggtgcatgaatgactgcacctttgataacttgttcacttcaattatttagggtggagctttggatgttccaattgtacattagaatcaccaggagagtttcgacagctaggtcatatcctattttaggcagttacatacttgtactggctagttttgtgtcaacttgacacagctggagttatcacagagaaaggagcttcatttgaggaaatgcctccatgagatccagctgtaaggcattttctcaattagtgatcaagggagaaaggccccttgtgagtgggaccatctctgctggtagtcttggttctataagagagcaggctgagcaacatccctgagaacatccctccatggcctctgcattagctcctgcttcctgacctgcttgagttccagtcctgacttcctttggtgatgaacagcagtatggaagtgtaagctgaataaaccctttcctccctaacttgcttcttggtcatgatgtttgtgcaggaatagaaaccctgactaagacaatactatatggtttaagtaattgaaattaatttttcttattattctgaagagtggatatttaaggccagcatggaagcacggcaaaagtttagagagtgctttcttcctcactttgtaagacaattatcttcctgttgtgttcttatgcagaagacaggtctgatgcctagtatgttcagtgttctacattataacctctttaacccgaatctcttcagtaaaggtcctgtctttagtatagtcacattcagggttaagtcctcaacatgtgaatttgagggaaataccattcagtccatagcatgccctgagtgagaaaatcaaatcagagcctctagaagtgaaacctggaatgagtaatttttttaagcttctaggtgattccagtatgaagccaagttttaagatattagttttcttctttgctactagaatgaaacccattgatcatttatgtcagcatcacctgggagcttgttagaagtacagagccttagatatcacccttaacttattgaatgggaacctgtgctttaatgagatccctaggtgatgcatcggcacactactatcccaagaagcactgactgagaatttctaacatgttcctacactagatcatctttctccttctttatgtagtcaaatgcttgcaacaagagctatgtgatctcattagtcactataagattgtccctagtaccaggtaactgacagtatggtcttctgacagttgcttgatggaatagaatatgtgaatggtatgctggtaggttcatgggaaccactaaagacatccatactgggcacctcatcactcactcaagtaccaagcacagtgctgggtaacttccagaaaatatatcaaatgaaggttgaaggttcgcttctaaaaacagatagagtctccatattactcttagtgatctttttccttttggattagtttcacaaaactgtcttctccgaaaaaccatttgcagcttcttgtttgggctatggattccacttattatgcttagctgaatattgccaaagacttgggatgtttgtttgtttgtttgtttgttttgttttttaggagagtttgccattaaactagtctagatgtttctacatgaaccactcatatttagctgtttccatggttcccattatgaatcaattcctttgtctggtcttgttacaacttagttgttaattgcatggcagtgtttctctttggcttctgctacactggactacacattttctttgttgttataaaaatgcacttcgctagtttcagttgtggaacattaaaaatatgatgaatggtagtgatggttgcccaatataaatggacttaatgatacagaactatacatttaagcatagctaagaggaagaatgttatgtatgttaccacaatttaaaatgtaaatgaattttgcttattgtggtacagaatcctcatttggattctctagtacaggaagcatgaatataaagctgttaaagatatgaatagagtggagtgttaatagtattataccaatgttaacttcttagatttaggaaatgtataatggttgtgcaaagacaagtcaggtgatggagatgagggtgatagcagaattctaatttctgcattttctataagtctaatattattctttttaaaagcttaaaaggaaattatgaactgtatttcaacccattagtttagaaagaaaagaagttagaccataggaacaatctgacagaaagacaggaggagcttaattcctttctgctccggagcttccaggtaaagatccttaaaaatgatggcagctggaagggcaacaaaatgctcctcacaaagatatatgctttctaaaaagaacagccaagagagcactgttctcccaagcttcaaagacaaacaaaccaacacacatatcacattggaaagtagttcagcatagtgataaagaaggaagagaaagtaggaaacatcctggaacacattggcacagggggaaactgaaggaactgaaggatagtgcaaccccatgggaagaacaacaatatcaactaacctggaccccacagagttcccagggactaagccacgaaccaaagagtatatagggcctggtctgtggctcctgctacatatgtagaagaggagtgccttatctggcatcaatgggaggggaggcacttggtcttgcggaggcttgattccctagagaagggggatgctagagaggtgaggaaggagagggttgttgggtggggaaacaccctcttagaggcaaactgagggggtagggtgggcttaagggggttcatggagactgggaagggagagaaaatttaaaatgtaaataaatattccattgtgtaaatgaaccatattttctgtatcctttcttctgttgtgggacatttaagttgtttccaacttctgactatcacaaataaggccgctgtgaacacagtagaatacatgcccctgtggcatggtggggcatcttttgggttattcccaaaagtggtattgctgggtcttcaggtagatctatttccaattttctaaggaacctccagagtgattttcagagtggttgtcccagtttgcaatcctaccaacaatagaggagtgttcccctttctccacatcctcaccaacatgtgctgtcacctaagattttgatcttagccactctgattggtataaggtggaatctcagggtcattttgaattgcatttctctaatcaataaggactttgaacatttctttaggtgcttctcagtcatttgagattcctctgttgtgagttctcagtttagttctatacccccatttttttttgatttgagtttttagtggttagcttcttgagttctttatatattttggatattagccctctcccagatgtggggttagtgaaggtttttcccaatctgtacacaatggaatattactcagctattaagaacaatgacaatctgagttttgcaggcaaatgaatggaactagaaaatatcatcctgattgaggtaactcagatccaaaaggacatgcatggtatgtactcactaattagtggatattagccccaaaatgtacaaaatacccaagatgtagtacacggaactcaaaaaggtcaacaagctgaagttcccaagtgaggacgcctcagtcccacttaggatagagaagaaagcaatcacaagtggggagggagggagggacctgggaggaaaagtggactgtagggaggagagtgggaggagagggggacctaatcttgttttgggtaagggagaaggactgaagccctgaggactagcaggaagaatggaaacgggcaaccttgggaggtaggaggttggggggaccctccagaatgcaccagagacctcaggaatcaaagggaggggccttagatgaaatgcctgacattagggagagggaacttgtagattccacctccagcaggaagacaggacatcaagtgaaggatggggttgccatcccacagtcacacctctgacccataattgttcctgtctgaaagaattacagggatggaaatggagagaagcctgaggaaaagaaggtccagcaacaggcccaaagtgggatcttgctcaaggggaggccccaaggtctgacactattactgaggctatggagctctcacaaaaagtgacctagcatgattgacctccaaaagaccaacaaacagctgaaagagttagatgcagatatttgcacccaaccaatggacagaagcagctgacccctattgttgaattagggaaggctgaaagaagctgaggagaagggcgattcttgtaggaggaccaacagtctcaattaatctggacccctgaaatctttcaaacactggaccaccaaccaggcagcatacaccagctgatatgaggcccccaacacatatacatcagaggactgcctggtctgtgttcattcagagatgatgaacctaaccctcaagagactggaggccccagtgaatttagaggtcaggtggggtagggggtggggaggaggtatgggatgtgaaacagtcagagggtggatcgggggaggggaataaaatatggactgtaaaaaataagttaattaaaataaaaatataaataaattaattaacaaaaaagaaagcaaagggaaaaaacgatgcataatcttgagctggaaaggtggctcagtggttaagagcacttcctgttctcacagaggaatcagactcagcgtgcagtagcttacagccacctgtagctctggttacagggggttcagtgcgcatttctgaactttgtgtgcactacattcatgcgtgcacatacatgcactgaagacagtgcttttacatttagaatcagtactcatatccccttagtttgaacagtgcttctatcacttttcaaataagtgaatgtgtatttatctaaccttcattgcttcattttcttcatagataaagcactgccaagagtagtttttgtggggtggtattcaataaaaccatccttttggatgcttaagcttaataccagcctgactcagttaatactaggtgttattgttactggttaggagacagatatatctatgtgtgtgtgcatgggtgtgtatatttctatgtgtttatatctagacctttttccatgtgtgtgtatgtatgtatgattaatatgctttaaaaataaaaaaatattaataatttaaattttacttttacccagtatttaatttgaaagaacattactaatttagttttaaatgaaaatcgcatggtgttgttcccataaaattacatggataataatttccaaagccttatggtataattgatagtctcctcaattcaattaagtgttcataaagtattctcaattcagttaaccagtattcagtgagccattactttggcaaagtactttctttggaaagaaaagtatactagacaaaagacaatctttagatgttctaagcatttcttaagaaacagaaattaagaattttagtccaagatgccaggagtggtggcgcatgcctttaatcccagcacttgggaggcagaggcaggcagatttctgagtttgaggccagcctgggttacagagtgaattctaggacagccaagactatacagagaaaccctgtctcaaaaaacaaacaaaaaaaacaaacaaaaaaaaacaaaaaaacaaaaatctacatgtggaatggccatccacaacaattaaaaaataaaatcattaatatacactttgtaactaacccagcagatttatcataaaaagatgtcagaacttataaataaaatgtcattgccatgaaaataccggcaaaatattttgaggaaattttaaaatgtgtctatcaaatatcctatgtgaagaaaataaaattacaaatataacagtttatcatttgaatcactgtatcaacactgagtttggaaagataaaatataaaatgtaagttttttatcaattaaaattgtgtaagacttcttaagacccccccaaaccatgaatctaaacttatagaactcacagattttattgcatcaactttaatatttccaaatccatgaagaattattatagataatgttctcagatagatgatagactgagagaagtcattggtttctatggtatccaaagaactctggtaaattaacaagaaaaaagaccaaaatcataatagttacaatgggcaaagtatattcacaagacagggaagacagaagggaaactagactacccaacaggtctctgaaaagatgctttccttttactggtattcaaaggaataaaattaaaacaacagtgatatatttctctatactcttctggttgacagcaatgaaaaagtcaggcaacaccaagtgtttacaagcatgcagggagacaaaaggaatagccatatattacttgtggcgatgcaagtatacatagtagcatttgaatatatactctatcaacactcactcctgggcatgtatttgtctaaaacaatgggacactttcaatgatttcagaaacatattttgtcacataatagcatgcaggcaaagtaggtgtctatcaatatgagtgaagtatagcaaatggaatggaatataatatatgggtcataaagcagtgaagtacttgtattactatcaacatagatctttaagacactcttagagaaataagagctaaaatataaatagctaaaagacacttgtcttgatttaagtacactcaagtatagatagttgatagatatatgataaatagatatcttgaaaaaaaagagcatgtacctacatggcagcattagagaaggtgcccgtgaagggacagggatgggaatgaggatgacgatatatgacaagaatgaataagattttgcatttaactgacaggtctgattaatttaggtctctatggcttatttcttcccccaaaatagttatcttaagtgatatggaaaggaaaacactgactgtacccagggaaatcagtttggtagagatcacatctgaggtgaatttttgaggatgaacagaatgttgcttagagagttctggaagacaagagtgtctttagcaagtaaatcagttgcttcaaggccaggcagtaggagagtacaagacaggtttaagttatcaataaagagttatgtgtgaagtctagggcaagtaatggtatttaatagaatataagcctgtgaaaacaggtggaaaccgaagggctttcaatgcctgctgaaagagttcaggttttatttgaaagtaataggtgtgattcacagttttgaacaaggccacaataggatcataactaggaagatggctgtccagagagaaaatgtttgaagaattgcagctatggttggatacaaaggctgttgtcactctctatgtgcaatctaatgatggactgagataagcttcatttattggctcttaatgagaccaataagaaggaagtgggcgtggccttggaaattgagagtgcctgagaaacagatgagtatgtgatctcaggtgtacacctgaggcggtagaatcggcagacggtgaatgaaatcagaagtgagtggcaagatctattgagcagcatagtgggggccaaagaaaagagctgtgagaacacagatacctgaagagcccctgggataatgcattgaaagcccagacaactttcagaaagaaaaggaacaattactgcaaagaatgtctatatataacataacttagcatgttcactggttacttccccaagaattcaatcaagatacaggtgttcatcaatctagagtgccaggagtgggaaaaataggaaaggcagaaggagagtcgaggacttttcaactagtctatcaaacagcttattctcaaaaagtgatagagaaattatgttgcagcttatgaggatttgaaagggtttttgtttgtttggttggttggttggttggatggttggttggttggtttttttggttggtcagttagttggttggctggctggttagttggttttagtaccaaacagataaaaacatgtttaaagatgaaaagaaagtaagatacaaggagaggaaaggtagtcagtccctctactacactcctaagaggtaaaagccatagagcagcctttcaggcaaaagttcattggaagctagccttggtatatctccatttacacctttcttctccttttgccccttgacctagtcttcccttccagatggactcataatagtcatcaccccaacctctacacttgtttagattggttgaaaccacactaacaaagaagcctgtctttgtcactcaaaggagcaatttgagtgtctgaagcactcaaagcctggatggggaaagtccctgaggtttgtgttccactcagctgtaggggacaattgttgccactcttgactgaggcaggcttcacagggaccttacaagtatgtagttttctgtgaactttatctgaaagattgccagcaccatatctagaagctgtttgaaatcctcataaaaccagagaatgaaaatggggcagggaggaggggtcctgaactagccagctcctttctgtaattttttctttcacaagtcctggtctttggcaagctttgcttcctattttgccttcttctgtttcctgttccagtccatttacttccaggaggtaagcaccctcctttcacaattttccccttgaaatagttaatggattgtccatagctctttttgacctgggaaccagatgacatattgttgaaagtgtcttcgttgctccccactctaagtcaacagttaacaacagtgagttctgaccaaagtcaatgaacaagtggaagcaggaatacacaaaacgtgaagaacaaaacatgattctttgatgagactggagcatgaaagctgcttttctatctacatgggacagtgatcctgacctggaagtcagaattactatttccacagcagtgaaaaacatttctctttcaatgtactattagaccaagcatcaagttatccagtaaggggagatgtggcacaatattaataatagtccagtagattttctccagggtgttgtctctggttcatgacttactaaaaaatgactgaaatactaaatactgtatataacttataccaatgggtagttcagacttcttactttgggggaggctaaaattagctcctctccagatgactcttcaaccttaggcccaatattagctattccgacaatgctcccataagcctccatttgagtctgttctcctgttcaacttcattctcacctctgggactcttgataaatcttacagtccccaactcgggagatcccaccaaccacctgtttcatctattcttcttcttggctgccagctattgtttgaaggacatacacgcatgcacacacacacacacacacacacacacacacacacacacacatatatatatatatatatatatatatatatatatatatatatatatatatatataccaactctagatcagtggttctcaaccctcctaatgctgtgtccctttaattcatttcctcatgttgtagcaacccccaaccacagaactatttttcttactacgttataactgtaactttgctgctgttatgtatcataatataaatatttgatgtgcaggatatctgctgtgggaactttgtgaaagggtcagtctactctcaaattggtcaaggcccataggtcgagaaccactgttccagagtcagtggtgcttcttggcatgtcttaactctgctcagtgaccttgtcatgtcctctgcattttagtcaaccctagctcaaccacttcctctctctctctctgcttttgaccacaattcttatggtcattgaggaaatttagatgaatttgaaaccaattttcttcacttcctttttagttaccaagactttccctgagtcttttcttcacaatcacctttcactctctagtagggaggactcaagaaccttgtcctgagtcttttctttacatattgcctttcacattctagtacagaggacttaaggatgagatttccaagaacaaatcaatcagcagtacttgaactcagaatcatatccctcctgcccactttggccattgtgtatatattttatctttcttctgagttggacaaagatctatatcttacttacttttatttttaattttttaatttttattagatattttctttatttacatttcaaatgttatcccctttcctagtttcccctccaaaaatcccctatcccctacccctacccctgctccccaacccacccactcctgcttcctggccctggcattcccctatactggggcaaagaaccttcacaggaccaagggcttctcccattgatgaccgactaggccattctctgctacatatgaagctagagccttgaggttctctgtgtttctttgattggtggtttagtcccagggagctttgggggtactggttagttcatattgttgttcctcctatggggctgtaaaccccttcagctccttgtatactttctctagctccttcattggggaccctgtgctctgtcccatggatggctgtgagcatccatttctgtatttgtcaggcactgacagagcctctcaggagacagctttagcaggctcctgtcatcctaagtgagataacccaatcacaaaagaacacacatgatatgcactcactgataaatagatattagcccagaagctcaaaatacccaagatacaatttgcaaaacacatgaaactcaaaaacaaggaagaccaaaatgtggatacttcgatccttcttagaagggggaacaaaatacccatagaaggagttacagagacaaagttcagagcagagactgaaggaatgaccatccagagactgccctgccttgggatccatcccataaacaaccaccaaacccagacactattgtgtatgcttacttacttttctttctttttttttaaatattttttattattacgtattttcctcaattacatttagaatgctatcccaaaagtcccccataccttcccccctacttccctacccacccattcccattttttggccctggcattcccctgtactggggcatataaagtttgcgtgtccagtgggcctctctttccagtgatggccgactaggccatctttttttttccattttttattaggtatttagctcatttacatttccaatgctataccaaaagtcccccatagccacccacccccactcccctacccacccactccccctttttggccctggcgttcccctgtactggggcatataaaatttgtgtgtccaatgggcctctctttccagtgatggccgaccaggccatcttttgatacatatgcagctagagtcaagagctccggggtactggttagttcataatgttgttccacctatagggttgcagatccctttagctccttgggtactttctctaactcctccattgggagccctgtgatccatccattagctgactgtgagcatccacttctgtgtttgcgtaggccatcttttgatacatatgcagctagagtcaagagctccggggtactggttagttcataatgttgttgcacctacagggttgcagatctctttagctcctccattgggggcgctgtgctccatccaatagctgactgtgaacatctacttatgtgtttgctaggccccggtctagtttcacaagagacagctatattagggtcctttcagcaaaatcttgctagtgtatgcaatggtgtcatcgtttggaggctaattatgggatggatctctggatatggcagtctctagatggtccatccttttgtctcaggtccaaactttgtctctgtaactccttccatgggtgattgtttccaattctaagaaggggcaaagtgtccatactttggtcttcattcttcttcagtttcatgtgttttgcaaattgtatcttatatcttgggtatactaagtttctgggctaatatccacttatcagtgagtacatgttgtgtgagttcttttgtgattgtgttacctcactcaggatgatgccctccaggtccatccatttggctaggaatttcataaattcattctttttaatagctgagtagtactccattgtgtaaatgtaccacattttttgtatccattcctctgttgaggggcatctgggttctttccagcttttggctattataaataaggctgctatgaacacagtggagcatgtgtccttcttaccggttgggacatcttctggatatatgcccaggagaggtattgcggggtcctccggtagtactatgtccaattttctgaggaaccaccagactgatttccagagtggttgtacaagcttgcaatcctaccaacaatggaggagtgttcctctttttccacatccttgccagcatctgctgtcacctgaacttttgatcttagccattctgactggtgtgagatggaatctcagggttgttttgatttacatttctctgatgattaaggatgctgagcattaagctctctgcttctgctccagtactatgcttgcctgcctgctgccatattccatgccatgacagtcatagattctcagctttaatactgaaagcatagccttaattagatgcttcctttcatatgttgctttggtcatggtttctcattgcagcaatagaaaagtaagtaagcaaataacacactacctacaacaaagccacactccctattttctttttttatcaaatagatccactaactgaggaccaagcattcaaatatatgaacctatgggggccattctcatccaaactaacacaagcacattgggagaatataactaacatagaatcaggtaaccaacatatagaatcatggtttgtacattatagagattgatccataaactgatgagttcttaggggacagaatagatggatttcagttcctttgtgtattgacatagctgtttaataacagtggctctgaatggccagaaagaggaattttttaaaagatttaacatgcttaacatccagtgttttagatagaattttgcatggtatcttggtgaaaaattgtcagcatgactcgtcatttagtaaaagagtggtgtactggctagttttgtgtcaacttgacacagctggagttatcacagagaaaggagcttcagttgaggaaatgcctccatgagatccaactgtaaggcattttctcaattagtgatcaagggggaaaggccccttgtgggtgagaccatctcagggctggtagtcttggttctataagaaagcaggctgagtaagccaggtgaggcaagccagtaaagaacatccctccatggcctctgcatcagctcctgcttcctgacctgcttgagttccagtcctgacttccttggtgatgaacagcagtatggaagtgtaagccgaataaaccctttcctccccaacttgcttcttggtcatgatgtttgtacagtaatagaaaccctgactaagacaggaacataaggttcccacatcattactttctctcttatacttaggacacggtcattttgatcattagatggagtactggatatgaaaaacactttttgaaatctaaaagaaactcttctccaatacagatgtgtagcttttagttgcaatgccacaaagaactctggaacttctatttgtcatctatatcactgtggagagccctgcagcgagcaatcgcgtgcgtgccgtgagcaatcaccattataagatggcgctggcttccactgtgcctaactagtaaacaagccttatgcgcaagtgcaagagtgaactcacgcctagtcactgcccatctctcagcgtagtaatggggtgatgggcaagcaatgaatcaggagctgtcacgccacatcaggtgctgaaacgtcacgctgcgggctatataagcagcgccattttcccggttcggggtcttccctcctgataagtaagcaataaaagctttgctgcagaagattccggttgtcctgagtgtgttcttgccggcggggacaaaagctcgggatatatcacatctactgtggcttctgacttatcttccttgtgaattcagaacttgattccaactacccatcatgtaaaatgaaaataaatcaaaaatgtaaagtcttttctctccagaccccaccccaactcctgtctcctctttggcctaagtatgtctatctggatagttttactagtccacaggaatgactgtataaagtaggaggggaagaaggtaagaagagctgtaagtcatcatttcttttattcaaattcgttcttctgcttgtattagggacagttcttctcatactgcattgccctttctagccttaacacaagggggtgtacctaatcttactgcaacttgatatggttatgtttggttgatattcataagaggcctgcccttctctgaactgaaacaggggaggattagataggggacggcgggtagaggggagttggtggaggagggattgggagaagaggaggaaggggaactgtggtcaggacgtaaaaacaaggaacaaacaaaaaccaaaacattttttctttacaagcaaaagaaaatagacaaaacaattcaatgctggctggaaagtataatgtaaactaagtcagagtaccactggctttaccactttagcagactcccatggatatatgtgcattggggttagaacatgaatctattatctgcctgagtatgaatatgaatactgctctagttctaaaagaatagagggtgttcatttgcatgagaactgcactgggattatgtgaatatacccttttcatggtttccccctgagagatgtctgagttctttaatacatgagtcatggtagagaatttctttgattctaccatactccttgttaagaagcagtagttagttgctgtctgttacctctcagttgccaaaacacaaaggtgtctcttcagaaaatgtaggaagccaacatgggtccagatgcaatcatctcacaccactcagtattagcccaaagattgtgtagtaaagcaatgaaggataatttattgtcagagaaaaatgcttcaagtatcccttagctaatggactagacacactacagcaaaaatgtctggcaggttatattctgatgtgattttcattatagaaccatggtgttttgatagaaaaactgaaagaaaaaacattggctctcacttgtaattaaactgtatgtttaaaaataaaccacatattttagcactaagtctaatcacttaaaaaactataatgagaatcctgtgccagatcatttgtccctgcctttcactgctttaaattctgctccttgtttcattcaatctttttctgctgaaaactcttccttgtgaatctttagtcatttaagggcttattgccttaggagcccaataaatgagaattttgttttgaaattggactttgcttattctcttttgcccccaaagcaaagctttgcaaatgggatgaatgcacagctccttttcatatgtgtctctccagatgctcaaagcatcatagaaaaataggacagatagtataacccatttagttgatgagaagacagagacctagagattaatctttctccaaatcatacagcaagaaattgcaagtggggacttgaacacaaaactcatgttttttaaatgggagaagcagaagcgacaatctatgtttgctggcaagcattttagttgtaaataggcctgcacaatcattcttgaggtattcttctgaacactatgcagaaaaaaaaatgataacaaattaagtaatccatgtctttgcaacaaatgtactagttataggttaacttcatgccaaataggaccatatgtattttctcatacacactgggactctttgtatagattatgcatccattccaaggaatgtacagacttattcaagcctttgtaatacttgcagaggtgtttattttgtttctgtttatatgatcaaatgttgttcatatttaccattttgtttgactttttggttctttcaatgttcaattataggaaagctggttctgttttgattcctgatactgatttaagaactggtcatggagaagacagacctgcagattcatcaagccattcacctctatccagatattccccatggataagtgagagtttggcatttaaaaactaaatactcccattataaaataagcagattatgtctaaattccctcatcctctactaaattaatatgtaaccattgggacacttagagcatcaaaatatgcctactagagtctggtaaactatccattggccataggctttattattattattattattattattattattatatattttctttatatacatttcaaatgctatctcaaaagttccctgtaccctccctctgcccagctcccatacccaaccactcccacttcttggccctggggttccccagtactggggcatataaagtttgcaagaccaaggggcctctcttcccgatgatggccaactaggccaccttctactatcaatgcagctagagacacgagggaccataggcttcttaaagaggacattttgatttcagaacaaaagaaataatttataacatttaggtagtgtcactgtttgaggtacattttctgactttattaattctattggtacacttgtgtttcttagttcttattccagtgaaaatattggggtggagtgagataaacatctttcatatcaataaaaaattaacatttccttcctgaatacctcttactgtgggttttatttctgtacttggagcattgctcaatatagaaaagtgggaaaaggaactgagagtatcgatggaaagagttgcctagcaagagttaaatttatcattctgggatttgtcgttcccaacatttcaacatgctgacaacagccaatggaatggttatgtgtctgtgtctgcaaacagaacttgtagatgcatgtcttcatgccaggcagagctggctctttcaaacactgattgcagctgaagaactagaagagaagtgttttcacctatgctttgagagccagattctgatacctaccttttcctttgcagtgacacagacaatttgggagattcactctttgataaatgcccatcactgtctacatacaaaatctttgtgcagttctttgtttgtttagataggaagggttattcctattactggctgacaaaatgtggatgatagtgatgttatcaaatcaaaatagagctttgtgggtgacaaaattctgtataaccatataaggaggtttttgtttgttactatttgggtttttaatatttgtattgttttgtctgtttattcatttgagttggggttgcttgtgccccccccattgacctcacactacattacctgtgtagccaaggatatccttgatcctgatcctcctgcctctacctttcaagtgctaagattacaggtgtgcactagcatgcccagctaaactctttagttgccaaatatttccaccatccttccaccacagggatactccttcagggctgctacttgaaaaataaccttaaagggacctgactcttctcatctcaatttgttccgataaaggaacgtagaattgattggaaagccctaacactagctctaccactgagtagctatgggactttaaagtccaatggtttactgtttcctgcttagtgctcatagcctgtgtcacaaaagtattctgatgactcagaggaagggcagaaatcctcttaaatatgtctgtgctcgaacaaatattcattaatatttgccttatcatattgtatggctagtctctttgggccagattctgtcacggttttcataccccaaacccataccctataactaagataagaataagaattacagttatgaattaaggatggtttgtggaatccaagccacctcctacctgcactggagcttgaggatctttatagtccattcctcaggagctccaggggacttccctgcctagcaataattattcaatctcattttgcccctaattaataagagttggaggaacttttaaaataaatccatgtgcacatttaattttctattttcgtttatttcacagttaggcttttcttctccaattttgtttttagtgcacaccacaccttggatactgcagtccaaagatgctgcagcatcccttgccttctcaaatctttcaggctagtgcaaaagcaattgttggccctcgcctcagatgttccaagacttcttaagtacaaatggtccaaacaggaactcatcctctcgcaccacaggctctctgtctcctcaaagcagtgtagagatccctcagaggccatatcaagtaaaatggtagtcaacctttgcacctccctcaattttactcaataaggtgagtctaaaacaacatctttgtcacttttactctctgaaatattgctcaatgttgccttctccacatctgcagtcctaagaatctaatgcagaccatggaggtcatgataccgacgccccatctctggctctgctgcccatacacttcactttctcttgcagcaaaatgagaaagaagcagaagtgcattgagccataggaatcaaaggaccctgggggacttgctgaaatgtttgaactcctgatcttcacaagccatagtctattaaggaattttaatatgctaacaacttaattcttagtgcacatttattcttctaggtactatgcaaaattatcttcagcaggggttcagcagtgtagccatcattccaatagccgagtaccacctgggaatttattaaatacacatatttttagcctcacctaactagtctgaaatggagggtggggtgtggttatctgtcatttattactacattcgggtgaatctgctgcatgctaaagagtaaaaaccatgggtttcactaattattttgcataaaatctgtaagtaccctgtgaaggagacactaatttatctttatttgatataaagatgagtaacatgaggtcatcctttgtgccatcttcctacagtgatgaagaggggatgtgaacccagggattttttttctttttttttttccatttttcattaggtatttagctcatttacatttccaatgctataccaaaagtcccccatagccacccacccccactcccctacccacccactccccctttttggccctggcgttcccctgtactggggcatataaaatttgcgtgtccaatgggcctctctttccagtgatggccgaccaggccatcttttgatacatatgcagctagagtcaagagctccggggtactggttagttcataatgttgttccacctatagggttgcagatccctttagctccttgggtactttctctagctcctccattgggagccctgtgatccatccattagctgactgtgagcatccacttctgtgtttgctaggccccggtatagtctcacaagagacagctacatctgggtcctttcaataaaatcttgctagtgtatgcaatggtgtcagcgtttggatgctggttatggggtggaacccaggaatttttattctgaatctttgtccccttagctactatgccaggctgtctctctaaattccaaatccttgcattggaagccaatataaggattaaaatgtagcttatggacaatagtagaccttttaagacccagagttgcctgcatctctttcctttttcattttgctcaagctaagtctggctcttgcccacaaaagttgatttgctactttctgcaaacacattgttctctatattttgaatgcattcgctaccatattattaaacctttccttatgtctctaacctcttgctggaccacacatctctgaattcctctggcattcgtgcactacaagttttaaagtttatggcatatgactttatccccaactacttcttacgatgagcttgctcgttcccaggaagcagggtgggccatgtggtatgttgtcttatatattaccatttcattaactgcacatagatacatacatgtttagttcagaactctgtccaagatgaagactgttgaattaatttgggggtgggcaatgcacaattgttttcaagtcacaaaattataagtaccacaaatggaaaatctgtttactacttaacatcttcacccaagtgcctggcatagggtaggtgctgaataaattcactgttgtggaaacagcaaccaatcaatatagaaaaaaaatttcattctacttagaactcagaaaacagaaattactcatgatgtagtcactacatatttttataaaaacaccctttaaagtctctaaacatatcacaatactgtgtttccaactgtgtatagttgatattggatgaacttagacaattctctttttctcaaccctgaactgggtaactcctgggtcttaggcagatctattttctttggtcctttgagaagtcctttcttgactgcaactgtgtagacttcccaagaagatactatcctttctgagccactggcttctcagtatgtatattcattcattaatttctccatccactcaccaaacatttattgccaagcactatgatgagccatggacaagtctatgggaagtaaggcatgagtctcaaggagctcattttaccttcaacagggggtattgacatataatctataatatgtaacacataaccttaccatgttgtgggatgggaataatcatggagaacttcatgaagaaatttatatctttgctagaacctggaagatacgtaggaactagccaggacaactaaattcacatataaatgcaatgtgtcagggttttcagaaagaaaacaaaacaaaacaaaacaagaccgaggatgataagctaatgtagaaacaccacacacagaggagagatgaagtcctgacgtaagactattgggatagagacaagcacatatgtttggcttatatttgaagttggattgagcatccttgctggtgatgagttggatgtgagaaaggaagtgatgtggagattattggaggatgggattgcagagaaaacaataacccaataagctcttgttggagttgaattggaacatcatagtgcagggaacagtcaaagcattggccataggcttacagctcattcagagaagaaatctagcttagaggttcacactcaggggtgtgtattaaaatgcagcttgtgttgctttaggctaaagaactagcagacactgaggacccctaagtctgcgagaactaggacacaatctataaggaatgaagaactggtctctggtctcacagatgtgggttgtcagtagacatactccatcatcccctgacactccctgcaaaggtttctcaatagcatccatgcatctttcagtcaaacttcagattgacaagcatgaattattcagtcctaacttcccccactctatcatgaatgatacctaaagagttttgttctaggtaccaggtatgttttataatcattgcctcactaaaatgctaacaataatcctacacaagggtttggtatcatacccaaacccttgatattcagaatctctaagaaatttgcctaagaatacagctagcatggctgtgaggggctctgaatccagggccatatatcagcactgctgcacctccccacctcctagaatacagctggatcctcaagaaggctgccctcttccttcccctgctttgtaaatatcacttgcatccctggcttaacattttgttctccattaaaggacaaggctccccttgggaaaagtaaacctcaaagtcgtcaatcattcaagcctcagtgggaatgagtttcagattcttaggaacacattttaattttatgagagaggaccactggaatcttgagggagggataataaggtagaagtacagcaaattatgcagtcagattcttccatcgattttgccaacccacctagttttgggtatgtgcttctaagattcttagatgctgtttgtgcatatttctactatgttgtaggtacctccattaatgggtctgttaccctagttgtttggttctaatcaaaggtaaccttacactacacactgactccaaaccaccatgattaggaagagatagccagcttgagctgtggttgtagacctgtagttcctggccttgggcacaattttgaacccttgagaattaagtcctgctgtgcacattaaaaaatattgagcagatggagacaggagagcttgttggaacaatgtagaggagtcccttctgccctggatgggtccatctgccaaaataaatgacatgtatcagggcatggcattagtccaagcccattgaaattctgtgagccatccaaacagtgatggggcttcagattgggtctgtgattggacttagagagagatgatgatgagtgagcatctggctgctgtagccttctgatgggaacagtcccaggggaggctccatggtgagaggaagacagcctcaaggaccccctaggacatctgccacagagagaccaacaggacctagcaccaaaagacaatatagtctcatgccattcctactaactatgtgaccaaaagaaatcttccttttctctcagcctcctccacccagtataaaataaactctgggcaaaatggtctccaagggcctttccctgcttgaacattctgtgacttctttgacacaggtttgatttctctttctctgtgtgagaaaaggtccacccacccacctgtttatctgcagtctctgtgttctcacactgacctctgctggtcatatgggggaaaaatgcagtatatcatgtctgcagggaaaacaaaacaaaatataatgcagtctatcaatgattcagtatgaagcttaagtgtcacaccgaaactctgcactggagatgagagcgagtggaaaccaaagcaatgctaagcacagatcaagacatggctctttttctcggggcttccttcatctgttcccggtgctctgcgccacagtgtgaaaggatttccatgggtagcaagatttcttgtctcagtgcaagacaaggccttggcaccctgctggggaggcaattcaagataagcctccagacacctaccagacagggccctgtgctgaaatcaacatgagaaatttccttccgggctgctgacatatccaaccaacctaaactacctgagaccagcccccatcatctttgtttctccaagacataccttcccaaaagccccttttggatttgttttttaatctcatgggttctttagatgtcttacatgcaactttctgttaaatttagcgtgcccactcagacaggagaaagaaagccgttttctgaaccatctcctggtggaccaactcagagttctattactgccatcttagcatttcacaagcctaagtttcctagtttacccatgctggtgagcttgtgttcagaaatataagaacacagaagtggatggcgctggcccttgtgctcacactgggtaatgcttgaactcccatagcagtacaagcagaatgggaactgggtcacatgacaaccagctctcttcgtagctgtcaagcaatttatcatgtctatcttccctttatggaaaaaaccccttttggtgggtccgaggtttgggccaaacattctgtggtctgactggatcttctctgttagtagctccagcaagtccaccgtgtcttcaacctctcaccaaacagtcccctccgccaacagctgattcttatctgcttcccttgttcctgcctcatgcaggctgccccagtgtcctgatgaggctcacatgttctttaggatgccgcctgaggagttacaactctaaacagtgctttctgcccagctgcttctccaggtctgaccacaccacgccttcaagtttcctgccaaactctctaggcccattccaagctgaagttcacttggcctccccaagtagccgtgactccccagccatgggccaggtgttgtgctccataggcctttccactgtgtgcctaagtgcttgctccctgcgccatgtgaacggaaaactcttgagtgatagatggtattgcagagtgttgcatctccttgggtagaacattgttcatttctttgcaagagctctagggcttcatgggcctgattgacactgcaaattatatcccgaaggatcagcacagctggtgggaacaaatattgccagaacataactctaaacactgtgtttaaggcgctgttttcagccttttaaagtgtaaagcttgagggtgattggaaagggcatttccgtgggctttttcagagttttctctgagttttaggaaattatggtcactaaaggggtggggaggtgggactggaagcatttatgcaaacttgatttctaccagataccaggttctcagataggtagtgcacatggttttcacttttcagccaaaaagaaaaaaaaaagtccctattgggataatccaggctgtctgctttgtacctactgggattaattctcagtctcagtcagtcagcttgaactctcagacttaattattacggacattttatagccaaggctttcaaaatcttcaggctgctcactcctgctaccataactgatacctaatagatattctcaggctccttgtgctgtacacatttgggtactgtgcaaatagaaggaggggctgaaagggggataggaaggaagagtgaacaaatgagtgtgggggaggggtccctgtaagtatttagtgccaggtataatgatggagtcctgggatcagctgtaaaatcaagatgtattttgaagagttgggcagtttcagtggtcactgttctctgtcctccccactggggcagcattctttagacacagccatttctgaacttcagtgcaatcatgtggttggccatttggatgtgacttataaaatgccatgatgctctccagtgttctgttcgttcactattttgacaatctgatggatggcctggcattaactaggaagaggacagtcttatgcagcctgaataactaatctcctaagaagtacaaagttgaaggatcttggtgcacatgaatcttattaaatgtgcttataaaatgtgttctatccaaataagcttaacggcccctaaaatagccctttctgatccctgtctggaacgctggcatgcctcacagatctctaagccaaaattatttagtcaagtggtgcctgtactttgtacatgagaaaattggaaatgttgatgttaaatcttctgttgactaaatttcagtctttctgtccatctttaggggcaccctggaccaattggaactcaaggtccagccggtccggaagggtttactggtccaactggtttatcaggtttgaaaggagaaagaggctccccaggccctctgggaccatatggatcaaaaggagataaggtaaggaacatctttgatgcaagggtggaagtacaaaagtcaaatgttccctctcagttctcagaggaatagtgttgctcctaaatatcgcggtgccagggcacacattttaagaaaagctgagccaaagtacagtgtgtactagtgtgaaagtgtctgtgaaatataatatggtgtacaattggtatacaacattaaagtaaaactatgaagaaaacagaaagaaagaaagaaagaaagaaagaaagaaagaaaggaaagaaagaaagaaagaaagaaagaaagaaaggagggagggagggagggagggagggagggagggagggagggagggagggagagagagagagagagagagagggcatggtgatgcacatctctaatcctagcattcaagagacagaagtgtcaagattgccacaaagttcaaggacatcctgacctcctcaataggtatcaggtcagccaaaatccataaaaatgtctatctcaaagaaaaaaaaaaagaaaggagtgactggtgggcaagtgatggaggaagcgtttctggagattctcaaagaaggcagactatcaagtaaatatactggttgcttacgtgacaagttggctcattcatgtcaagtcatggggatttgaaatgggcttgggtggagagtctgatgagctgatcagtagagatcaagcatacaacagaggagactaacaagcaagaactaacaggcaagatttagaaacaacctggctcataaatataagggaatgcactaccaaacaagaatggtaataacatgatgactagcctactgaatttatcaactcagttgagatgctctgtgtattttcatcacgtcctgttaatctcatattttagggaagggattgccacactaagtataaggtagctgaagtataacatttatctgggcacatgaggttgaaggcaattttctactcacagatgaggtagatggcaattgatgaatcacaaatattcacatcttaggaaagggagccattgcgtagcatgtaaggacccaaagagttgtgcttgggaacagagtgaaccaagaggctgcaggtgacaggccttagcatcaagaggttgtggtggccctggttcctgaaagaaggtgtgacttgtttgaatatgtcattggcttagcttgaactgccttttgtggatgaacaagaattgcacttgtcccctgataataaaggtagagtagcttaggacctttatctgaaggagcagaatagggagaaactattttgttagatttatcaaagcccttctgttgttatacagatgtgaagactgcctgtaatgctgagtgttaaattttagggcttacactacactgcttaacacaagaacttgtctcagaacataagcatgctcaagaccattcttagaacaactccttagacttgggggtaggaagtatggcaacatgacatgaagaaggagatataaaacaccaacaacttaggtcatcaaatccagtcaccaaatctattgaccctaacaggcatcaatttgattgccatacacatttctctctcttctccttttttagggtcccattggagttcctggctttgttggcatcagtggtattccggtaagtgtgtacatggaagagactttaatatcacctttcaggttctgtctcctggctcaagtactttgaccttacatactgtgtgtgtgtgtgtgtgtgtgtgtgtgtgtgtgtgtgtgtgtgtgtgtgttgtacaagtaggctgagtgtcatgcactgagataaagtgtggtgaggtgagaagagcaagagtcccacacattttgattcaagtagcccttactcggatggtttaagagaagtgccaccaggcatggtggcacacacctttaatcccagcacttgggaggcagaagcacttgggaggcagaagcaggcggatttctgagttccaggccagcctggtctacaaagtgagttccaggacagccagggctatacagagaaaccctgtctcgggggaaaaaaaaaaggagagaaatgccatctatgagaaaacatctatatcttagcctaagtaagctaatactgggcaggggtggggacactgagcggaatttcagccaggcatagagggactgcctctgaattgcggaggcacattgaagcatgcatgtactcattacaggaaaagtaagaagatgcacagagtttgaatgaaatacattttatttcagtaatgtgttcttatcagccttattgcccttcagaggggactacccttcagataatttggttgatgcttgtttgtttacccttccagatatcagtggtggattggaagcttgtaacacagcccctttccaaattctattctgcccaaccacttagattccccatgtgtaacctatatccacacttaactgatggcttctggttccatggtaactgttcaccaacctctgaacttgttaacattggagcttactggctagttctttctgcttttgtctgtatttatcccataacctgggtcatgtttgtctacaagtttttctgacttatttaagagaccaaaaaggccatggacacttagactatacaaagaggaaatctccttcacctgagggagactttagcttgccctcatccttctaacaacccctaagaggtccttttgaaccctatcaaagcacagttggagatactgtagtctacccattgtcttatgtaatgctatacaaccttctggtatcagtaaaggtgattcagatctttcttgttccaatctctaggcaatgtcttgaacacctgctatgtgctcatactccactatgagaatatacagcaaggatatagttttgtgtttatagatactatcatctgatctatttttctctcaaatctagtagacatttgtagatctggagaataaaagacccactctttttgtgtttctaacttgaatcgagtcacccataaaataacacattttattcagctgcaatgtcaagaaaatgtccagaaataagccaattggataattgaatggacagggatagccatccttttttgacattcacctattttcttatgaccttgtttctatgcctgcatgagaaagaatccctgcccagagtgtgccttccaggtgcagaagatgagtgtaactgctaaactggaggtaccattacccaatcatcctacagacctggctaggtgaaagatgcacagtgattggaacttgcactgttactatgccctccccctattctctcttttgggctggaactgagagcaagtaaatcttgtgctgcctaggctgcttctaaatctaggctggaaccagtccttaagtccagatggatgcttcttatgcctcaaacttatggccaacgcaagcattgaccacttgtctttgtggcttcattgcttaggggaaagagttgcagctcttcagtatcctccaaataagctggctgctccccaaaagacacacccattcttagtcctttcattgaccaaaggttgtctgtgcttcccctcttccaactagccaagaagtatctgttgtgtgcctttcatttattacttacctcttccttccatcttgaagctcttaggagtctttgatgtgtggttcactactctacttccttgatgcatacagttccctggtcctgattgctttgtgtgacagtttcatctctgactcctaaaattcacagataagatcttctgtttccctcccccatccctgaggcccaagagtcctggaaatcctaaaagaaaagtttaaagacctgactcagagttctaatacctgcaaaagccagaattctccgactgatggagctacttcagacagaaaagcacagaacctacaggccttttccaactaatcaatctgttcaacttttaacatcacacacttaacacttcatctgaaaacaacagattctgacacatcttactaaactggaccactgtgaaaatcaagttcccctcctaataatagccaatcattaacacgggtcactggtttgggtctccaaattccaatttttgctattatatagacaatttcaaaatgaagtcactttcatgatagcccagttaattgcaccaaaggtcataacagtcaataaagagggcaagcagggcttgcctaccagtaggatgttcaatatcagcacaacagacactggggatggtacagctcagggctttgagatatcccaattgtgtgttagggctgttggcattatttataaaacactttcatttaaaatgagttgagcttggcgactctaattggagaacaggaggaaggattgtagcctctaaggggatcggagctccacagaaagaccaacagagacaactaacctgaacacttgagactctcagagactaaaccaccaacctaagaatatacccaggctggacctaggctttcctgcacaaaccagccttataatctcattttcctatgttttcaggcaactattgggtatcttagactatatcccacatgactaatagaggtcacactatcagaagaaggtctcatttacaatattcttatatagaaaatgttatcagagttatcggaggtaaacagactactcttacaaatgtgtgaatccagacaactaaaatgatggcttcagttttgcaggggaaatgggcggcatactcatgccttgactctttattaccaactagctcggttagtcccattgcctgggaagagctccagccctgtgtttttgctggcatagcttttcaggttgaggttggatcttaaaactagaacaaatttcctttcctggttcacagtttgaggggtagatttttgtcttatgttagatcagagtaacctcagagcacatgtcgtttctttgctcatgaagctaactttccctttttttcatttaagggatgtattttgcttctgtttgctatatccaaatcaccagcatcactattcttctagtttagggccattgttaagtaaaatagttatgttccacatgtactgtggaactgctgtgaaaattgatctgataacaaagataactatgtagtgactaataggctggtagagaatgtagcataaatattcatagatgtgctggagaaggggatgatttacactgcaggtaggattgagtggattgacattaatgttcattatactactcagcacaatgtgtaatttaaaattcatgagttatttccatggataaggagggactactggtcatttgaaaggctcattttgaacacatgatatgtttccctcaaattgttaaatatacattttaccctttgaaagtatatttaagggaatgtagaagtctacctacctttcattgacctgtccagatgatctattaaggtcatctatttgcaccatggcccacatacaactggcttttactagattgaaatattatgttctccaattctgaaatacactgaattcagatgagctctatgaaaatgcttttgaactcccaagctaaacaaatgccctgatagtgaatgtggagaaaaagagaagagatggattcttaactgaaccagttacctaccatgggattgtgacaaactgagtgcaagtgagactggctagtttttggccaagcagctttcagtagaggaagtgctgtgggaacttcctccgctcagttgaccaagatcaggcatctgctcccatgcagaacttccgttcagaaagccatccagctatctgtctggtctgaggaatctcaaaccttggcatggttctctattgatagcagttcagctgccagacagctaaaccccattttagtacatctctatattcagggaaggtgaaattgtagtgccttgactattgtatgtgttcaagtttgagccctttagtttcagcttggatattattaaagcaccagttgtctttttgagtgggataactcaagttgtgatcttggcaacatatgtctgagcacaaaggaaacatttgagaatgtacaagatgaagctaagggagtagacaaggagccagaatttagcagtgtacttgtctgttctcattgtgagccttttaaattgactaataatcctgtggctgacttgatcccttaatttttctttgaacagggccaccctggacagccaggtccaagaggtccacctggcccagatggctgtaatggaactcaaggagctgttggatttccaggccctgatggctaccctgggattttaggaccacctgtatgttaccagatctttgcaccttaatgcaaatgcaccttcaaatgtgtttttgtttgtttgcttgtttgtttatcttgaaacaccattaaggccttgtagacagccactgtactaccttgcccaatgcaagagtttatacggatggcaccataacagcaaaactctttaaaagtgccagttgaggggtgcacatgttaaatgactttaggttactttctaatgctaccttgggaattgtcaagattgttaaaacaaacaaataaataatagttatagcacatttccgagcaaagcatgcacttgagctatttggcattttgcctatcaggtaacattgggatattccagggctggagagatggctagcggttaagagcactgactgctcttccagaggtcctgagttcaattcctagcaaccacatagtggctcacaaccatctgtaatgagatctgatgccctcttctggggtgtctgaagacagagatggtgtactcacatatataaaataaataaaatctttaataatgggagaggatattcttggaagaccttcatgtgatcatatgcatattaaccaggacctaaaggcatgatgaacttggtttataccaatagtttcctgacttgaagaataacacatttcaagctcactattcatctaatttggaaaaacctaaatctataagagttgtcatgtgaggccatttgaaactagaaatcatacaaccaattatacagatctcatagttctctgagtagccttcaatgaccaagttgtggagtataagaatacatgcaaaaaatgacacagaggataggcagaatacaagccccaaactgccctaaaggaccctgccatcaatggtccagaccaataaacagcagagagataacagggaaagctatagtcctaaataatctacacaagtcttaaaggctccttaatgctgccatggcaacagaaaggggaagaaaatagacaatgaagccagcaaaggagagttccaccccaacaaatggaataaagaccttgaagtagcagacatcctctgaaagagagaaccccagagtggaaacctaaacccagcctgaaactttaccttaagttttaatagaaatgtgggcatatgtttttactaagttgaacctcacctcctgctgaatatccattcagtaagtccatttgaaacttctatgaaagaaaatggggaacacataaataaggggaagcagacaatattcagaaactgatttgcatgtctaggcgcttgttttactagaagtacagtagtccccttgaacttgaggaatccatcatcaatcaacaatgtattctccaaagtgtacccttaatactacctaatactaatcctgacttctccttagatgccaccatttgctactaagacaggaaacaaaaagaaatctgattgaaagactggaatcaggtatattgactgatttccatgataatgagacacaccagctttttcaaaggtttgaagctgaaattgtgttgtagaaacacgagatgaagttggtgtcatagttgttttagacccatggcctacgtgttggcccccaaaagcacctgtcctctagcctgtttttacatcttaaaaataaataacaagaaaaatatatgacagaccccagatttgactcacaaaactttaatgatctagaatcgtagaaacttttgttgacctttgacctagataaagatccagttagtgaggtaaggggtagagttttacctaaaccagtgttctccatagatagaaagtctgctgcagtctaaccctcatcatttcacagacccctggcatagagacagaagaatggcacccagcttcaagacgacctctttagaggttaggctattacctttaacacagccaagttttccacagcaaaagacacataatttcaggttcccattgccaaatcctctatctaattaggtaatattgctatgaaaactctgcgtgggtaagtggagttttgtttttcatttgttttgggtgtgtgtgtgtgtgtgtgtgtgtgtgtgtgtgtgtgtgttcagggattttctcacaggtttttcatattttatccaggggctgcctggtcacaaaggtgccaaaggagagcctgttccttttcaaggcagcattacaggaataagggtaagagtttctaaagcaggcagcggagtgggtgggaatcaaggtttcctcacaccaagccatttccaaaactaagaaacctgtgcgcctgcttaaggagcagcaccagctgactttcaaaggattccaagttttttggtggtagaaacatttgcagaaatgtttgtagctatgctgtctagaaatttgttttccaggatctgcaccaaaactaagagagaatttggcaatgagtttgcatggctattttctttgacaagccaaaacgttttctagaggcacatgcttttgtgtttcctctaaagccttaatacctatgcaccttagtttgagtctgtatatatccttatacagcttagtatggctactgccccagcatctgggttccttctctagactcctgaaagtctacaaatacttgcctgtcaactttcaactgattggaatctaatctcttgtcaataatatcattttattgagccttcctctatttgctaactggtagctttatgtgtcctcaataaaccctggttccaaatgattgaccctactcgtctgcagactgggaaagaatccatcactaccttgatagcaaataggaatttatgtgcctgcatttggaggggagaatacaccaagcttactgagataattgacactactctcccatcactgtacagggcctggaaccttagaaactggccataaaagcagagatggggatggaacatctggataactacagaagaaggaaatttgggttcttgacttggatgccatagcagaagatagaacattaaagttggcaagggcctcttggcttttgaattcatgtcactcattagacagatttaaaatctaaggctatataacttactcagagccagatggccagttctctgaagaactaaacctcaggcagtgttctttccatgctacagggagcttagaggtttttactgtaagtcaagtgatgtaagactagcaggtgtcaaagcacagccattgtcttagcaaacattgattaaatgatttttccagaaatcaaagaaaccttggatccagtggaacacagcaatttccacaagatggttatattacagattcatacagtggcttaagatgcctcaaagtaattaaaacgtaatcagagtctgtatgctctgttgattttcccttgaaatgtctgatttgcattgtatacatataagcacagattctctggggatgaaggcacaagggaaggtagctttgctttcctccaaaaggagcagaaaatcaccagcctgcagaagccttttctaattgataagttcctagcaaatgtgaaaattaattaatctaggttaagtaggaaatcttgttcagccaaggctataatatttgttttctagagtccagaatgttcatagggaaaaagtaaatgggtagatacagccaatttatgcattatttaaaacacaagaccttgataggggcccaagttgccgtaatttgtttctatccccttgaatctcaggttggttgtctgaaaccctttgggcttaatttttaatctcttccgtgtgttctctatttctatttctcagggagatcctgggctgcctggactagatggaatccctgtaagtcatgcttcttgtgttgacctcttaatgttttgtcaagatgttgatggtatctttccattcttcatggtggagttcaaaggtcttcgtagacttgctcaaagaaattctggagtattgcaatagaacaaatcatactagccacattttattttcagacagaaagtcctaagaagatgaaatgcacaactcgagttttaagacaggcagtcttcagagtttacattagatctatgtctgacacccccctccccccccacacacacacactccctgttcccttatggatgcccctgatggatgcctgaaaccatagataatactaagccctgtatgaaccattctctttctatgtatatagacttatggtagagttaaataataagttaatcacaggaaaatattagcaacaattgctaataaactatagcataatatgattagacaaagtaatgaaagttatgaatcccttgtcaaaataacttagtgtgttgcacttggcattgctcttgtgaatttgtgaaacaatataaagcttctgtggtgttataaagtgaggtaaataaaatgggctatgagacatagcattaggtgactatgtaacagttactttaacataaacacttccatacttctttctgttcactggtcttgaactgaggttaacaggaatatggaaaggaaaacaatagattaggagatccaccctactctcttgcatgtatcaggaaggtaccatgtttttcattcaacaacaatgtactgttttctatgtgtgttcagggttacatacacacttcttttaaagctatcccatagagaaatttccattagggtacatggaagtccacaagttaaactaataagggatgtctatttccttgcaattccatatctccattgctttcctttgaaaagatataagaactgtccctggcttgtttgttttttcttattttcctttgtcttgatagttttcgatacatacggagtatccagtatgagcaaagtgctatgagtgatccctcagacaatgtagacattgtccctcccacaaaggagatgaaaatgtaagggtaggaatatctcagaggaatcctagaaccccttagggaagaatactgtgtatcaaaaattctgataggagatatgtatctatgaaagagaatgtagtgtctaagaagcatgggtcaagtttagatgtgccagttgtagatggatgcttatacaagggatgtgaagtatgggagctcacacaggaaacaaagatgactaaggaccaaatttatagattcccccagagcaaaacaaaattgactttaaaagtatgtttattaaatttgtatgataacattcactcagtttgctttgcaatttctcttagggattcagcctccttgcctgtcaatacaaccatgaggcaatatgtatttagcttagaggacaggatgtctgttaactaaacaagtttatgatcaataaggagaccacaagttgttcctggttgtcaatccaaaattctattaagccacagaacattggcatcactccagaagattccctcctacctattcacagtcaatctgtccctatctcactgttgtgattattcttctgtttaaattagtagttcatagcatcaccatttctagagaaccttccaatccccttctcctcctgttgtctaaatcttgtcttctctttcttgggcacataacacctgtgtcctgctaccccactggaatggagccttacatttccacataacagcttttctcctgatttcagccttcctttgttactcaattcgacacattttctcatttttcatgtgaaattttattttctttttgacccatggaatatttagaagtgatgttttctcattccctagtatatgactgctttctgtctacctttcctttataaatttctagtgtaagtctataaaaattaagagtattacactcttatgtttcatcccattaaatttgctggagtttggtttatgaccaaaacttacagagaacacatactcagaagttggtgatataatgttttaaggaatatctattaggttaaggtagttaatggtatttcaatagccaatgacctgggattttttgtttgtttttgctttattgttttttgttttgttttttgctgttttgtgttattttaagttctacaaattactgaggcaaagatactgcattttgtttaaaattataacgtttttatctatgcagttcttttttttgctttatatatgttgaatctctgttaggtgtagatacatgtaatactatgatgtcttctagaattgacccatttatcattatgaaatgcctcctgcctatatctagttaatagcttgaagtctagtttatctaatactaaataactaggttttttccttttaaattttttaatagtaaaaattcaaatgcagagccaagtataatgaattttacaataattactcataactttaatattttactagaatctccttatctctcttctgtccatctatctatcactgtctatccatcagctcactgattttaatgaatttcagaatacattgcagaagtattccaaaatacaacaataatgcctattattagttaaactttagtatctgatttcttttgtttataagatactaaatgtatatttaatacatttacaatatagtaaatccacaaatactaaatgtatattttttcaattttgacagacacatactcctaggtaatctaaaattctattaagccacagaacattaacattacccccaaaaaagaggatcctgcctcttcgtagtcaatccctgctcctaccccatcctaaaggcaaaatccattgtgattactcttcagtatagatcagctttcacttgccctgaggagtcatatgtagggaataatatcatatacagtcttttgggcctaacatctcttgctgccgtgcgtttcagattcatctgtattgttctatatatgagtaaacttgcttcctttcactgttgtatgtcacagctcatttatcaatccctggaccagtgagtacttggaagagttctaacattttctattatgaataaaaatgctgtaacaactcttatacaattcttgtgggcattttttgtctttttgagaagttatcttgccttttgaccttaataaaaaaaaaaattctgtctccagggtccatcaggatcctccggctctcctggagatgcaggacccataggaccaccaggcttacaagtaagaccaacttaaaactagtgcatagttgcacatttttttaaccagtccatggatttgatgcagccctatgtgatttaggttctcttagagaaaggcagaagccatttctggaagattatacctaaacacgctgacttttttatccctccttgcctccctccctccctccctcctctctcttttagagacagagtctcatcatatagccctggctatcttggcactcacttttaaatgtttcaagaccaggttgtccttgaaattacaaagattcacctgattccaccgcctgagtgctaagattaaaggcacgttaccactccaggcttgaaacatgctcttgctaagagctatttgttgtccttgtttgttgtcattgttgcttccctaactgtccattctgtccccctaaagcttactggtatagctcaacatgaggtatagccaaaagaagacaaataacttgacacatctattggtgccttctgctccctcattatgtcaggcattgctaattaattaattataccaaccactatcatcattcttaggatacttccaaatttttctcaatgctacatttgggcaactgtacctacttgtttttctgatgtcaaaactatgtattactggtaaagggagaacatagctagccatctctggttctgggaaagccctgtccccagatcattttcatcaatacctaaatcctgctacttaatttactactgtgtttgaacttcaccaagtcaacttgaaacatccctaggatgttatgaggaataacacatgatatttttactaccttcacatgagtgtgactaccagactaatttggaagatgtcaaaggagaacaaaagaaacaatgagtgggaccgaaagatggcccaagggttaagagcacataccactcttgcagaggacccaagtttcattcctagcacccacatggggtagctgacaaccaccaactgcctgtaaaccccaggagccccgtgggatctaatcaccatcgcctagccttggtgggcaggcactacattcatgtgcacaaacccacactcgggtgcacacatgtacaaataattcaaaataaaattcttttcaaaaggaaccatgagaaatagcactaaaaaaccccactataacagagtcagtctgcatcagtgcattgagcagggagccagtgtatctctgccctctgtcatccaacatggccatggttttctttttgtttgtttgtttggttggttggttggttgattggttggttgggttttttctataattaagaaatactcattcctttcaatttcgttaatctagggtcccccaggcctccccggacttcccggtcctgaggtaagtatgctttgggagcatgtatgtcttgccattaagttctctgggttattttctttctttctttctttttttcataaagatactggtttacatctattttctagttaaaaaataaaactatcatattccaatttaagttgttggagcttattagtaattgattttctttttcttccctgtacccttgtgccccagggaaatatggggttaggtttccaaggagaaaaaggagtcaaggtaaatagattctgaatacacaatccacatcccacatgctccaataaatgtctgtggttactcatatacgcacacttgtggaaatggaattattttccaccttagaatatgacctttcctatctcacacaggtcccctatggcgtccattgagagctacatgttcgcatgccacacacatgggcttttggagtgtttttctttcaaaaatttttgtttccctgcttcctatgtctaaatctatattgcctcatttaaatatactctcttaaaatgtattctttcttcttcttccacataggtacttctctgcttgtttttgtacactattgcatgatattattttttgcttcctatcttccttctaaccttcttcccccttccccctcccctcctccctctacaagcctgcatacacacaaacatgcatacacatatttgatacctcttctctgcctctttttgtaatccctctttctctctcttgtaaactttcctttctatttgtgtctaatatgtgagtaaaggtgcccacaggaaagaaaaagaggatgtcggatcccaggagttggggttacaggcagttgtaagctgcttggtgtaggtgctgggaaatgaacacaggtccttggcaagagcagtatgtgctcttaactgagccatctctccaaagctttaatctctcttttaatattcacttcccttccttcccacctttgaaccaatcagatatcagggggaggatcgcataacgttttaagcaagtttacaattttgtgttgggacaaatccatagctccctttggtggcacacagccatatgcagcctatgggatgagtacaggttacacaaacccaatagagtcttatcactgttggcaggaggcagccattccctttgcccaaatctcacatggctcccttcttattacctctttgtgcatgatcatgcaactgtgaatctattttaactccccccccccttctcatccatctgccttttcccttcacaactcttgggcttagcattcttcttaatcccttaccaatgaaactttgttttttccttggcacaagggtaaagagaacagttcatttgtggattgcatccagaaacaagctgaccttttgcgaacattatttgtatgattatccttcattcaatggcctctttgattctacagggggatgttggcctccctggccctgcaggaccacctccatctactggggaactagaattcatgggattccccaaaggaaagaaaggttccaaggtagtaaatgtttactttaggaaaaattaatagaccttttcctgctaatactcaaattcaagtctaatattcaaagtaacctgagtcaattccaaaagaggagtaaggggtttttctttggaagggaaggtaaaacagctttcttctgtcctttatggaaagaattatgaaaattctgagggttttttttctggtgtgtagatagatattagtgacttgtatctgactattcatgtaggaattattttttgagtcttcaatttttaatctgccaaataacttgaaacaggcattatacacttgattttttttccctacaaactccagacctctcagtatttaaattgtctactaaatacatgaagtataaatcttccctttggagttttcacgttaaagaagttacttgccatcaaagatttagtctaaggccttaagtataagtcagtggtagagggcttgcacaaggacatggttgtattggagccctggaggaaaatagttgactttaaataccatgaatattgttaagaagcagcagtagatgatcgaatttgccttacctgaaccaccaaggattaaggttatatttcataatctgtccattaggataaaattatgtcgatgtttgcttttcaatggttctagtctgctgaaggccacagatatctttcaggggcctgcattcccttccttccttcctgagcttcctttaaattttgtgattatatttccatagtgaaggggcccaaatggaaacatatcaagtctcacttctttaattttgtttttgtggacaaccccagttccctctagctttatattgggaaaattcttgatttgggaccaatctaagtgtatgtaggatgattttatttttttaccccttcaatccatccctaaaccatagggggcttttcggtggcctatgtaagataaattagcagttcagagagagagagagacattagaatattatatgtctcttcccaaattttgattcttaacatctgtttgatgccattctcttctttgtagcctatatttttaaagcagcttcttcctccagaaatgcaacaactaaccatttttctatctcccagcctccctccccgccccccaggttgaaattatgtatcagtcattgaatttccatatgccaaggagctctctaaactaaggcatcccagcaagcatatagatctacaccactgtcctgtagtgtgatagtcacacttcctggctccctacagagcagtcaaagtagtttgaatgagcatctatccttcatgttcttgctttttgtggctactcattagcctttggttaatttttcagggtgagccagggcctccaggtttcccaggaatgagtggccctccaggtgtcccggtaagtcttaatttgtaaatatgcattcagggtctgattaaattaaaagcacagtatgcctaccaggaagatctcctcccatggttattgctgtgaatgttaccatcttcaccgaaggccttgaaagaaatagccttgttttctgatctaggggaacgtttaacctaactctccgtgaagttttttagatgctaacagcccaaactttagagttagaacagacctaggcttgacttctgggtcaagaatctcttaatacttctgaggacagcaatggactatatctgaagattaaatgagattgcccacactagagaaaagtttgtacacagctgacacttatcaaatgttcagtaaacagtatcttttctgagtaatcctatctttactttccgatctgcctttctagcttagatgcttacatgcaacagatgtcagaggcttctatgtgccaggttttctactgaactcagaggctataagagcaactaaataaaagttcctctctgtccttgagattacattctaatagaaaaccgataatgtggaaaatgagatgaatcaatagcaaaagcaggagttcatggcatggctcattgtatactgtttgccttgcattcccaggccctgggttctattcccaccagcacaaagaaaacaaagcaaaaacaagtccatacaatggtgatatataaaagatggaagagcactggactgagcacagggtccccaatgaaggagctagagaaaggagccaagaagatgaagggggtttgcagccccataggaggaacagcaatatgaactaaccagtaccccccagaggtccttgggactaaaccaccaaccaaagagtacacatggagggactcatggctccagctgcatatgtagcagaggatggcctagtcagtcatcaatgggaaaagaggcccttggtcctgtgaaggctctatgccccaatgtagggaaatgccagggccaggaagcaaatgtgggtgggttggtaagcagcaggaggggggaaggaatagggggttttcgaaggggaagccaggaaaggagacaacatttgaaatgtaaataatgtaaatatctaataaaaaagatagaagagggttgcagtgatggagtctagatgagaaaacacttgggagagagtggtcaacaagagcctctctgaaagaagtcctatataagctgagaactgtataatatgaagtaacaggtcatgtgaatattatataaagtgtttgtaggctggagggtaccataaataccaacacctgaggttgagttgctcagcacttcagaggcacagcaaggtgagtggtcagagcccagtatggtagcacataactatagtcccatcaattaggaggctgaggcagaaggatcaccatgatttcgaagaaaccatgcgcaacactgcaagaccatacctgaaaaatcgaaattaaatagccaagtggaaaggaaaggacaaactgaaagatgccaacaaacaagcagagactttggtgtcaggtcacagccagcttcagaagtcgattgtggcttttatttggagtgtcatgagaagctatttgtgtgtgtgtgtacacacctttgtttgtatgtacacattcatttatgtaaacatgtgtggaagcccaaatctggcactggatatcttcatagatggctcttcactttgtttattgaggcagggtctctagcagaaccacagctgtcctagtgatctctccttcctttatgttccgtatttctcaaaaataaggactttttgaaaacttgacaattagttattatataatagtaactgagcaggcagagatctgtgatcaccaatatagtttccaggttccttgtttacgtgagaacccaaatgaggccacagtattacatttggtcatctgttaacgtgtcacaaaatgtgttcagaagacgctgacaaaattttcaaagatttgggatagggactcgaagaaagtagaagaatccaagataacaagacctatccccccacctacctgcacactgggaataactgtggactctagtccttgctggtagtactttgaactacttggtgtctcactgagtgattaggaagtacagccagaggagccagtagtacagattgcttctagcagggttactgttaccccacagaaacaaaggggcatagagaatcatttgttctatgcctttgattttaattagttttgcagctagtgaatgagaaaggaagtgcgccctggtgtaggaggtagaacacccccaccttagactccactccagctctggaactttggaaaactgctgaaatattttctgtatgtgtgcaatacagcagcggttatagccagtcttctttctgaggcccaaattgcactgtgttgaagattttttttgtttgtttgtttttttacaaagctttgccatgtaacgatataatctgtagctatatatggctaccgagctcttaaaaggtggctcattcaaaatgagatgatttgtactgcaagcgaatacacactggatctcaaaaacaccagtggggaaagagtaatttgagacagttcctatttattgtggatttggataaccattaaaatcattatttcctttttaaaatacagctactggaaaattgcaaatatgatagtatatttgtatcacatgacatttttcaaggaggtttggagaaaaggattgcactagtctctgtggagtattttgtatagactctagtcacctggcaccatccctgggaagtgagtgagtgagtccaggttggcccctcttgcccggtagaggacaccattccctaagcagggaaagagccatctccaaagacacatagctacttagagagctgagactgccgctcattattgaattttgttgtttttgcttcatagttgtttttttttcttttctcagaatgaataagtgttgtttaatcatttttagccaattcttttttttccttttactgaaatggatttctttctcacataataagccctaattacaattccccttcccttcactcctccagtccctccccacattccttcccatttcgcttctattccctttttgtctcccattagaaaacaaacaggcttctaagacataataataaaatgtaataaaatagaataaaacaaacaaacaaaaagaaaacagtggaactgtacaaaaacacacacacacagagaagaaaaagagcttaagacagagatccactcattcacaaactcacaaatcccataaatataaaatcgctaagctagaagccataatatacacacagaggacctggtgcagaagtacaggccctgattccgttcagtattgttgaatgctggcagtatagaatttgttttctcataccatactgccccctgcagtccagttcactattgtcacccagaggaggtgtttgggctctaaagatttaatgatctctgctgctctgggatttgggattcactgactcacgctccctccctcctcttttctgtacttagacctgggagggtttcctccactgcagtatggacgcattccctttatgcctgtaaaagagactggctgactacaatatgcgatgagaaatcacagtactgttctcagcgcagtattttcaatgtttcacagttctggttgaaaaacagaaaccctagctggaaaaaaaaaaaagcatcaaagctgggaaatgcctctttttacatatcacatcgtattgcatagaacagaaaccaaggatgcggttctcagctcaccactacatggattcagtggttgacagtagctaaatcataaactgccttcactcataattctatctacctgcttactgtggatgctcgtgaatgccttactacgcctaacaggaaagttaccagaggaaagctgagagcacatgtgaactatcatgaggttttcaaacctaaagcctccatcacaccagctttccataaccaatgcttactgaaaaacaaggccctgtggaggacagaaatctcctgggaatccaaagtagtcccctttcttcccactgtagctggaatctttgcaggagataaaaatgcccaatctgacagatgtatgccttatctcttgcaccctcagcggttaagaaagaaaaaaaaaatccccaattttctggctttgtcccagcttcactcacttcacctcgcttgtctccagctgcatgctcacacttgtaggtccttccatggaggttgtcagaattatatacacaagtgccctttattcagggactatagacacataggggaagctaggatggcaatgttcagggagagatcagagatgaaactttcaaatcctgagggtttaagtagtcagtagatctgagggaattcctgagtagatggagctctctgagtctcctcagaaacaaaaagcagcaccaggaactggtgggatggggcagggggtctggaaagctaagctagtgcactaagaagtcttctgggctgtggaggagaaggaggacgggggacgctgtggcgggcctgtttgagtcaaggccaacagtaaagggtcaggtcccaggatatccatctagaacagcttgttcagcagggtctctaaacagtgcctccctgtgctgggaggcaagctgaaaccatggcccaggagcttgccaagtcatttatcttttattggctctaatatagagagaaagtggagagagaggaagacaagaaagaaaagaaaaggggggaaaggaaagaaatgaaaagaaaagaaaagaaaagaaaagaaaagaaaagaaaaggagagaggggagggagatttcctgttttcatttttcacatttatttctcttcatatttttcacaaactctggacctcaaaaaggtgaaaaagtacaggttcccccactctttgaagatgtaaaacacccccttctatttatactcctgggaaaaacagataggacatgttacagttgttaagcatgttgttgttattgttgttgttgttgttgtttaccatttgccatagttttattctttgtgtcactattattgcagttaattcagcaagtatttaccggaccactttgcacatgtgcagttggcaataacatgcttcacagggagacaggaacgaccataaggaaggttttctacttacaagactttcttacatttagtcttggtgactaaagagtttggggcagactagaacatttttggacaggtcagggaaggttattggattattcaaccttagagaccactagatatattccactaggtggcagcacaggttgtggggggttgttgttttgttttgtttttcaagtttttaggtttttcaagacaaggggttgtgtgtgtgtgtgtgtgtgtgtgtgtgtgtgtgtgtgtgtgtgtgtgtgtgtaacctgagccatcctggaactagttctgtagaccaggctggcctcgaatcacatctgcctgagtctgcctcctgagtgctgggattaaggacaagtgccaccatcatacctgtcttggtttctgatttgaaatatggaggtggaagaggctaagatttcaaagaagttgcatttttaaatcacattgttatttaacatttgagaatttcgtagaatatattttgattacattcattcccttcccccaactcctcccagctgcattcccaccttctactcatccaacttcatgttcttgtggctggccatggtggcgcacgcccttgatcccagcacttgggaggcagaggcagatgaatttctgagttcaaggccagccagaccagtcagagctatacagagaaactctgtctcaaaaaatcaaaaaaccaaaaaaaaaaaaaaaaaaaaaaaaaaaagtggatctggggagtccagactgggctgggtgaaatttattttaaattggacactgcatgagcactgtcttagttagggttttactgatgtgaacagacaccatgaccaaggcaactcttataaggacaaagtttgcttgccactggctttctggttcagaggcaggagcatggcagcatccaggcaggcatggtgcagaaggagctgagagttctacaacttcatctgaaagctgctggtggaagactgtcttctaggcagctaggatgaggatcttaagcccatgtccacagtgacacacctcctctaacaaggccacacctcctaatagtgccactctctgtgccaagcatatacaaaccatcacaagggctaaattctgtcaaggcagagaaagaaaaggagaagtagtaacagaagccctgtttgaactgtacccctcaaagataccctcccctcaatgaagaggcaatagaagacccacaattgattttttttaactcccaagtctacaaggagacacaggaatattcatccaggttgcagtacttgtagtaatacacagattatttaaaaagtagaaaaaggtacagatgtgtcctcataccagctgagtcaggtgacaccaaaggaaaagtgagagatatgccacatcaacagttagcatcttttgacaagcttatagttgagaaagctatatttcctccatttttttttttttttttttttttttttggtttttgagacagagtttctctgtatagccctggctgtcctggaactcactctgtagaccaggctggcctcgaactcagaaatccgcctgcctctgcctcctgagtgctgggactagaggcgtgcgccaccacgcccagcttcctcctttgctcttaaaatgggaataaatgcttcttgataaaaatctatgctccaataagtataattttaaacagcccaccaatgacttaagtttcccatgaaacactttattcactttggtaatgactatttctataacttgggggcctagatgttggctctggacccagacttgacaaggttctctctcagtctgcttcttaaatttcctgtttgtctctaggaagcccacaaatgaaatccatggctgtaagccctcagttattgtaagcaacgcaaaacgaactaattaccacttaacaagcccctttggtttactcctagcatgtgacaaggtacttaaaagtaccagtaaggagctgttgattgaactagctttcccatggaaaaaagatgctgtagttcttgtatgtaaatgtcttccttctagtagagattcccaaacatttagacaatcttccattgttttgtcagagtcaagttcctagatggcaaaatgcagctgcttctcatagaaagggctctggagtcatagaagacatagctttctcattgattcttatcctttctggaaattactttcctggtctgtaaaatcagtgtgggtgtttaggcacgttttttattccctttctgttagctcatgatactacaagagcatgcaacagtgttttagagaaaaaggagttacttctagaagcattcaatgaatagtctaaaaaacatagagcaatccctaaggaatcagtagagctagcttgaagttgcctccttcctttgaatggaaccagtcaaccggtgagggattgattgattgattgattgattgactaactaattgattcattggttgtgtgattgagatacagtcttgctaagtagctttggctttcctggcattcacaatgtagcccaaactggcctcagattcttcttttgccatctcacaatctttcttcctttgcctccaaagagctggaattacaagtatatgccaccacatcatcccaatgagaaaatgagtgttataatttgtgacttctcttttccttcaggaatttggatctactggagaaaaaggagaaaaggggattcttggtttgccaggacctagggtatgaacccagtgtcatttgcctgtgtttgtcaagtcccctaatctgtttcttttcttttttgaaagcgatgtagcactttcttgtcttcatattatttcttctttagtcctttgcttatgtaacttgatggctagctaagattcttttatttctcttctcaactttctggcaggcttgcccctccacttatccccattctcttgactgaatggcttccttgaataaggaatgatgtaaccactacacctaggtggctgcatagtctacttagcatttctgacattcatatataattttctcatgagctaaataatgatgcatatgctttcttgcttttattctattatgctctaagagaatacaggcaagaagtagaacaggaatagaagagagccaagtgtaatctttctaggacataaacaaatctggaaacttctagaacaaagtgaataatgtttggagtcagcactttctaaaattatcttattttgagtggagacataattatcattccttctgatttttagctctcagaaactgataccttggattataagaaattggtcaacttttattttacataagcatgttgtagaaaattgtgcttttattttgtctaagaggatattaagtctctttcagtatttagcaatacctcattgctctgccatttctttatctactatcccttatcttttgtcttgaaaaaactcataagcactgacagagaatatgtttgtggtagcagacaagaggtcgcctgatgctctatctagaatcctctgacttggaactgatacagctaagtataataccatccaatccctctactaagggccttctgatatttctgtttacttagctctttaaaaatgttccaggaagctattcatcctagtaaaataatgctcagaaagaagtcatttaagccaagtctaggacgattttcttacctaggtttagttactatgcataactttgttgtgtgagcctggcaggttttgttccctagtttgatctattcatctttctaaggtgtggttcttcgattcacagggtcccatgggttcagaaggaatacaaggccatccagggagacaggtattttgagtaacatccataaagccttgatatacaaaatctaatcaaaaggtcattttgctttccttaacctggccaaatggaaatattgcttataatgcaaatcatccactctttaataacataattttataattctagggactctcttttttgttgttattttgttgtttttcacccaaaaggatagataaccactgttaggttacattttctgttttgccatgccatagtacagtaatgtatggtagcatgttttcaagggctagcaaggctagcctgcttgtacctacactccattgactcttgtgcactttaatatgcaagttgactaccagatgctatattgtcatctggagaaatttacaaagctgtacatactctgaatgactgagaaatccctgtacaaattgccctagcccaaaccacaggccagcagacattatgtactttatgtggacttggtaatacctatgtttctattacagggaaagaaggggacttcaggttttcctgggattaacgggttcccaggaattaaggtaatatcattgggaagtacaactcccagatttgagaagtgaaaaaatgagtgattcctataaatgcctacttatgaaatagagtatttttaatatcttgatgttttagatgtcatcttattttcaaaagaaatgcatataccccatgctgtacataaacctggtaaccattccccagatgtcaccaacacttagcatttaaaatcctctactgacaatgcatcctcttattgcttaccttaacacccactctgggtatttctctgaataagattttagttgctgagtctgtatttgcggagattaggactctttcgactcccttgccattattcacacaagggtagtagcctttagaatcttgggcctgctgagagcagaagaaaaagattgacattcagttttctccttagctattttatctgtgttgtgatacatttcccaggtccagaaacagactgtcttgcagtggtgttgcaaaacaaaactgagtgcactagttcttggcaaatttgcagatcaaatttgcagatctggctaccttatgttaccttcatctttgatttattgttcttagaagttaacctctggaaatcaggagtcaaggagcaaaggactttctacttttctggggtcttgctttgaaggcaagtagattttaggtgatggagtcaagacatcttttgtgttcaatttatttaatattttcagggtgaaaagggagacattggtgttcgaggcccagacagtttcactgatgcagatggcgctgtgatctcaggtgcaattctttgttgatttgattggagaagaaaagagaaagtgttcaattctgtatctcctataattgttgaaaagatacattgtcagccactggattgactggatttctgacagtatcaagggccactcacaggtcctgaatttactgaatgaatgggattacaaattcttaagcagacaagccaagtcaagcctccgtttgtgtgtgtgtgtgtgtgtgtgtgtgtgtgtgtgtgtgtgtgtgtgtgtgtgtgtgttgatccatcaagatgagattttggactttcctaagcctgaattaagttggcagaaaggttcccctggcaatgcttagagagggattgatatcctcctcagctgggttgcctttagcctaagactatagagtatgcagggtttcatgtagataatcccaagcaggctgctgatctagttgctaagagacctgagaaggatgatacttagaaagtttgttcttcagtccttatcctagtcactgggtatggtctactcttcctttctgcctctaccaaagatctaaacactcaatgttgataacagctttgtgagctctactcccaggaaacctgtggcaataagtgtttgctaaccatcttaatctcaacagtagacatttaaggcaagaacagtagaagaaccttcctagtactttctaggtcttgtcagaaaagtaaggctctaacaagaccaggtttgaggtactaatagtaacttgctatgatgatttgtgtttgtaattccagaccttggaagtctgaaacaggaggaaagtaaattcaaggattctatgagatccagttaaaaagtaaaagagtagcagagccttctctctggtcaattaagaccattagcatctcttatcaggcattttgcagcaagtgtgatccactatttactccttttttcactgtaatgtcaggttatcctggagaccctggtgtgctgggccttccaggccttagaggagatgaaggcgtccaaggccaacgtggcccttctggaacccctggcctcccatcattaacaggtgaaacagactaatccactctctgcattgaatagtctgtactctaaatcctagcatcttcctctgtaactgggaatccaataatatgtctagccaaggtcaaaagaaagatagactggtcagtaaattctccaatgactagctcaaagctagtgtatgtgtagagagggcctaggtaagcagcttcccttgagataaatgaggatcacagatggaaagacaattccagagtgccattgaggctggaagtaactagagatctgggtggggtggttgaagccctctcactcttcactggatatgccatctaatcttatacttgccaagagtttttaacagacgagaagctggccatgcctgaatcctcaaggtggctactaaaagccttcatggggcgggggtgggggtggggactaaaggtatagctcagttgaagataattccttggcttgtgcaaagcaatgggttctattctcaacatgagacagttagaatatagagatatggatgttatactagatagatagttagatagatagatagatagatagatagatagatagatagtagatagatgatagatagtagatagatagatgatagataagataggataggagaggagaggataggtctgtacccaggccctcctatggacttagatgtagcacaaaatgcccccagcatcctatggatgatacccttgaaccacacaatgcaggagctgtaagccattccatatggcagagaaagagcatgccagaatctagaagacagagctgtccctagtctaaaccctcagatgtggatctagtaacatcactagtctctaaattccttagagaggagcttctgtaaggatatttgtgtttctaaggcagccattcataggagacccagctggacccagcacctaagtagaacaaatggaacagtgagagactggaaacctagctttccctcacatgttaacaaccacagtttctcaggcagttaggctaactgatccccaaaaactttcctaactctcatgaaagagaagagcaattggtttcccaaattcttcccttgtgttcttttgtaaacacactgctgatcagaatctacccaaatagtagggtgctatggtgagcatttttgtgtgggcttatccttccaggtcttccaggtgccctagggcctcagggatttcctggcctgaaaggagaccaaggaaactcaggacgtaccacctttggagaagctggcctacctggcagggttggtttaccaggtttaccaggcctgccaggcccatcaggcccacctggtaagttattccttctttaaaaaaaatttttgagacagttatgatctagaaccactctgatttttaggggttccctcacaggagaaacagttcagccatgatagctaattgcagtgggacagtgtatcaattagaggtttagtccattatcataatgcaaggaagaatggcagcacccctccagacaaggtgctagagaagaagcccggagttctgcaacctgatccaactgcagccaggaaaaagactgtctgatgggcagcttagaaggaggatatttttttgcatagggtttagcctgagcataggatctcaaagcctatgtgacacacttcctccaacaaggccacacctcttactatagtgtcatttcccatgggccaagcttattccaaccaccacaggcagcaatgagaagtcctacttcatctgtgttggcttcacctttactgacagcaacagcactggagtgtgcatttggttacaagatgaccaaggtggcaccctgatgagggagcaagcactagcttctgtactcatcatccttctgtcgtacacagctcttagtgcccacagcaccccctgcaccactctctacccgtcccactacatacccccctcaccaccaggactttggcttaccaggttctagggaagcagaactggattttctgggtttgctgtactcaacagagttacaggtaggtgggctgagaatctgaaggaggagaagctatgcctagatcctcaaggtatctgctaaaatcctttatgaggctagatatgtagtccagtttgataaagttttcttggcatgtgcaaggcaatgagttctattcccagaatgagatagatagatagatagatagatagatagatagatagatataaaatatgcatagataatagatatgcttatctacgtaggtgggattctgggttgtgagaaaaaggctagaagtattgcccagtttatttgcagtctaatcctctgacaactgctactggcacctgctccctctttttcccagaggaaactttctgggatagagactggcactgctgagttattgagttactatgttcatctctgagtgcccagaatctactacagtgtgtggaacataacagtcatcattctgctagtagagtgaatgaagccaaatgagagttcttccctgcagacttggcaggaatcttaggctgggatttttttttccctcctactctactctgtgtgttgagcttcaaggacccaagtcttcaagattaaggtgagtacttaggcttacatcaacctctaaccttttgcattctcttaaactctgcaggtcgcacatttgagactggacatctgtccaacatagagcctgggttccctggtctccaaggagaacaaggtccaaaaggacatcaaggcctcaaaggagtaaaaggtcattttgtttgtctcctcccccccccccacccccccccccacacaaatccctagagaggctttaaagggatctatcacagcaatagccttgagaatctgaatgtaacctcttgagaggttatggtataagactgttagaagtgctctaattagggctctcagaatgaagctggcaatggaggtcacacaggacaaaaagaagttttccacccctcaagcctactgaagctattgttagcatctcagggtgctgaccatcacctctaatcccaatttgcaagactttagctaaacactgcttcccaacaccattaatgtgaggactctatgtaggttaagagtgaggcatagaaaaagccacctggctccaataaagtgaacagggtcctggcaagctgccttataaaccagtatcacaagtgctttatccaaattgactatgcctattccaaatgcttgggatcagaaacgcttcagaattagtagtctttggactttgaaatatttacatagactttcccagataatcattcctaatatgaaaaaatccaaaatctcccttgcttaggatttcagagcatttgtgctcagtctttctttactagtctgaagaacaggaaatgctctcagagtttccaagatctcagttttctaagagtaagaagagatcctttggaatcagaggggaatgcagccatccacagttgtcacttctcactctggagacaatgctcatgcaatctctgtagattgttaggttgcgtacttatgactcctttgcctatcttccaaagtgctttgctgtaactgagttggatggtgcacacttgtaatcaatcctgctagaagcagaaggatcagaaattcaaggtcatcctcagctacatgagtttgaggccaaccagcacacatgagacctgttttgttttttttttaatgcacttctctgaaactcatatcatcaagtatatacataagtacatgtatagaattagattctagcttccaagttacctaagtagcaatttatggtcctcagcatgtgactcactaatagccggacctcatctcagactagtaaaaacagactcagtaacacagatgccttctgatggcactgagcttggtctgagtctcggaaagctgtctgatttccacccaagggaggctaactaagccactcttttccatgagtttatttgatgtagtctgtttttccttcaggagactctggtttttgtgcttgtgaaggtggtgcccccaacattggaccacatggggaaccaggtctgcctgggatacaaggtcccattggtctacagggttttaaggggactaaaggagatccaggctcaaggggagcatctggtcctgcagggacgccagtaagtcttccgtaaggtctttggcacagagggaggaatggaggatttcaagtgttcttcgctccctatcaaccactttcctaagacacatgaaacaaagaggagtaaaacaaatctgtgacaacaatctcagggagatttttgcttaaactcttgcagttagtcaaataaattcttgtttacccttggcaagtaacaaattgcagtgttaatcgggtacacaagaaactccctcaacaatggaaaagctacaagcactcatttttaagtctaagctctaattggaaattgtgttgctggaggaaatggaggaaaatttttcacagggagcaatttgagagcaacttagaaaatgaacaaaaccaaaacaaatctatgggcttttgatgtgtcaacatgaagaaatctgaccagaaggtctctaaagtctctttgtttccctccttcctttcctcatgcctgactgggtgatgctgcttaggggttaacataaagctcagtcctcatagatttcaaaatttagaaaagatacaggaaatgtgaagtaattacccaagacagcaacataatcacatgcccagaagagtgttaacaatatcctcaaagtacctgttttaggtcatatctttgctaagctatgaaggctgtacctcccgattattgtcttttgtttcattgtcaggggctatttggacctagaggtcagactggcctcaaaggaaagaaaggagaaccaactgtcagtagaggatcaaaaatgtcaggggacaaaggtgaccctggtcctcagggtaccccaggtttggcaggaactccgggcaaggatggaagaccaggtttaccaggcctcccaggcattcaggtaaatggatcattcttggatggttagccctatcaaccaccctactggacttagggacaatctgctggttatcacctcatggaataagatagactagggaacttgagtcccccgaaatgttgactcaatgctttattttctataaatatgacatttttttcccagaatacttattgataagtgctaggaagagttgaacacgttcatttaaaacaactcagcttctcaatagctccttcctccaagatcaacagttgttcattccctgctttcttcccctagaccagcagttctcaaccttcctaatgctgacaaatctttaatacagttagttcctcatgttgtggtggtccccagccatagagttatttccattgctactttatagctgtaatttggctactgttatgaactgtaatgtaaatatctgagctgtaagtactctgagggtcataacccacagattgagaaccactgacttagccccatctagaaccttttataaagctagattatccagagttgataagatccgttttctctaagaaaattcagaggttgatcaataaacaactagagtgatggagaattttcacaaaacattgttcactaactatctctttcctgtggttagaagccttttcagataagtcttaaaatgatcttttgtcttctttttctttgttctctagggagatggtgggtctggcttcccaggtgaaagagggttaccaggacttcctggtgaaaaaggccatgatggtccaattggaccaccaggaattgggctgccaggacctcctgggccccgtggacttcctggagataaaggagtagatgggttaccagggcaacaaggcctccgtggagctcaaggtgagtcatgtaatcagatagttttggacttggaaaatcaacctttgtaaaatgcctctgactcatattatgaaatgcgtcataaaaaaaaaagagagatctggctagctgtaatcactccagtcaatcctcaagagttttaaaataggaaatggatcataagtgttatggtaagttcagaaggtagaacaatgtggatttcagctctgcttaatgaggaccctgctacttgagctgtctgaaatgtcacagagctatctagacactttatgagctcatagtccatagaaaaattcaaggagagggtggatgactgtgtttctaatcaaagtagtttgtggagagtttgataaatagtcctctaagttgtatgatcagcagacaaaaatgctttcctatctgacagaatctcagattggtcagagattctaacctaatctttatatgatacctaacttcctccctttaaataaattattttcccacttggcattttgagaatataataagcaacactcctgattgtatattatgaaggtcccatactataacttgtattttgtgcagtcagtacactccttcattgtttccagtagtgacattacacttcttactattagtggcatcacacttgtaattgtcatcaaagtttaaaaaaattgaggttatctattctcacttggaaatgcctcccattatttcctttatcttcttgctagtaagttctcatgatcccatacttagtttatcaaatacctatgcgcttttggaaaagaaggatggatggatgggcaaaagaaatttcctaagtagtttctcttctattccttgctgagtttccccaattaaattatacttatacacattgtagacgattaaataccttttgccatctagccttcctttgacttctacatgttgttattattgaaattatgcccacttctactagtggtttcccctttaacaacgtttcaaagtctctagcttctaaagatgatgatacatcttactctcacaacctgccaacagagtagaacattccttcttgcagaagaaaagcccttcctaataaccttgaatgattaagaaataaaaaataagatattatatcttatgtgttcatattttaaaatctatcttgatataataatcatgatggcataggctaatactgcattcaagattcttgaaaccaaagcccttgaacaagtttgggaagcattctacttccctaggccatatcttatcaaacaatattggttttcctttgagaacttctggtttcaacaatagatttacttctactgtattcctcagggatattagtcatgtattttctattgctcttcagctgttgatggatcaatcattctaggtcagcccattttaaaggcaaccagattctaaatttagttacagtgcatgatacctataaacttgtacatcctcaagtcttttggatattatcaatgttctatttcttggtttgagatgaggctgcatcaatgggaagaaacctatgggatcatttctatctcaaatattactagttcctgtacacagaaagttctcaggaagacagagctagtgagcctagcctggaaggaaccttatatagaaaaatccactttttgaagtacctgattttcaaacaaatactttatttagattttgtgttggggtgttatatggttggttggttggttggttggttggttggttggttggttggttggttggtttgagacagggtctctctacatggtcctgggtgtcctggaactcagtattacagactgggctgaccttgaactcacagagatcagcctgcctccacctcctgagtactgcgactaaatgtttataccactccacacagaaaatacttcatttagaatgttaccttgttttttctctatagaagctgaatataactcactaaaaatagtattctttccaatcatttaaacataaattttgaggcttctagtttatgtgttatagccatttctgttagcacaaaaagtaagatgttgttcctaaatgttgcctacaccttccagtggtaacccagtattaaacatctccattggtagtgaagggcatgtagtcaatcagaagctcttcagcccagtgatgtgaattattacaaacttgggtacattgatagcttacggtccccatagaggctatggctccatcttctcaacgtaatctatcattcaagttatttctccaagtgacttctgtatacttgatcgtgtatgagtaccaacactccactcaatcctcacgattgaatgtggttgacaggcatatctgggctgtacacaagacctcccttaggattcagccaacatgtcttggtttcatttttttctttccttgattggtctaggtgattattgctgtagcaggggggaatattatttacctattcacctttgtctctgaccctcagagtgtcttaaactacattgcacttttttttttcttttgaggcagggtagttgtgaggctgggatgcagaggttgccactggcaactgatactactttaatggttctttagcacatactcctgggaactatagaaatgggtatgcagactctgagaggagctgatttcctttatctcacatgttgatggttacccatctcttaactaattatattctctgaacttatggggtataacttgctttccaagatgtatgtgcaaggagtcaaataattctgatctctattatttggtctcagaacaaatagaaaggatagacttgaaaactagagttgctttatattctaaagatgaattttggcattaatggtgaaaaatctgaataatgtggtcatctgttgcacttctaaagtataatacggctagagctgacttctgctttattgagagtggtctgaattcagaaatgggaatcccaaaacatggcaataagtgataaaaaccagatctggtacaatgtaaaatctttaaatttcccaccactttaaacccctccttgtgaaatacaatacagtgtagtctatgtccaaattatgagggcataattttttcctttcattaaaaaactctgggccccagaagaatataggattggagtctctccctctctctccttccttccttccttccttccttccttccttccttcctcccccacccccatctctctctcagtgaagcacctcaccaaaaggtgcctttcaatgccacacatttgtacaatgggcaaataactctgagaaacagttttgccacctcagtgtctggcataacggaggtgggtgtgacgacacatgcaggaggattcatgcttcaggccatctttagacctgtgggaatatggccacaggagcacaatgactagcaggcaggaagctggggagttgacttacaggagcgcctctgaagctctctccttaaggaaggtaagacctgccattcaccgagcatgcagcaggatggcaggcactacatcaagtgcctctgtcttggtctcacacacttctcacagatgccactggacacacaaggctcagagaccataagttttccccacacaggtgtattataacagaagtaagttctgttcggctcctaggtccagtataaccagtacattatactgttcaagtctcgatgttgacttagaactaaagcaagtgatttttttttcaaagcaagatttcatattagaaagcaggagtgagtggaaggaggagtggcagctacttgaatgagcagtctgaatcagaggctttatgcacagttttcaaaaataatctgaggctgtgctggttacttttagagccatgtgtttggttttttgtttgtttattttttaatacaaacaaatgctacagagttttattggaactgttggctctgtggtttaagacagaccttggtggattgttctaatagaacaggctaattttagttagcatagcacttgaggaagtccatatgtacacagtctgtcactggtagtttattaaacttcccatctgtgatcctatagactctttatttgcagtatgaatgagcaaagaatttcccacagaaaagactgtgcatgctaatttcaacattttaaatactaagattgactacttctattcctttagtagcagagtttatagtttccaataatgatctgaggagtcataatttgtcatgactaggggtcttatgtgtttccctagtttagatatacacatatctgaacaaggatggccaatacatttcagtagactcaaaatgaactgcttttaaaaagctccatggtttggggaaaacctccttgcaagaaaagtgttagggctagagttagtggtttcaagcgttgtctcctctcccagaagactgggcatctagtcccagcacctacatggaggctcacaaccatctatgactccagttccaggagattcaacaccttcttatggcttccttgggcaccagtcacacatgtggtacacagacacacatgcacgcaaaatgtccacatgcatgcaaatttaaaaataaaaaagttcagatgtgaactctaattgttatggcttcaaattatccactctaataatacagcatcatggacccttagtgctaaaacccaagtgcccacgctagagagagagtttatctaagggactggtgaacggaaaattgctgctcactgctgttcctgtgcaggccacctctaggagtacttgttaggtaacaccctctgcctagatgactgcttgtctgtcaggcaccagcggttcaataagtaatattctggaaccctgaacactcagaacaaagataagcatttgcactggtattgtctcccaaaagcttctcatgtcaagctttctgtgtgtcctactagctgctgggtggggagaatacaattttccactaaatagaatggggggggggggaccatgtaaggggaactcttctctgacttgctgagctcacagttccacatgttatcatttccaggagtcaccttgccttgtatcattcctgggtcatatggtccatcaggatttcctggagctcctggattcccaggtatggaatgtggccagagaaagtgagcacactttaagggcttttaatccaaggaagcaagaatgccaatagcacatgagagtcccactgatggattcctcagcaactgaggtaatggcttacagagagcgtgttatgaggaaatgagactcgaggaagccagcaagagagtagactacttgatcagacatcataaatctaacttatccatgctagcgttcctttctactcactatacacatttggggtttcaggctctaagggagctcggggcctccctggaattccaggcaagcctggcactcacggaagcaaaggagggcctgggagtccagggttaatgcatctcccaggattgccaggtaaggaaaagggtcatcaacttcctcctgtgttatgtttggactgttttcattctccatcgaggactgtaagctaggtctgctccctggattagccgagatggtttgaatttacttccaagcaaaaatgccatagagcaaagaacagaccgtggcaagaaaccaatggaagcaatcccttaagtctcagataaggaaactgatactttacaaagccactagtgacaaagccaggaggctgcagttgtctgcttaccactccagtgataatatcctagataaacttcttagaggccaaagaaggaagttcacaacagtccaaaaaatgctacccatttcttttccttgccagagttgttccaacctgagctccacaggactgcagtgtaccactggtcctccagctgcattccctggctcagcacctacatcacctgggaacctgatagacatacaaattctccacctgttcacaatagctagtgagcagagactttaggagagagccagtaatctgtgtgttctgaaccaccattgccctagtagtgtttgagtcttatctggatgtatcattgcttcatttctttctactctcttctgcccactcaagaagaggaaggccatggcagcaaaaggtttaaaactgtaggagatactgagctttggccaaaagacttggtgtgactgtgttcttagcaaccattgagccccaggaacagaaaagaaagctgctgagctgtacctattcctagtctcaccaaactagagcctccttccactcgtgtggtgtagtccctacttctgtacaagccctccatggagtgaagatcactaatcatgattaatatatgggctttgtattagagaaatcggtctcagatgtctaccgagatagcttggttctaagcatccatgttctttttaatttttgcctctttacatttagggtttcctggagttcgtggggagaagggattacctgggtttcctgggcttcctggaaaagatggctaccctgggaaagctggcagtccagggttaccaggtttcaagggagctgctggtgacatatttggtgctgaaaatggtgcttcgggggagcaaggcctacagggattgccaggggacaaaggatttcctggagactctggccttccaggacccaagggtgactcactctacttgaccccttacttagcattatacagacagcattctagtaactgctgtctttgcatggatatgtgtgtaaaatgcatgtctggatctggtatggttaattagggagcaaaaatggcattctattctgtgtctctttggggggcgggaggaatttccttatgtggttgcagtccattttccttttgtagaaattccaagaatagctataaccaatagtcacatttcttataatgctgttgttgagagaagacaatgtcatctgaggtgaatcctggaccaagcccttctattggaagatggtttgatgacccagcacctccctgttaaccagactataaacatctgccacctcctttttcttaggtttgaatgggaaacctggtatgctaggccccaagggtgagcggggcaaccctggaacatcaggaccaccaggacagccaggaccctcagggtctactgacccatttggcatcaagggcacatctggattcccaggagcaccaggccttccaggcatctcaggtaaatccattgaaggaagaatcctgacttggcagggccttacttagacaaaggcaccccggggactaagagtggcagtatgatatgctcagcacctaggatatttgactttcctaatctctctagtttcaaatcccagatcatcctggctgggccagaccagaacacattgctactgtttaacttctgatccatgacaacaaatctctgtcacctcccttttccagggcctcctacatccttttggtgtttttggcctgctgctggcctttttctattaaagaaatcaccctgtgttgaatggtgttaaaccctcgctgtggctatgttaagcctgctttgagctacagagaaactggagctgattgtgacctcttccctcccccaccagtagcctgcctgtcaggagaaaatgcctctgagggtccataggcaaatagtggctttcactaagcaatgaggactgacacccactggtttcagcctaacatttgcagttcacctttttgtttgtttgtttgtttgtttgtttgtttataccatcatccttactctgacacctagactgcatcactgaccaagtgactgaagctgggttatttgcagagctgttaatatcccttttatttcctctatcctgtttctggggccttcatataagttgctgaggtgaaggttaaaaacaacaacaacaacagcccacaagctcactgactaagactccccatggggaattgtgtgattgtctgctataacaaaccttgcttacaaggccagagatccctgaaccgctgctataaggtttgttcccactgcattcccttctcctgttgcagacttatcctcattgcttcctattagattcctgcggctcacagctacttgatgcttttcatttcatggaaagctaagtcagccattcattgaggtccttgggaacccaaatacttctgtcctcagtgatgtaagcctttggatttttcatttccttgctttgtacctggacattcaacttcggcagcagctcaggaggttaatcccattgaccaacttcaagccctggtgaaagaagactcagaatacctaagagaccaaatgggccttgggggtttctacaatacttggcactagggggtctttcaaacctaatgccaaagaactggctgatttaactgcttgtttgagggattaaaagggcaaccctagatgcaagactccctggaaagccagaacaacagttcagatttaacctctatttcatgaattggctcaggaaacaaccattggaacttgattcagggttgaagtcccagggaaactagagcccacttgccaccctggcttcccagagctccatttagaggctcctctgtgaaccacattcataaaggaagaagttataattacaaggtacttgcttttcctacccaccactgtgccatgctggaagtgatgagcatttagggaggtgctctgggtggtaggtactaatgctctgaccaactcagcaccaggcttcttggcatctctttttaggtagtgttaaaggaccgtggacaaacccctcctagccagccaaagagaacctctagaaataaacagtggcccaaacctgaccagagcctgactaagctgacctgtgtcctcttctataaccattcagggcaccctggaaagaaaggtcaaagaggagacataggtcagcctggatcaactggaaaaagaggtctacctgggataaaaggccttcctggtcctcaagggtcacctggcttcctggggagcccaggtttgtcaggcgtcactgggttgccgggcatcgaaggccaaaagggtaagtgaaataattaggaagaccagtaaagtagtcagggtttacccaaagggagtgtgccacaactgcccaacttgcctcctcccctcttctctgcccaggaatagaaggtaggcaggggtttggggggggcaaggctaatactaaaggaaacctgtcacctaacatgaatcactcaacctgcttgctgtgtggaacaatgggctgatcaacagaaaaggccagctacacatagatcactcagtctgacacataccaaggagcctgacaactctcacttcccgtgactgacacagcagtggttaggtgtatggcatctgtgtttcaaataggtgaaaaaatggctagtctcagagcagcacacacagctggttagtacaaagaggcaagatcacacactcatctcttccccaactacaactaggtgtttcttttctgtgcccctacacgcattctgaacttaatgaattcaagcagaagtgcccacgtcttcatttctgtctggtgttcagtgctatgtggctgtttggaggaatcctagaataggtaataactaacatgcttggtaaagactcagactttggagttagagaaacctatgttcaattccttcctcttcaccatcttagctctgtaacattgtacaagcaattcaacctttctgtgcttccttttctttacttgtatatacaatggaaatgataatgaaagaaagtcttacttttcaacaggtgaaaaggggtcctctggaccagtaggatttcctgggttacctggtcttcctggtcttcctggagctgatggattaaagggattttctgggtcatttggaaaggtgggacaacctggacagactggtacttccggagaaaaaggtaagggggtatggggagacagaggcagagagacaaacagagacacatacacacacacacagagagagagagagagagagagagagagagagagacagagagagagacagagagagacagagagagagacagagagagataaagagagagagatttcaagacaaccactttgtttttcaatatgcattttgcttgtcaacttggtcattcatctgatgaatgccacatattaggcaaaactttggacttccaaattaagtcctttgagaccaaaaggctactcactttagagtcaacagtacatgatatggactatgtgacaaccgcaaaagaaaatcatagcataaatagtttttaagaaggaaaagagttatattatatatatatattagttatatatattagttcttggtttcagaggagtccattggtgatcagttgaccttgttgattttgaacgggtggtggcccagtgtatcatgggacagagcttccttcatggcagctgggaaaacaaaaccaagaagatacattcaataacttgcctttttcccactgagctccacacataaaaggcccctcatctcccaatgaagtcagtgcctgagaatcaagtctttaccaaccaaatctttggggaacacttactcaaattaaaatggagccctccacaatatactctttccttgaaagagaatttagagtagggcctaaagttattggtgactttgggtctggagaaggagagagcagactcagaaatgcaaagttagaggctggggtgtgaaagaggacaaaaaggtctcgaaactcggtgtgtgtgggaagaaacaatacgaaaggtcatatttgtgtgtaactttgtgcataaactgtgactttgtgtgtaaactgtcactctcctgatgactgtctgatctgccttccttcaggagacagaggggatccagggccagttggcatatctagtccaagacctccaatgctaaacctttggttcaaaggagaaaaaggctctcgaggttctgctggatcggatggatttcctgggcccagaggtgctgaggcaggggatatttgggagtgattctcatgcaaggatttgtttatagccatcattggtttccttcccaagaaaagcaaagctcagacccaggaacagcagtatgggaacaacaatgaggttcaaggaggctgtctttcttcttcctaaatttcccttgctcgttgagactgactcatactattgtagaactgaaggttttggcccatagtctggtacccctgaaatagcctggtaggtagcaaggcatagatactgattgcccaatactagagctgagatgataccaatggaaccactttccaccaccactacccccaagccagcctctgccttagctaagagcacatctggactatgattttgagcacctgcacctagacaaataggtcttttcttgcctagcctttttctaatagattttgcttctttcccaggtgacaaaggagagcctggcatcccagggttaccaggtccacctggagctactggacaaaccaataccatcaaagggctcaatgggaggccaggttctcctggatctatgggaagaaggggattacctggcctgaaggggtctcttgggattgcaggtttcccaggaatgccagggaaaagcgtaagtttatacagattcttgtttttttaccataactgaacctttaaagcatgggcacatgtcccacgtccccatgcccaacccctgtcctcaagataacctcaaagtgcttgctctccatgtgtatatgacacagcttcctacctcagtattccctcctttatgtctttgttccccttattgatcccacgtggcaaagcttcctgcctacttcctgcagtctccaacacatctctgcctgctcttaaaggcaccatctcatcatgagttgctgggctcctgctaggttggcacttttcactgctcatatcaaagtgctcctagttggatcttcagagaatctcacttcttcagtgagatttctgggacttaaaaatagccgtttaagtcttaatttgcaccccatggccagcaccccacagcccacattaagctggacatattgtaaaactgtacagaccgtggagaaggttgttaaggcaaggtcttgctatgttatcaagggaaaccttgacctcataatactcctgcctaacctttgcaaattacaggattagagagaggtatgcaccaccacacccaataagaaataagtgtagggtttttgtttttacttaggattaaatatatagcctgaaacattctaggcaagtactcactctattgtaggcttagatttttcaaaacttacttttaataggggttcttaaatgttttaccctcccttctagcccatcacccaccagaggttgtggaaaagaaaagttattaggatatgggagaagtgaacctgttttcaaattgttttttggagcaaatccaatctgtgttgtcaggatatcagcagctcagttcacacaaatcagcagcggcagctccatccactctcaaacaccattcacaattcagaaacagcaggtagagccaggaaaagctgcaagactctgctgtatgctattgagaagaagttccttggggcaatttcaatctccaattgtcaggatactagcagtctagttcagtagtgtcaggatagcaaacaggaatcagcagtactggcacaatgtagaagaaaccgccaggctaccaccaaatcagcaggagtcagcaggagtgatcagaaccagcagttctctgcagtgcctctcttaaggaaggggaagatccgcaaagaagaagacaaaagacaacaaagcactggaaagttagttgtgcaagcccaccctcactgttccttgagtcctatttatactccctccaaacctccaatgggtcttgcctcagaaaaataccacgtgagtctgtattagctgacatattcagaaacttccacttcactctgccaatcagccatgagtccacagaagtggcaagaagctgccagaacaccaccagaagtttttgggtgcttttctctctgtggagtcatgacaaatgatgaccaataaacaatgaatggcaaggcgtaccaatatcatccagcattgtccactgtctgttgggttatattccttctaaataccacacgccctttcacctgtgtgccccagcaaatatcatttgacataactgacttttcaaagaaaccagaagtttccacttcactctatcactgagctatatctttcagcctagcattcagagatttcttgatagtttaataggaaggtacttgaagtaccacaggggacaagtagcaaagaatcaagtctagattatctggtcttttaaaaggcaggataggggctatagagatagctcagtggttaaaagtgcttgctgctctaccagaggacttgagtttggttcttagcacttacaacaacctacagctccaggcgatccaaagcattcttaggccatgagcacatgcacatgtgatgctctcccccctcctccctcccgctctcactccctccttcttctccctcttcctttccttttacctttctctctcactcttactctttctcacatacatgtagacataaatttctctcaacctactttaataaggattcaacctctccttgagctcgctacccaccagaggtagcagaaaagaaaagttatcaggacatggataagtagacctgttaagaaatagttccttgggggtgagtccgatcttcattgtcagtgtatcagcaatccagtcctctagcaaaacaccaacataaatgagcagtggcagtccagttcattcggcagtcaccactcataaatcagcagctgcagaccagttcactcagcagataccacacaaaaatcagcaagggcagttcaatccagaagaaactgcaaggctcaccaaccagcctgagtccaccatggaagtggcaagaagccataggatcctcatgagaagtcctttggggagcttctctctgtgatgtcaccccaagtggagctcagcaatggaacctaaagtgaaccaatacgtgcatatccttagcgaagaatagtgaagtggagcaaatcgaaggaaggttcgagctcccactgtctgtggggtcagatttattatattccttctaaacatcatccatcctttcacgtgcttgctatagcaaaaacatcctttcacccatgtctgcttcagcaaaacatcctttcagctgtgtgccccagtaagacatcatttgacgtaactggtttttcaacgaaaccagaagtttccacttcacactcacgtgcaaatgaaaattttagaacataaatcttaaaaggcagagtaaactagagtaggtttgacacagatggacttgaatttgaatgtcagacacctccattactcatctgctctgtgatcttgtgtaccttgcttaattaacatcactgagccttattgttttcttcctattctttttgttttttaaagtagactaatatccaaacttttttggacagtagtgaaggttaagtgagatgagacatgcaaagaacattgtggtcagacacattgcatgttctatataaaaaggagtctgatcactgggcccagaatacctgtagtccctacaggcaaattcttgtctttcaaaagcatcagtcaatctgatagagagactagacttacatggttgaaacattagctgaagaaatcattctagatttaaggtcctggcaactcacaaaggagggatagaaataaagtgggaataggtttggggaggtgggagtcccagcataagcagagactcacattaggaacatctgtgtctacagcagtgtgctacatgaagccaggccagaaaacaagcagaaaaatagtagggggcaccctgggtagtggtccaaagaacacagtgacccagcccattactcggcctcctgttcaaagcattacttgaagcacatttttactgggtacatctccaaatacctcaactcatacaaggcaccctgaaaacagccgaaagcagctgacatgaacactccccagattcagagtgtgtcagaaacctgccaataactgtaaataaagatctatccatccaaatgcagactagcacctgcgtgtttacagcctgttacctggtagcagggcgacctcatgttctttgtggcgcctgcagcagagttctggcacagcttagtaaaacaagactgctgctgtttcgattgttttgttttcccagttttgacagagtctcaataggtaacatgaagtttctgcctttgtctcctgactgctgagataatcagcatgtatgtgccttcactcctggctgaagcaatgattgtgtgagatgactctagagctatggccagaaaacctgcagagcagattgagtgccttgctcaggggtcatgttctatgattcctgtgacttaataattaatgcagccatacatttgactcatcaagatgggatattccccctgaaaactctaagcgtgtatgtggctcagcacctgcccatgtctagaatatacctcctgtcctgcctaacacagtgtataaccagcatctcctaggcaatggctagggattgggggagaggaggaggaggagcaagagcatctctgagctctaggcagaaataatggtttccatattgctttcaagggttcacaggggctcactgggacttctggcctcctgggagcaactggtatcccaggtttaaaaggtaaggaacattttgtcttctgatgtgtttgcctagaccaaggtgatgttctaccaatccacaactcaggagtagtgggagctgtgttaagggagaaaatgaattttgtttgtatttcccgtttggctaaacacactcttcactccttgttcttcaaagacattgcaaacaacagtgtcacatgccaaaatctcttccccgggctttcatggacaataaacaaacaaacaaacaaatcaacattccattcgcttcgtattttgatacaccgaaacagcaacatagaacttcacctcgaaacacctcttcccctgatgagcacagccccataggcaggaccaattctcttgtttaaatgaatcaccattccattctggtagtatttcagggctcacttaccatcttctcacatgtgctggaccatgtttccagtacaggggtgctgtgtataaatcatctcattctagtagcttgttagcatcccgggtccttttacccagtggatgcttttgtcaagaagcccctctgactgttttgaatctgaatcgagggggaaaatatattgaaaagactgggtgaaaaaaatgaataattgtttcttctgaccatttgaaaaataatatttttcatacctgcaggagatcaaggccaaacacttggcatttctggaagcccaggacccaagggacagcctggagaattaggttttaaaggtagggctagtacatttttgtccatacctcacaaatgcttcagaactgaagactggagtgacttttggagatcattcccaagttctttagcttccatccagtggatacctatagttttcgaaagcaaactgatttacaccactgatacgtacctttggcatggtctaccaactacctcaaacttcatttacctattttcctctaatgtttactgcaaaatatttcagcccatcatttttgattctagaaggaagccagaaactgtctactcacttctcagatgggtaacactttccaaatatgaaaacaactgccataaatcttttcccgagtttcttcactgaatcaagttccctcaacatctcaaaatgtttttaccttccaacttatgttttcccatggaggagtgcaattccagaaatagagattaatcattcagcaattgattgatcttctaggtgtcaaaggaaaagatggactagttggtgatagaggttacccaggaaacaaaggtgatggtggaaaagttggaattactggagatcctggcttccctggctccccaggtaccatgctacttgaaaactttattttgaagaagttaggattcacttcaagccatactgtattctaaatgtccaccttggtttcacacttaggacttcaagggatttcaggtatgaatggagacccaggcctcccaggttcctctggccatctggggtcaattggccgccctggaccctcaggcttaataggacctaaaggtatgtgtgtttgctagcaaggagtgggtgaagtgtctttcccccaataacagggggcaactcctcaatcttagaatgtagcagctaggcctaagccaggtaaaatggggtgttatatgaggattaattaaaaagatgggtgtagaatgagctagagagatggctcaggggttaagagcactttttctttgcagaggatctgagttggattcctagcacccacatggtgactcataacaatctataactccagttctaggtgatccagttccttcttctaaggcaccaggcacttgtatagtacacagatatacttgtagaaaaaattctcatacacataaaattaaatgagtatcaaatattaattgaaaagccagagaagtaaaaaggagaattataaatcagaatagaagaatgtcatacgcctagcagtggtgacccatgcctttaatcccaaaacttgggaggtagaggcaggtggatttctgagtttgaggccagcctggtctacagaatgagttccaggacagccatggctatacagagaaactgtgtctcaaaacaacaacaacaaagatgaagaagaatgtcagatccatgaagaaaagaattaacaagaaaaacattagttgcccattactaaaatgaaatccctgtggttgattacttagaaagaaaataaatttatcttataatttttgaggctctaattccaaacagctacggcgctggctttatggaggaatagcccctaacaatatcacctcacggggatgccatctatgtcaccccaccccacctcatgggtgatggcatcatggcatattatgacagacagagagagagagagagagagagagagagagagagagagagagagagagagagagaagaaaaagaaggaggaggaggaggaggaggaggaggaaatcacaactcaacagaaagccaatgtgaggggtagggtgagtcatactcttctgtagcaattcataattttgagagctcagggtccacgagaattaccttattaccttattccttctctgtggaaaatcccagtgaccaaagtaactttcactaagcctctcttgttaaagatcccaccacctcataatatcatcaaaatgggaactttggggaccacattaaaaccacagccaagtgtgatggttaatatcgtcaacttgatcagatctagacaagctttggggataccttttaagggaaaatacggattaggttagcctttggatatgcccgtgaggaattacctagattgggttgagttaggtagaaccaccttaactttggccattcaattggtagtggtcagagactgaatacaataggagaaagtggtctgagaaccatcattcaatgccatctgcttcatgattatggatgcaacataaccccctgcctcctcaagctgctgctgccacattttccttgatacgatagatagtcccctcaaactacaagccaaaataagactttccttttttaagctgtttataaagtatctgatcatggaaatgagaaatgtaactatgatatgaagccatagcagaaagttattactctggcatatgttgtctttctctgctttaatggtagaaccagtttcggggagaagacaactcaagggcctggcattgctactcctacattctattaaaaatacctactgtaggtggggggagcaaggttgtggttcaattggtagagtgcttgtccagcatatacaagtcccccccatgttcacttcctagcactacataaagcaagagtgatgacacatctgtaatctctgcactctggatgtagatgcaggaagatgaaaagttcaaggtcacactcacctacgttgagagttataggtatcccgggattcacgagactctatctcaaacaaacaaacaagcaagcaacatcatcaacagcaaaaaccaagaaaagcaggaagtcatatttatttggtcttgtgattttagaggttttagtccacagtcatcccttggcttcattgtgtctggacctgtggtcaggaatggtatcatgatagtgtattgtagagctgagctgctcactgccttgcgatcaagaagcagtaaaatgcaataccagaaaaaacaataccccctttcaagacatggacccaattaactacttcctccaattgcaccccactttgtaagttctaccactcaagaactcactaatattttaagtcaaacttgaattaatacatttctaaagtcaggatcattgtaattgaataacttcctaaaggatctagagaataaaccttcaatatttggtcttttggtagatatttcagatccaagccttatcagctaattaactgccatcttactctaaaagctacagtagcctttataagaatatgagaacccaaggttgcagggtgtatgttagaaattggctattcttctagagaacatcaagtaatgtctcaataaagttagagccatttctgatgttttctctccttaggattccctggagctcctggtttacatggactgaatggacttccaggcaccaagggcacccatggcactccaggtaagaaaggccctgaaggtcaaggtcaaggttaagggcataaagctcttccagaactgggaggagttggccatgtgttcttgactgtagtacaccccatatcctgggagttagatctcctcacttgtcttcagttggagaaggaaagaggatgtttcacctttctgtaggaatgagctcttcttctagaccacagggaagtcaactaggcctaaggactgtctccctctgagctctgtctcctccctctgcatttcttcctaggagccagtatcactggtgttcctgggccggctggcctgcctggtcccaaaggggaaaggggagtgccaggaattgtcatcggagatccagggaaacaaggttcaaagggacaaaaaggtgaccaaggtaagtaagcccaaatcaggacttgcagaaactgattgaggccttggcagtggatcagagtttgggattgttttggagccaaatggttcgtagggtagacttgtgcttatctaagaacccttaacaatgactgtgaagaaaatgatgatgaatagtcctaccaagtgccctcctagccttcagttagttccccctggctctttccaattcagctctggaccactttttcagacttgggcaaagccaagatgaatgcttctaaggagcagagttattccatttagtaagatcttaggtccaatttccttcgtgatccatgaggatgctagactccacctggcagaagaaacccaagaccgagagaacatggatctcctgaggccaagcctacaggctacactcaaccaggataggttgtgttttcattaaccaaagtccaccctgacctcagcttcccacactgcttgaagttttcctgggtgtcccattctagaactctctaaaatcatgaaaccattcttcagcttccttggcagtgttctggagactcacctgtctcccactatatataaagcaaaacatgactgcagtcagtcaggactaaagcatattccagttctccctctcattgagctgtatgtccccaagcaatgaacttacacacctgtctctcaatgccaattggacttaggttttttttttctttctgtaaaatggatataacagaactgtctcacagatatttctgaggactctgtgaatagtaaggtaatatgagtttgctgagcatatctcagtgcccagcagatgccccagaaacactgggcaccatgctattacatgccagttgggaagtagtaactgcagtatatttggagcctgaggtctcatcgtgtgtgtgtcccaggaaccagggtcatacattcattcatttcctgctgcaatttgatttgaggcatctgttgtttctgtgtttaatccttcctttggtctgggcaaacgtgttcttttggggaatctagagaaggctcaaaggacggtctgagcctgcaaagcaactgtggcttctttcccaggacacagagaagagggaaccagatggaagcatatggcatttctccttctgtttgtaaatcttgactgtgaatttctggttatcaaattattcacttactttagctgacataaaattataattacaattatagtaaacagcacacatcaagatggatatattatagaaacataattatgaggggcagcaagtcacaagggaatactcttggtgtggttctctcattagatgttcaaaataagcaaaacaaccaacatactgtctagggatgccaatattcatgaagaaattatgacaagaaggaaagaagtgaacatagaatttggaaatggttctctgagaggagggagtggaatctatggagactacacacataattaccaagataatgccatcttcgtttttctttagtgggacaatgaagtacagatgtgttcatcatacttagattattctttactgaagcaatttgtttaaaaaagaatacagcatgtattgtgcccaccagaggaaacgatctgtgatttggtagtggaagtaaaacagactgagcctgagaacactccgttccctgtgctcacaatacctttcactaaatgatttgcaattatattgttgttttcatacttgcattaaatctttagagcctacatttatgtatttaaagtttctcagggtttggcattggaaggagctagcaaaatggttatttgtcatttgcagctccttatttagaacattttagttttaataaaaaaaaaaaacatacaagcaaggactcacaatatggctcagtggataaagatacctaaattataagcctgacaacctgagttccacttctggaaccaaagtaaagggtgatggagagacccaactccacagagtgactatctggactccactcatgcactgtggcatacacacacacacacacacacacaatagtgataagtttttaaagacatgagcttttggcactattttagtttagtatatttatttataaagtcaagaatcagataaagagcatgtgtgtcttttaaaaattgacatggaggactctatgattctgtgagcagctccattatatggtgttatatggtatttcgcttgttggttttgcataattctaggtgatataaatacatacatcttctatatgcacatatacacatataagcctctgtttcaggggggaaagcgtgcaaaacatatctttctttcagttccttacctcaatgaaaaagaaaagtacttcagaaactcgtcacgacacagcggacaacacatgtagcttttttgtgtgtgtttgtttttccctaaagttaacaagagtgttttctcaaaatcaacgttttcatctctagtttcccttgtgattcaaaatatcaatgaactacttttaaacacctgctttggctaatctaccatcttttgacacatttacaaggttgtcccagcttttaaaagatcgatataacaaggaaaattgggtaacaatatttttggatttttcctctcacacacaaaaaggaatctcaaccaatgggtttttatcaggcagattccactgaactttcttttttctttttttaaatatttttattaggtattttcctcatttacatttccaatgctatcccaaaagccactgaactttcttattggactctccatcagaatatgccagttaacacatttgttccatacttagcatacagcaggaactttcacctgtgtatagatagttttgatgtttccccttcttatcatacatgtttttagcatacattaaataaatatctcgtcgtttggtgtaagtttttgtttttataacatatagtagaattggttccactaacgaaaaacatgtaaagtaatatggaaacctaagcaaggaacataactatatactttggccaaagggtgacaggtatctagtataatgagatatgttcaacaggcgactaagcagtaattccactaagtcacctacaaaagactggttgttgttgttgttgtcgctgctgttgtttgcctagatgtgccagaagagagcagggaatcttagggcacacatgagcatccataatctttttgctgtctccgttctggatgatctggtctcagtcatacataactttggagcagcatcagccagaactggcagttaggaaagtttgatgaaccagtgtgtatactaacaacactttgaaaacttaaattccagctgctcagccaagctttctttctgatctggaggaaaaacagcctaaaagatttccatccccggtgaaattggggagctagaaatttccacagctccgtctcaggaaaatgaagctccagctggaaacgaagaagctgagcctggtttactgttgtcagcttgctggaagttcggatgaatggaagacagccctctactggtgtcttctggtcttgcagctatttcatggcttccatttttctgaatgcacttggccatttccaggacgtgggaagcccaccgagccccattttatttattctttgcaggttccccaggtcttcaaggtcctgctggtacccctggagccccaggcatctccttgccctcagtcatagcaggacagcctggtgaccctgggcggccaggcctagatggagaacgaggtaaaaataagaaaccccaaacacatctggccaccttactttaatgtgggcagacatgctgtatataacgcagctctttccctattgctggaaatacatggatctgcttggcctcaatgtattccctctcatcaagatttgagagactggaactgactgtatttttgctgaagtgttttgcaaagtctggacatgtgcgcttcagggacctgtactaggagtgggctttggctacctgactccctaggccttcagcagcttcctatctctttgcacttccttacttctcccatcttatccctaggccgcccaggccctccaggtcctccaggtccccctgggccatcctcagatcaaggcgatcctggagactctggcttccctgggattccaggccttcaagggttcaagggaaaccaaggacttccaggtttctctggcctctctggagagctagggctaaagggtaagtctgttccaccagcttcaagacccatcagtcaccactgcacagtccagtcgccctgaagaggctctcgatggtgctttttctgactggtccccctctgtcaccatcatgccaacacctcacatgttttcctttggcccttaccaggcatgagaggggaacctggcctcatggggactcctggcaagatcgggcaaccaggagacccaggatttcctgggatgaaggggaaggcggggccaagaggtgagtgcagggccaagcctgagcctcagagggaaggggtacagcatgaagttgaggtttttcggaagccatgttgtctaccacaccacaaaaccaagtagggtatcatgctcccaagcccaggaggtagtttccctcctttggagataccaccatgccaatctactgccagaactgaaggtccctaccattggtacctgacctccctctgtattacttctgcattgcacctagaccactaagctcactttctaagttcaaaaaagaaacaaaattctttctatcctcgagccaaatgtcaactattcagtctatcagccaccccagagggctccttctcctagcatgccttgtatctgctcactttctatcagttctgctgctcccttgaggtctaagccatcagcagttctcatgtagcacccttcctcccccaacaacaattatttgtcccatatagtcgccggtaaaaagcaaaccattctattcatggcatagacaggaaccatggcccacaaaatcctgtgtgacccctccctctttatctcatgccagctcatgtcccttttactgtccattgacatctgaaatattgtcccaattatcctttctgccctcctccccttcctactagttccctttcccctaattagcccctcctctgtttttatgtcagatatgatgttctccaattgtatccatttgcttgtacatggcgtgcttcacttttcatcctgactgaagaaagttccttcatgtatatgtgtcctatttcctttgtccattcatctgttaatggacatttaggttgttcccaaaccttggttattgtgaatactacagggataaacataaatgtgtatgctggcttggagtcctactgggaatggtacagctggatcatatggaaattctagttttagagttttctaaggagtcctaatattgatgcctgcactagtttaccttcctgtcagtactgtatatgttttctgatgcttgcttgcccttcaatctttaaatgtctagctccccctgatacgtctgatgtttgaatagtttcagtgtaactgtcattggttataagaagccactggtagctctgaagcagacccctttacccaaaccactccctgctccctctcattgtcactacagcacttatttcctccccagtccttcttataagatttgaacaatggggttaacggtatttgccaaatggtgctttgttcatcttcatcactaggccttaggctctataaaggtctatcactgctcttgtttctcatctcccagaatcttggcagatagtaaggacccaagaattactttattaatgaattagtgaacaagctattctatttgtaaagtggctgacttgggtgggtctcttagactgggatgccaactgcacctctgaagttgaatacatcgatcgctacagtatctttggtagtgcattctgaccagtgtgtaagttataactgcttcatccctgacccaaagctcagcttgctagagttgcagtagagatttcctaactgctttccacctagtgaattctatactgggatatggggagccacaataagtatgacttgctccctgccttgcctacaggcactaagaagaagatgggaaaggaggttctatcaagggttgtgtattctatactggaggcctcaagtggggattgtgagcacaaaaagaaagaaaatagttggcgactgccaggcagagagaaggctgcctttgttactcctccagcctgacaggtgctgtttcactacctgtcttcaggcttttccggcccacagggagctccaggacacacaccaattgctgaagctatgcaggttcctccaggacctttgggtctgccaggcattgatggtatcccaggcctcataggagaccctgggtctcaaggctctgtgggtctgcaaggtaagaatggcaccagagaacaggtactcactgggaagctgaaaggccttggttgagagactgaagctactggcttgacacaggtctgagaaagtgccttcatcaaacatttcccaagctacttcccgaagctcccaaactctttgccagggaaggaaaaagctagaaagccagtggggcagtggttatacttgtcttcagagaacatgtgaatctctcccctagacagcttgccatttctaaagagtgtttggagctagagaagacgtgagtgacaaaggagaacacagggtagtggagaaagcaaaagactctggacaggaaatgtggtttccaagtcttagctttgccccaataggagtaagttgttattctccctgtgacttcacatgagacttccatattgagtgctcctctgccttgtgcattttctctcttacaggttccaaaggcctacctggcatccctggtaaggatggccccagtgggcttccaggcccatctggaatccttggtgatcctggtctccctggactacaaggacctccaggatttgaaggtcaggttaacaaaacttggacacttagtcaaccatgtggtaaatttgccactatgaggtcgctcacaggctgagttcttgtctctctttatgttctattactatgaagagacaccatgaccaaggcaactcttatgaaagaaagcataccaggattggagtattgctgtgacaggcatgatcatgcctttgttgaaggaatatagaagactttgggactttggactagaaaagtgattggatacattaagtagggtgtaatgagccataataacaggaacagggaagatagtattaagggcaatttgaactttaggggcctggctgaagaagttccagggggaaataatattagtaagtaggctagataccattcttgtgatatttggcaaagactgtggctgctttttgcccttcccataaaaatctgcctgaaactaaactgaagagttttggattaatgaggttcgcagaggaaatttcaagatagcctagtactgactgtgctgtgtgggtttgatagcgcttatacagatccacaatgaaaaggagcaggggaagcaaggggaaaaaaacaaaatttacagtttgacgagaaaaggagtaccagtaaatgttttgttggagccaattctagtgctcaagaagataaaaaaaaaatttttttaatcctgctgctaaatgaaataaaagaagtaacatcagggcaagaccccacttctggcacaatcttatgtctttctcactgttctattcctgtgaagagacaccatgacaaaggcaactctgaataaaagaaattatttaattgggggctttcttgtagttacagaggtttagtccattatcatcctgaatggaacatggcagtagacaggtaggcactggagcagtagctgagagagatacttcctgatccataggaagacagatatacagacacacatacacacatacacacatacacacaaacacacacacacacacacacacacacacacagagagagagagagagagagagagaccctaagttgggcgtgagcttttgaaacctccaagcctatccccagtgacacttcctccaacaaggccatacttcctaatccttctcaaatagtgacattcctggtgactaagtgtcttagttagggttttcctgctgtgaacagacaccatgaccacggcaactcctgtaaggacaacatttaattgggactggcttacaggttcagaggttcactccaacattgtctaggcaagagcatggaggcatccaggcaggcatggtgcaggaggagccgagagtactacatcatcatctgaaggctcctagcataatactggtttccaggcagctaggatgagggtcttaaagctcatacccaacagggccacaccttctaatagcaccacaccctgagccgagcacatacaaaccatcatattaagcatttagctatatgagcttatcacagtctttcttattcaaaccatcacattgttcttctcttcacactgcacaggctccagcctatgatgagaagtccttcatacttcagtaaggcaacagacttctcctccttgtctgggctctcctccagctatctatctatctatctatctatctatctatctatctatctatctatctacctacctacctacctatctatctatctatctatctatctatctatctatctatctacctacctacctacctatctatctatcccagtatcttgctgcaagcccagtttgccctcaaagtcactatgtaagccaagttggcttcaaactcttgatcttctgcctttgcttcccatggctttctgtcctgtcctgacatggatgaaagaatacaacaaattacttgtccttggtatagaatccttctaaagctcagtagtaaaatattgaagtacagtggtcatatccaccatggacaagagaggcagatgcaactttgcccttctaatgctaacgttacttataatgcttctgattcagcagctagttatgtcctgtgagagacgccaagggtggggatgagaaggattccactccatttactcttagaaccgaaggccgggaggctgaagaaggggaatggatagtgtactcttttaaaatgggaaatatttagctgggcacacacatgacttggagttgtaactccattagcttctagctgtggcagctcagaacctcattttcctcaactgtagaacagggggtatcaggatcaagtgtttgaacacacgcatatgatgcgccttacaaatgtttaggatcaatgagtgggtagtgttattaccatctgcagcatgctgacttttatgtccttttcttctcaggagctccgggaaatcagggccccattgggcagcctgggatgcctgggcacggtgtgagagtgggctacacactagtaaaacacagtcagtcagaacaggtgccactatgccccactgggatgagccggctctgggtgggttacagcttgctcttcgtggaggggcaggagaaagcccataaccaggatctgggtaagtacagctagtccttgctccctgaccctacaaggattgagaactgaccacttttcttctcacagccctttcgactcatggttatgaaataggccacagctctggggtcaaaaggattttgattcaaatgctggtcctactgcttcaaagccacaggccctgggtaaattattcaacctctccaagctttcatcctccctcaatgggactaagctatttctactatctgtcacatagagtgctgtaaggaattcatgaatcacccaatgtacaatatatttaagcctccattaagtattagtgattagtaataacaatagtaacatgacctacagggcattgatgattgcccaaggattaattgcattagcagcaggtgtgctacctcttagatgtgaattctgtctactaaatgtaggttttacaaagcagattaattagggagtaattattcactttatcaaaagattctcatcattattcaactcccctggtaactttatgatacaatttgatcctcagactccagcacctaccaaagtcataggactgtaagagcgctgtactctccgagcaagcatttagaaggaaattcacatctttggctactccaggccttgtgcctctgccctttagccagcacttagctgattcttgtccatcttctcttcccaggatttgctggctcctgcctgccccgattcagcaccatgcccttcatatactgcaacatcaatgaagtgtgccactatgccagacgcaatgataaatcttactggctctccactactgcccccattcccatgatgcctgtgggccagacccagattccccagtatatcagccgctgctctgtatgtgaggcaccctcacaagccattgctgtacacagtcaggacatcattgtcccacagtgccctctgggctggcacagcctctggatcggatactccttcctcatggtgaggccttgaaccattctgtccctcaatggagaaacagagatatatagggtaggggtgaagagctcaggaaaggacccttcctttgatcccaggctcaaggggacaaaggatagaaaatagtttaacaggaagagagatgaagatgggaattacaattttgtggtttgcagggtagaaggtggggttagatagcaatttgaacctggtgttctggactgagaacctgtatgtgtcacaagtcaaggccctactctatgtgtccttcagttttctcactacgaagggaacactagaactgtaatctgaacagatactgagagaaatactgtcctcaacagaggccaacacgtaattgtactgatcaggctgagaagaatatttaccaccttgcagtctgccctcccagatctgtctagcttctactatctctttttgatatctcctcttaaagattggcaaggaggcatgctgcgtttgtatggccttcattgcttctccagtttttgtggtgtgaaggcatgctgtgtatctagctaggaaagagaacatcagtagtaccgaggagatggtcccataactatctggggaggttttttcaaatgaaatcaggagtaagactaaggcaactcccaggaaaactacagtgtaaagctcactgaagtcccctggttgggcagagcttctcactgaatcaccaaagactctggtacaacagctcccacccaaaactgacatgttttcgtaagccagagccatcagcaaagtatcactctctgaaagttaagcaaactgacagcctgctagccacttgctgatgcagattgcataaagcctcctcttggcctcctgtgcttccagctaatctgaagggagatggctggagtatagacaggaggtctggaggtctagtgactagagactgccagaacaactgtggcctagaaactgaactccaagtaagccctctgaagtgaggcctgagacattttaggtcctttgtcaggtaacaaatattgtgtgtcactctagagggtatggcacaggttgaaaatagaaatagttctagtagaggcagtcttaaggatgagaactataggggacatgctgttacaagaaagagcattggggactactatatgcttttccttcttagaagacagtgcccagcaatgggcttaaagctttgttaattccacaacctaaatccaacattgttccggtgtatatgtctgaggaccaagaagatggacccctaggaaaaggcatttaccatacacacacacacacacacacacacacacacacacacacacacacacacacctgtggaaatggggagctgaaggtaaacctcacacagctgtgaagtccgagggaaacattggttggaatgggatcactgatcacggaggtcccaaaggagctgcttagagaggatggccagtacttgcctccgaagcccaggttcatcaggcaggctagaaactgagtgatctggaggggtccagagttctagaatggtgcacatatgaagtcctgtagaaacaggccatggagcatctctgtgttgacttctggcagagctcacacagacccctcccttctgtttcagcacactgctgctggggctgagggtggaggccagtccctagtctcccctggctcgtgtcttgaggacttccgggccactcctttcattgagtgcagcggcgcccgtggtacatgccactactttgccaacaagtacagtttctggctgacaacggtggaggagagagggcagtttcgggaagagcccgtgtctgagacgctgaaaactgggcagcttcacaccagggtgagccgctgccaggtgtgtatgaaaaccccgtagggtactgcccgtcatccagcccacctcacaacactcacctcaacagtctgagaaaggaaggcctgagcccatctgcctgtcaagttgtacatcaatgcctcgtttggactggactactggacaatggtcatcccaaccctcagacccaacagatgagcccactgtgctaggatttgctttcctgtttccatccatctggtgctaacattccatttagatatgtgtgtgattactcatggctaccttaggaaggtgtgctaagctgtcacttgcgaagatggctagagctctcttcactgccttaagctggaagttctttataacagcgaagttatgtctttatgacaagacgtcaccacacatcatttgagtcaaactaaagctcaggatttccaccctaaaaatacgtttctggctgaatatgatagataattcaagtctgcctagggctagccctccctactgaaggcagcctattatatttagacaggcagtagtgttggaatgagaaaccagcctatagccagaactgagctgtgattccttgcagagttttgttaagcccatgccccatcttgagtaggaaaggctgaaaggccagtatttggtcctagacaaatcactgtcccctggtcccacatctagagatataagacaagttggcccagtccaaagtggaaccaagaattcgataagtgtgatcaagcttgtcacagaaagacatgagaatcacttctccttcttcttggcctagggcagaaggagaaatacatatagaggtagcagttttgcttctgagtccaggaaccaaaaggtaaagctcatgtccccattcctcagaagtccctagttattccaaatgccacccagatttatgcagggtgacaaactgaagctgcagtgtgttggctccttgcatgctgaggctcttagaggtgttctgataaaatggccatccaaacaccctcccacgggtagccttttaaactatttgacagggttttttttttttaatttcataaaaatctagcacacaccaatgttagcagacccgaggtacattctgagctggccatgaagtatactgccttctgtttgaagcagttcattttaattaccagttgcggagaacacaatcagttccactgacatgaagcgctcccttgcaggtgattggcttccttgagtactatgtaaaccgtgcccacgcaggcaaagcataacaagtacattctgagctcttgttatcacctcctagataagtaacaaatggtgtcagctttgtacatagcaaataaaattaatgaaatacgaa

SEQ ID NO: 308 - DNA, 273 bp, mus musculus
atgcccaaaagaaaggctgaaggggatgctaaaggaaacaaaactaaggtgaaggacgagccacagagaagatctgcaaggttgtctactaaacctgctcctccaaagccagagcccaaacctaaaaaggcccccgggaagaagggagagaaggtacccaaggggaagaaggggaaagctgatgcccggaaggatgcaaataatcctgcagaaaatggagatgccaaaacaaaccaggcacagaaagctgaaggtgctggagatgccaagtga

SEQ ID NO: 309 - DNA, 966 bp, mus musculus
atgtctaagtagtccaagtctctcaaggagccagaacagctgcggaagctcttcatcggagggctgagcttcgaaacaaccgacgagagtctgaggagccattttgagcaatggggaacactaaccaactgtgtggtaatgagagatccaaacaccaagagatccaggggctttgggtttgtcacatatgccactgtggaagaagtggatgctgccatgaatgcaagaccacacaaggtggatggaagagttgtggaacctaagagaactgtctcaagagaagattctcagcgaccaggtgcccacttaactgtgaaaaagatctttgttggtggtattaaagaagacactgaagaacatcacctacgagattattttgagcagtatgggaagattgaagtgatagaaattatgactgacagaggcagtgggaaaaagaggggctttgcttttgttacctttgatgaccatgactctgtggataagattgttattcagaaataccatactgtgaatggccacaactgtgaagtaagaaaggctctgtcaaagcaagagatggctagtgcttcatccagccagagaggtcgcagtggttctggaaactttggtggtggtcgtggaggcagttttggtggcaatgacaatttttgtcgaggagggaacttcagtggtcgtggtggctttggtggcagccgtggtggtggtggatatggtggcagtggggatggctataatggatttggcaatgatggaagcaattttggaggtggtggaagctacaatgattttggcaattacaacaatcagtcttccaattttgggccgatgaagcgagaaaactttggaggcaggagctctggcccttatggtggtggaggccagtactttgctaaaccacggaaccaaggtggctatggcagttccagcagcagcagtagctatggcagtggcaggaggttctag

SEQ ID NO: 310 - DNA, 966 bp, mus musculus; identical to SEQ ID NO: 309

SEQ ID NO: 311 - DNA, 411 bp, mus musculus
ggacaagatgggtcctccagagcgaaattccggatttccctgggtcttccggtcagagctgtgatcaactgtgcggacaacacaggaaccaaaaacttgcatatcatctctgtgaagggaatcaaggtacggctgaacagacttcctgctgctggtgtgggggacatggtgatggccacagttaagaaaggcaaaccagaactaaggaaaaaggtccatccagcagcggtaagtcgacaacaaaagtcatatggaagaaaagacggggtgtttctttattttgaagataacgcagggggcatagtaaacaataaaggagagatgaaaggttctgctatcgcaggtccagtggcaaaggagtgtgcagatttgtggtccaagattgcatccaacgcaggaagcattgcatga

SEQ ID NO: 312 - DNA, 411 bp, mus musculus; identical to SEQ ID NO: 311

SEQ ID NO: 313 - DNA, 2913 bp, mus musculus
actctggagtctcattcacaagagttagggagaaagaaaggatgttcaccgacatattctaacgatgtggccttttagttggttccagatgtacagactgtgatcttaccttcaaaggctgtgtgtgatgagtggtgtgaatgagaattgatgaaaagaagccgtgtctgcagagaccgcttgactgattagaattccagtactgtggagagatgcgaatgttacagatctaaaggccgattaccttattttggatgagttctcgccctccagatcagccatttcttgcccaacctctgtgttggaactattatcttgtgtctaataaatacaaaccttttggagtctattaacagaccagtggcttccactaattcaaaagcaaagaacataatcggcctatagaacagcttctcccacttcatgtaccagcctctctgatgtgtgaaccaatgtatttaaaacttatcttgatttatgactccctttgttctgtaaaactataaaaaatcatgaaacttctttcacactggaacatagaatttgacataacgtaaatctgtgtttctgagccatagtcactccaaatggctacataataaactgggaactaaaatgaggaatagctcccatcagattcctctgttagcattttaaaattttctttctttctttctttgtctttttatttttatgttttattaagaccaggtttggtctggggaaggcagccgcttgacacggccggccggctgcccgcccgcccgctcgcccgccgcccgccctcccctcgggaggagccgggtggagccccgcggcgggtggccggcaggagctgcagcagctaggagttgcctgggtccttgctggagtgtactggatgtttgagacagaggcagatgagaaggagatgcccctggtcgaggggaaggggccaggtgctgaggaacccgcacccagcaaaaatccctctcctggccaggagcttcctccaggacaagacctccctcccagcaaagacccctctcccagccaggagcttcctgcaggacaagatctccctcccagcaaagacccctctcccagccaggagcttcctgtaggacaagacctcccacccaggaaggactcctcaggccaagaagctgctcctggcccagaatcaccatccagtgaagacatagcaacctgccctaagccccctcaaagcccagaaacctcaacaagcaaggactccccaccaggccagggatcctccccgaccacagaactcccatcttgccagggccttcctgctggtcaagaatctactagccaggaccctctgctcagtcaagagccccctgttatcccagaatcctctgcctccgtccagaaacgcctaccctctcaggagtcaccctccagcctgggctccctgccagagaaggaccttgctgagcagaccatcagctccggggagccaccagtcgccactggtgctgtactgccagcctctagacctaactttgtgatccccgaggtgcgtctggataatgcctacagccaactggatggggcccacggaggcagctctggcgaggacgaggatgcagaagagggagaggaggggggagaaggggaggaagatgaggaggacgacaccagcgacgacaactacggggatcgtagcgaggccaagcgcagcagcctgattgagactggccaaggcgccgagggcggcttctcgttgcgtgtgcagaactcgctgcggcgccggacgcacagcgagggcagcctgctgcaggagtcccgggggccctgctttgcctctgacaccaccttacactgctctgatggcgagggcgccacatccacctgggctatcccttcaccccgcaccctcaaaaaagaactgggtcgtaatggaggctccatgcaccacctttccctgttcttcacgggacacaggaagatgagtgggactgacctcacagaatgtgatgaagcttcccggaagagaaagagcaaaaacatagccaaggacatgaagaataagctggccatcttcaggcggcggaacgaatctcccggggctcagctagccagcaagacagacaagacaaccaagtccttcaagcctacctcggaggaagccctcaagtggagcgagtccctggaaaagttgctgcttcataaatatggcttagaagtgttccaggccttccttcgcaccgagttcagtgaggagaacctggagttttggctcgcttgcgaggacttcaagaaggtcaaatcacagtccaagatggcagccaaagccaagaagatctttgctaaattcatcgcaatccaggcttgcaaagaggtaaacctggactcctacacacgagaacacaccaaggagaatctgcagagcatcacccgaggctgctttgacttggcacagaaacgtatctttgggctcatggagaaggactcttaccctcgcttcctccgctctgacctctacctggacctcattaaccagaagaagatgagtcccccgctctagggaccaccagtatccagctcagcgttcgcaccaagcggagcgggctccctgcccacccgcctcccttccctgtgacggagggggcaagtaagcccccagaggctgtgtctccagaccagcagatggacatttgaaatggaggcctggactgagagagacccaggccactacaggaagtaggaggaccagccgcatcaggtccttaacgccctggtacgaggggaccaagggccctagcaggtcagggccctggaggagtcagatcaggagctgtggctccctgctttggcgatatggagacttcccgctgaccaagttcctttgagaactggctgaggtggggacaggagacccagatctgggctctgggtccatcaggg

SEQ ID NO: 314 - DNA, 2533 bp, mus musculus
actctggagtctcattcacaagagttagggagaaagaaaggatgttcaccgacatattctaacgatgtggccttttagttggttccagatgtacagactgtgatcttaccttcaaaggctgtgtgtgatgagtggtgtgaatgagaattgatgaaaagaagccgtgtctgcagagaccgcttgactgattagaattccagtactgtggagagatgcgaatgttacagatctaaaggccgattaccttattttggatgagttctcgccctccagatcagccatttcttgcccaacctctgtgttggaactattatcttgtgtctaataaatacaaaccttttggagtctattaacagaccagtggcttccactaattcaaaagcaaagaacataatcggcctatagaacagcttctcccacttcatgtaccagcctctctgatgtgtgaaccaatgtatttaaaacttatcttgatttatgactccctttgttctgtaaaactataaaaaatcatgaaacttctttcacactggaacatagaatttgacataacgtaaatctgtgtttctgagccatagtcactccaaatggctacataataaactgggaactaaaatgaggaatagctcccatcagattcctctgttagcattttaaaattttctttctttctttctttgtctttttatttttatgttttattaagaccaggtttggtctggggaaggcagccgcttgacacggccggccggctgcccgcccgcccgctcgcccgccgcccgccctcccctcgggaggagccgggtggagccccgcggcgggtggccggcaggagctgcagcagctaggagttgcctgggtccttgctggagtgtactggatgtttgagacagaggcagatgagaaggagatgcccctggtcgaggggaaggggccaggtgctgaggaacccgcacccagcaaaaatccctctcctggccaggagcttcctccaggacaagacctccctcccagcaaagacccctctcccagccaggagcttcctgcaggacaagatctccctcccagcaaagacccctctcccagccaggagcttcctgtaggacaagacctcccacccaggaaggactcctcaggccaagaagctgctcctggcccagaatcaccatccagtgaagacatagcaacctgccctaagccccctcaaagcccagaaacctcaacaagcaaggactccccaccaggccagggatcctccccgaccacagaactcccatcttgccagggccttcctgctggtcaagaatctactagccaggaccctctgctcagtcaagagccccctgttatcccagaatcctctgcctccgtccagaaacgcctaccctctcaggagtcaccctccagcctgggctccctgccagagaaggaccttgctgagcagaccatcagctccggggagccaccagtcgccactggtgctgtactgccagcctctagacctaactttgtgatccccgaggtgcgtctggataatgcctacagccaactggatggggcccacggaggcagctctggcgaggacgaggatgcagaagagggagaggaggggggagaaggggaggaagatgaggaggacgacaccagcgacgacaactacggggatcgtagcgaggccaagcgcagcagcctgattgagactggccaaggcgccgagggcggcttctcgttgcgtgtgcagaactcgctgcggcgccggacgcacagcgagggcagcctgctgcaggagtcccgggggccctgctttgcctctgacaccaccttacactgctctgatggcgagggcgccacatccacctgggctatcccttcaccccgcaccctcaaaaaagaactgggtcgtaatggaggctccatgcaccacctttccctgttcttcacgggacacaggaagatgagtgggactgacctcacagaatgtgatgaagcttcccggaagagaaagagcaaaaacatagccaaggacatgaagaataagctggccatcttcaggcggcggaacgaatctcccggggctcagctagccagcaagacagacaagacaaccaagtccttcaagcctacctcggaggaagccctcaagtggagcgagtccctggaaaagttgctgcttcataaatatggcttagaagtgttccaggccttccttcgcaccgagttcagtgaggagaacctggagttttggctcgcttgcgaggacttcaagaaggtcaaatcacagtccaagatggcagccaaagccaagaagatctttgctaaattcatcgcaatccaggcttgcaaagaggtaaacctggactcctacacacgagaacacaccaaggagaatctgcagagcatcacccgaggctgctttgacttggcacagaaacgtatctttgggctcatggagaaggactcttaccctcgcttcctccgctctgacctctacctggacctcattaaccagaagaagatgagtcccccgctctag

SEQ ID NO: 315 - DNA, 66 bp, mus musculus
caaattgaatgcacgtggcaacgtagggctacttgggcagcagaatggagctagacactttaagcc
